(12) United States Patent
Gifford et al.

(10) Patent No.: US 12,290,554 B2
(45) Date of Patent: *May 6, 2025

(54) COMPOSITIONS FOR OPTIMIZED BCR-ABL PEPTIDE VACCINES

(71) Applicant: Think Therapeutics, Inc., Newton, MA (US)

(72) Inventors: David Kenneth Gifford, Newton, MA (US); Brandon Carter, Cambridge, MA (US)

(73) Assignee: Think Therapeutics, Inc., Newton, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/934,067

(22) Filed: Sep. 21, 2022

(65) Prior Publication Data

US 2023/0099121 A1  Mar. 30, 2023

Related U.S. Application Data

(60) Provisional application No. 63/249,235, filed on Sep. 28, 2021.

(51) Int. Cl.
*A61K 38/00* (2006.01)
*A61K 39/00* (2006.01)
*C12N 15/85* (2006.01)

(52) U.S. Cl.
CPC ...... *A61K 39/001197* (2018.08); *A61K 39/00* (2013.01); *C12N 15/85* (2013.01); *C12N 2510/00* (2013.01)

(58) Field of Classification Search
None
See application file for complete search history.

(56) References Cited

U.S. PATENT DOCUMENTS

| | | | |
|---|---|---|---|
| 5,443,956 A | 8/1995 | Carney | |
| 5,961,978 A | 10/1999 | Gaudernack et al. | |
| 6,602,510 B1 | 8/2003 | Fikes et al. | |
| 7,488,718 B2 | 2/2009 | Scheinberg et al. | |
| 7,756,644 B2 | 7/2010 | Fridman et al. | |
| 7,973,128 B2 | 7/2011 | Kosmatopoulos et al. | |
| 8,007,810 B2 | 8/2011 | Fikes et al. | |
| 8,465,747 B2 | 6/2013 | Kosmatopoulos et al. | |
| 8,653,237 B2 | 2/2014 | Liu et al. | |
| 8,741,576 B2 | 6/2014 | Tangri et al. | |
| 8,765,687 B2 | 7/2014 | Scheinberg et al. | |
| 8,900,600 B2 | 12/2014 | Kosmatopoulos et al. | |
| 9,340,577 B2 | 5/2016 | Grey et al. | |
| 9,913,884 B2 | 3/2018 | Fikes et al. | |
| 10,024,868 B2 | 7/2018 | Kosmatopoulos et al. | |
| 10,238,741 B2 | 3/2019 | Creusot | |
| 10,335,473 B2 | 7/2019 | Eriksen | |
| 10,456,457 B2 | 10/2019 | Eriksen | |
| 10,556,943 B2 | 2/2020 | Knutson et al. | |
| 10,596,239 B2 | 3/2020 | Eriksen | |
| 10,738,355 B2 | 8/2020 | Sahin et al. | |
| 10,835,585 B2 | 11/2020 | Fritsch et al. | |
| 11,058,751 B1 | 7/2021 | Gifford et al. | |
| 11,161,892 B1 | 11/2021 | Gifford et al. | |
| 11,222,711 B2 | 1/2022 | Sahin et al. | |
| 11,235,039 B1 | 2/2022 | Gifford et al. | |
| 11,464,842 B1 | 10/2022 | Gifford et al. | |
| 11,466,053 B2 | 10/2022 | Tang et al. | |
| 11,672,850 B2 | 6/2023 | Gifford et al. | |
| 2002/0155093 A1 | 10/2002 | Houghton et al. | |
| 2002/0164346 A1 | 11/2002 | Nicolette | |
| 2003/0220239 A1 | 11/2003 | Simard et al. | |
| 2003/0224036 A1 | 12/2003 | Fikes et al. | |
| 2004/0037843 A1 | 2/2004 | Fikes et al. | |
| 2004/0072240 A1 | 4/2004 | Kosmatopoulos et al. | |
| 2006/0018915 A1 | 1/2006 | Ishioka et al. | |
| 2006/0093617 A1 | 5/2006 | Buyse et al. | |
| 2007/0054262 A1 | 3/2007 | Baker et al. | |

(Continued)

FOREIGN PATENT DOCUMENTS

WO WO-97/33602 A1 9/1997
WO WO-99/63945 A2 12/1999

(Continued)

OTHER PUBLICATIONS

Betts et al., "Amino Acid Properties and Consequences of Substitutions," Chapter 14 in Bioinformatics for Geneticists, Wiley & Sons, Ltd., Apr. 18, 2003, pp. 289-316.
Carter et al., "A pan-variant mRNA-LNP T cell vaccine protects HLA transgenic mice from mortality after infection with SARS-CoV-2 Beta," bioRxiv preprint, posted Sep. 26, 2022. 38 pages. (https://www.biorxiv.org/content/10.1101/2022.09.23.509206v1).
Carter et al., "A pan-variant mRNA-LNP T cell vaccine protects HLA transgenic mice from mortality after infection with SARS-CoV-2 Beta," Frontiers in Immunology, Mar. 9, 2023, vol. 14:1135815, pp. 1-9.

(Continued)

*Primary Examiner* — Aradhana Sasan
*Assistant Examiner* — Mercy H Sabila
(74) *Attorney, Agent, or Firm* — Wilmer Cutler Pickering Hale and Dorr LLP

(57) ABSTRACT

The present disclosure provides for methods, systems, and compositions of nucleic acid and peptide sequences. The present disclosure provides for a nucleic acid sequence encoding two or more amino acid sequences selected from the group consisting of SEQ ID NOs: 1 to 44. The present disclosure also provides for an immunogenic peptide composition comprising two or more peptides selected from the group consisting of SEQ ID NOs: 1 to 44. The present disclosure further provides for a nucleic acid sequence encoding one or more amino acid sequences selected from the group consisting of SEQ ID NOs: 46 to 112. The present disclosure additionally provides for an immunogenic peptide composition comprising one or more peptides selected from the group consisting of SEQ ID NOs: 46 to 112.

16 Claims, 10 Drawing Sheets

Specification includes a Sequence Listing.

(56) References Cited

U.S. PATENT DOCUMENTS

| | | | |
|---|---|---|---|
| 2007/0098776 | A1 | 5/2007 | Fikes et al. |
| 2007/0224201 | A1 | 9/2007 | Wu et al. |
| 2011/0002963 | A1 | 1/2011 | Weinschenk et al. |
| 2011/0182926 | A1 | 7/2011 | La Monica et al. |
| 2011/0257890 | A1 | 10/2011 | Weinschenk et al. |
| 2014/0178421 | A1 | 6/2014 | Kosmatopoulos |
| 2016/0101170 | A1 | 4/2016 | Hacohen et al. |
| 2016/0125129 | A1 | 5/2016 | Sahin et al. |
| 2018/0066017 | A1 | 3/2018 | Hunt et al. |
| 2018/0102585 | A1 | 4/2018 | Forster |
| 2018/0117133 | A1 | 5/2018 | Chaplin et al. |
| 2018/0134804 | A1 | 5/2018 | Scheinberg et al. |
| 2018/0141998 | A1 | 5/2018 | Nguyen et al. |
| 2019/0175727 | A1 | 6/2019 | Huang et al. |
| 2019/0307868 | A1 | 10/2019 | Rooney |
| 2019/0322714 | A1 | 10/2019 | Petit et al. |
| 2020/0061166 | A1 | 2/2020 | Sahin et al. |
| 2020/0069782 | A1 | 3/2020 | Biskup et al. |
| 2020/0078454 | A1 | 3/2020 | Kosmatopoulos et al. |
| 2020/0105378 | A1 | 4/2020 | Abelin et al. |
| 2020/0237885 | A1 | 7/2020 | Levey et al. |
| 2021/0154280 | A1 | 5/2021 | Martin et al. |
| 2021/0177954 | A1 | 6/2021 | Juneja |
| 2021/0177955 | A1 | 6/2021 | Petit et al. |
| 2021/0196806 | A1 | 7/2021 | Yelensky et al. |
| 2021/0196809 | A1 | 7/2021 | Maianti et al. |
| 2021/0268086 | A1 | 9/2021 | Zhong et al. |
| 2021/0268091 | A1 | 9/2021 | Juneja |
| 2021/0275657 | A1 | 9/2021 | Juneja et al. |
| 2021/0290746 | A1 | 9/2021 | Sahin et al. |
| 2021/0389280 | A1 | 12/2021 | Wang |
| 2022/0160848 | A1 | 5/2022 | Gifford et al. |
| 2022/0194999 | A1 | 6/2022 | Krishna et al. |

FOREIGN PATENT DOCUMENTS

| | | |
|---|---|---|
| WO | WO-2005/042698 A2 | 5/2005 |
| WO | WO-2009/002418 A2 | 12/2008 |
| WO | WO-2013/177214 A2 | 11/2013 |
| WO | WO-2016/172722 A1 | 10/2016 |
| WO | WO-2016/187508 | 11/2016 |
| WO | WO-2017/075531 A1 | 5/2017 |
| WO | WO-2018/081459 A1 | 5/2018 |
| WO | WO-2018/081480 A1 | 5/2018 |
| WO | WO-2018/102585 A1 | 6/2018 |
| WO | WO-2018/187356 A2 | 10/2018 |
| WO | WO-2019/246286 | 12/2019 |
| WO | WO-2020/037239 A1 | 2/2020 |
| WO | WO-2020/123300 A2 | 6/2020 |
| WO | WO-2020/154617 A1 | 7/2020 |
| WO | WO-2020/252039 A1 | 12/2020 |
| WO | WO-2020/253643 A1 | 12/2020 |
| WO | WO-2021/055594 | 3/2021 |
| WO | WO-2021/087840 A1 | 5/2021 |
| WO | WO-2021/207152 A1 | 10/2021 |
| WO | WO-2022/036142 A2 | 2/2022 |
| WO | WO-2022/132596 A2 | 6/2022 |
| WO | WO-2022/171032 A1 | 8/2022 |
| WO | WO-2022/180219 A1 | 9/2022 |
| WO | WO-2023/170535 A2 | 9/2023 |
| WO | WO-2023/230014 A1 | 11/2023 |

OTHER PUBLICATIONS

Chu et al., "A transformer-based model to predict peptide-HLA class I binding and optimize mutated peptides for vaccine design," Nature Machine Intelligence, vol. 4(3), Mar. 23, 2022, pp. 300-311 and figures. 15 pages.

Chu et al., "TransMut: a program to predict HLA-I peptide binding and optimize mutated peptides for vaccine design by the Transformer-derived self-attention model," Research Square, Sep. 30, 2021. 47 pages. (https://doi.org/10.21203/rs.3.rs-785618/v1).

Getentry Accession No. CU234118, DNA Data Bank of Japan. (Year 2015). 1,543 pages.

NCBI Database, GenBank Accession No. AB051004. (Year 2016). 1 page.

NCBI Database, GenBank Accession No. FRAP01000011. (Year 2016). 73 pages.

NCBI Database, GenBank Accession No. PYDT01000009. (Year 2019). 983 pages.

Racle et al., "Robust prediction of HLA class II epitopes by deep motif deconvolution of immunopeptidomes," Nature Biotechnology, Nov. 2019, vol. 37(11), pp. 1283-1286, Methods and Reporting Summary. 12 pages.

UniProt Accession No. A0A1M6V319-A0A1M6V319_PSETH. (Year 2017). 5 pages.

UniProt Accession No. A0A4S8INI8-A0A4S8INI8_MUSBA. (Year 2019). 6 pages.

UniProt Accession No. A4YTR3-A4YTR3_BRASO. (Year 2007). 5 pages.

Aurisicchio et al., "A novel minigene scaffold for therapeutic cancer vaccines," OncoImmunology, published online Jan. 16, 2014, vol. 3, e27529, pp. 1-13. 14 pages.

Fikes et al., "Design of multi-epitope, analogue-based cancer vaccines," Expert Opinion on Biological Therapy, published online Mar. 3, 2005, vol. 3:6, pp. 985-993. 10 pages.

Fridman et al., "An efficient T-cell epitope discovery strategy using in silico prediction and the iTopia assay platform," OncoImmunology, published online Nov. 30, 2012, vol. 1:8, pp. 1258-1270 and Supplemental Material. 21 pages.

Zhang et al., "Epitope-based minigene vaccine targeting fibroblast activation protein α induces specific immune responses and anti-tumor effects in 4 T1 murine breast cancer model," International Immunopharmacology, available online Sep. 21, 2022, vol. 112, 109237, pp. 1-10.

Antunes et al., "General Prediction of Peptide-MHC Binding Modes Using Incremental Docking: A Proof of Concept," Scientific Reports, published online Mar. 12, 2018, vol. 8(1):4327-4339. 13 pages.

Badrinath et al., "A vaccine targeting resistant tumours by dual T cell plus NK cell attack," Nature, Jun. 30, 2022, vol. 606, pp. 992-998 and Methods. 31 pages.

Bai et al., "Immune-based mutation classification enables neoantigen prioritization and immune feature discovery in cancer immunotherapy," Oncoimmunology, Jan. 15, 2021, vol. 10(1), e1868130. 13 pages.

Bear et al., "Biochemical and functional characterization of mutant KRAS epitopes validates this oncoprotein for immunological targeting," Nature Communications, published online Jul. 16, 2021, vol. 12(1):4365-4380. 16 pages.

Brito et al., "A cationic nanoemulsion for the delivery of next-generation RNA vaccines," Molecular Therapy, Dec. 2014, vol. 22(12), pp. 2118-2129.

Bulik-Sullivan et al., "Deep learning using tumor HLA peptide mass spectrometry datasets improves neoantigen identification," Nature Biotechnology (2019), published online Dec. 17, 2018, vol. 37, pp. 55-63 and Online Methods. 13 pages.

Dai et al., "Constrained Submodular Optimization for Vaccine Design," arXiv preprint, arXiv:2206.08336v2. https://arxiv.org/abs/2206.08336, version 2, Jan. 27, 2023. 24 pages.

Geall et al., "Nonviral delivery of self-amplifying RNA vaccines," Proc. Natl. Acad. Sci., Sep. 4, 2012, vol. 109(36), pp. 14604-14609.

Hie et al., "Learning the language of viral evolution and escape," Science, Jan. 15, 2021, vol. 371(6526):284-288. 5 pages.

Kreiner et al., "Current state of antigen-specific immunotherapy for type 1 diabetes," Curr. Opin. Endocrinol. Diabetes Obes., Aug. 2021, vol. 28(4), pp. 411-418.

Li et al., "Circular RNA cancer vaccines drive immunity in hard-to-treat malignancies," Theranostics, Aug. 29, 2022, vol. 12(14), pp. 6422-6436.

London et al., "Rosetta FlexPepDock web server—high resolution modeling of peptide-protein interactions," Nucleic Acids Research, published online May 27, 2011, vol. 39, Web Server issue: W249-253.

Parkhurst et al., "Improved induction of melanoma-reactive CTL with peptides from the melanoma antigen gp100 modified at HLA-

(56) References Cited

OTHER PUBLICATIONS

A*0201-binding residues," The Journal of Immunology, Sep. 15, 1996, vol. 157(6), pp. 2539-2548.
Postigo-Fernandez et al., "A multi-epitope DNA vaccine enables a broad engagement of diabetogenic T cells for tolerance in Type 1 diabetes," Journal of Autoimmunity (2019), available online Nov. 17, 2018, vol. 98, pp. 13-23.
Robinson et al., "Potential for Antigen-Specific Tolerizing Immunotherapy in Systematic Lupus Erythematosus," Frontiers in Immunology, Jul. 16, 2021, vol. 12:654701, pp. 1-13.
Slingluff et al., "Immunologic and clinical outcomes of a randomized phase II trial of two multipeptide vaccines for melanoma in the adjuvant setting," Clin. Cancer Res., Nov. 2007, vol. 13(21), pp. 6386-6395.
Wang et al., "A benchmark study of sequence alignment methods for protein clustering," BMC Bioinformatics, Dec. 31, 2018, vol. 19(Suppl 19):529, pp. 95-104.
Wang et al., "Direct Detection and Quantification of Neoantigens," Cancer Immunology Research, published online Sep. 16, 2019, vol. 7(11), pp. 1748-1754.
U.S. Appl. No. 17/243,096, Gifford et al.
U.S. Appl. No. 17/551,679, Gifford et al.
U.S. Appl. No. 17/815,086, Gifford et al.
Abelin et al., "Defining HLA-II Ligand Processing and Binding Rules with Mass Spectrometry Enhances Cancer Epitope Prediction," Immunity, Oct. 15, 2019, vol. 51(4), pp. 766-779; e1-e17, and Update (Feb. 9, 2021, 54(2):388). 34 pages.
Alhadj-Ali et al., "Metabolic and immune effects of immunotherapy with proinsulin peptide in human new-onset type 1 diabetes," Science Translation Medicine, Aug. 9, 2017, vol. 9;9(402):eaaf7779. 9 pages.
Alvarez, B. et al., "NNAlign_MA; MHC Peptidome Deconvolution for Accurate MHC Binding Motif Characterization and Improved T-cell Epitope Predictions", Molecular & Cellular Proteomics, Dec. 2019, vol. 18(12), pp. cover, 2459-2477 (20 pages).
Asahara et al., "Phase I/II clinical trial using HLA-A24-restricted peptide vaccine derived from KIF20A for patients with advanced pancreatic cancer," Journal of Translational Medicine, Nov. 16, 2013, vol. 11:291. 13 pages.
Bae et al., "Myeloma-Specific Multiple Peptides Able to Generate Cytotoxic T Lymphocytes: A Potential Therapeutic Application in Muliple Myeloma and other Plasma Cell Disorders," Clinical Cancer Research, published online Jul. 2, 2012, vol. 18(17), pp. 4850-4860.
Berzofsky et al., "Progress on new vaccine strategies for the immunotherapy and prevention of cancer," The Journal of Clinical Investigation, Jun. 2004, vol. 113(11), pp. 1515-1525.
Berzofsky et al., "Strategies for designing and optimizing new generation vaccines," Nature Reviews: Immunology, vol. 1(3), Dec. 2001, pp. 209-219.
Berzofsky, "Epitope selection and design of synthetic vaccines. Molecular approaches to enhancing immunogenicity and cross-reactivity of engineered vaccines," Annals of the New York Academy of Sciences, Aug. 12, 1993, vol. 690(1), pp. 256-264.
Bhasin, M. and Raghava, G.P.S., "Prediction of Promiscuous and High-Affinity Mutated MHC Binders", Hybridoma and Hybridomics, Nov. 4, 2003, vol. 22, 229-234, (8 pages).
Candia et al., "On Peptides and Altered Peptide Ligands: From Origin, Mode of Action and Design to Clinical Application (Immunotherapy)," International Archives of Allergy and Immunology, published online Sep. 20, 2016; vol. 170(4), pp. 211-233.
Chicz et al., "Predominant naturally processed peptides bound to HLA-DR1 are derived from MHC-related molecules and are heterogeneous in size," Nature, Aug. 27, 1992, vol. 358(6389), pp. 764-768.
Cleveland et al., "Routine large-scale production of monoclonal antibodies in a protein-free culture medium," Journal of Immunological Methods, Jan. 28, 1983, vol. 56, Issue 2, pp. 221-234.

Croft et al., "Most viral peptides displayed by class I MHC on infected cells are immunogenic," Proceedings of the National Academy of Sciences, Feb. 19, 2019, vol. 116(8), pp. 3112-3117.
Dai et al., "Machine learning optimization of peptides for presentation by class II MHCs," bioRxiv, posted Aug. 18, 2020 (https://doi.org/10.1101/2020.08.18.256081). 35 pages.
Dastagir et al., "Efficient Presentation of Multiple Endogenous Epitopes to Both CD4+ and CD8+ Diabetogenic T Cells for Tolerance," Molecular Therapy: Methods & Clinical Development, Mar. 2017, vol. 4, pp. 27-38.
Dey et al., "A Bioinformatics approach to designing a Zika virus vaccine," Computational Biology and Chemistry, available online Mar. 10, 2017, vol. 68, pp. 143-152.
Dyall et al., "Heteroclitic Immunization Induces Tumor Immunity," J. Exp. Med., Nov. 2, 1998, vol. 188(9), pp. 1553-1561.
Fong et al., "Altered peptide ligand vaccination with Flt3 ligand expanded dendritic cells for tumor immunotherapy," PNAS, Jul. 17, 2001, vol. 98(15), pp. 8809-8814.
Gibson et al., "Proinsulin multi-peptide immunotherapy induces antigen-specific regulatory T cells and limits autoimmunity in a humanized model," Clinical and Experimental Immunology, Dec. 2015, vol. 182(3), pp. 251-260.
Guevara-Patino et al., "Optimization of a self antigen for presentation of multiple epitopes in cancer immunity," The Journal of Clinical Investigation, May 2006, vol. 116(5), pages: cover, 1382-1390.
Hollingsworth et al., "Turning the corner on therapeutic cancer vaccines," npj Vaccines, published online Feb. 8, 2019, vol. 4(7), pp. 1-10.
Hong et al., "Epitope-optimized alpha-fetoprotein genetic vaccines prevent carcinogen-induced murine autochthonous hepatocellular carcinoma," Hepatology, Apr. 2014, vol. 59(4), pp. 1448-1458.
Hoppes et al., "Altered Peptide Ligands Revisited: Vaccine Design through Chemically Modified HLA-A2-Restricted T Cell Epitopes," Journal of Immunology, published online Oct. 13, 2014, vol. 193, pp. 4803-4813. (12 pages).
Houghton et al., "Immunological validation of the EpitOptimizer program for streamlined design of heteroclitic epitopes," Vaccine, available online Jun. 4, 2007, vol. 25(29), pp. 5330-5342.
International Search Report and Written Opinion mailed Mar. 28, 2022, in the International Application No. PCT/US2021/060013. 14 pages.
International Search Report and Written Opinion mailed Oct. 14, 2022, in the International Application No. PCT/US22/26354. 21 pages.
Jain et al., "Synthetic Tumor-Specific Breakpoint Peptide Vaccine in Patients With Chronic Myeloid Leukemia and Minimal Residual Disease," Cancer, Sep. 1, 2009, vol. 115, pp. 3924-3934.
Jaravine et al., "Assessment of cancer and virus antigens for cross-reactivity in human tissues," Bioinformatics, Jan. 1, 2017, vol. 33, No. 1, pp. 104-111.
Jaravine et al., "Expitope 2.0: a tool to assess immunotherapeutic antigens for their potential cross-reactivity against naturally expressed proteins in human tissues," BMC Cancer, Dec. 28, 2017, vol. 17:892. 9 pages.
Jurtz, V. et al., "NetMHCpan-4.0: Improved Peptide-MHC Class I Interaction Predictions Integrating Eluted Ligand and Peptide Binding Affinity Data", The Journal of Immunology, prepublished online Oct. 4, 2017, vol. 199, pp. 3360-3368 (9 pages).
Keogh et al., "Identification of new epitopes from four different tumor-associated antigens: Recognition of naturally processed epitopes correlates with HLA-A*0201-binding affinity," The Journal of Immunology, Jul. 15, 2001, vol. 167(2), pp. 787-796. 11 pages.
Klinger et al., "Multiplex identification of antigen-specific T cell receptors using a combination of immune assays and immune receptor sequencing," PLOS One, Oct. 28, 2015, vol. 10(10), e0141561. 21 pages.
Kranz et al., "Systemic RNA delivery to dendritic cells exploits antiviral defence for cancer immunotherapy," Nature, Jun. 16, 2016, vol. 534(7607), pp. 396-401, and Methods. 16 pages.

(56) References Cited

OTHER PUBLICATIONS

Kreiter, et al., "Increased antigen presentation efficiency by coupling antigens to MHC class I trafficking signals," The Journal of Immunology, Jan. 2008, vol. 180(1), pp. 309-318, and Corrections. 12 pages.

Krienke, C. et al., "A noninflammatory mRNA vaccine for treatment of experimental autoimmune encephalomyelitis", Science, Jan. 8, 2021, vol. 371, pp. 145-153 (10 pages).

Liu et al. "Computationally Optimized SARS-CoV-2 MHC Class I and II Vaccine Formulations Predicted to Target Human Haplotype Distributions," Cell Systems, Aug. 26, 2020, vol. 11(2), pp. 131-144, e1-e6, Supplementary Table. 23 pages.

Liu et al., "Maximum n-times Coverage for COVID-19 Vaccine Design," arXiv (arXiv:2101.10902v1), submitted Jan. 24, 2021. 13 pages.

Liu et al., "Predicted Cellular Immunity Population Coverage Gaps for SARS-CoV-2 Subunit Vaccines and their Augmentation by Compact Peptide Sets," bioRxiv, posted Oct. 21, 2020, 29 pages. (https://www.biorxiv.org/content/10.1101/2020.08.04.200691v2).

Liu et al., "Predicted Cellular Immunity Population Coverage Gaps for SARS-CoV-2 Subunit Vaccines and their Augmentation by Compact Peptide Sets," Cell Systems, Journal Pre-proof, Nov. 26, 2020. (https://doi.org/10.1016/j.cels.2020.11.010). 36 pages.

Longmate et al., "Population coverage by HLA class-I restricted cytotoxic T-lymphocyte epitopes," Immunogenetics (2001), published online Dec. 19, 2000, vol. 52, pp. 165-173.

Maa et al., "Biopharmaceutical Powders: Particle Formation and Formulation Considerations," Current Pharmaceutical Biotechnology, Nov. 2000, vol. 1, No. 3, pp. 283-302.

Mahanty et al., "Immunogenicity of infectious pathogens and vaccine antigens," BMC Immunology, published online May 29, 2015, vol. 16(31), pp. 1-6.

Mashiba et al., "Identification of CTL epitopes in hepatitis C virus by a genome-wide computational scanning and a rational design of peptide vaccine," Immunogenetics, published online Jan. 16, 2007, vol. 59, pp. 197-209.

Merriam-Webster, "Prevent", available online at https://www.merriam-webster.com/dictionary/prevent. 10 pages. Accessed on Sep. 24, 2021.

Mösch et al., "Machine Learning for Cancer Immunotherapies Based on Epitope Recognition by T Cell Receptors," Frontiers in Genetics, Nov. 19, 2019, vol. 10, Article 1141. 17 pages.

Nair et al., "A simple practice guide for dose conversion between animals and human," Journal of Basic and Clinical Pharmacy, Article Review, Mar.-May 2016, vol. 7, Issue 2, pp. 27-31.

Ng et al., "In silico-guided sequence modifications of K-ras epitopes improve immunological outcome against G12V and G13D mutant KRAS antigens," PeerJ, published Jul. 20, 2018, 6:e5056. doi: 10.7717/peerj.5056. 21 pages.

Nielsen et al., "NNAlign: a platform to construct and evaluate artificial neural network models of receptor-ligand interactions," Nucleic Acids Research, published online Apr. 12, 2017, vol. 45, pp. W344-W349.

Nielsen et al., "The role of the proteasome in generating cytotoxic T-cell epitopes: insights obtained from improved predictions of proteasomal cleavage," Immunogenetics, published online Mar. 3, 2005, vol. 57, pp. 33-41.

Nielsen, M. and Lund, O., "NN-align. An artificial neural network-based alignment algorithm for MHC class II peptide binding prediction", BMC Bioinformatics, Sep. 18, 2009, vol. 10:296, pp. 1-10 (10 pages).

Nielsen, M. et al., "Quantitative Predictions of Peptide Binding to Any HLA-DR Molecule of Known Sequence: NetMHCIIpan", PLoS Computational Biology, Jul. 4, 2008, vol. 4(7):e1000107, pp. 1-10 (10 pages).

O'Donnell, T.J. et al., "MHCflurry 2.0: Improved Pan-Allele Prediction of MHC Class I-Presented Peptides by Incorporating Antigen Processing", Cell Systems, Jul. 22, 2020, vol. 11, pp. cover, 42-48 (15 pages).

O'Donnell, T.J. et al., "MHCflurry: Open-Source Class I MHC Binding Affinity Prediction", Cell Systems, Jul. 25, 2018, vol. 7, pp. cover, 129-132 (9 pages).

Ogishi et al., "Quantitative Prediction of the Landscape of T Cell Epitope Immunogenicity in Sequence Space," Frontiers in Immunology, Apr. 16, 2019, vol. 10, Article 827. 20 pages.

Park et al., "Accurate structure prediction of peptide-MHC complexes for identifying highly immunogenic antigens," Mol. Immunol., Nov. 2013, vol. 56(0):81-90. NIH Author Manuscript. 25 pages.

Reynisson et al., "NetMHCpan-4.1 and NetMHCIIpan-4.0: improved predictions of MHC antigen presentation by concurrent motif deconvolution and integration of MS MHC eluted ligand data," Nucleic Acids Research, published online May 14, 2020; vol. 48(W1), pp. W449-W454.

Rist et al., "HLA peptide length preferences control CD8+ T cell responses," The Journal of Immunology, published online Jun. 7, 2013, vol. 191(2), pp. 561-571. 12 pages.

Rosenberg et al., "Immunologic and therapeutic evaluation of a synthetic peptide vaccine for the treatment of patients with metastatic melanoma," Nature Medicine, Mar. 1998, vol. 4(3), pp. 321-327.

Sahin et al., "Personalized RNA mutanome vaccines mobilize poly-specific therapeutic immunity against cancer," Nature, Jul. 13, 2017, vol. 547(7662), pp. 222-226, and Methods. 19 pages.

Schipper et al., "Minimal Phenotype Panels, A Method for Achieving Maximum Population Coverage with a Minimum of HLA Antigens," Human Immunology, vol. 51, Dec. 1996, pp. 95-98.

Sette et al., "Peptides and Methods for Creating Synthetic Peptides With Modulated Binding Affinity for HLA Molecules," Application for utility U.S. Appl. No. 09/226,775, filed Jan. 6, 1999—not published, abandoned. 133 pages.

Sette et al., "The Relationship Between Class I Binding Affinity and Immunogenicity of Potential Cytotoxic T Cell Epitopes," The Journal of Immunology, Dec. 15, 1994, vol. 153, pp. 5586-5592.

Shimokawa, C et al., "CD8+ regulatory T cells are critical in prevention of autoimmune-mediated diabetes", Nature Communications, Apr. 22, 2020, vol. 11:1922, pp. 1-9 (9 pages).

Sim et al., "Correction—High-affinity oligoclonal TCRs define effective adoptive T cell therapy targeting mutant KRAS-G12D," Proc. Natl. Acad. Sci. USA, Nov. 3, 2020, vol. 117(44), pp. 27743-27744.

Sim et al., "High-affinity oligoclonal TCRs define effective adoptive T cell therapy targeting mutant KRAS-G12D," Proc. Natl. Acad. Sci. USA, first published May 27, 2020, vol. 117(23), pp. 12826-12835.

Slansky et al., "Enhanced antigen-specific antitumor immunity with altered peptide ligands that stabilize the MHC-peptide-TCR complex," Immunity, Oct. 2000, vol. 13(4), pp. 529-538.

Slota et al., "ELISpot for measuring human immune responses to vaccines," Expert Review of Vaccines, Mar. 2011, vol. 10(3), pp. 299-306. NIH Author Manuscript. 14 pages.

Soria-Guerra et al., "An overview of bioinformatics tools for epitope prediction: implications on vaccine development," Journal of Biomedical Informatics (2015), available online Nov. 10, 2014, vol. 53, pp. 405-414.

Takahashi et al., "Induction of Broadly Cross-Reactive Cytotoxic T Cells Recognizing an HIV-1 Envelope Determinant," Science, Jan. 17, 1992, vol. 255(5042), pp. 333-336.

Tangri et al., "Structural Features of Peptide Analogs of Human Histocompatibility Leukocyte Antigen Class I Epitopes That Are More Potent and Immunogenic than Wild-Type Peptide," Journal of Experimental Medicine, Sep. 17, 2001, vol. 194(6), pp. 833-846.

Tapia-Calle et al., "A PBMC-Based System to Assess Human T Cell Responses to Influenza Vaccine Candidates In Vitro," Vaccines, Nov. 13, 2019, vol. 7(4):181. 26 pages.

Toussaint, N.C et al., "A Mathematical Framework for the Selection of an Optimal Set of Peptides for Epitope-Based Vaccines", PLoS Computational Biology, Dec. 26, 2008, vol. 4(12):e1000246, pp. 1-10 (10 pages).

Trolle et al., "The length distribution of class I-restricted T cell epitopes is determined by both peptide supply and MHC allele-specific binding preference," The Journal of Immunology, Feb. 15, 2016, vol. 196(4), 1480-1487. HSS Author Manuscript. 21 pages.

(56) References Cited

OTHER PUBLICATIONS

Vita et al., "The Immune Epitope Database (IEDB): 2018 update," Nucleic Acids Research (2019), published online Oct. 24, 2018, vol. 47, database issue D339-D343. 5 pages.

Woodham et al., "Nanobody-Antigen Conjugates Elicit HPV-Specific Antitumor Immune Responses," Cancer Immunology Research, Jul. 2018, vol. 6(7); pp. 870-880.

Zaremba et al., "Identification of an enhancer agonist cytotoxic T lymphocyte peptide from human carcinoembryonic antigen," Cancer Research, Oct. 15, 1997, vol. 57(20), pp. 4570-4577.

Zhang et al., "Cancer vaccines: Targeting KRAS-driven cancers," Expert Review of Vaccines, published online Mar. 14, 2020, vol. 19(2), pp. 163-173. 12 pages.

Zirlik et al., "Cytotoxic T cells generated against heteroclitic peptides kill primary tumor cells independent of the binding affinity of the native tumor antigen peptide," Blood, Dec. 1, 2006, vol. 108, No. 12, pp. 3865-3870.

Bakker et al., "Analogues of CTL epitopes with improved MHC class-I binding capacity elicit anti-melanoma CTL recognizing the wild-type epitope," Int. J. Cancer, Jan. 27, 1997, vol. 70(3), pp. 302-309.

Gross et al., "High vaccination efficiency of low-affinity epitopes in antitumor immunotherapy," The Journal of Clinical Investigation, Feb. 2004, vol. 113(3), pp. 425-433.

International Search Report and Written Opinion mailed Apr. 2, 2024, in the International Application No. PCT/US23/74984. 11 pages.

Menez-Jamet et al., "Optimized tumor cryptic peptides: the basis for universal neo-antigen-like tumor vaccines," Ann. Transl. Med., Jul. 2016, 4(14):266, Review Article pp. 1-11.

Scardino et al., "HER-2/neu and hTERT cryptic epitopes as novel targets for broad spectrum tumor immunotherapy," The Journal of Immunology, Jun. 2002, 168(11):5900-6. 8 pages.

Tourdot et al., "A general strategy to enhance immunogenicity of low-affinity HLA-A2.1-associated peptides: implication in the identification of cryptic tumor epitopes," Eur. J. Immunol., Dec. 2000, vol. 30(12), pp. 3411-3421.

Valmori et al., "Enhanced generation of specific tumor-reactive CTL in vitro by selected Melan-A/MART-1 immunodominant peptide analogues," The Journal of Immunology, Feb. 15, 1998, 160(4):1750-8. 10 pages.

Bell et al., "Dynamics-Based Peptide—MHC Binding Optimization by a Convolutional Variational Autoencoder: A Use-Case Model for CASTELO," Journal of Chemical Theory and Computation, Nov. 18, 2021, vol. 17, pp. 7962-7971.

Xiao et al., "In silico design of MHC class I high binding affinity peptides through motifs activation map," BMC Bioinformatics, published Dec. 31, 2018, vol. 19(Suppl 19):516. 12 pages.

Factoring of disease presentation type probabilities and for each
presentation, probability of targets presented

| | Brain Cancer | Bronchus and Lung Cancer | Colorectal Cancer | Pancreatic Cancer | Skin Cancer | Thyroid Cancer | Breast Cancer | Ovarian Cancer |
|---|---|---|---|---|---|---|---|---|
| BRAF_V600E | - | - | 0.1029 | - | 0.4392 | 0.5854 | - | - |
| BRAF_V600M | - | - | - | - | 0.0853 | - | - | - |
| EGFR_A289V | 0.0230 | - | - | - | - | - | - | - |
| EGFR_G598V | 0.0208 | - | - | - | - | - | - | - |
| EGFR_L858R | - | 0.0216 | - | - | - | - | - | - |
| HRAS_Q61K | - | - | - | - | - | 0.0061 | - | - |
| HRAS_Q61R | - | - | - | - | - | 0.0285 | - | - |
| IDH1_R132C | 0.0197 | - | - | - | - | - | - | - |
| IDH1_R132H | 0.4178 | - | - | - | - | - | - | - |
| KRAS_G12A | - | 0.0169 | - | - | - | - | - | - |
| KRAS_G12C | - | 0.0583 | - | - | - | - | - | - |
| KRAS_G12D | - | 0.0188 | 0.1235 | 0.3280 | - | - | - | - |
| KRAS_G12R | - | - | - | 0.1505 | - | - | - | - |
| KRAS_G12V | - | 0.0376 | 0.0947 | 0.2258 | - | - | - | 0.0092 |
| KRAS_G13D | - | - | 0.0700 | - | - | - | - | - |
| NRAS_Q61K | - | - | - | - | 0.0832 | 0.0163 | - | - |
| NRAS_Q61L | - | - | - | - | 0.0384 | - | - | - |
| NRAS_Q61R | - | - | - | - | 0.1215 | 0.0630 | - | 0.0069 |
| PIK3CA_E542K | - | 0.0169 | - | - | - | - | 0.0435 | - |
| PIK3CA_E545K | - | 0.0197 | 0.0700 | - | - | - | 0.0638 | - |
| PIK3CA_H1047R | - | - | - | - | - | - | 0.1225 | - |
| TP53_R158L | - | 0.0188 | - | - | - | - | - | - |
| TP53_R175H | 0.0186 | - | 0.0679 | - | - | - | 0.0202 | 0.0343 |
| TP53_R248Q | - | - | - | - | - | - | - | 0.0252 |
| TP53_R273C | 0.0581 | - | - | - | - | - | 0.0051 | 0.0137 |
| TP53_R273H | - | - | - | - | - | - | 0.0121 | 0.0206 |

FIG. 8

```
def merge_multi(lists):
    values = []

# While any list in lists has elements remaining
    while max(map(lambda l: len(l), lists)) > 0:
        # Find list with largest value at its head.
        cur_max = None
        cur_max_idx = None
        for idx, l in enumerate(lists):
            if not l:  # List is empty.
                continue
            if cur_max is None or l[0] > cur_max:
                cur_max = l[0]
                cur_max_idx = idx
        # Pop that value from list l.
        values.append((lists[cur_max_idx].pop(0), cur_max_idx))

return values
```

FIG. 10

COMPOSITIONS FOR OPTIMIZED BCR-ABL PEPTIDE VACCINES

This application claims the benefit under 35 U.S.C. § 119(e) of provisional application U.S. Ser. No. 63/249,235, filed Sep. 28, 2021, the entire contents of which is incorporated by reference herein.

This patent disclosure contains material that is subject to copyright protection. The copyright owner has no objection to the facsimile reproduction of the patent document or the patent disclosure as it appears in the U.S. Patent and Trademark Office patent file or records, but otherwise reserves any and all copyright rights.

INCORPORATION BY REFERENCE

All documents cited herein are incorporated herein by reference in their entireties.

Sequence Listing

The instant application contains a Sequence Listing which has been submitted electronically in XML format and is hereby incorporated by reference in its entirety. The XML copy, created on Sep. 13, 2022, is named 2215269_00129US2_Sequence_Listing_as_filed.xml and is 55,022 kilobytes in size.

TECHNICAL FIELD

The present invention relates generally to compositions, systems, and methods of peptide vaccines. More particularly, the present invention relates to compositions, systems, and methods of designing peptide vaccines to treat or prevent disease optimized based on predicted population immunogenicity.

BACKGROUND

The goal of a peptide vaccine is to train the immune system to recognize and expand its capacity to engage cells that display target peptides to improve the immune response to cancerous cells or pathogens. A peptide vaccine can also be administered to someone who is already diseased to increase their immune response to a causal cancer, other diseases, or pathogen. Alternatively, a peptide vaccine can be administered to induce the immune system to have therapeutic tolerance to one or more peptides. There exists a need for compositions, systems, and methods of peptide vaccines based on prediction of the target peptides that will be displayed to protect a host from cancer, other disease, or pathogen infection. We introduce novel prophylactic and therapeutic vaccines for cancer based upon neoantigens introduced by the BCR-ABL gene fusion that occurs in cases of chronic myelogenous leukemia (CML), acute lymphoblastic leukemia (ALL), and acute myelogenous leukemia (AML), breast invasive ductal carcinoma, and other cancers.

SUMMARY OF THE INVENTION

In one aspect, described herein is a composition comprising nucleic acid sequences encoding at least two amino acid sequences selected from the group consisting of SEQ ID NOs: 1 to 8, SEQ ID NOs: 10 to 17, and SEQ ID NOs: 19 to 44.

In some embodiments, the nucleic acid sequences are contained in a construct for in vivo expression of the nucleic acid sequences.

In some embodiments, an administration of the nucleic acid sequences causes one or more peptides encoded by the nucleic acid sequences to be displayed by an HLA class I molecule in a subject.

In some embodiments, the nucleic acid sequences are contained in a construct for in vivo expression of at least two peptides encoded by the nucleic acid sequences, wherein an administration of the nucleic acid sequences causes: a first peptide of the at least two peptides to be displayed by a first plurality of HLA class I alleles in the subject; and a second peptide of the at least two peptides to be displayed by a second plurality of HLA class I alleles in the subject, wherein the first plurality of HLA class I alleles and the second plurality of HLA class I alleles differ by at least one HLA class I allele.

In some embodiments, the one or more peptides is a modified or an unmodified fragment of a BCL-ABL gene fusion. In some embodiments, the BCR-ABL gene fusion is b3a2 or b2a2. In some embodiments, the two or more amino acid sequences are selected based on a prevalence of the BCR-ABL gene fusion in a risk group that the subject belongs to, and wherein the composition is administered in an effective amount to the subject to promote an immune response against cancer or to treat cancer, and wherein the cancer is associated with the BCR-ABL gene fusion.

In some embodiments, the nucleic acid sequences are configured for administration in an effective amount to the subject to treat cancer.

In another aspect, described herein is a peptide composition comprising at least two peptides selected from the group consisting of SEQ ID NOs: 1 to 8, SEQ ID NOs: 10 to 17, and SEQ ID NOs: 19 to 44.

In some embodiments, a peptide in the peptide composition is configured for display by a HLA class I molecule in a subject.

In some embodiments, an administration of a first peptide of the at least two peptides causes: the first peptide to be displayed by a first plurality of HLA class I alleles in a subject; and a second peptide of the at least two peptides to be displayed by a second plurality of HLA class I alleles in a subject, wherein the first plurality of HLA class I alleles and the second plurality of HLA class I alleles differ by at least one HLA class I allele.

In some embodiments, a peptide in the peptide composition is a modified or an unmodified fragment of a BCL-ABL gene fusion. In some embodiments, the BCR-ABL gene fusion is b3a2 or b2a2. In some embodiments, the at least two peptides are selected based on a prevalence of the BCR-ABL gene fusion in a risk group that the subject belongs to, and wherein the peptide composition is administered in an effective amount to the subject to promote an immune response against cancer or to treat cancer, and wherein the cancer is associated with the BCR-ABL gene fusion.

In some embodiments, the peptide composition is configured for administration in an effective amount to a subject to treat cancer.

In another aspect, described herein are nucleic acid sequences encoding one or more amino acid sequences selected from the group consisting of SEQ ID NOs: 46 to 112.

In some embodiments, the nucleic acid sequence are contained in a construct for in vivo expression of the nucleic acid sequences.

In some embodiments, an administration of the nucleic acid sequences causes one or more peptides encoded by the nucleic acid sequences to be displayed by an HLA class II molecule in a subject.

In some embodiments, the one or more amino acid sequences are derived from a modified or an unmodified fragment of a BCL-ABL gene fusion. In some embodiments, the BCR-ABL gene fusion is b3a2 or b2a2. In some embodiments, the one or more amino acid sequences are selected based on a prevalence of the BCR-ABL gene fusion in a risk group that the subject belongs to, and wherein the composition is administered in an effective amount to the subject to promote an immune response against cancer or to treat cancer, and wherein the cancer is associated with the BCR-ABL gene fusion.

In some embodiments, the composition is configured for administration in an effective amount to a subject to treat cancer.

In some embodiments, the nucleic acid sequences encode at least two amino acid sequences selected from the group consisting of SEQ ID NOs: 46 to 112.

In another aspect, described herein is a peptide composition comprising one or more peptides selected from the group consisting of SEQ ID NOs: 46 to 112.

In some embodiments, a peptide in the peptide composition is configured for display by an HLA class II molecule in a subject.

In some embodiments, a peptide in the peptide composition is a modified or an unmodified fragment of a BCL-ABL gene fusion. In some embodiments, the BCR-ABL gene fusion is b3a2 or b2a2. In some embodiments, the one or more peptides are selected based on a prevalence of the BCR-ABL gene fusion in a risk group that the subject belongs to, and wherein the peptide composition is administered in an effective amount to the subject to promote an immune response against cancer or to treat cancer, and wherein the cancer is associated with the BCR-ABL gene fusion.

In some embodiments, the peptide composition is configured for administration in an effective amount to a subject to treat cancer.

In one aspect, described herein are nucleic acid sequences encoding one or more amino acid sequences selected from the group consisting of SEQ ID NOs: 1 to 45.

In some embodiments, the nucleic acid sequences encode two or more amino acid sequences selected from the group consisting of SEQ ID NOs: 1 to 45.

In some embodiments, the invention provides for an immunogenic composition comprising nucleic acid sequences encoding one or more amino acid sequences selected from the group consisting of SEQ ID NOs: 1 to 45.

In some embodiments, the immunogenic composition is administered to a subject. In some embodiments, the immunogenic composition comprises nucleic acid sequences encoding two or more amino acid sequences selected from the group consisting of SEQ ID NOs: 1 to 45. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or an unmodified fragment of a BCR-ABL gene fusion. In some embodiments, the BCR-ABL gene fusion is b3a2 or b2a2. In some embodiments, the immunogenic composition is administered in an effective amount to a subject to prevent cancer. In some embodiments, the immunogenic composition is administered in an effective amount to a subject to treat cancer. In some embodiments, the immunogenic composition is administered in an effective amount to a subject to prevent chronic myelogenous leukemia (CML), acute lymphoblastic leukemia (ALL), acute myelogenous leukemia (AML), or breast invasive ductal carcinoma. In some embodiments, the immunogenic composition is administered in an effective amount to a subject to treat chronic myelogenous leukemia (CML), acute lymphoblastic leukemia (ALL), acute myelogenous leukemia (AML), or breast invasive ductal carcinoma.

In some embodiments, the immunogenic composition comprises nucleic acid sequences encoding at least three amino acid sequences selected from the group consisting of SEQ ID NOs: 1 to 45.

In another aspect, described herein is a peptide composition comprising one or more amino acid sequences selected from the group consisting of SEQ ID NOs: 1 to 45.

In some embodiments, the invention provides for an immunogenic peptide composition comprising one or more peptides selected from the group consisting of SEQ ID NOs: 1 to 45.

In some embodiments, the immunogenic peptide composition comprises two or more peptides selected from the group consisting of SEQ ID NOs: 1 to 45. In some embodiments, the immunogenic composition is administered to a subject. In some embodiments a peptide in the immunogenic peptide composition is displayed by an HLA class I molecule. In some embodiments, a peptide in the immunogenic peptide composition is a modified or an unmodified fragment of a BCR-ABL gene fusion. In some embodiments, the BCR-ABL gene fusion is b3a2 or b2a2. In some embodiments, the immunogenic peptide composition is administered in an effective amount to a subject to prevent cancer. In some embodiments, the immunogenic peptide composition is administered in an effective amount to a subject to treat cancer. In some embodiments, the immunogenic composition is administered in an effective amount to a subject to prevent chronic myelogenous leukemia (CIVIL), acute lymphoblastic leukemia (ALL), acute myelogenous leukemia (AML), or breast invasive ductal carcinoma. In some embodiments, the immunogenic composition is administered in an effective amount to a subject to treat chronic myelogenous leukemia (CIVIL), acute lymphoblastic leukemia (ALL), acute myelogenous leukemia (AML), or breast invasive ductal carcinoma.

In some embodiments, the immunogenic peptide composition comprises three or more peptides selected from the group consisting of SEQ ID NOs: 1 to 45.

In another aspect, described herein are nucleic acid sequences encoding one or more amino acid sequences selected from the group consisting of SEQ ID NOs: 1 to 44.

In some embodiments, the invention provides for an immunogenic composition comprising nucleic acid sequences encoding one or more amino acid sequences selected from the group consisting of SEQ ID NOs: 1 to 44.

In some embodiments, the immunogenic composition is administered to a subject. In some embodiments, the immunogenic composition comprises nucleic acid sequences encoding two or more amino acid sequences selected from the group consisting of SEQ ID NOs: 1 to 44. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or an unmodified fragment of a BCR-ABL gene fusion. In some embodiments, the BCR-ABL gene fusion is b3a2 or b2a2. In some embodiments, the immunogenic composition is administered in an effective amount to a subject to prevent cancer. In some embodiments, the immunogenic composition is administered in an effective amount to a subject to treat cancer. In some embodiments, the immunogenic composition is administered in an effective amount to a subject to prevent chronic myelogenous leukemia (CML), acute lymphoblastic leukemia (ALL), acute myelogenous leukemia (AML), or breast invasive ductal carcinoma. In some embodiments, the immunogenic composition is administered in an effective amount to a subject to treat chronic myelogenous leukemia (CML), acute lymphoblastic leukemia (ALL), acute myelogenous leukemia (AML), or breast invasive ductal carcinoma.

In some embodiments, the immunogenic composition comprises nucleic acid sequences encoding at least three amino acid sequences selected from the group consisting of SEQ ID NOs: 1 to 44.

In another aspect, described herein is a method of treating or preventing cancer by administering to a subject an immunogenic composition comprising nucleic acid sequences encoding one or more amino acid sequences selected from the group consisting of SEQ ID NOs: 1 to 44.

In some embodiments, the immunogenic composition comprises nucleic acid sequences encoding two or more amino acid sequences selected from the group consisting of SEQ ID NOs: 1 to 44.

In another aspect, described herein is a peptide composition comprising one or more amino acid sequences selected from the group consisting of SEQ ID NOs: 1 to 44.

In some embodiments, the invention provides for an immunogenic peptide composition comprising one or more peptides selected from the group consisting of SEQ ID NOs: 1 to 44.

In some embodiments, the immunogenic peptide composition comprises two or more peptides selected from the group consisting of SEQ ID NOs: 1 to 44. In some embodiments a peptide in the immunogenic peptide composition is displayed by an HLA class I molecule. In some embodiments, a peptide in the immunogenic peptide composition is a modified or an unmodified fragment of a BCR-ABL gene fusion. In some embodiments, the BCR-ABL gene fusion is b3a2 or b2a2. In some embodiments, the immunogenic peptide composition is administered in an effective amount to a subject to prevent cancer. In some embodiments, the immunogenic peptide composition is administered in an effective amount to a subject to treat cancer. In some embodiments, the immunogenic composition is administered in an effective amount to a subject to prevent chronic myelogenous leukemia (CIVIL), acute lymphoblastic leukemia (ALL), acute myelogenous leukemia (AML), or breast invasive ductal carcinoma. In some embodiments, the immunogenic composition is administered in an effective amount to a subject to treat chronic myelogenous leukemia (CIVIL), acute lymphoblastic leukemia (ALL), acute myelogenous leukemia (AML), or breast invasive ductal carcinoma.

In some embodiments, the immunogenic peptide composition comprises three or more peptides selected from the group consisting of SEQ ID NOs: 1 to 44.

In another aspect, described herein is a method of treating or preventing cancer in a subject comprising administering to the subject an immunogenic peptide composition comprising one or more peptides selected from the group consisting of SEQ ID NOs: 1 to 44.

In some embodiments, the immunogenic peptide composition comprises two or more peptides selected from the group consisting of SEQ ID NOs: 1 to 44.

In another aspect, described herein are nucleic acid sequences encoding one or more amino acid sequences selected from the group consisting of SEQ ID NOs: 46 to 112.

In some embodiments, the nucleic acid sequences encode two or more amino acid sequences selected from the group consisting of SEQ ID NOs: 46 to 112.

In some embodiments, the invention provides for an immunogenic composition comprising nucleic acid sequences encoding one or more amino acid sequences selected from the group consisting of SEQ ID NOs: 46 to 112.

In some embodiments, the immunogenic composition comprises nucleic acid sequences encoding two or more amino acid sequences selected from the group consisting of SEQ ID NOs: 46 to 112. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or an unmodified fragment of a BCR-ABL gene fusion. In some embodiments, the BCR-ABL gene fusion is b3a2 or b2a2. In some embodiments, the immunogenic composition is administered in an effective amount to a subject to prevent cancer. In some embodiments, the immunogenic composition is administered in an effective amount to a subject to treat cancer. In some embodiments, the immunogenic composition comprises nucleic acid sequences encoding at least three amino acid sequences selected from the group consisting of SEQ ID NOs: 46 to 112. In some embodiments, the immunogenic composition is administered in an effective amount to a subject to prevent chronic myelogenous leukemia (CIVIL), acute lymphoblastic leukemia (ALL), acute myelogenous leukemia (AML), or breast invasive ductal carcinoma. In some embodiments, the immunogenic composition is administered in an effective amount to a subject to treat chronic myelogenous leukemia (CIVIL), acute lymphoblastic leukemia (ALL), acute myelogenous leukemia (AML), or breast invasive ductal carcinoma.

In another aspect, described herein is a method of treating or preventing cancer by administering to a subject an immunogenic composition comprising nucleic acid sequences encoding one or more amino acid sequences selected from the group consisting of SEQ ID NOs: 46 to 112.

In some embodiments, the immunogenic composition comprises nucleic acid sequences encoding two or more amino acid sequences selected from the group consisting of SEQ ID NOs: 46 to 112.

In another aspect, described herein is a peptide composition comprising one or more amino acid sequences selected from the group consisting of SEQ ID NOs: 46 to 112.

In some embodiments, the invention provides for an immunogenic peptide composition comprising one or more peptides selected from the group consisting of SEQ ID NOs: 46 to 112.

In some embodiments, the immunogenic peptide composition comprises two or more peptides selected from the group consisting of SEQ ID NOs: 46 to 112. In some embodiments a peptide in the immunogenic peptide composition is displayed by an HLA class II molecule. In some embodiments, a peptide in the immunogenic peptide composition is a modified or an unmodified fragment of a BCR-ABL gene fusion. In some embodiments, the BCR-ABL gene fusion is b3a2 or b2a2. In some embodiments, the immunogenic peptide composition is administered in an effective amount to a subject to prevent cancer. In some embodiments, the immunogenic peptide composition is administered in an effective amount to a subject to treat cancer. In some embodiments, the immunogenic composition is administered in an effective amount to a subject to prevent chronic myelogenous leukemia (CIVIL), acute lymphoblastic leukemia (ALL), acute myelogenous leukemia (AML), or breast invasive ductal carcinoma. In some embodiments, the immunogenic composition is administered in an effective amount to a subject to treat chronic myelogenous leukemia (CIVIL), acute lymphoblastic leukemia (ALL), acute myelogenous leukemia (AML), or breast invasive ductal carcinoma.

In another aspect, described herein is a method of treating or preventing cancer in a subject comprising administering to the subject an immunogenic peptide composition comprising one or more peptides selected from the group consisting of SEQ ID NOs: 46 to 112.

In some embodiments, the immunogenic peptide composition comprises two or more peptides selected from the group consisting of SEQ ID NOs: 46 to 112.

BRIEF DESCRIPTION OF THE DRAWINGS

The following figures depict illustrative embodiments of the invention.

FIG. 8 is a table showing the respective probabilities of target presentations for various mutated protein targets across different cancers.

FIG. 10 is a script showing an example Python implementation of the M$_{\text{ERGE}}$M$_{\text{ULTI}}$ function for combined vaccine design procedures.

DETAILED DESCRIPTION

Figure 1:
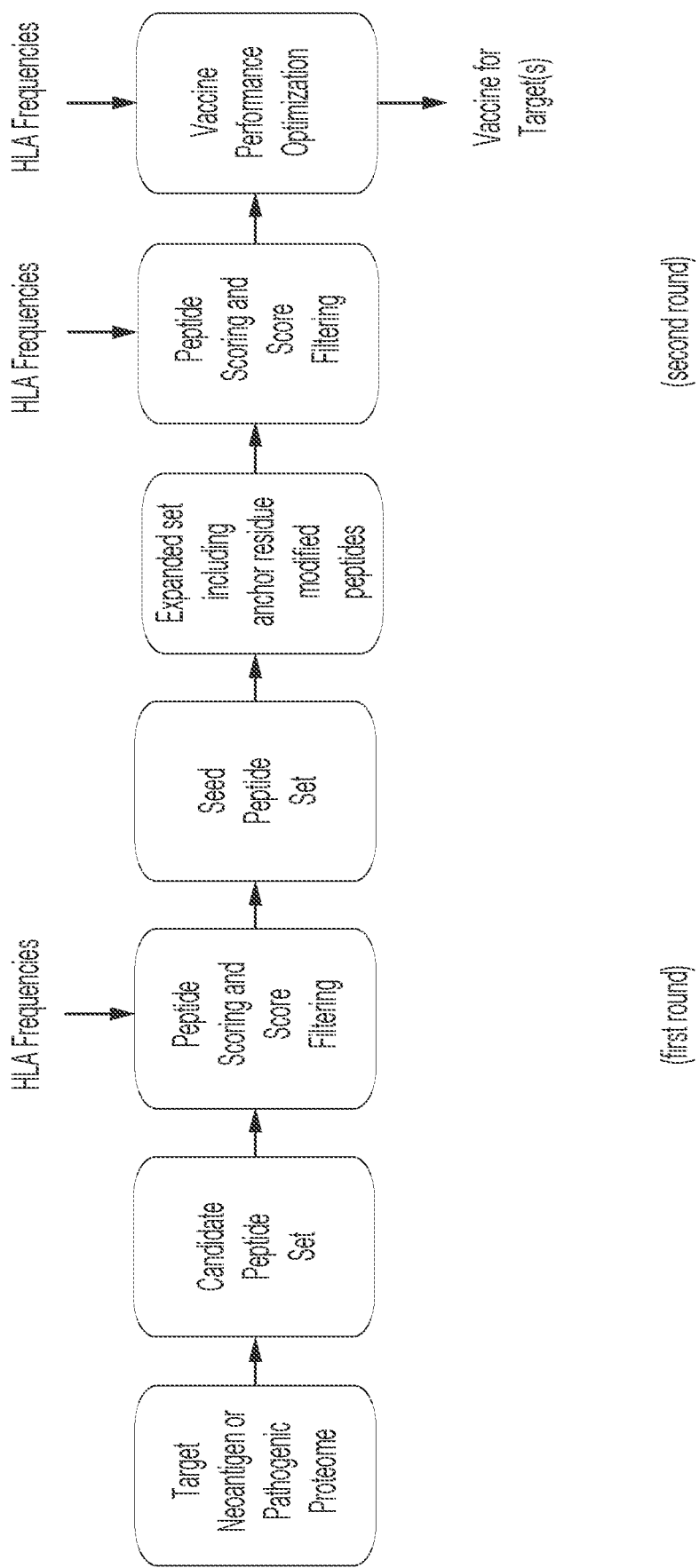
FIG. 1 is a flow chart of a vaccine optimization method.

In some embodiments, the disclosure provides for peptide vaccines that incorporate peptide sequences that will be displayed by Major Histocompatibility Complex (MHC) molecules on cells and train the immune system to recognize cancer or pathogen diseased cells. In some embodiments, the disclosure provides for peptide vaccines that that incorporate peptide sequences that will be displayed by Major Histocompatibility Complex (MHC) molecules on cells to induce therapeutic tolerance in antigen-specific immunotherapy for autoimmune diseases (Alhadj Ali et al., 2017, Gibson, et al. 2015). In some embodiments, a peptide vaccine is a composition that consists of one or more peptides. In some embodiments, a peptide vaccine is an mRNA or DNA construct administered for expression in vivo that encodes for one or more peptides.

Peptide display by an MHC molecule is necessary, but not sufficient, for a peptide to be immunogenic and cause the recognition of the resulting peptide-MHC complex by an individual's T cells to trigger T cell activation, expansion, and immune memory. In some embodiments, ELISPOT (Slota et al., 2011) or the Multiplex Identification of Antigen-Specific T Cell Receptors Using a Combination of Immune Assays and Immune Receptor Sequencing (MIRA) assay (Klinger et al., 2015) are used to scoring peptide display (e.g., a peptide immunogenicity that requires peptide binding) by an MHC molecule (e.g., HLA allele) (e.g., measured as a peptide-HLA binding score). In some embodiments, experimental data from assays such as the ELISPOT (Slota et al., 2011) or the Multiplex Identification of Antigen-Specific T Cell Receptors Using a Combination of Immune Assays and Immune Receptor Sequencing (MIRA) assay (Klinger et al., 2015) can be used to produce a peptide-HLA immunogenicity metric with respect to a peptide and an HLA allele in a given experimental context or individual. In some embodiments, experimental data from assays such as the ELISPOT (Slota et al., 2011) or the Multiplex Identification of Antigen-Specific T Cell Receptors Using a Combination of Immune Assays and Immune Receptor Sequencing (MIRA) assay (Klinger et al., 2015) can be combined with machine learning based predictions for scoring peptide display (e.g., binding affinity) by an MHC molecule (e.g., HLA allele) (e.g., measured as a peptide-HLA binding score) or for determining a peptide-HLA immunogenicity metric. In some embodiments, MHCflurry or NetMHCpan (Reynisson et al., 2020) computational methods (as known in the art) are used to predict MHC class I display of a peptide by an HLA allele (see Table 1). In some embodiments, the NetMHCIIpan computational method (Reynisson et al., 2020) is used to predict MHC class II display of a peptide by an HLA allele (see Table 2).

In some embodiments, computational methods such as MHCflurry (Odonnell et al., 2018, Odonnell et al., 2020, incorporated by reference in their entireties herein), NetMHCpan (Reynisson et al., 2020, incorporated by reference in its entirety herein), and NetMHCIIpan (Reynisson et al., 2020) are used to predict either MHC class I (MHCflurry, NetMHCpan) or class II (NetMHCIIpan) display of peptides by an HLA allele. In other embodiments, other methods of determining peptide-HLA binding are used as disclosed in International Publication No. WO 2005/042698, incorporated by reference in its entirety herein. NetMHCpan-4.1 and NetMHCIIpan-4.0 utilize the NNAlign_MA algorithm (Alvarez et al., 2019, incorporated by reference in its entirety herein) for predicting peptide-HLA binding. NNAlign_MA is in turn based upon the NNAlign (Nielsen et al., 2009, Nielsen et al., 2017, incorporated by reference in their entireties herein) neural network. NetMHCpan-4.1 (Reynisson et al., 2020) uses NNAlign_MA networks with at least 180 inputs that describe the peptide sequence (9×20=180 inputs). Networks with both 56 and 66 hidden neurons and two outputs are utilized (Alvarez et al., 2019). Each network architecture (56 or 66 hidden neurons) is trained with 5 different random parameter initializations and 5-fold cross-validation resulting in a total of 50 individual trained networks (2 architectures×5 initializations×5 cross-validation). These 50 trained networks are used as an ensemble with 25 networks having at least 10,800 parameters (180 inputs×56 neurons) and 25 networks consist of at least 11,880 parameters (180 inputs×66 neurons). Thus, the ensemble of 50 networks in NetMHCpan-4.1 consists of at least 567,000 parameters that must be evaluated with at least 567,000 arithmetic operations for computing peptide-MHC binding. NetMHCIIpan-4.1 (Reynisson et al., 2020) uses NNAlign_MA networks with at least 180 inputs that describe the peptide sequence (9×20=180 inputs). Networks with 2, 10, 20, 40, and 60 hidden neurons and two outputs are utilized (Alvarez et al., 2019). Each network architecture (2, 10, 20, 40, or 60 hidden neurons) is trained with 10 different random parameter initializations and 5-fold cross-validation resulting in a total of 250 individual trained networks (5 architectures×10 initializations×5 cross-validation). These 250 trained networks are used as an ensemble with 50 networks having at least 360 parameters (180 inputs×2 neurons), 50 networks having at least 1800 parameters (180 inputs×10 neurons), 50 networks having at least 3600 parameters (180 inputs×20 neurons), 50 networks having at least 7200 parameters (180 inputs×40 neurons), and 50 networks having at least 10,800 parameters (180 inputs×60 neurons). Thus, the ensemble of 250 networks in NetMHCIIpan-4.0 consists of at least 1,188,000 parameters that must be evaluated with at least 1,188,000 arithmetic operations for computing peptide-MHC binding.

A peptide is displayed by an MHC molecule when it binds within the groove of the MHC molecule and is transported to the cell surface where it can be recognized by a T cell receptor. A target peptide refers to a foreign peptide or a self-peptide. In some embodiments, a peptide that is part of the normal proteome in a healthy individual is a self-peptide, and a peptide that is not part of the normal proteome is a foreign peptide. In some embodiments, target peptides can be part of the normal proteome that exhibit aberrant expression (e.g., cancer-testis antigens such as NY-ESO-1). Foreign peptides can be generated by mutations in normal self-proteins in tumor cells that create epitopes called neoantigens, or by pathogenic infections. In some embodiments, a neoantigen is any subsequence of a human protein, where the subsequence contains one or more altered amino acids or protein modifications that do not appear in a healthy individual. Therefore, in this disclosure, foreign peptide refers to an amino acid sequence encoding a fragment of a target protein/peptide (or a full-length protein/peptide), the target protein/peptide consisting of: a neoantigen protein, a pathogen proteome, or any other undesired protein that is non-self and is expected to be bound and displayed by an HLA allele.

The BCR-ABL mutation is the result of the abnormal joining of the BCR gene from chromosome 22 with the ABL gene from chromosome 9 that results in a fusion of the two genes on chromosome 22. Differences in the fusion product formed result in different BCR-ABL transcripts, with b3a2 (also known as e14a2) and b2a2 (also known as e13a2) being the most prevalent. In a study of two hundred BCR-ABL affected patients 42% expressed b2a2, 41% expressed b3a2, and 18% expressed both transcripts (Jain et al., 2016). The abnormal b2a2 and b3a2 BCR-ABL fusions create novel protein sequences that contain foreign peptides at the junction of BCL and ABL. Disclosed herein is how these foreign peptides and their derivatives are used as neoantigen epitopes for vaccine design.

A challenge for the design of peptide vaccines is the diversity of human MHC alleles (HLA alleles) that each have specific preferences for the peptide sequences they will display. The Human Leukocyte Antigen (HLA) loci, located within the MHC, encode the HLA class I and class II molecules. There are three classical class I loci (HLA-A, HLA-B, and HLA-C) and three loci that encode class II molecules (HLA-DR, HLA-DQ, and HLA-DP). An individual's HLA type describes the alleles they carry at each of these loci. Peptides of length of between about 8 and about 11 residues can bind to HLA class I (or MHC class I) molecules whereas those peptides of length of between about 13 and about 25 residues bind to HLA class II (or MHC class II) molecules (Rist et al., 2013; Chicz et al., 1992). Human populations that originate from different geographies have differing frequencies of HLA alleles, and these populations exhibit linkage disequilibrium between HLA loci that result in population specific haplotype frequencies. In some embodiments, methods are disclosed for creating effective vaccines that include consideration of the HLA allelic frequency in the target population, as well as linkage disequilibrium between HLA genes to achieve a set of peptides that is likely to be robustly displayed.

The present disclosure provides for compositions, systems, and methods of vaccine designs that produce immunity to single or multiple targets. In some embodiments, a target is a neoantigen protein sequence, a pathogen proteome, or any other undesired protein sequence that is non-self and is expected to be bound and displayed by an HLA molecule (also referred to herein as an HLA allele). When a target is present in an individual, it may result in multiple peptide sequences that are displayed by a variety of HLA alleles. In some embodiments, it may be desirable to create a vaccine that includes selected self-peptides, and thus these selected self-peptides are considered to be the target peptides for this purpose.

The term peptide-HLA binding is defined to be the binding of a peptide to an HLA allele, and can either be computationally predicted, experimentally observed, or computationally predicted using experimental observations. The metric of peptide-HLA binding can be expressed as affinity, percentile rank, binary at a predetermined threshold, probability, or other metrics as are known in the art. The term peptide-HLA immunogenicity metric is defined as the activation of T cells based upon their recognition of a peptide when bound by an HLA allele. The term peptide-HLA immunogenicity score is another term for a peptide-HLA immunogenicity metric, and the terms are interchangeable. A peptide-HLA immunogenicity metric can vary from individual to individual, and the metric for peptide-HLA immunogenicity can be expressed as a probability, a binary indicator, or other metric that relates to the likelihood that a peptide-HLA combination will be immunogenic. In some embodiments, peptide-HLA immunogenicity is defined as the induction of immune tolerance based upon the recognition of a peptide when bound by an HLA allele. A peptide-HLA immunogenicity metric can be computationally predicted, experimentally observed, or computationally predicted using experimental observations. In some embodiments, a peptide-HLA immunogenicity metric is based only upon peptide-HLA binding, since peptide-HLA binding is necessary for peptide-HLA immunogenicity. In some embodiments, peptide-HLA immunogenicity data or computational predictions of peptide-HLA immunogenicity can be included and combined with scores for peptide display in the methods disclosed herein. One way of combining the scores is using immunogenicity data for peptides assayed for immunogenicity in diseased or vaccinated individuals and assigning peptides to the HLA allele that displayed them in the individual by choosing the HLA allele that computational methods predict has the highest likelihood of display. For peptides that are not experimentally assayed, computational predictions of display can be used. In some embodiments, different computational methods of predicting peptide-HLA immunogenicity or peptide-HLA binding can be combined (Liu et al., 2020b). For a given set of peptides and a set of HLA alleles, the term peptide-HLA hits is the number of unique combinations of peptides and HLA alleles that exhibit peptide-HLA immunogenicity or binding at a predetermined threshold. For example, a peptide-HLA hit of 2 can mean that one peptide is predicted to be bound (or trigger T cell activation) by two different HLA alleles, two peptides are predicted to be bound (or trigger T cell activation) by two different HLA alleles, or two peptides are predicted to be bound (or trigger T cell activation) by the same HLA allele. For a given set of peptides and HLA frequencies, HLA haplotype frequencies, or HLA diplotype frequencies, the expected number of peptide-HLA hits is the average number of peptide-HLA hits in each set of HLAs that represent an individual, weighted by their frequency of occurrence.

Because immunogenicity may vary from individual to individual, one method to increase the probability of vaccine efficacy is to use a diverse set of target peptides (e.g., at least two peptides) to increase the chances that some subset of them will be immunogenic in a given individual. Prior research using mouse models has shown that most MHC displayed peptides are immunogenic, but immunogenicity varies from individual to individual as described in Croft et al. (2019). In some embodiments, experimental peptide-HLA immunogenicity data are used to determine which target peptides and their modifications will be effective immunogens in a vaccine.

Considerations for the design of peptide vaccines, are outlined in Liu et al., Cell Systems 11, Issue 2, p. 131-146 (Liu et al., 2020) and (Liu et al., 2020b) and U.S. Pat. No. 11,058,751 which are incorporated by reference in their entireties herein.

Certain target peptides may not bind with high affinity to a wide range of HLA molecules. To increase the binding of target peptides to HLA molecules, their amino acid composition can be altered to change one or more anchor residues or other residues. In some embodiments, to increase the immunogenicity of a target peptide when displayed by HLA molecules, a target peptide's amino acid composition can be altered to change one or more residues. Anchor residues are amino acids that interact with an HLA molecule and have the largest influence on the affinity of a peptide for an HLA molecule. Peptides with one or more altered amino acid residues are called heteroclitic peptides. In some embodiments, heteroclitic peptides include target peptides with residue modifications at anchor positions. In some embodiments, heteroclitic peptides include target peptides with residue modifications at non-anchor positions. In some embodiments, heteroclitic peptides include target peptides with residue modifications that include unnatural amino acids and/or amino acid derivatives. Modifications to create heteroclitic peptides can improve the binding of peptides to both MHC class I and MHC class II molecules, and the modifications required can be both peptide and MHC class specific. Since peptide anchor residues face the MHC molecule groove, they are less visible than other peptide residues to T cell receptors. Thus, heteroclitic peptides with anchor residue modifications have been observed to induce a T cell response where the stimulated T cells also respond to unmodified peptides. It has been observed that the use of heteroclitic peptides in a vaccine can improve a vaccine's effectiveness (Zirlik et al., 2006). In some embodiments, the immunogenicity of heteroclitic peptides are experimentally determined and their ability to activate T cells that also recognize the corresponding base (also called seed) peptide of the heteroclitic peptide is determined, as is known in the art (Houghton et al., 2007). In some embodiments, these assays of the immunogenicity and cross-reactivity of heteroclitic peptides are performed when the heteroclitic peptides are displayed by specific HLA alleles.

Peptide Vaccines to Induce Immunity to One or More Targets

In some embodiments, a method is provided for formulating peptide vaccines using a single vaccine design for one or more targets. In some embodiments, a single target is a foreign protein with a specific mutation (e.g., KRAS G12D). In some embodiments, a single target is a self-protein (e.g., a protein that is overexpressed in tumor cells such as cancer/testis antigens). In some embodiments, a single target is a pathogen protein (e.g., a protein contained in a viral proteome). In some embodiments, multiple targets can be used (e.g., foreign peptides derived from BCL-ABL transcripts b2a2 and b3a2).

In some embodiments, the method includes extracting peptides to construct a candidate set from all target proteome sequences (e.g., entire KRAS G12D protein) as described in Liu et al. (2020).

Figure 2:
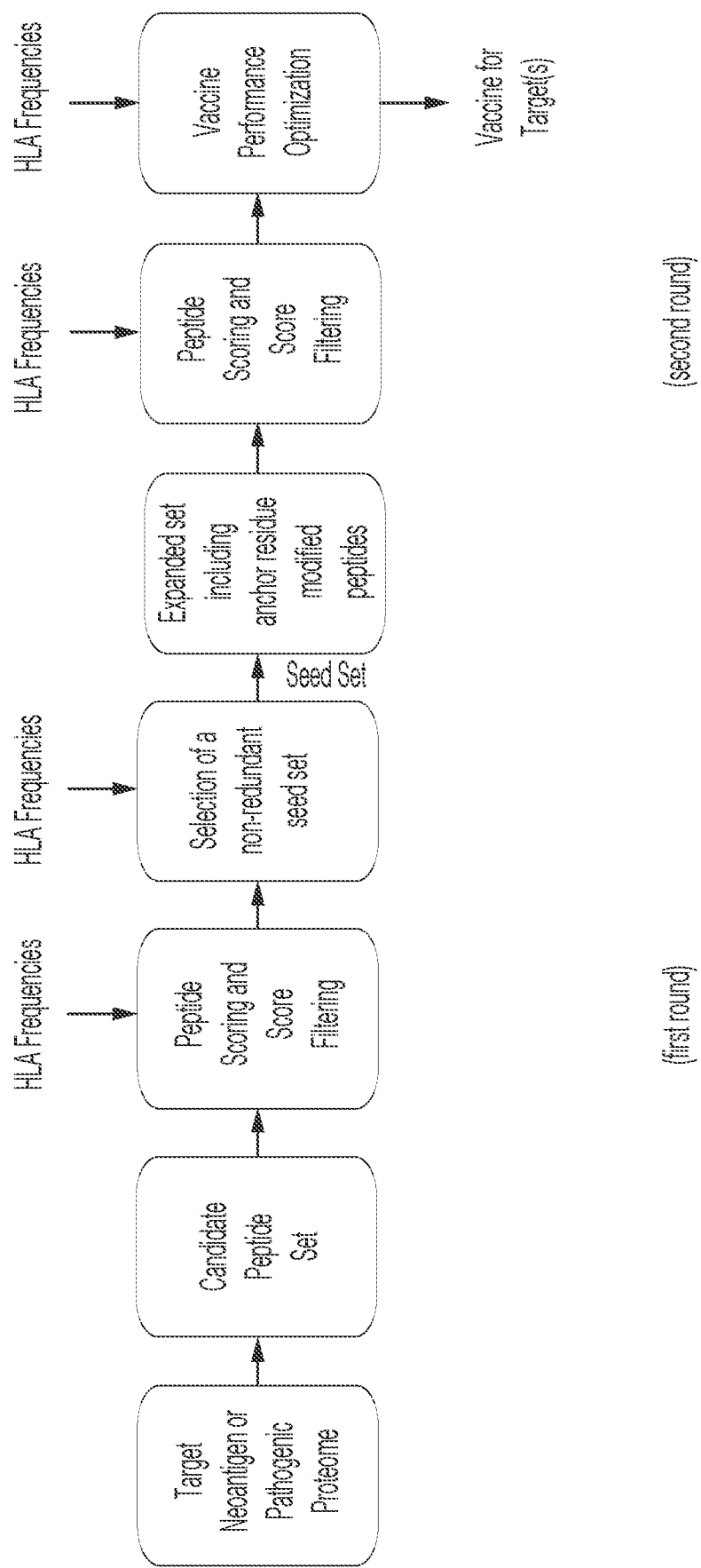
FIG. 2 is a flow chart of a vaccine optimization method with seed set compression.

FIGS. 1 and 2 depict flow charts for example vaccine design methods that can be used for MHC class I or MHC class II vaccine design. A Candidate Peptide Set (see FIGS. 1 and 2) is comprised of target peptides extracted by windowing an input protein sequence. In some embodiments, extracted target peptides are of amino acid length of between about 8 and about 10 (e.g., for MHC class I binding (Rist et al., 2013)). In some embodiments, the extracted target peptides presented by MHC class I molecules are longer than 10 amino acid residues, such as 11 residues (Trolle et al., 2016). In some embodiments, extracted target peptides are of length between about 13 and about 25 (e.g., for class II binding (Chicz et al., 1992)). In some embodiments, sliding windows of various size ranges described herein are used over the entire proteome. In some embodiments, other target peptide lengths for MHC class I and class II sliding windows can be utilized. In some embodiments, computational predictions of proteasomal cleavage are used to filter or select peptides in the candidate set. One computational method for predicting proteasomal cleavage is described by Nielsen et al. (2005). In some embodiments, peptide mutation rates, glycosylation, cleavage sites, or other criteria can be used to filter peptides as described in Liu et al. (2020). In some embodiments, peptides can be filtered based upon evolutionary sequence variation above a predetermined threshold. Evolutionary sequence variation can be computed with respect to other species, other pathogens, other pathogen strains, or other related organisms. In some embodiments, a first peptide set is the candidate set.

In some embodiments, for the design of vaccines for foreign peptides that are generated by abnormal gene fusions, target peptides are extracted for inclusion in the Candidate Peptide Set from the gene fusion product where each extracted target peptide includes the breakpoint between the two genes. For example, in some embodiments for the design of the BCR-ABL vaccines, the BCR-ABL b3a2 (e14a2) and b2a2 (e13a2) chimeric protein sequences were obtained from NCBI (GenBank ID CAA10376.1 and CAA10377.1, respectively). For each isoform, sliding windows of length 8-11 (MHC class I) and 13-25 (MHC class II) were extracted around the BCR-ABL breakpoint. Sliding windows can be extracted using the procedures described herein in "MHC Class I Vaccine Design Procedure" and "MHC Class II Vaccine Design Procedure" where $P_{1 \ldots n}$ contains the chimeric protein sequence, t specifies the position of the breakpoint in the chimeric protein sequence, and s=true. For b3a2, the BCR-ABL junction disrupts a triplet codon, yielding a novel lysine ("K") at the breakpoint (Clark et al., 2001). For b2a2, a codon disruption at the junction causes Asp to be altered to Glu, but this novel amino acid is also present at the normal a1a2 junction (Clark et al., 2001). Thus, for b3a2, all resulting windows spanning the "K" breakpoint were retained. For b2a2, only windows containing the sequence "KEE" were retained, eliminating windows that are found solely in BCR or ABL protein sequences. This procedure can be applied to generating vaccines for other abnormal gene fusions by identifying the breakpoint between the fused genes and utilizing the described windowing strategy.

As shown in FIGS. 1-2, in some embodiments, the next step of the method includes scoring the target peptides in the candidate set for peptide-HLA binding to all considered HLA alleles as described in Liu et al. (2020) and Liu et al. (2020b). In some embodiments, a first peptide set is the candidate set after scoring the target peptides. Scoring can be accomplished for human HLA molecules, mouse H-2 molecules, swine SLA molecules, or MHC molecules of any species for which prediction algorithms are available or can be developed. Thus, vaccines targeted at non-human species can be designed with the method. Scoring metrics can include the affinity for a target peptide to an HLA allele in nanomolar, eluted ligand, presentation, and other scores that can be expressed as percentile rank or any other metric. The candidate set may be further filtered to exclude peptides whose predicted binding cores do not contain a particular pathogenic or neoantigen target residue of interest or whose predicted binding cores contain the target residue in an anchor position. The candidate set may also be filtered for target peptides of specific lengths, such as length 9 for MHC class I, for example. In some embodiments, scoring of target peptides is accomplished with experimental data or a combination of experimental data and computational prediction methods. When computational models are unavailable to make peptide-HLA binding predictions for particular (peptide, HLA) pairs, the binding value for such pairs can be defined by the mean, median, minimum, or maximum immunogenicity value taken over supported pairs, a fixed value (such as zero), or inferred using other techniques, including a function of the prediction of the most similar (peptide, HLA) pair available in the scoring model.

In some embodiments, foreign peptides created by abnormal gene fusions are not eliminated when they contain a fusion breakpoint that falls on an MHC Class I or Class II anchor position for an HLA allele. For example, for the design of the BCL-ABL vaccines for MHC class I, no windows are eliminated when the BCR-ABL breakpoint falls within a peptide anchor position. For MHC class II, the scoring model requires the breakpoint to lie within the predicted 9-mer binding core for a given HLA (in any position), and scores for peptide-HLA pairs not meeting this criterion are eliminated. In some embodiments, for the design of BCR-ABL vaccines for MHC class I, windows are eliminated if the BCR-ABL breakpoint falls within a peptide anchor position. In some embodiments, for the design of BCR-ABL vaccines for MHC class II, peptide-HLA scores are eliminated if the BCR-ABL breakpoint lies within an anchor position of the predicted 9-mer binding core for a given peptide-HLA pair. In some embodiments, for the design of MHC class II vaccines, the gene fusion breakpoint can lie in any position either inside or outside of the predicted 9-mer binding core for a given peptide-HLA pair.

In some embodiments, a base set (also referred to as seed set herein) is constructed by selecting peptides from the scored candidate set using individual peptide-HLA binding or immunogenicity criteria (e.g., first peptide set) (FIG. 1). In some embodiments, since a given peptide has multiple peptide-HLA scores, the selection can be based on the peptide-HLA binding score or peptide-HLA immunogenicity metric with the best affinity or highest immunogenicity (e.g., predicted to bind the strongest or activate T cells the most for a given HLA allele). The criteria used for scoring peptide-HLA binding during the scoring procedure can accommodate different goals during the base set selection and vaccine design phases. For example, a target peptide with peptide-HLA binding affinities of 500 nM may be displayed by an individual that is diseased, but at a lower frequency than a target peptide with a 50 nM peptide-HLA binding affinity. During the combinatorial design phase of a vaccine, a more constrained affinity criteria may be used (e.g., when selecting a third peptide set, the Vaccine for Target(s) in FIGS. 1 and 2), such a 50 nM, to increase the probability that a vaccine peptide will be found and displayed by HLA molecules. In some embodiments, a relatively less constrained threshold (e.g., less than about 1000 nM or less than about 500 nM) of peptide-HLA immunogenicity or peptide-HLA binding is used as a first threshold for filtering candidate peptide-HLA scores (the first Peptide Scoring and Score Filtering step in FIGS. 1 and 2) and a relatively more constrained second threshold (e.g., less than about 50 nM) is used for filtering expanded set peptide-HLA scores (the second Peptide Filtering and Scoring step in FIGS. 1 and 2) for their scores for specific HLA alleles. In some embodiments, specific peptide-HLA scores are not used for modified peptides for a given HLA for vaccine design when their unmodified counterpart peptide does not pass the first less constrained threshold. This filtering of peptide-HLA scores is based on the observation that peptides that are not immunogenic enough for vaccine inclusion may be antigenic (meet the first threshold) and thus recognized by T cell clonotypes expanded by a vaccine. A peptide is antigenic when it is recognized by a T cell receptor and results in a response such as CD8+ T cell cytotoxicity or CD4+ cell activation. Derivatives of an antigenic peptide may be strongly immunogenic, included in a vaccine, and thus activate and expand T cells that recognize the antigenic peptide. The expansion of T cells that recognize an unmodified antigenic peptide can provide an immune response that contributes to disease control. In some embodiments, peptides are scored for third peptide set (Vaccine for Target(s) in FIGS. 1 and 2) potential inclusion that have peptide-HLA binding affinities less than about 500 nM. In some embodiments, peptides are selected for the base set that have peptide-HLA binding affinities less than about 1000 nM for at least one HLA allele. Alternatively, predictions of peptide-HLA immunogenicity can be used to qualify target peptides for base set inclusion. In some embodiments, experimental observations of the immunogenicity of peptides in the context of their display by HLA alleles or experimental observation of the binding of peptides to HLA alleles can be used to score peptides for binding to HLA alleles or peptide-HLA immunogenicity.

In some embodiments, experimental observations of the display of peptides by specific HLA alleles in tumor cells can be used to score peptides for peptide-HLA binding or peptide-HLA immunogenicity. In some embodiments, experimental observations of the display of peptides tumor cells by a specific HLA allele can be used to score peptides for peptide-HLA binding or peptide-HLA immunogenicity for that HLA allele. In some embodiments, experimental observations of the display of peptides tumor cells can be used to score peptides for peptide-HLA binding or peptide-HLA immunogenicity, with the HLA allele(s) for a specific observed peptide selected from the HLA alleles present in the tumor that meet a predicted peptide-HLA binding or immunogenicity threshold. In some embodiments, mass spectrometry is used to experimentally determine the display of peptides by tumor cells as described by Bear et al. (2021) or Wang et al. (2019) and these data are used to score for peptide-HLA binding or peptide-HLA immunogenicity. In some embodiments, mass spectrometry is used to experimentally determine the display of peptides by tumor cells, and these experimental data are used to qualify the inclusion of base set (seed set) peptides for one or more HLA alleles for a vaccine. In some embodiments, mass spectrometry is used to experimentally determine the display of a peptide by tumor cells, and these experimental data are used to exclude peptide-HLA binding scores or peptide-HLA immunogenicity scores for the peptide when the peptide is not observed to be displayed by an HLA allele by mass spectrometry. In some embodiments, mass spectrometry is used to experimentally determine the display of peptides by tumor cells in an individual, and these experimental data are used to qualify the inclusion of base set (seed set) peptides for that individual for one or more HLA alleles. In some embodiments, mass spectrometry is used to experimentally determine the display of a peptide by tumor cells in an individual, and these experimental data are used to exclude peptide-HLA binding scores or peptide-HLA immunogenicity scores for the peptide when the peptide is not observed to be displayed by an HLA allele by mass spectrometry. In some embodiments, computational predictions of the immunogenicity of a peptide in the context of display by HLA alleles can used for scoring such as the methods of Ogishi et al. (2019) or Bulik-Sullivan et al. (2019).

In some embodiments, a peptide-HLA score or a peptide-HLA immunogenicity score for a first peptide in the base set (seed set) for a given HLA allele is eliminated and not considered during vaccine design if the wild-type peptide corresponding to the first peptide (e.g. the unmutated naturally occurring form for the peptide or a peptide in the respective species within a defined sequence edit distance) has a peptide-HLA score or a peptide-HLA immunogenicity score for the same HLA allele within a defined threshold. The threshold can be based upon the difference of the scores of the first peptide and the wild-type peptide, the ratio of the scores of the first peptide and the wild-type peptide, the score of the wild-type peptide, or other metrics. The defined threshold can be either greater than or less than a specified value. In some embodiments, the threshold is defined so that the wild-type peptide is not predicted to be presented. In some embodiments, when a peptide-HLA score or peptide-HLA immunogenicity score is eliminated for a first peptide during vaccine design, then peptide-HLA scores or peptide-HLA immunogenicity scores for all of its derivatives (e.g., heteroclitic peptide derivatives) for the same HLA allele are also eliminated and not considered during vaccine design.

In some embodiments, the method further includes running the OptiVax-Robust algorithm as described in Liu et al. (2020) using the HLA haplotype frequencies of a population on the scored candidate set to construct a base set (also referred to as seed set herein) of target peptides (FIG. 2). In some embodiments, HLA diplotype frequencies can be provided to OptiVax. OptiVax-Robust includes algorithms to eliminate peptide redundancy that arises from the sliding window approach with varying window sizes, but other redundancy elimination measures can be used to enforce minimum edit distance constraints between target peptides in the candidate set. The size of the seed set is determined by a point of diminishing returns of population coverage as a function of the number of target peptides in the seed set. Other criteria can also be used, including a minimum number of vaccine target peptides, maximum number of vaccine target peptides, and desired predicted population coverage. In some embodiments, a predetermined population coverage is less than about 0.4, between about 0.4 and 0.5, between about 0.5 and 0.6, between about 0.6 and 0.7, between about 0.7 and 0.8, between about 0.8 and 0.9, or greater than about 0.9. Another possible criterion is a minimum number of expected peptide-HLA binding hits in each individual. In alternate embodiments, the method further includes running the OptiVax-Unlinked algorithm as described in Liu et al. (2020) instead of OptiVax-Robust.

The OptiVax-Robust method uses binary predictions of peptide-HLA immunogenicity, and these binary predictions can be generated as described in Liu et al. (2020b). The OptiVax-Unlinked method uses the probability of target peptide binding to HLA alleles and can be generated as described in Liu et al. (2020). In some embodiments, OptiVax-Unlinked and EvalVax-Unlinked are used with the probabilities of peptide-HLA immunogenicity. Either method can be used for the purposes described herein, and thus the term "OptiVax" refers to either the Robust or Unlinked method. In some embodiments, the HLA haplotype or HLA allele frequencies of a population provided to OptiVax for vaccine design describe the world's population. In alternative embodiments, the HLA haplotype or HLA allele frequencies of a population provided to OptiVax for vaccine design are specific to a geographic region. In alternative embodiments, the HLA haplotype or HLA allele frequencies of a population provided to OptiVax for vaccine design are specific to an ancestry. In alternative embodiments, the HLA haplotype or HLA allele frequencies of a population provided to OptiVax for vaccine design are specific to a race. In alternative embodiments, the HLA haplotype or HLA allele frequencies of a population provided to OptiVax for vaccine design are specific to individuals with risk factors such as genetic indicators of risk, age, exposure to chemicals, alcohol use, chronic inflammation, diet, hormones, immunosuppression, infectious agents, obesity, radiation, sunlight, or tobacco use. In alternative embodiments, the HLA haplotype or HLA allele frequencies of a population provided to OptiVax for vaccine design are specific to individuals that carry certain HLA alleles. In alternative embodiments, the HLA diplotypes provided to OptiVax for vaccine design describe a single individual and are used to design an individualized vaccine.

In some embodiments, the base (or seed) set of target peptides (e.g., first peptide set) that results from OptiVax application to the candidate set of target peptides describes a set of unmodified target peptides that represent a possible compact vaccine design (Seed Set in FIG. 2). A base peptide is a target peptide that is included in the base or seed peptide set (e.g., first peptide set). In some embodiments, the seed set (e.g., first peptide set) is based upon filtering candidate peptide scores by predicted or observed affinity or immunogenicity with respect to HLA molecules (Seed Set in FIG. 1). However, to improve the display of the target peptides in a wide range of HLA haplotypes as possible, some embodiments include modifications of the seed (or base) set. In some embodiments, experimental assays can be used to ensure that a modified seed (or base) peptide activates T cells that also recognize the base/seed peptide.

For a given target peptide, the optimal anchor residue selection may depend upon the HLA allele that is binding to and displaying the target peptide and the class of the HLA allele (MHC class I or class II). A seed peptide set (e.g., first peptide set) can become an expanded set by including anchor residue modified peptides of either MEW class I or II peptides (FIGS. 1-2). Thus, one aspect of vaccine design is considering how to select a limited set of heteroclitic peptides that derive from the same target peptide for vaccine inclusion given that different heteroclitic peptides will have different and potentially overlapping population coverages.

In some embodiments, all possible anchor modifications for each base set of target peptide are considered. There are typically two anchor residues in peptides bound by MHC class I molecules, typically at positions 2 and 9 for 9-mer peptides. In some embodiments, anchors for 8-mers, 10-mers, and 11-mers are found at positions 2 and n, where n is the last position (8, 10, and 11, respectively). For MHC class I molecules, the last position n is called the "C" position herein for carboxyl terminus. In some embodiments, at each anchor position, 20 possible amino acids are attempted in order to select the best heteroclitic peptides. Thus, for MEW class I binding, 400 (i.e., 20 amino acids by 2 positions=$20^2$) minus 1 heteroclitic peptides are generated for each base target peptide. There are typically four anchor residues in peptides bound by MHC class II molecules, typically at positions 1, 4, 6, and 9 of the 9-mer binding core. Thus, for MHC class II binding there are 160,000 (i.e., 20 amino acids by 4 positions=$20^4$) minus 1 heteroclitic peptides generated for each base target peptide. In some embodiments, more than two (MHC class I) or four (MEW class II) positions are considered as anchors. Other methods, including Bayesian optimization, can be used to select optimal anchor residues to create heteroclitic peptides from each seed (or base) set peptide. Other methods of selecting optimal anchor residues are presented in "Machine learning optimization of peptides for presentation by class II MHCs" by Dai et al. (2020), incorporated in its entirety herein. In some embodiments, the anchor positions are determined by the HLA allele that presents a peptide, and thus the set of heteroclitic peptides includes for each set of HLA specific anchor positions, all possible anchor modifications.

In some embodiments, for all of the target peptides in the base/seed set, new peptide sequences with all possible anchor residue modifications (e.g., MHC class I or class II) are created resulting in a new heteroclitic base set (Expanded set in FIGS. 1-2) that includes all of the modifications. In some embodiments, anchor residue modifications of a peptide are not included in the heteroclitic base set if one or more of the peptide's anchor residue positions contains a substitution mutation that distinguishes the peptide from a self-peptide. In some embodiments, anchor residue modifications of a base/seed peptide are only included in the heteroclitic base set for peptide positions that do not contain a substitution mutation that distinguishes the base/seed peptide from a self-peptide. In some embodiments, anchor residue modifications of a peptide are not included in the heteroclitic base set when one or more of the peptide's mutations does not occur between a pair of its adjacent anchor residues. In some embodiments, for all of the target peptides in the base/seed set, new peptide sequences with anchor residue modifications (e.g., MEW class I or class II) at selected anchor locations are created resulting in a new heteroclitic base set (Expanded set in FIGS. 1-2) that includes the selected modifications. In some embodiments, the anchor residue positions used for modifying peptides are selected from anchor residue positions determined by the HLA alleles considered during vaccine evaluation. In some embodiments, the heteroclitic base set (Expanded set in FIGS. 1-2) also includes the original seed (or base) set (Seed Peptide Set in FIGS. 1-2). In some embodiments, the heteroclitic base set includes amino acid substitutions at non-anchor residues. In some embodiments, modifications of base peptide residues is accomplished to alter binding to T cell receptors to improve therapeutic efficacy (Candia, et al. 2016). In some embodiments, the heteroclitic base set includes amino acid substitutions of non-natural amino acid analogs. The heteroclitic base set is scored for HLA affinity, peptide-HLA immunogenicity, or other metrics as described herein (another round of Peptide Scoring and Score Filtering as shown in FIGS. 1-2). In some embodiments, the scoring predictions may be further updated for pairs of heteroclitic peptide and HLA allele, eliminating pairs where a heteroclitic peptide has a seed (or base) peptide from which it was derived that is not predicted to be displayed by the HLA allele at a specified threshold of peptide-HLA binding score or a specified peptide-HLA immunogenicity metric. In some embodiments, the peptide-HLA scores may also be filtered to ensure that predicted binding cores of the heteroclitic peptide displayed by a particular HLA allele align exactly in position with the binding cores of the respective seed (or base) set target peptide for that HLA allele. In some embodiments, the scoring predictions are filtered for an HLA allele to ensure that the heteroclitic peptides considered for that HLA allele are only modified at anchor positions determined by that HLA allele. Scoring produces a metric of peptide-HLA immunogenicity for peptides and HLA alleles that can be either binary, a probability of immunogenicity, or other metric of immunogenicity such as peptide-HLA affinity or percent rank, and can be based on computational predictions, experimental observations, or a combination of both computational predictions and experimental observations. In some embodiments, probabilities of peptide-HLA immunogenicity are utilized by OptiVax-Unlinked. In some embodiments, heteroclitic peptides are included in experimental assays such as MIRA (Klinger et al., 2015) or ELISPOT to determine their peptide-HLA immunogenicity metric with respect to specific HLA alleles. In some embodiments, the methods of Liu et al. (2020b), can be used to incorporate MIRA data for heteroclitic peptides into a model of peptide-HLA immunogenicity. In some embodiments, peptide-HLA immunogenicity metrics of heteroclitic peptides are experimentally determined and their ability to activate T cells that also recognize the corresponding seed (or base) peptide of the heteroclitic peptide is performed as is known in the art to qualify the heteroclitic peptide for vaccine inclusion (e.g. Houghton et al., 2007). In some embodiments, these assays of the immunogenicity and cross-reactivity of heteroclitic peptides are performed when the heteroclitic peptides are displayed by specific HLA alleles.

In some embodiments, experimental observations of the display of heteroclitic peptides by specific HLA alleles in cells can be used to score peptides for peptide-HLA binding or peptide-HLA immunogenicity. In some embodiments, mass spectrometry is used to experimentally determine the display of heteroclitic peptides by cells as described by Bear et al. (2021) or Wang et al. (2019) and these data are used to score for peptide-HLA binding or peptide-HLA immunogenicity. In some embodiments, mass spectrometry is used to experimentally determine the display of heteroclitic peptides by cells, and these experimental data are used to qualify the inclusion of heteroclitic peptides for inclusion in a vaccine. In some embodiments, mass spectrometry is used to experimentally determine the display of a peptide by tumor cells, and these experimental data are used to exclude peptide-HLA binding scores or peptide-HLA immunogenicity scores for the peptide when the peptide is not observed to be displayed by an HLA allele by mass spectrometry. In some embodiments, mass spectrometry is used to experimentally determine the display of a heteroclitic peptide by cells with an HLA allele found in an individual, and these experimental data are used to qualify the inclusion of the heteroclitic peptide for inclusion in a vaccine for the individual. In some embodiments, mass spectrometry is used to experimentally determine the display of a peptide by tumor cells in an individual, and these experimental data are used to exclude peptide-HLA binding scores or peptide-HLA immunogenicity scores for the peptide when the peptide is not observed to be displayed by an HLA allele by mass spectrometry. In some embodiments, computational predictions of the immunogenicity of a heteroclitic peptide in the context of display by HLA alleles can used for scoring such as the methods of Ogishi et al. (2019) or Bulik-Sullivan et al. (2019).

In some embodiments, a peptide in the heteroclitic base set is removed if (1) one of its anchor positions for an HLA allele corresponds to the location of a mutation in the base/seed peptide from which it was derived that distinguishes the base/seed peptide from a self-peptide, and (2) if the peptide-HLA binding or peptide-HLA immunogenicity of the self-peptide is stronger than a specified threshold for self-peptide binding or immunogenicity. This eliminates peptides in the heteroclitic base set that may cross-react with self-peptides as a result of sharing TCR facing residues with self-peptides. In some embodiments, the threshold for self-peptide binding is between approximately 500 nM to 1000 nM.

In some embodiments, redundant peptides in the heteroclitic base set are removed. In some embodiments, a redundant peptide is a first heteroclitic peptide that has peptide-HLA immunogenicity scores or peptide-HLA binding scores that are less immunogenic for all scored HLAs than a second heteroclitic peptide in the heteroclitic base set, where both the first and second heteroclitic peptides are derived from the same base (or seed) peptide. In some embodiments, peptide redundancy is determined by only comparing peptide-HLA immunogenicity scores or peptide-HLA binding scores for HLA alleles where the peptide-HLA immunogenicity scores or peptide-HLA binding scores for both peptides for an HLA allele are more immunogenic than a given threshold (e.g., 50 nM for binding). In some embodiments, a redundant peptide is a first heteroclitic peptide that has an average peptide-HLA immunogenicity score or peptide-HLA binding score that is less immunogenic than the average peptide-HLA immunogenicity score or peptide-HLA binding score of a second heteroclitic peptide in the heteroclitic base set, where both the first and second heteroclitic peptides are derived from the same base (or seed) peptide, and the average scores are computed for HLA alleles where the peptide-HLA immunogenicity scores or peptide-HLA binding scores for both peptides for an HLA allele are more immunogenic than a given threshold (e.g., 50 nM for binding). In some embodiments, a redundant peptide is a first heteroclitic peptide that has a weighted peptide-HLA immunogenicity score or peptide-HLA binding score that is less immunogenic than the weighted peptide-HLA immunogenicity score or peptide-HLA binding score of a second heteroclitic peptide in the heteroclitic base set, where both the first and second heteroclitic peptides are derived from the same base (or seed) peptide, and where the weighting is determined by the frequency of the HLA allele in a human population, and the weighted scores are computed for HLA alleles where the peptide-HLA immunogenicity scores or peptide-HLA binding scores for both peptides for an HLA allele are more immunogenic that a given threshold (e.g., 50 nM for binding).

In some embodiments, the next step involves scoring the heteroclitic base set (the second peptide set) and filtering the resulting scores to create a second peptide set by comparing the peptide-HLA immunogenicity scores or peptide-HLA binding scores of the peptides for one or more HLA alleles to a threshold. In some embodiments, an affinity criterion of about 50 nM is used to increase the probability that a vaccine peptide will be found and displayed by HLA molecules. In some embodiments, the affinity criteria is more constrained than 50 nM (i.e., <50 nM). In some embodiments, the affinity criteria is more constrained than about 500 nM (i.e., <500 nM). In some embodiments, individual peptide-HLA binding scores or immunogenicity metrics are determined and thus a peptide may be retained as long as it meets the criteria for at least one HLA allele, and only peptide-HLA scores that meet the criteria are considered for vaccine design.

In some embodiments, the next step involves inputting the second peptide set to OptiVax to select a compact set of vaccine peptides that maximizes predicted vaccine performance (Vaccine Performance Optimization; FIGS. 1-2). In some embodiments, predicted vaccine performance is a function of expected peptide-HLA binding affinity (e.g., a function of the distribution of peptide-HLA binding affinities across all peptide-HLA combinations for a given peptide set, or weighted by the occurrence of the HLA alleles in a population or individual). In some embodiments, predicted vaccine performance is the expected population coverage of a vaccine. In some embodiments, predicted vaccine performance is the expected number peptide-HLA hits produced by a vaccine in a population or individual. In some embodiments, predicted vaccine performance requires a minimum expected number of peptide-HLA hits (e.g., 1, 2, 3, 4, 5, 6, 7, 8, or more) produced by a vaccine. In some embodiments, predicted vaccine performance is a function of population coverage and expected number of peptide-HLA hits desired produced by a vaccine. In some embodiments, predicted vaccine performance is a metric that describes the overall immunogenic properties of a vaccine where all of the peptides in the vaccine are scored for peptide-HLA immunogenicity for two or more HLA alleles (e.g., three or more HLA alleles). In some embodiments, predicted vaccine performance excludes immunogenicity contributions by selected HLA alleles above a maximum number of peptide-HLA hits (e.g., 1, 2, 3, 4, 5, 6, 7, 8, or more). In some embodiments, predicted vaccine performance excludes immunogenicity contributions of individual HLA diplotypes above a maximum number of peptide-HLA hits (e.g., 1, 2, 3, 4, 5, 6, 7, 8, or more). In some embodiments, predicted vaccine performance is the fraction of covered HLA alleles, which is the expected fraction of HLA alleles in each individual that have a minimum number of peptides (e.g., 1, 2, 3, 4, 5, 6, 7, 8, or more) with predicted peptide-HLA immunogenicity produced by a vaccine. In some embodiments, predicted vaccine performance is the expected fraction of HLA alleles in a single individual that have a minimum number of peptides (e.g., 1, 2, 3, 4, 5, 6, 7, 8, or more) with predicted peptide-HLA immunogenicity produced by a vaccine.

In some embodiments, a vaccine is designed by the iterative selection of peptides from the heteroclitic base set (also referred to as Expanded set as shown in FIGS. 1-2) at progressively less stringent criteria for predicted peptide immunogenicity or display. In some embodiments, a peptide is retained if at least one of its peptide-HLA scores is not eliminated by the thresholds employed. In some embodiments, OptiVax is first used to design a vaccine with a desired vaccine performance with specific peptide qualification criteria (e.g., seed HLA-peptide scores from the candidate set must bind to MHC molecules at 500 nM or stronger, and peptide-HLA scores from the expanded set must bind to MHC molecules at 50 nM or stronger). The vaccine that results from this application of OptiVax is then used as the foundation for vaccine augmentation with less stringent criteria (e.g., seed peptide-HLA scores from the candidate set must bind to MHC molecules at 1000 nM or stronger, and peptide-HLA scores from the expanded set must bind to MHC molecules at 100 nM or stronger) to further improve the desired vaccine performance. Methods for vaccine augmentation are described in Liu et al. (2020b), incorporated by reference in its entirety herein. In some embodiments, multiple rounds of vaccine augmentation may be utilized. In some embodiments, the final augmented vaccine is the one selected.

In some embodiments, selection of peptide sets to meet a desired predicted vaccine performance can be accomplished by computational algorithms other than OptiVax. In some embodiments, integer linear programming or mixed-integer linear programming is employed for selecting peptide sets instead of OptiVax. One example of an integer programming method for peptide set selection is described by Toussaint et al., 2008, incorporated by reference in its entirety herein. An example solver for mixed-integer linear programming is Python-MIP than can be used in conjunction with Toussaint et al., 2008. A second example of methods for vaccine peptide selection is described in "Maximum n-times Coverage for Vaccine Design" by Liu et al., 2021, incorporated by reference in its entirety herein.

Predicted vaccine performance refers to a metric. Predicted vaccine performance can be expressed as a single numerical value, a plurality of numerical values, any number of non-numerical values, and a combination thereof. The value or values can be expressed in any mathematical or symbolic term and on any scale (e.g., nominal scale, ordinal scale, interval scale, or ratio scale).

A seed (or base) peptide and all of the modified peptides that are derived from that seed (or base) peptide comprise a single peptide family. In some embodiments, in the component of vaccine performance that is based on peptide-HLA immunogenicity for a given HLA allele, a maximum number of peptides (e.g., 1, 2, 3, 4, 5, 6, 7, 8, or more) that are in the same peptide family are given computational immunogenicity credit for that HLA allele. This limit on peptide family immunogenicity limits the credit caused by many modified versions of the same base peptide. In some embodiments, the methods described herein are included for running OptiVax with an EvalVax objective function that corresponds to a desired metric of predicted vaccine performance. In some embodiments, population coverage means the proportion of a subject population that presents one or more immunogenic peptides that activate T cells responsive to a seed (or base) target peptide. The metric of population coverage is computed using the HLA haplotype frequency in a given population such as a representative human population. In some embodiments, the metric of population coverage is computed using marginal HLA frequencies in a population. Maximizing population coverage means selecting a peptide set (either a base peptide set, a modified peptide set, or a combination of base and modified peptides; e.g., a first peptide set, second peptide set, or third peptide set) that collectively results in the greatest fraction of the population that has at least a minimum number (e.g., 1, 2, 3, 4, 5, 6, 7, 8, or more) of immunogenic peptide-HLA bindings based on proportions of HLA haplotypes in a given population (e.g., representative human population). In some embodiments, this process includes the OptiVax selection of heteroclitic peptides (as described in this disclosure) that activate T cells that respond to their corresponding seed (or base) peptide and the heteroclitic base peptides to improve population coverage. In some embodiments, the seed (or base) target peptides are always included in the final vaccine design. In some embodiments, peptides are only considered as candidates for a vaccine design (e.g., included in a first, second, and/or third peptide set) if they have been observed to be immunogenic in clinical data, animal models, or tissue culture models.

Although heteroclitic peptides are used as exemplary embodiments in this disclosure, any modified peptide could be used in place of a heteroclitic peptide. A modified peptide is a peptide that has one or more amino acid substitutions of a target base/seed peptide. The amino acid substitution could be located at an anchor position or any other non-anchor position.

In some embodiments, a candidate vaccine peptide (e.g., a base peptide or a modified peptide) is eliminated from vaccine inclusion if it activates T cells that recognize self-peptides (e.g., this can be achieved at the first and/or second round of Peptide Filtering and Sorting as shown in FIGS. 1-2). In some embodiments, a candidate vaccine peptide (e.g., a base peptide or a modified peptide) is computationally eliminated from vaccine inclusion if its outward facing amino acids when bound by an HLA allele are similar to outward facing self-peptide residues that are presented by the same HLA allele, where similarity can be defined by identity or defined similarity metrics such as BLOSUM matrices (BLOSUM matrices are known in the art). Testing a vaccine peptide for its ability to activate T cells that recognize self-peptides can be experimentally accomplished by the vaccination of animal models followed by ELISPOT or other immunogenicity assay or with human tissue protocols. In both cases, models with HLA alleles that present the vaccine peptide are used. In some embodiments, human primary blood mononuclear cells (PBMCs) are stimulated with a vaccine peptide, the T cells are allowed to grow, and then T cell activation with a self-peptide is assayed as described in Tapia-Calle et al. (2019) or other methods as known in the art. In some embodiments, the vaccine peptide is excluded from vaccine inclusion if the T cells are activated by the self-peptide. In some embodiments, computational predictions of the ability of a peptide to activate T cells that also recognize self-peptides can be utilized. These predictions can be based upon the modeling of the outward facing residues from the peptide-HLA complex and their interactions with other peptide residues. In some embodiments, a candidate vaccine peptide (e.g., a base peptide or a modified peptide) is eliminated from vaccine inclusion or experimentally tested for cross-reactivity if it is predicted to activate T cells that also recognize self-peptides based upon the structural similarity of the peptide-MHC complex of the candidate peptide (e.g., a base peptide or a modified peptide) and the peptide-MHC complex of a self-peptide. One method for the prediction of peptide-MHC structure is described by Park et al. (2013).

In some embodiments, the peptide-HLA binding score or peptide-HLA immunogenicity metric for a candidate heteroclitic vaccine peptide (e.g., a modified peptide) and HLA allele is eliminated from consideration during vaccine design if the candidate heteroclitic vaccine peptide does not activate T cells that recognize its corresponding base/seed target peptide (second round of Peptide Scoring and Score Filtering, FIGS. 1-2) for the given HLA allele. In some embodiments, a heteroclitic vaccine peptide (e.g., a modified peptide) is eliminated from a vaccine design if the candidate heteroclitic vaccine peptide does not activate T cells that recognize its corresponding base/seed target peptide (second round of Peptide Scoring and Score Filtering, FIGS. 1-2) for a given HLA allele. Testing a candidate heteroclitic peptide (e.g., a modified peptide) for its ability to activate T cells that recognize its corresponding seed (or base) target peptide with respect to the same HLA allele can be experimentally accomplished by the vaccination of animal models followed by ELISPOT or other immunogenicity assay or with human tissue protocols. In both cases, models with HLA alleles that present the heteroclitic peptide are used. In some embodiments, human PBMCs are stimulated with the heteroclitic peptide, the T cells are allowed to grow, and then T cell activation with the seed (or base) target peptide is assayed as described in Tapia-Calle et al. (2019) or using other methods known in the art. In some embodiments, computational predictions of the ability of a heteroclitic peptide to activate T cells that also recognize the corresponding seed (or base) target peptide can be utilized. These predictions can be based upon the modeling of the outward facing residues from the peptide-HLA complex and their interactions with other peptide residues. In some embodiments, the structural similarity of the peptide-HLA complex of a heteroclitic peptide and the peptide-HLA complex of the corresponding seed (or base) target is used to qualify heteroclitic peptides for vaccine inclusion or to require experimental immunogenicity testing before vaccine inclusion.

TCR Interface Divergence (TCRID) is the Least Root Mean Square Deviation of the difference between a first peptide's TCR facing residues' 3D positions and the corresponding residue positions of a second peptide with respect to a specific HLA allele. In some embodiments, other metrics are used for the TCRID instead of Least Root Mean Square Deviation. In some embodiments, other metrics are used for the TCRID that include position deviations in non-TCR facing residues and MEW residues from the specific HLA allele. In some embodiments, TCRID is used to predict if two peptides when displayed by a given HLA allele will activate the same T cell clonotypes. In some embodiments, FlexPepDock (London et al., 2011, incorporated by reference in its entirety herein) or DINC (Antunes et al., 2018, incorporated by reference in its entirety herein) in conjunction with the crystal structures of HLA molecules can be used to compute TCRID metrics for pairs of peptides given an HLA molecule. In some embodiments, TCRID is computed by (1) determining the 3D peptide-HLA structures for two different peptides bound by a specific HLA allele, (2) aligning the HLA alpha helices of the peptide-HLA structures, and (3) computing the Least Root Mean Square Deviation of the difference between the TCR facing residues of the two peptides with respect to the aligned alpha helix reference frame.

In some embodiments, the second Peptide Scoring and Score Filtering step in FIGS. 1 and 2 will eliminate the peptide-HLA binding or immunogenicity score for a heteroclitic peptide for a specific HLA allele when the HLA specific TCRID between the heteroclitic peptide and its corresponding base (or seed) peptide from which it was derived is over a first TCRID threshold. In some embodiments, the second Peptide Scoring and Score Filtering step in FIGS. 1 and 2 will eliminate all peptide-HLA binding or immunogenicity scores for a heteroclitic peptide when a HLA specific TCRID between the heteroclitic peptide and its corresponding unmutated self-peptide from which it was derived is under a second TCRID threshold. In some embodiments, the first Peptide Scoring and Score Filtering step in FIGS. 1 and 2 will eliminate all peptide-HLA binding or immunogenicity scores for a candidate peptide when the HLA specific TCRID between the peptide and its corresponding unmutated self-peptide is under a third TCRID threshold. In some embodiments, any of the TCRID thresholds are determined by experimentally observing or computationally predicting the cross-reactivity of TCR molecules to peptide-HLA complexes.

Figure 3:
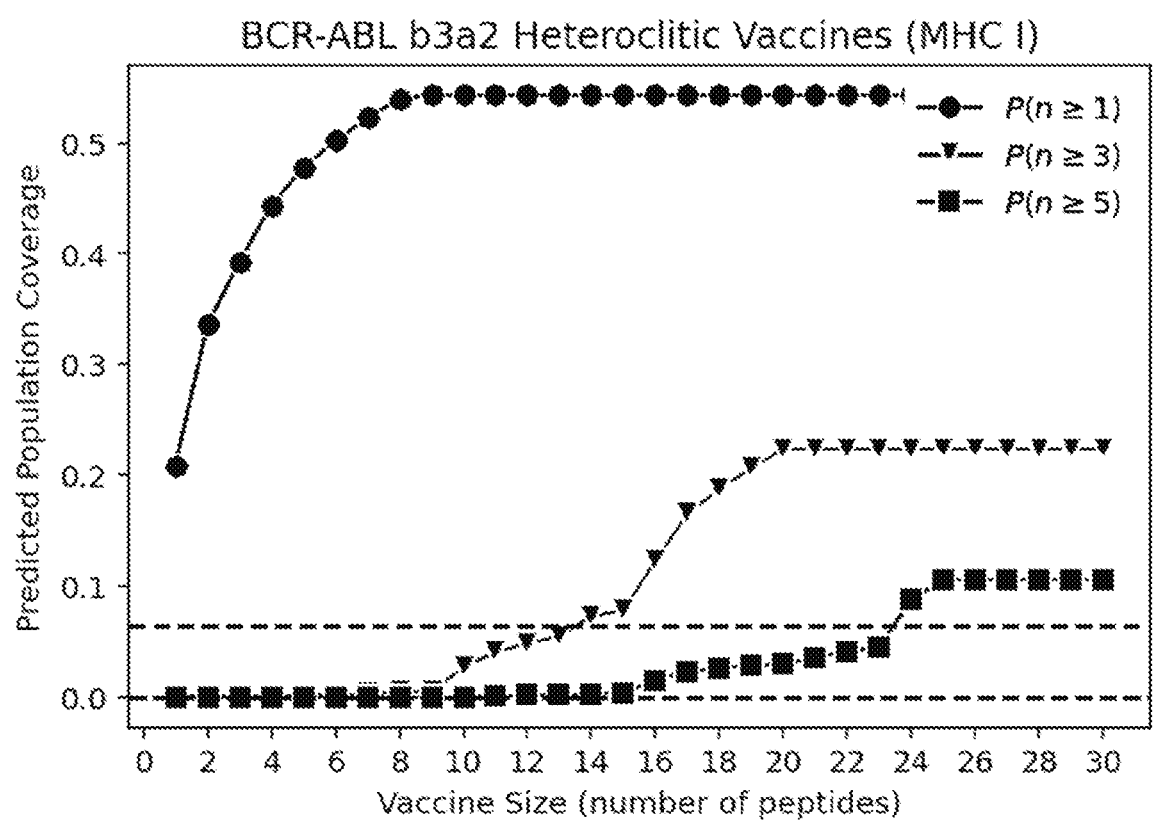
FIG. 3 is a graph showing predicted population coverage for MHC class I vaccines that include heteroclitic peptides by vaccine size for the BCR-ABL b3a2 fusion, for at least one peptide-HLA hit (circles), at least three peptide-HLA hits (triangles), and at least five peptide-HLA hits (squares). The dashed lines show the predicted population coverage of BCR-ABL b3a2 fusion vaccines without heteroclitic peptides for at least 1 (top dashed line) and 5 (bottom dashed line) peptide-HLA hits per-individual.
Figure 4:
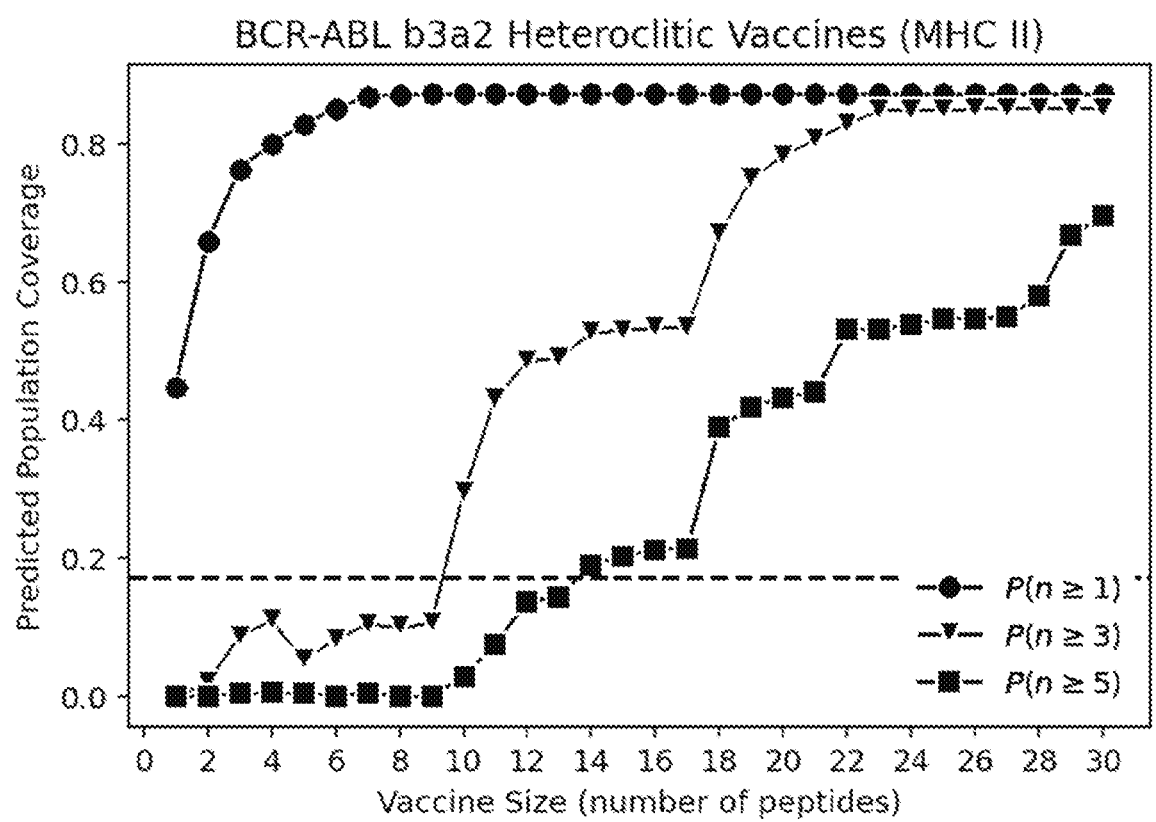
FIG. 4 is a graph showing predicted population coverage for MHC class II vaccines that include heteroclitic peptides by vaccine size for the BCR-ABL b3a2 fusion, for at least one peptide-HLA hit (circles), at least three peptide-HLA hits (triangles), and at least five peptide-HLA hits (squares). The dashed line shows the predicted population coverage of BCR-ABL b3a2 fusion vaccines without heteroclitic peptides for at least one peptide-HLA hit per-individual.
Figure 5:
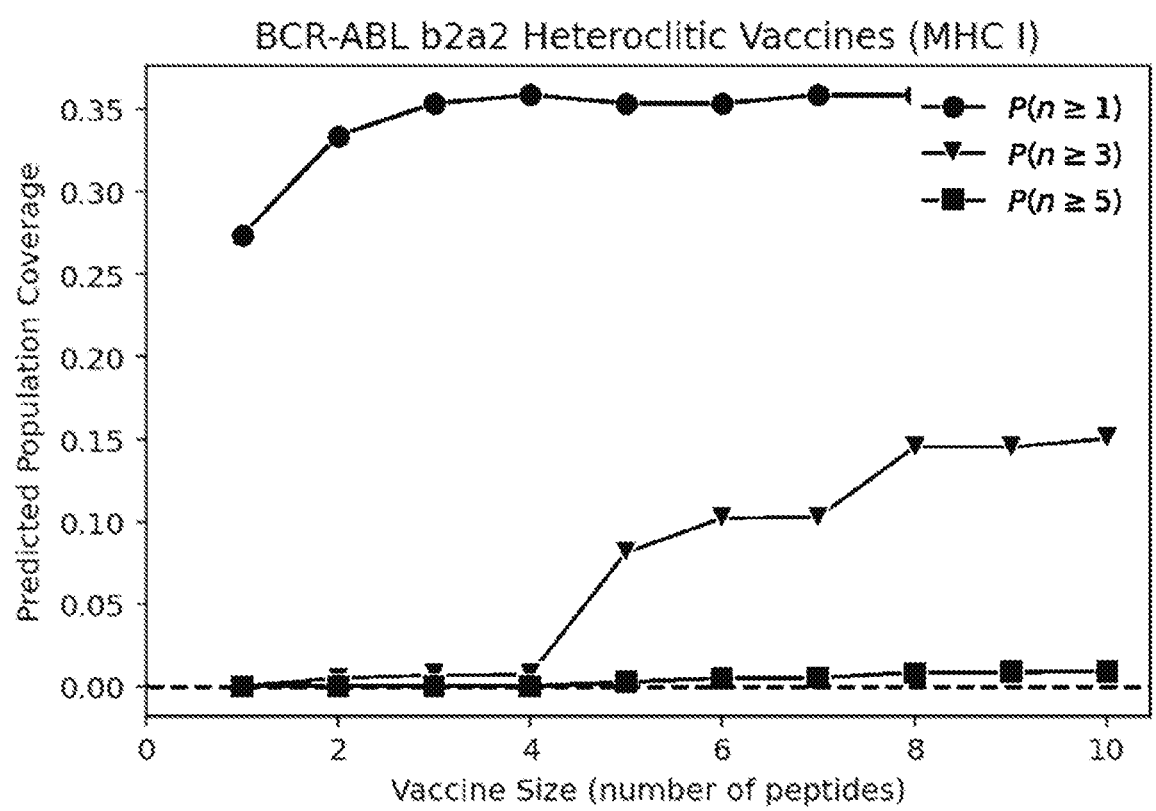
FIG. 5 is a graph showing predicted population coverage for MHC class I vaccines that include heteroclitic peptides by vaccine size for the BCR-ABL b2a2 fusion, for at least one peptide-HLA hit (circles), at least three peptide-HLA hits (triangles), and at least five peptide-HLA hits (squares). The dashed line shows the predicted population coverage of BCR-ABL b3a2 fusion vaccines without heteroclitic peptides for at least one peptide-HLA hit per-individual.
Figure 6:
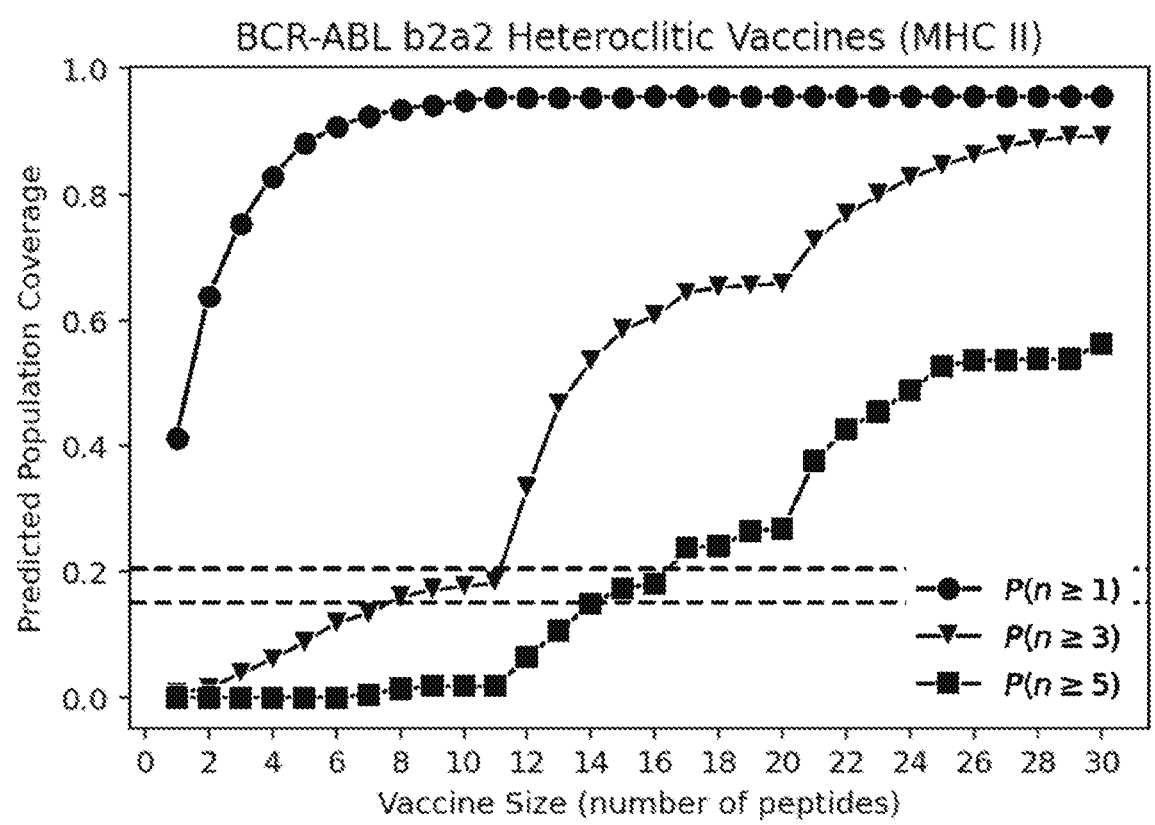
FIG. 6 is a graph showing predicted population coverage for MHC class II vaccines that include heteroclitic peptides by vaccine size for the BCR-ABL b2a2 fusion, for at least one peptide-HLA hit (circles), at least three peptide-HLA hits (triangles), and at least five peptide-HLA hits (squares). The dashed lines show the predicted population coverage of BCR-ABL b3a2 fusion vaccines without heteroclitic peptides for at least 1 (top dashed line) and 5 (bottom dashed line) peptide-HLA hits per-individual.

FIG. 3 shows predicted population coverage for MHC class I vaccines by vaccine size for the BCL-ABL fusion that produces b3a2. FIG. 4 shows predicted population coverage for MEW class II vaccines by vaccine size for the BCL-ABL fusion that produces b3a2. FIG. 5 shows predicted population coverage for MHC class I vaccines by vaccine size for the BCL-ABL fusion that produces b2a2. FIG. 6 shows predicted population coverage for MEW class II vaccines by vaccine size for the BCL-ABL fusion that produces b2a2.

OptiVax can be used to design a vaccine to maximize the fraction/proportion of the population whose HLA molecules are predicted to bind to and display at least p peptides from the vaccine. In some embodiments, this prediction (e.g., scoring) includes experimental immunogenicity data to directly predict at least p peptides will be immunogenic. The number p is input to OptiVax, and OptiVax can be run multiple times with varying values for p to obtain a predicted optimal target peptide set for different peptide counts p.

Larger values of p will increase the redundancy of a vaccine at the cost of more peptides to achieve a desired population coverage. In some embodiments, it may not be possible to achieve a given population coverage given a specific heteroclitic base set. In some embodiments, the number p is a function of the desired size of a vaccine.

The methods described herein can be used to design separate vaccine formulations for MHC class I and class II-based immunity.

In some embodiments, this procedure is used to create a vaccine for an individual. In some embodiments, the target peptides present in the individual are determined by sequencing the individual's tumor RNA or DNA and identifying mutations that produce foreign peptides. One embodiment of this method is described in U.S. Pat. No. 10,738,355, incorporated in its entirety herein. In some embodiments, peptide sequencing methods are used to identify target peptides in the individual. One embodiment of this is described in U.S. Publication No. 2011/0257890. In some embodiments, the target peptides used for the individual's vaccine are selected when a self-peptide, foreign peptide, pathogen peptide or RNA encoding a self-peptide, foreign peptide or pathogen peptide is observed in a specimen from the individual is present at a predetermined level. The target peptides in the individual are used to construct a vaccine as disclosed herein. For vaccine design, OptiVax is provided a diplotype comprising the HLA type of the individual. In an alternative embodiment, the HLA type of an individual is separated into multiple diplotypes with frequencies that sum to one, where each diplotype comprises one or more HLA alleles from the individual and a notation that the other allele positions should not be evaluated. The use of multiple diplotypes will cause OptiVax's objective function to increase the chance that immunogenic peptides will be displayed by all of the constructed diplotypes. This achieves the objective of maximizing the number of distinct HLA alleles in the individual that exhibit peptide-HLA immunogenicity and thus improves the allelic coverage of the vaccine in the individual.

Figure 7:
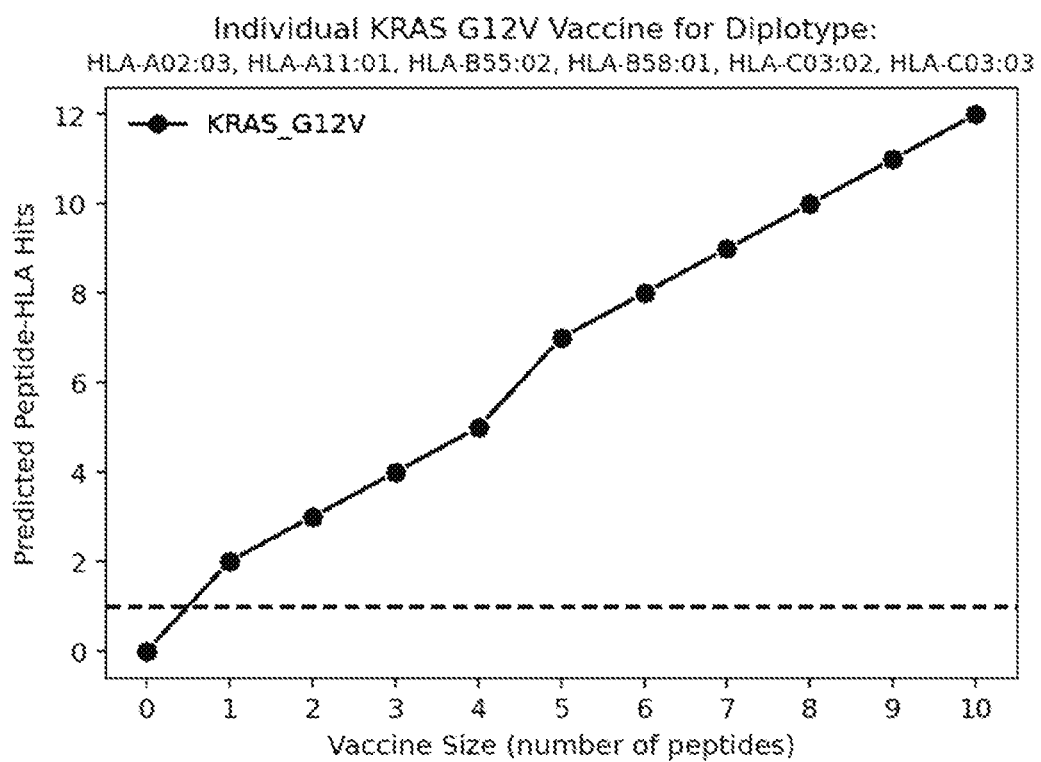
FIG. 7 is a graph showing predicted peptide-HLA hits by vaccine size for a KRAS G12V vaccine that includes heteroclitic peptides for the HLA diplotype HLA-A02:03, HLA-A11:01, HLA-B55:02, HLA-B58:01, HLA-C03:02, and HLA-C03:03. The dashed line shows predicted peptide-HLA hits by vaccine size for a KRAS G12V vaccine without heteroclitic peptides.

FIG. 7 shows the predicted vaccine performance (predicted number of peptide-HLA hits) of ten example G12V MHC class I vaccines for a single individual with the MHC class I HLA diplotype HLA-A02:03, HLA-A11:01, HLA-B55:02, HLA-B58:01, HLA-C03:02, and HLA-C03:03. OptiVax was used to design ten G12V MHC class I vaccines for this HLA diplotype with peptide counts ranging from 1 to 10. For the results in FIG. 7, OptiVax was run with six synthetic diplotypes, each equally weighted, each with one HLA allele from the individual's HLA diplotype, and the other allele positions marked to not be evaluated.

MHC Class I Vaccine Design Procedure

In some embodiments, MHC class I vaccine design procedures consist of the following computational steps.

In some embodiments, the inputs for the computation are:
Peptide sequence (length n) containing the neoantigen or pathogenic target(s) of interest (e.g., KRAS G12D, KRAS G12V, KRAS G12R, KRAS G12C, KRAS G13D, BCR-ABL b3a2, BCR-ABL b2a2). $P_i$ denotes the amino acid at position i.
t; Position of target mutation in P, $t \in [1, \ldots n]$ (e.g., t=12 for KRAS G12D).
s: Substitution mutations E [true, false] is true if the mutation is a substitution, and false if the mutation is a deletion or insertion or the peptide does not contain a mutation (such as in pathogen targets). When the mutation is a deletion or insertion then t indicates the position immediately before the deletion or insertion.

$\tau_1$: Threshold for potential presentation of peptides by MHC for peptide-MHC scoring (e.g., 500 nM binding affinity)

$\tau_2$: Threshold for predicted display of peptides by MHC for peptide-MHC scoring (e.g., 50 nM binding affinity)

$\vec{\mathcal{H}}$ : Set of HLA alleles (for HLA-A, HLA-B, HLA-C loci)

F: $\vec{\mathcal{H}}^3 \to \mathbb{R}$ : Population haplotype frequencies (for OptiVax optimization and coverage evaluation).

N; Parameter for EvalVax and OptiVax objective function. Specifies minimum number of predicted per-individual hits for population coverage objective to consider the individual covered. Default=1 (computes $P(n \geq 1)$ population coverage).

In some embodiments, Peptide-HLA Scoring Functions used are:

ScorePotential: $P \times \vec{\mathcal{H}} \to \mathbb{R}$ : Scoring function mapping a (peptide, HLA allele) pair to a prediction of peptide-HLA display. If predicted affinity$\leq \tau_1$, then returns 1, else returns 0. Options include MHCflurry, NetMHCpan, PUFFIN, ensembles, or alternative metrics or software may be used, including models calibrated against immunogenicity data.

ScoreDisplay: $P \times \vec{\mathcal{H}} \to \mathbb{R}$ : Scoring function mapping a (peptide, HLA allele) pair to a prediction of peptide-HLA display. If predicted affinity$\leq$r', then returns 1, else returns 0. Options include MHCflurry, NetMHCpan, PUFFIN, ensembles, or alternative metrics or software may be used, including models calibrated against immunogenicity data.

Next, from the seed protein sequence (P), a set $\mathcal{P}$ of windowed native peptides spanning the protein sequence(s) is constructed. $P_{j \ldots j+(k-1)}$ only produces set members when the subscripts are within the range of the defined seed protein P. In some embodiments, 8-mers, 9-mers, 10-mers, and 11-mers are produced, but this process can be performed with any desired window lengths and the resulting peptide sets combined. In some embodiments, only 9-mers are produced.

$$\mathcal{P} = \bigcup_{k \in [8, \ldots, 11]} \mathcal{P}_k$$

$$\mathcal{P}_k = \{P_{j \ldots j+(k-1)} \mid j \in [t-(k-1), \ldots, t],$$

$$\text{if } s \text{ then } j \neq \{t-(k-1), t-1\}\}$$

The second condition $j \neq \{t-(k-1), t-1\}$ excludes peptides where the mutation at t is in positions P2 or Pk of the windowed k-mer peptide (i.e., the anchor positions) and the mutation is a substitution.

MHC Class I Vaccine Design Procedure with Defined Peptide Set $\mathcal{P}$

Next, each peptide sequence in $\mathcal{P}$ is scored against all HLA alleles in $\vec{\mathcal{H}}$ for potential presentation using SCOREPOTENTIAL (with threshold $\tau_1$=500 nM) and store results in a $|\mathcal{P}| \times |\vec{\mathcal{H}}|$ matrix S:

$$S[p,h] = \text{ScorePotential}(p,h) \forall p \in \mathcal{P}, h \in \vec{\mathcal{H}}$$

Note that S is a binary matrix where 1 indicates the HLA is predicted to potentially present the peptide, and 0 indicates no potential presentation.

Define Base Set of Peptides B⊆$\mathcal{P}$:

$$B=\{p\in \mathcal{P} \mid \exists h \ s.t. S[p,h]=1\}$$

Thus, B contains the native peptides that are predicted to be potentially presented by at least 1 HLA.

Create a Set of all Heteroclitic Peptides B' Stemming from Peptides in B:

$$B' = \bigcup_{b\in B} A_{NCHOR} - M_{ODIFIED}(b)$$

where ANCHOR-MODIFIED(b) returns a set of all 399 anchor-modified peptides stemming from b (with all possible modifications to the amino acids at P2 and P9).

Next, all heteroclitic candidate peptides (e.g., modified peptides) in B' are scored against all HLA alleles in $\vec{\mathcal{H}}$ for predicted display using SCOREDISPLAY (with threshold $\tau_2$=50 nM), and store results in binary $|B'|\times|\vec{\mathcal{H}}|$ matrix $S'_1$:

$$S'_1[b',h]=\text{SCOREDISPLAY}(b',h) \forall b' \in B', h \in \vec{\mathcal{H}}$$

Next, an updated scoring matrix $S'_2$ is computed for heteroclitic peptides conditioned on the potential presentation of the corresponding base peptides by each HLA:

$$S'_2[b', h] = \begin{cases} S'_1[b', h], & \text{if } S[b, h] = 1 \\ 0, & \text{otherwise} \end{cases} \forall b' \in B', h \in \mathcal{H}$$

where each heteroclitic peptide b'∈B' is a mutation of base peptide b∈B. This condition enforces that if h was not predicted to potentially present b, then all heteroclitic peptides b' derived from b will not be displayed by h (even if h would otherwise be predicted to display b').

In some embodiments, OptiVax-Robust is used to design a final peptide set (e.g., third peptide set) from the union of base peptides and heteroclitic peptides B U B' (with corresponding scoring matrices S and $S'_2$ for B and B', respectively). OptiVax will output m sets $\mathcal{V}_s$ for s∈[1, . . . , m] where m is the largest vaccine size requested from OptiVax. Let $\mathcal{V}_k$ denote the compact set of vaccine peptides output by OptiVax containing k peptides. Note that $\mathcal{V}_{k+1}$ is not necessarily a superset of $\mathcal{V}_k$. In alternate embodiments, OptiVax can be used to augment the base set B with peptides from B' using scoring matrix $S'_2$ to have OptiVax return set $\mathcal{A}_k$, and the final vaccine set $\mathcal{V}_{k+|B|}$ consists of peptides B∪$\mathcal{A}_k$.

In some embodiments, this procedure is repeated independently for each target of interest, and the resulting independent vaccine sets can be merged into a combined vaccine as described below.

WIC Class II Vaccine Design Procedure

In some embodiments, WIC class II vaccine design procedures consist of the following computational steps.

In some embodiments, the inputs for the computation are:

$P_{1 \ldots n}$: Peptide sequence(s) (length n) containing the neoantigen(s) of interest (e.g., KRAS G12D, KRAS G12V, KRAS G12R, KRAS G12C, KRAS G13D, BCR-ABL b3a2, BCR-ABL b2a2). $P_i$ denotes the amino acid at position i.

t: Position of target mutation in P, t∈[1, . . . ,n] (e.g., t=12 for KRAS G12D).

s: Substitution mutations ∈[true, false] is true if the mutation is a substitution, and false if the mutation is a deletion or insertion or the peptide does not contain a mutation (such as for pathogen targets). When the mutation is a deletion or insertion then t indicates the position immediately before the deletion or insertion.

$\tau_1$: Threshold for potential presentation of peptides by MHC for peptide-MHC scoring (e.g., 500 nM binding affinity)

$\tau_2$: Threshold for predicted display of peptides by MHC for peptide-MHC scoring (e.g., 50 nM binding affinity)

$\vec{\mathcal{H}}$ : Set of HLA alleles (for HLA-DR, HLA-DQ, HLA-DP loci)

F: $\vec{\mathcal{H}}^3 \to \mathbb{R}$ : Population haplotype frequencies (for OptiVax optimization and coverage evaluation).

N: Parameter for EvalVax and OptiVax objective function. Specifies minimum number of predicted per-individual hits for population coverage objective to consider the individual covered. Default=1 (computes P(n≥1) population coverage).

In some embodiments, Peptide-HLA Scoring Functions used are:

SCOREPOTENTIAL: P×$\vec{\mathcal{H}} \to \mathbb{R}$ : Scoring function mapping a (peptide, HLA allele) pair to a prediction of display. If predicted affinity ≤$\tau_1$, then returns 1, else returns 0. Options include NetMHCIIpan, PUFFIN, ensembles, or alternative metrics or software may be used, including models calibrated against immunogenicity data.

SCOREDISPLAY: P×$\vec{\mathcal{H}} \to \mathbb{R}$ : Scoring function mapping a (peptide, HLA allele) pair to a prediction of peptide-HLA display. If predicted affinity≤$\tau_1$, then returns 1, else returns 0. Options include NetMHCIIpan, PUFFIN, ensembles, or alternative metrics or software may be used, including models calibrated against immunogenicity data.

FindCore: P×$\vec{\mathcal{H}} \to$[1, . . . ,n]; Function mapping a (peptide, HLA allele) pair to a prediction of the 9-mer binding core. The core may be specified as the offset position (index) into the peptide where the core begins.

Next, from the seed protein sequence (P), a set $\mathcal{P}$ of peptides spanning the protein sequence are constructed. $P_{j \ldots j+(k-1)}$ only produces set members when the subscripts are within the range of the defined seed protein P. Here, we extract all windowed peptides of length 13-25 spanning the target mutation, but this process can be performed using any desired window lengths (e.g., only 15-mers).

$$\mathcal{P} = \bigcup_{k\in[13,\ldots,25]} \mathcal{P}_k$$

$$\mathcal{P}_k = \{P_{j\ldots j+(k-1)} \mid j \in [t-(k-1), \ldots, t]\}$$

where $\mathcal{P}_k$ contains all sliding windows of length k, which are combined to form $\mathcal{P}$. Note that here (unlike MHC class I), no peptides are excluded based on binding core or anchor residue positions (for MHC class II, filtering is performed as described in this disclosure).

MHC Class II Vaccine Design Procedure with Defined Peptide Set $\mathcal{P}$

Next, each peptide sequence in $\mathcal{P}$ is scored against all HLA alleles in $\vec{\mathcal{H}}$ for potential presentation using SCOREPOTENTIAL (with threshold $\tau_1$=500 nM) and store results in $|\mathcal{P}|\times|\vec{\mathcal{H}}|$ matrix $S_1$:

$$S_1[p,h]=\text{SCOREPOTENTIAL}(p,h) \forall p\in \mathcal{P}, h\in \vec{\mathcal{H}}$$

Note that $S_1$ is a binary matrix where 1 indicates the HLA is predicted to potentially present the peptide, and 0 indicates no potential presentation.

For each (peptide, HLA allele) pair (p, h), identify/predict the 9-mer binding core using FINDCORE. The predicted binding core is recorded in a matrix C:

$$C[p,h] = \text{FindCore}(p,h) \forall p \in \mathcal{P}, h \in \vec{\mathcal{H}}$$

Next, if not(s) then $S_2[p, h] = S_1[p, h]$ otherwise an updated scoring matrix $S_2$ is computed for native peptides in P:

$$S_2[p, h] = \begin{cases} S_1[p, h], & \text{if } C[p, h] \text{ specifies } P_t \text{ at a non-anchor position inside core} \\ 0, & \text{otherwise} \end{cases}$$

$$\forall p \in \mathcal{P}, h \in \mathcal{H}.$$

where $P_t$ is the target residue of interest (e.g., the mutation site of KRAS G12D). This condition enforces the target residue to fall within the binding core at a non-anchor position for all (peptide, HLA allele) pairs with non-zero scores in $S_2$, and allows the binding core to vary by allele per peptide (as the binding cores of a particular peptide may differ based on the HLA allele presenting the peptide). Thus, for each pair (p, h), if the predicted binding core C[p, h] specifies the target residue $P_t$ at an anchor position (P1, P4, P6, or P9 of the 9-mer core), or if $P_t$ is not contained within the binding core, then $S_2$ [p, h]=0. In an alternate embodiment, $P_t$ can be located outside of the core or inside the core in a non-anchor position. In some embodiments, $P_t$ can only be located at specific positions inside and/or outside of the core. In some embodiments, the binding core predictions in C are accompanied by prediction confidences. In some embodiments, if the confidence for predicted core C[p, h] is below a desired threshold (e.g., 0.5, 0.6, 0.7, 0.8, or 0.9), then $S_2$ [p, h]=0.

Next, OptiVax-Robust is run with peptides $\mathcal{P}$ and scoring matrix $S_2$ to identify a non-redundant base set of peptides $B \subseteq \mathcal{P}$. (In alternate embodiments, B can be chosen as the entire set $\mathcal{P}$ rather than identifying a non-redundant base set.)

Next, a set of all heteroclitic peptides B' is created stemming from peptides in B:

$$B' = \bigcup_{b \in B} \{A_{NCHOR} - M_{ODIFIED}(b, c) \forall c \mid \exists h \text{ s.t. } S_2[b, h] = 1\}$$

where ANCHOR-MODIFIED(b,c) returns a set of all $20^4$-1 anchor-modified peptides stemming from b with all possible modifications to the amino acids at P1, P4, P6, and P9 of the 9-mer binding core c. Thus, for each base peptide b, the heteroclitic set B' contains all anchor-modified peptides b' with modifications to all unique cores of b identified for any HLA alleles that potentially present b with a valid core position as indicated by scoring matrix $S_2$.

Next, all heteroclitic candidate peptides (e.g., modified peptides) in B' are scored against all HLA alleles in $\vec{\mathcal{H}}$ for predicted display using SCOREDISPLAY (with threshold $\tau_2$=50 nM), and store results in binary $|B'| \times \vec{\mathcal{H}}|$ matrix $S'_1$:

$$S'_1[b',h] = \text{ScoreDisplay}(b',h) \forall b' \in B', h \in \vec{\mathcal{H}}$$

For each (heteroclitic peptide, HLA allele) pair (b',h), identify/predict the 9-mer binding core using FINDCORE. The predicted binding core is recorded in a matrix C':

$$C'[b',h] = \text{FindCore}(b',h) \forall b' \in B', h \in \vec{\mathcal{H}}$$

An updated scoring matrix $S'_2$ is computed for heteroclitic peptides conditioned on the identified binding cores of a heteroclitic and base peptides occurring at the same offset by a particular HLA:

$$S'_2[b', h] = \begin{cases} S'_1[b', h], & \text{if } C'[b', h] = C[b, h] \\ 0, & \text{otherwise} \end{cases} \forall b' \in B', h \in \mathcal{H}$$

where each heteroclitic peptide b'∈ B' is a mutation of base peptide b∈ B. This condition enforces the binding core of the heteroclitic peptide b' to be at the same relative position as the base peptide b, and, implicitly, enforces that the target residue $P_t$ still falls in a non-anchor position within the 9-mer binding core (Step 3).

An updated scoring matrix $S'_3$ is computed for heteroclitic peptides conditioned on the potential presentation of the corresponding base peptides by each HLA:

$$S'_3[b', h] = \begin{cases} S'_2[b', h], & \text{if } S[b, h] = 1 \\ 0, & \text{otherwise} \end{cases} \forall b' \in B', h \in \mathcal{H}$$

where each heteroclitic peptide b'∈ B' is a mutation of base peptide b∈ B. This condition enforces that if h was not predicted to display b, then all heteroclitic peptides b' derived from b will not be displayed by h (even if h would otherwise be predicted to display b').

OptiVax-Robust is used to design a final peptide set (e.g., third peptide set) from the union of base peptides and heteroclitic peptides B∪B' (with corresponding scoring matrices $S_2$ and $S'_3$ for B and B', respectively). OptiVax will output m sets $\mathcal{V}_s$ for s∈[1, . . . , m] where m is the largest vaccine size requested from OptiVax. Let $\mathcal{V}_k$ denote the compact set of vaccine peptides output by OptiVax containing k peptides. Note that $\mathcal{V}_{k+1}$ is not necessarily a superset of $\mathcal{V}_k$. In alternate embodiments, OptiVax can be used to augment the base set B with peptides from B' using scoring matrix $S'_2$ to have OptiVax return set $\mathcal{A}_k$, and the final vaccine set $\mathcal{V}_{k+|B|}$ consists of peptides B∪$\mathcal{A}_k$.

In some embodiments, this procedure is repeated independently for each single target of interest, and the resulting independent vaccine sets can be merged into a combined vaccine as described below.

MEW Class I or Class II Vaccine Design Method Prioritizing Peptide Conservation

In some embodiments, peptide sequences that are more conserved across strains, species, or other protein sources of interest are prioritized for vaccine inclusion. In some embodiments, a set of related protein sequences called protein variants are considered for vaccine design. A protein variant is one instance of a family of protein sequences, and protein variants can be sequences from various species, pathogen strains, viral strains, or other variations considered for vaccine design. In some embodiments, each protein variant has an associated probability called a protein variant probability, where the sum of all protein variant probabilities for the supplied set of protein variants is one. In some embodiments, multiple proteins of interest can be considered for the design of a single vaccine using an MEW Class I or Class II vaccine design method prioritizing peptide conservation. In these embodiments, protein variants for all proteins of interest are collectively considered for generating candidate peptides. In some embodiments, the protein variant probabilities across all of the considered multiple proteins sum to one.

A set of candidate peptides are created from each protein variant using a sliding window method that parses the protein variant into peptide sequences. In some embodiments, for MEW Class I 8-mers, 9-mers, 10-mers, and/or 11-mers are produced, but this process can be performed with any desired window lengths and the resulting peptide sets combined. In some embodiments, for MEW Class I, only 9-mers are produced. In some embodiments, for MEW Class II, all windowed peptides of length 13-25 are produced, but this process can be performed using any desired window lengths (e.g., only 15-mers). In some embodiments, peptides that are predicted to be glycosylated in a given protein variant are removed and not considered for that variant as described in Liu et al. 2020 which is incorporated by reference herein in its entirety.

In some embodiments, for each generated peptide sequence (MHC Class I or Class II) conservation is defined as the fraction of input protein variants where the peptide sequence occurs. For example, if a given 9-mer peptide sequence occurs in the peptides generated from 90% of the protein variants provided as input, its conservation is 0.90. In some embodiments, conservation is defined for each generated peptide sequence (MHC Class I or Class II) as the sum of the protein variant frequencies where the peptide sequence occurs. For example, if a given 9-mer peptide sequence occurs in the peptides generated from protein variants with protein variant probabilities of 0.10 and 0.20, its conservation is 0.30. In some embodiments, this functionality is implemented by a ComputeConservation function that computes the sum of the frequencies of the protein variants that contain a peptide sequence. In some embodiments, when sufficient protein variants are not sufficient for computing expected future conservation a method of predicting conservation can be used to implement ComputeConservation, such as the one found in Hie et al., 2021 which is incorporated by reference herein in its entirety.

In some embodiments, vaccine design considers conservation by prioritizing peptides for vaccine inclusion that are more conserved than others to meet a desired vaccine performance metric. In some embodiments, the vaccine design method attempts to first design a vaccine with candidate peptides that all meet a first conservation threshold, and if the desired vaccine performance is not met, it iteratively adds additional peptides with less stringent conservation to attempt to meet the desired vaccine performance metric. In some embodiments, vaccine design prioritizing conservation proceeds by setting a vaccine design D to be an empty set, and then performing the steps of: (1) selecting candidate peptides in which each peptide passes a conservation threshold to create a candidate peptide set and is not in D, (2) selecting vaccine designs having varying peptide numbers/combinations from this candidate set to optimize a vaccine performance metric using methods disclosed herein for MHC Class I or Class II vaccine design to augment the vaccine design contained in D (one implementation of vaccine augmentation is described in (Liu et al., 2021), incorporated by reference in its entirety herein), (3) selecting the smallest vaccine peptide set design from Step 2 that either meets the desired vaccine performance metric or where adding one more peptide to the selected set does not provide a desired minimum improvement in the vaccine performance metric, (4) if a vaccine peptide set was found in Step 3, adding the vaccine peptide set design from Step 3 to the vaccine design D, and (5) determining whether the vaccine design D meets a desired vaccine performance metric objective, and if so, return vaccine design D as the final vaccine design. If at Step 6, the vaccine design D fails to meet the desired vaccine performance metric objective, the computation continues with the following steps: (6) setting an updated conservation threshold to be lower than the current conservation threshold (less constrained) and (7) repeating the process starting at Step 1 retaining the current vaccine design D and current candidate set until either a desired vaccine performance metric objective is reached at Step 6, or the updated conservation threshold is lower than a minimum desired conservation threshold. If on any iteration, the updated conservation threshold is lower than a minimum desired conservation threshold, the latest version of vaccine design D will be used as the final vaccine design. When the process completes, the final vaccine design D includes all of the peptides that can be used in a vaccine.

In some embodiments, MEW class I or class II vaccine design procedures consist of the following computational steps.

In some embodiments, the inputs for the computation are:

$P_{j,1 \ldots n_j}$: Peptide sequence of protein variant j of length $n_j$. $P_{j,i}$ denotes the amino acid at position i of protein variant j; where $j \in [1, \ldots \alpha]$ and a is the number of protein variants $O_j$: Protein variant probability of protein variant $P_j$ $t_j$: Position in protein variant $P_j$ of the target mutation $t \in [1 \ldots n]$ D: The vaccine design, initialized to the empty set $\emptyset$ s: Substitution mutations $s \in [\text{true, false}]$ is true if the mutation is a substitution, and false if the mutation is a deletion or insertion or the peptide does not contain a mutation. When the mutation is a deletion or insertion then t indicates the position immediately before the deletion or insertion.

$c_1$: Initial conservation level of peptides $c_c$: Current conservation threshold $c_2$: Change in conservation level on each iteration $c_m$: Minimum final conservation v: Target vaccine performance metric $v_d$: Minimum change in vaccine performance metric to increase vaccine size N: Parameter for EvalVax and OptiVax objective function. Specifies minimum number of predicted per-individual hits for population coverage objective to consider the individual covered. Default=1 (computes $P(n \geq 1)$ population coverage).

COMPUTECONSERAVTION: $S \times X \times 0 \rightarrow \mathbb{R}$: In some embodiments, computes the fraction of sets $X_j$ that contain sequence S. In some embodiments, sums all the $O_j$ where sequence S appears in $X_j$ The protein variant sequences $P_i$ are used to produce windowed peptides that span the protein sequence(s) starting at each location m with a peptide length of k residues. The result is the set $X_j$ that contains all of the peptide sequences in protein variant $P_j$. $P_{j,m \ldots m+(k-1)}$ only produces a sequence when the subscripts are within the range of the defined protein $P_j$. In some embodiments for MEW Class I, k is chosen to produce 8-mers, 9-mers, 10-mers, and 11-mers, but this process can be performed with any desired window lengths and the resulting peptide sets combined. In some embodiments for MEW Class I, only 9-mers are produced. In some embodiments for MEW Class II, we extract all windowed peptides of length 13-25, but this process can be performed using any desired window lengths (e.g., only 15-mers).

$$X_j = \bigcup_{\substack{t \in [1 \ldots n_j] \\ k \in \left[\substack{8-11 MHC\ Class\ I \\ 13-25 MHC\ Class\ II}\right]}} \left\{ \begin{array}{l} P_{j,m \ldots m+(k-1)} \mid m \in [t-(k-1), \ldots, t], \\ \text{if } s \text{ and } MHC\ Class\ I \text{ then} \\ m \neq \{t-(k-1), t-1\} \end{array} \right\}$$

In some embodiments for MEW Class I, the second condition $m \neq \{t-(k-1), t-1\}$ excludes peptides where the mutation at t is in positions P2 or Pk of the windowed k-mer peptide (i.e., the anchor positions) and the mutation is a substitution and if for MHC Class I design. MHC Class II anchor positions are filtered in the MHC Class II design method.

Create the set of all peptides B that occur in any input protein variant.

$$B = \bigcup_{j \in [1, \ldots a]} X_j$$

$$z = |B|$$

For each peptide $B_w$ in B its conservation metric $C_w$ is computed using COMPUTECONSERVATION $$C_w = \text{ComputeConservation}[B_w, X, O]$$

The current conservation threshold is then set to the initial conservation threshold $$c_c = c_1$$

At Step 1, candidate peptides are selected where each peptide passes a conservation threshold to create a candidate peptide set and is not in D. A set of peptide candidates $\mathcal{P}$ is defined such that each candidate peptide meets the current conservation threshold $c_c$ and the peptide candidate is not already in D. D is set to empty (0 peptides) on the first iteration of the computational steps.

$$\mathcal{P} = U_{w \in [1, \ldots, z]} B_w \text{ where } C_w \geq c_c \text{ and } B_w \notin D$$

At Step 2, vaccine designs are selected having varying peptide numbers/combinations from the candidate set to optimize a vaccine performance metric using methods disclosed herein for MHC Class I or Class II vaccine design to augment the vaccine design contained in D. The peptide set $\mathcal{P}$ is provided to "MHC Class I Vaccine Design Procedure with Defined Peptide Set $\mathcal{P}$" for MHC Class I and "MHC Class II Vaccine Design Procedure with Defined Peptide Set $\mathcal{P}$" for MHC Class II. The peptide set $\mathcal{P}$ is provided as the set of candidates to augment the set D. Both the set $\mathcal{P}$ and D are provided to OptiVax which uses D as the fixed starting set and augments D with peptides from the set $\mathcal{P}$ using vaccine augmentation as described in (Liu et al., 2021), incorporated by reference in its entirety herein. OptiVax-Robust is used to augment the set D with peptides from $\mathcal{P}$ using the scoring matrices as defined in "MHC Class I Vaccine Design Procedure with Defined Peptide Set $\mathcal{P}$" for MHC Class I and "MHC Class II Vaccine Design Procedure with Defined Peptide Set $\mathcal{P}$" for MHC Class II, and returns sets $\mathcal{A}_s$ where each set $\mathcal{A}_s$ is a compact set of vaccine peptides output by OptiVax containing s peptides. In some embodiments, the steps to modify anchor positions are not utilized in the MHC Class I or MHC Class II vaccine design methods and only the base peptides B are utilized for vaccine design. In some embodiments, positions in addition to anchor positions are modified in the MHC Class I or MHC Class II vaccine design methods utilized to create B'.

At Step 3, the smallest vaccine peptide set design is selected from Step 2 that either meets the desired vaccine performance metric or where adding one more peptide to the selected set does not provide a desired minimum improvement in the vaccine performance metric. A vaccine design $\mathcal{A}_s$ is chosen that meets minimum requirements. In some embodiments, the vaccine design $\mathcal{A}_s$ is chosen with the value s chosen to be the minimum value of s such that the difference in vaccine performance between $D \cup \mathcal{A}_s$ and $D \cup \mathcal{A}_{s+1}$ is less than $v_d$. In some embodiments, the value s is chosen to be the minimum value such that the vaccine performance metric of $D \cup \mathcal{A}_s$ meets the final vaccine performance metric v. In some embodiments, $\mathcal{A}_{s+1}$ is not necessarily a superset of $\mathcal{A}_s$.

At Step 4, if a vaccine peptide set was found in Step 3, it is added to the vaccine peptide set design D. If an acceptable vaccine design $\mathcal{A}_s$ was found in Step 4, the vaccine design set D is updated to consist of $D \cup \mathcal{A}_s$.

At Step 5, it is determined whether the vaccine design D meets a desired vaccine performance metric objective. If the vaccine design set D meets the final vaccine performance design metric v, return D as the final design.

At Step 6, the conservation threshold is updated to be lower than the current conservation threshold (less constrained). If the vaccine design set D does not meet the final vaccine performance design metric v, reduce $c_c$ $$c_c = c_c - c_2$$

At Step 7, repeat the process starting at Step 1 retaining the current vaccine design D and current candidate set until either a desired vaccine performance metric objective is reached at Step 5, or the updated conservation threshold is lower than a minimum desired conservation threshold. If $c_c < c_m$ then return design set D as the final vaccine. If not, return to Step 1 and repeat all subsequent steps.

In some embodiments, this procedure is repeated independently for each single BCL-ABL gene fusion of interest, and the resulting independent vaccine sets can be merged into a combined vaccine.

Methods for Combining Multiple Vaccines

The above-described methods will produce an optimized target peptide set (e.g., third peptide set) for one or more individual targets. In some embodiments, a method is provided for designing separate vaccines for MEW class I and class II-based immunity for multiple targets (e.g., two or more targets such as KRAS G12D and KRAS G12V).

In some embodiments, a method is disclosed for producing a combined peptide vaccine for multiple targets by using a table of presentations for a disease that is based upon empirical data from sources such as the Cancer Genome Atlas (TCGA). FIG. 8 shows one embodiment for factoring disease presentation type probabilities (e.g., pancreatic cancer, colorectal cancer, and skin cancer) by probability, for each disease presentation, of target presented for various mutation targets (e.g., KRAS G12D, KRAS G12V, and KRAS G12R). A presentation is a unique set of targets that are presented by one form of a disease (e.g., distinct type of cancer or cancer indication as shown in FIG. 8). For each presentation, FIG. 8 shows an example of the probability of that presentation, and the probability that a given target is observed. For a given presentation, there can be one or more targets, each having a probability. In some embodiments, the method for multi-target vaccine design will allocate peptide resources for inducing disease immunity based on the presentation and respective target probabilities as shown in FIG. 8, for example. In some embodiments, presentations correspond to the prevalence of targets in different human populations or different risk groups. The probability of a target in a population is computed by summing for each possible presentation the probability of that presentation times the probability of the target in that presentation. FIG. 8 shows weights used for merging individual vaccines for each target (row) into combined vaccines for each disease indication (column). Values indicate the observed fraction of cases containing each target mutation. Data are from The Cancer Genome Atlas (TCGA). For each disease indication, TCGA data are filtered to cases where the Primary Site is the indication.

In some embodiments, the same vaccine design will be generated for mutations to different proteins when the base peptides generated by the mutations to the different proteins are identical. For example, in some embodiments of base peptide selection the following mutations have identical vaccine designs because they share the same set of base peptides: HRAS Q61K, NRAS Q61K, and KRAS Q61K; HRAS Q61L, NRAS Q61L, and KRAS Q61L; HRAS Q61R, NRAS Q61R, and KRAS Q61R. Referring to FIG. 8, in some embodiments, when two mutations have identical individual vaccine designs, their presentation specific probabilities are added when weighting the individual vaccine design for inclusion in a combined vaccine as described below (e.g., for Thyroid Cancer NRAS Q61R and HRAS Q61R).

Figure 9:
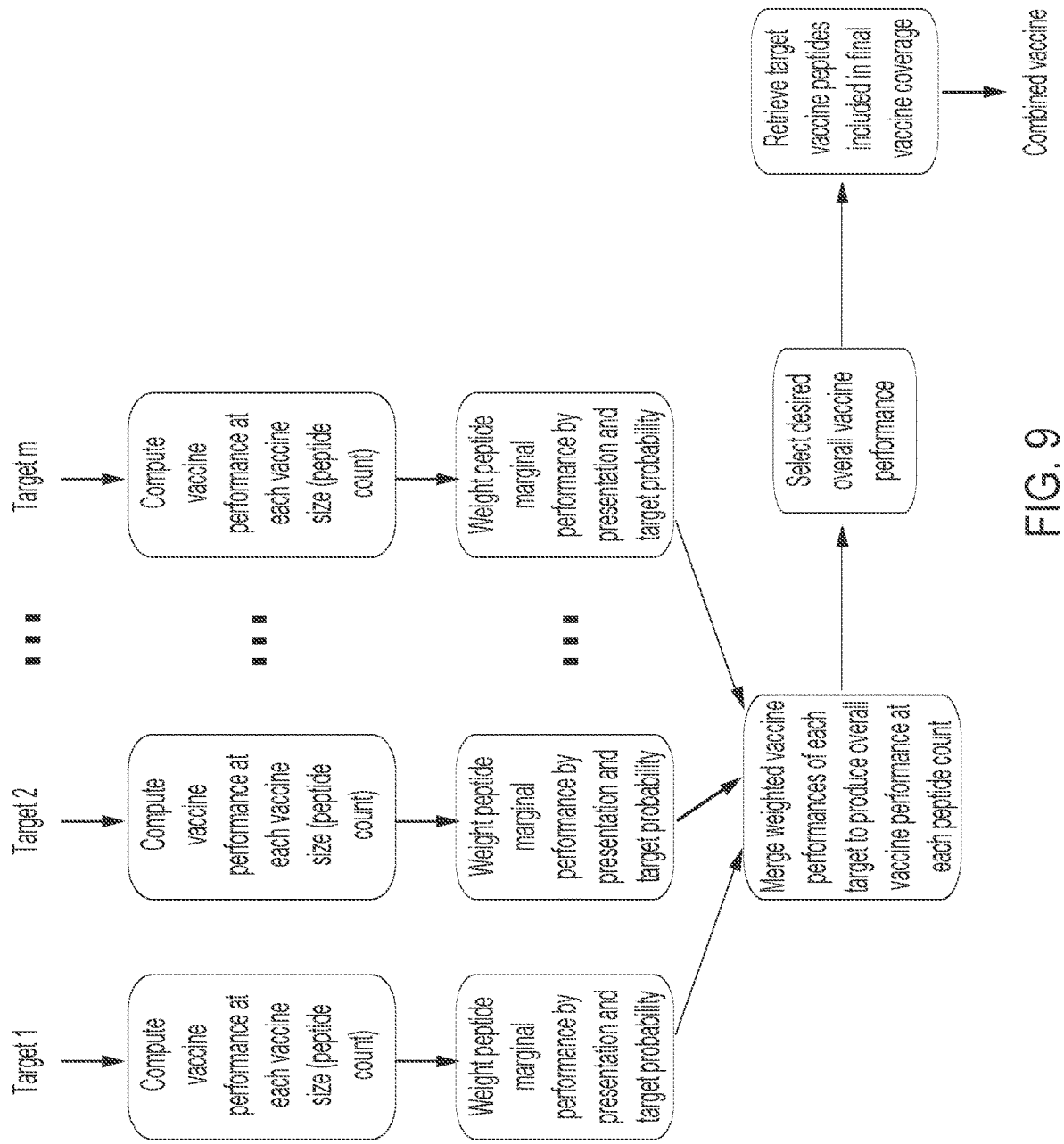
FIG. 9 is a flow chart showing a multiple target (combined) vaccine optimization method.

Referring to FIG. 9, in some embodiments, the method first includes designing an individual peptide vaccine for each target to create a combined vaccine design for multiple targets. This initially results in sets of target-specific vaccine designs. In some embodiments, the marginal predicted vaccine performance of each target-specific vaccine at size k is defined by predicted vaccine performance at size k minus the predicted vaccine performance of the vaccine at size k minus one. The composition of a vaccine may change as the number of peptides used in the vaccine increases, and thus for computing contributions to a combined vaccine, the marginal predicted vaccine performance of each target-specific vaccine is used instead of a specific set of peptides.

In some embodiments, the weighted marginal predicted vaccine performance of a target-specific vaccine design for each target specific vaccine size is computed as shown in FIG. 9. For a given target specific vaccine size, its weighted predicted vaccine performance is computed by multiplying its predicted vaccine performance times the probability of the target in the population (e.g., by using values as shown in FIG. 8). The marginal weighted predicted vaccine performance for a target specific vaccine is its weighted coverage at size k minus its coverage a size k minus one. The marginal weighted predicted vaccine performance of a target specific vaccine of size one is its weighted predicted vaccine performance. The marginal weighted predicted vaccine performances for all vaccines are combined into a single list, and the combined list is sorted from largest to least by the weighted marginal predicted vaccine performances of the target specific vaccines as shown in FIG. 9. The combined vaccine of size n is then determined by the first n elements of this list. The peptides for the combined vaccine are determined by the individual peptide target vaccines whose sizes add to n and whose weighted predicted vaccine performances sums to the same sum as the first n elements of the sorted list. This maximizes the predicted vaccine performance of the combined vaccine of size n.

In some embodiments, the combined multiple target vaccine can be designed on its overall predicted coverage for the disease described depending on the presentation table used (e.g., see FIG. 8), by its predicted coverage for a specific indication, and/or by its predicted coverage for a specific target by adjusting the weighting used for predicted vaccine performance accordingly. Once a desired level of coverage is selected, the peptides of the combined vaccine are determined by the contributions of target-specific designs. For example, if the combined vaccine includes a target-specific vaccine of size k, then the vaccine peptides for this target at size k are used in the combined vaccine.

As an example of one embodiment, FIG. 8 shows mutations (e.g., KRAS G12D, G12V, and G12R) and their respective probabilities of occurring in an individual with different cancer indications (e.g., pancreatic cancer). The marginal population coverage of each target-specific vaccine at a given vaccine size is the improvement in coverage at that size and the size minus one. The coverage with no peptides is zero. The marginal coverage of each target-specific vaccine is multiplied by the probability of the target in the population as determined by the proportions as shown in FIG. 8 for a selected indication (e.g., pancreatic cancer). These weighted marginal coverages of all target-specific vaccines are sorted to determine the best target-specific compositions, and the resulting list describes the composition of a combined vaccine for the selected indication at each size k by taking the first k elements of the list. At each combined vaccine size, different components of the target-specific vaccines are utilized for the indication illustrated.

Combined Vaccine Design Procedure

In some embodiments, the procedure described herein is used to combine individual compact vaccines optimized for different targets into a single optimized combined vaccine.

In some embodiments, the computational inputs for the procedure are:

$\mathcal{T}$: Set of neoantigen or pathogenic targets of interest (e.g., KRAS G12D, KRAS G12V, KRAS G12R, BCR-ABL b3a2, BCR-ABL b2a2)

$\mathcal{V}$: Vaccine sets optimized individually for each target. Let $\mathcal{V}_{t,k}$ denote the optimal vaccine set of exactly k peptides for target t ET (e.g., as computed by the procedures describe above). Note that $\mathcal{V}_{t,k+1}$ may not necessarily be a superset of $\mathcal{V}_{t,k}$.

W: $\mathcal{T} \rightarrow [0,1]$: Target weighting function mapping each target t∈$\mathcal{T}$ to a probability or weight of t in a particular presentation of interest (e.g., pancreatic cancer; see Exhibit A, Table 1 for example).

POPULATIONCOVERAGE: $\mathcal{V} \rightarrow [0,1]$: Function mapping a peptide set into population coverage (e.g., EvalVax). This function may also take as input additional parameters, including HLA haplotype frequencies and a minimum per-individual number of peptide-HLA hits N (here, we compute coverage as $P(n \geq 1)$ using EvalVax-Robust).

At Step 1, for each target t (individually) compute optimized vaccines of sizes 1 to m as the sets $\mathcal{V}_{t,k}$ where k denotes the size of the vaccine and then compute their vaccine performance at each vaccine size. For each target t (individually) and vaccine size (peptide count) k, the unweighted population coverage $c_{t,k}$ is computed:

$$c_{t,k} = \text{PopulationCoverage}(\mathcal{V}_{t,k}) \forall t \in \mathcal{T}, k$$

In some embodiments, for each target, t, $c_{t,k}$ is generally monotonically increasing and concave down for increasing values of k (each additional peptide increases coverage but with decreasing returns).

At Step 2, vaccine marginal performance is computed and weighted by each target's prevalence weight. For each target t (individually), the marginal coverage $m_{t,k}$ is computed of the k-th peptide added to the vaccine set:

$$m_{t,k} = \begin{cases} c_{t,k} & \text{if } k = 1 \\ c_{t,k} - c_{t,k-1}, & \text{otherwise} \end{cases} \forall t \in \mathcal{T}, k$$

In some embodiments, for each target t, $m_{t,k}$ should be a monotonically decreasing function in k (by Step 1 above).

The weighted marginal population coverage $\tilde{m}_{t,k}$ is computed using weights of each target in W:

$$\tilde{m}_{t,k} = W(t) \cdot m_{t,k} \forall t \in \mathcal{T}, k$$

The weighted marginal population coverage gives the effective marginal coverage of the k-th peptide in the vaccine weighted by the prevalence of the target in the presentation (by multiplication with the probability/weight of the target in the presentation).

At Step 3, the weighted vaccine performances are merged for all targets to produce combined vaccine designs at each peptide count. The individual vaccines are combined into a combined vaccine via the MERGEMULTI procedure called on the weighted marginal population coverage lists $\tilde{m}_t = [\tilde{m}_{t,k} \in 1, 2, \ldots]$. FIG. 10 shows an example Python implementation of the MERGEMULTI function. This procedure takes as input multiple sorted (descending) lists and merges them into a single sorted (descending) list. Let M indicate the output of MERGEMULTI where each element $M_k$ contains both the marginal weighted coverage and source (target) of the k-th peptide in the combined vaccine. The combined vaccine contains peptides from different targets. In particular, the combined vaccine with k peptides contains $C_{t,k} = \Sigma_{j \leq k} \mathbb{1}\{M_k \text{ from } t\}$ peptides from target t. $C_{t,k} \in [0, \ldots, k]$ and $\Sigma_t C_{t,k} = k$ ($C_{t,k}$ gives the distribution of the k peptides in the combined vaccine across the targets).

At Step 4, a vaccine with a desired performance is selected. The final vaccine size k can vary based upon the specific population coverage goals of the vaccine. The marginal weighted coverage values of the combined vaccine $M_k$ can be cumulatively summed over k to give the overall effective (target-weighted) population coverage of the combined vaccine containing k peptides as $\Sigma_{j \leq K} M_k$ (taking into account both the probabilities/weights of the targets in the presentation and the expected population coverage of peptides based on HLA display).

At Step 5, the vaccine peptides corresponding to the target coverage is retrieved for the final vaccine size k. The optimal combined vaccine set $\hat{V}_k$ for the final vaccine size k is defined as:

$$\hat{V}_k = \bigcup_{t \in \mathcal{T}} V_{t,C_{t,k}}$$

Thus, the combined vaccine with k peptides is the combination of the optimal individual ($C_{t,k}$)-peptide vaccines.

mRNA and DNA Vaccines

In some embodiments, vaccine peptides are encoded as mRNA or DNA molecules and are administered for expression in vivo. One example of the delivery of vaccines by mRNA is found in Kranz et al. (2016), incorporated by reference in its entirety herein. In some embodiments, vaccine peptides are encoded in more than one mRNA or DNA molecule as is disclosed in Sahin et. al. (2017), incorporated by reference in its entirety herein. In one embodiment, a construct comprises 20 peptides, including a ten-peptide MHC class I BCR-ABL b3a2 vaccine and a ten-peptide MHC class II BCR-ABL b3a2 vaccine, as optimized by the procedure described herein. Peptides are prepended with a secretion signal sequence at the N-terminus and followed by an MHC class I trafficking signal (MITD) (See Kreiter et al., 2008; Sahin et al., 2017, incorporated by reference in their entireties herein). The MITD has been shown to route antigens to pathways for HLA class I and class II presentation (Kreiter et al., 2008). Here we combine all peptides of each MHC class into a single construct using non-immunogenic glycine/serine linkers from Sahin et al. (2017), though it is also plausible to construct individual constructs containing single peptides with the same secretion and MITD signals as demonstrated by Kreiter et al. (2008).

In some embodiments, the amino acid sequence encoded by the mRNA vaccine comprises SEQ ID NO: 62113. Underlined amino acids correspond to the signal peptide (or leader) sequence. Bolded amino acids correspond to MHC class I (8-11 amino acids in length; 10 peptides) and MHC class II (13-25 amino acids in length; 10 peptides) peptide sequences. Italicized amino acids correspond to the trafficking signal. In alternate embodiments, any number and variation of peptide sequences disclosed herein can be included in an mRNA vaccine comprising the signal peptide sequence and the trafficking signal as shown in SEQ ID NO: 62113 below.

(SEQ ID NO: 62113)
MRVTAPRTLILLLSGALALTETWAGSGGSGGGGSGGA

MGFKQSSKGGSGGGGSGGGYKQSSKAMGGSGGGGSG

GKQLQRPVASDYGGSGGGGSGGKTLQRPVASDWGGS

GGGGSGGKYSSKALQRGGSGGGGSGGSAKALQRPMG

GSGGGGSGGSAKALQRPYGGSGGGGSGGSTKALQRP

LGGSGGGGSGGSTTGFKQSSKGGSGGGGSGGSTTGF

KQSSRGGSGGGGSGGLNVIVHSATGIKQISAALIRP

VASDGGSGGGGSGGLNVIVHSATGIKQISSALIRPV

ASDGGSGGGGSGGSATGFFQSKKFLQVPVASDFGGS

GGGGSGGSATGFKQFSIALRRPVASDFGGSGGGGSG

GSATGFKQISRALSRPVASDFGGSGGGGSGGSATGF

KQSSFALIRPVASDFGGSGGGGSGGSATGFKQSSRA

LSRAVANDFGGSGGGGSGGSATGFNQSAKVLQAPVA

SDFGGSGGGGSGGYGFLNVIVHSATGFKQTSFALNR

PVGGSGGGGSGGYGFLNVIVHSATGIKQASNALARP

VGGSLGGGGSGIVG*IVAGLAVLAVWIGAWATVMCRR*

*KSSGGKGGSYSQAASSDSAQGSDVSLTA*.

In some embodiments, the vaccine is an mRNA vaccine comprising a nucleic acids sequence encoding the amino acid sequence consisting of SEQ ID NO: 62113. In some embodiments, the nucleic acid sequence of the mRNA vaccine encodes for an amino acid sequence 80, 81, 82, 83, 84, 85, 86, 87, 88, 89, 90, 91, 92, 93, 94, 95, 96, 97, 98 or 99% identical to SEQ ID NO: 62113.

In some embodiments, the vaccine is a DNA vaccine comprising a nucleic acids sequence encoding the amino acid sequence consisting of SEQ ID NO: 62113. In some embodiments, the nucleic acid sequence of the DNA vaccine encodes for an amino acid sequence 80, 81, 82, 83, 84, 85, 86, 87, 88, 89, 90, 91, 92, 93, 94, 95, 96, 97, 98 or 99% identical to SEQ ID NO: 62113.

In some embodiments, one or more MHC class I and/or MHC class II peptides disclosed herein (SEQ ID NO: 1 to 62113) can be encoded in one or more mRNA or DNA molecules and administered for expression in vivo. In some embodiments, between about 2 and about 40 peptide sequences are encoded in one or more mRNA constructs. In some embodiments, between about 2 and about 40 peptide sequences are encoded in one or more DNA constructs (i.e., nucleic acids encoding the amino acids sequences comprising on or more of SEQ ID NOs: 1 to 62113). In some embodiments, the amino acid sequence of the mRNA vaccine or the nucleic acid sequence of the DNA vaccine encodes for an amino acid sequence 80, 81, 82, 83, 84, 85, 86, 87, 88, 89, 90, 91, 92, 93, 94, 95, 96, 97, 98 or 99% identical to any of SEQ ID NOs: 1 to 62113.

In some embodiments, mRNA encoded vaccine peptides are used as the payload of a self-amplifying RNA vaccine. In one embodiment, the mRNA sequence encoding the vaccine peptides replaces one or more structural proteins of an infectious alphavirus particle as described in Geall et al. (2012) that is incorporated herein by reference. As is described by Geall et al. (2012), self-amplifying RNA vaccines can increase the efficiency of antigen production in vivo.

Non-Limiting Embodiments of the Subject Matter

In one aspect, described herein is a composition comprising nucleic acid sequences encoding at least two amino acid sequences selected from the group consisting of SEQ ID NOs: 1 to 8, SEQ ID NOs: 10 to 17, and SEQ ID NOs: 19 to 44.

In some embodiments, the nucleic acid sequences are contained in a construct for in vivo expression of the nucleic acid sequences.

In some embodiments, an administration of the nucleic acid sequences causes one or more peptides encoded by the nucleic acid sequences to be displayed by an HLA class I molecule in a subject.

In some embodiments, the nucleic acid sequences are contained in a construct for in vivo expression of at least two peptides encoded by the nucleic acid sequences, wherein an administration of the nucleic acid sequences causes: a first peptide of the at least two peptides to be displayed by a first plurality of HLA class I alleles in the subject; and a second peptide of the at least two peptides to be displayed by a second plurality of HLA class I alleles in the subject, wherein the first plurality of HLA class I alleles and the second plurality of HLA class I alleles differ by at least one HLA class I allele.

In some embodiments, the one or more peptides is a modified or an unmodified fragment of a BCL-ABL gene fusion. In some embodiments, the BCR-ABL gene fusion is b3a2 or b2a2. In some embodiments, the two or more amino acid sequences are selected based on a prevalence of the BCR-ABL gene fusion in a risk group that the subject belongs to, and wherein the composition is administered in an effective amount to the subject to promote an immune response against cancer or to treat cancer, and wherein the cancer is associated with the BCR-ABL gene fusion.

In some embodiments, the nucleic acid sequences are configured for administration in an effective amount to the subject to treat cancer.

In another aspect, described herein is a peptide composition comprising at least two peptides selected from the group consisting of SEQ ID NOs: 1 to 8, SEQ ID NOs: 10 to 17, and SEQ ID NOs: 19 to 44.

In some embodiments, a peptide in the peptide composition is configured for display by a HLA class I molecule in a subject.

In some embodiments, an administration of a first peptide of the at least two peptides causes: the first peptide to be displayed by a first plurality of HLA class I alleles in a subject; and a second peptide of the at least two peptides to be displayed by a second plurality of HLA class I alleles in a subject, wherein the first plurality of HLA class I alleles and the second plurality of HLA class I alleles differ by at least one HLA class I allele.

In some embodiments, a peptide in the peptide composition is a modified or an unmodified fragment of a BCL-ABL gene fusion. In some embodiments, the BCR-ABL gene fusion is b3a2 or b2a2. In some embodiments, the at least two peptides are selected based on a prevalence of the BCR-ABL gene fusion in a risk group that the subject belongs to, and wherein the peptide composition is administered in an effective amount to the subject to promote an immune response against cancer or to treat cancer, and wherein the cancer is associated with the BCR-ABL gene fusion.

In some embodiments, the peptide composition is configured for administration in an effective amount to a subject to treat cancer.

In another aspect, described herein are nucleic acid sequences encoding one or more amino acid sequences selected from the group consisting of SEQ ID NOs: 46 to 112.

In some embodiments, the nucleic acid sequence are contained in a construct for in vivo expression of the nucleic acid sequences.

In some embodiments, an administration of the nucleic acid sequences causes one or more peptides encoded by the nucleic acid sequences to be displayed by an HLA class II molecule in a subject.

In some embodiments, the one or more amino acid sequences are derived from a modified or an unmodified fragment of a BCL-ABL gene fusion. In some embodiments, the BCR-ABL gene fusion is b3a2 or b2a2. In some embodiments, the one or more amino acid sequences are selected based on a prevalence of the BCR-ABL gene fusion in a risk group that the subject belongs to, and wherein the composition is administered in an effective amount to the subject to promote an immune response against cancer or to treat cancer, and wherein the cancer is associated with the BCR-ABL gene fusion.

In some embodiments, the composition is configured for administration in an effective amount to a subject to treat cancer.

In some embodiments, the nucleic acid sequences encode at least two amino acid sequences selected from the group consisting of SEQ ID NOs: 46 to 112.

In another aspect, described herein is a peptide composition comprising one or more peptides selected from the group consisting of SEQ ID NOs: 46 to 112.

In some embodiments, a peptide in the peptide composition is configured for display by an HLA class II molecule in a subject.

In some embodiments, a peptide in the peptide composition is a modified or an unmodified fragment of a BCL-ABL gene fusion. In some embodiments, the BCR-ABL gene fusion is b3a2 or b2a2. In some embodiments, the one or more peptides are selected based on a prevalence of the BCR-ABL gene fusion in a risk group that the subject belongs to, and wherein the peptide composition is administered in an effective amount to the subject to promote an immune response against cancer or to treat cancer, and wherein the cancer is associated with the BCR-ABL gene fusion.

In some embodiments, the peptide composition is configured for administration in an effective amount to a subject to treat cancer.

MHC Class I Peptide Sequences

In some embodiments, a peptide vaccine (single target or combined multiple target vaccine) comprises about 1 to 40 MHC class I peptides with each peptide consisting of 8 or more amino acids. In some embodiments, an MHC class I peptide vaccine is intended for a BCR-ABL gene fusion. In some embodiments, the BCR-ABL gene fusion is selected from the group consisting of b3a2 and b2a2. In some embodiments, an MHC class I peptide vaccine is intended to prevent cancer. In some embodiments, an MHC class I peptide vaccine is intended to treat cancer. In some embodiments, an MHC class I peptide vaccine is intended to prevent chronic myelogenous leukemia (CML), acute lymphoblastic leukemia (ALL), acute myelogenous leukemia (AML), or breast invasive ductal carcinoma. In some embodiments, an MHC class I peptide vaccine is intended to treat chronic myelogenous leukemia (CIVIL), acute lymphoblastic leukemia (ALL), acute myelogenous leukemia (AML), or breast invasive ductal carcinoma.

In some embodiments, the amino acid sequence vaccine for a MHC class I peptide vaccine for BCR-ABL comprises one or more of the SEQ ID NOs: 1 to 45. In some embodiments, any one of the peptides in the BCR-ABL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 1 to 45.

In some embodiments, the amino acid sequence vaccine for a MHC class I peptide vaccine for BCR-ABL comprises two or more of the SEQ ID NOs: 1 to 45. In some embodiments, any one of the peptides in the BCR-ABL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 1 to 45.

Table 1 shows MHC class I peptide sequences described herein including the respective SEQ ID NO, amino acid sequence corresponding to the SEQ ID NO, the seed amino acid sequence (i.e., the amino acid sequence of the wild type BCR-ABL protein fusion fragment), the amino acid substitution (if any) for heteroclitic peptides at positions 2 and C (carboxyl terminus), and notes detailing embodiments in which the peptide may be included in a combined peptide vaccine as described herein. SEQ ID NOs: 1-33, and 45 are derived from BCR-ABL b3a2, while SEQ ID NOs: 34-44 are derived from BCR-ABL b2a2. In some embodiments, any combination of peptides listed in Table 1 (SEQ ID NOs: 1 to 45) may be used to create a combined peptide vaccine having between about 1 and about 40 peptides. In some embodiments, any one of the peptides (peptides 1 to 45; SEQ ID NOs: 1 to 45) in the combined vaccine comprises an amino acid sequence 80, 81, 82, 83, 84, 85, 86, 87, 88, 89, 90, 91, 92, 93, 94, 95, 96, 97, 98 or 99% identical to any of SEQ ID NOs: 1 to 45.

In some embodiments, any combination of the peptides listed in Table 1 in the "b3a2 Vaccine" column (SEQ ID NOs: 1 to 33 and SEQ ID NO: 45) may be used to create a combined peptide vaccine having between about 1 and about 40 peptides. In some embodiments, any one of these peptides in the combined vaccine comprises an amino acid sequence 80, 81, 82, 83, 84, 85, 86, 87, 88, 89, 90, 91, 92, 93, 94, 95, 96, 97, 98 or 99% identical to the peptides listed in Table 1 in the "b3a2 Vaccine" column (SEQ ID NOs: 1 to 33 and SEQ ID NO: 45).

In some embodiments, any combination of the peptides listed in Table 1 in the "b2a2 Vaccine" column (SEQ ID NOs: 34 to 44) may be used to create a combined peptide vaccine having between about 1 and about 40 peptides. In some embodiments, any one of these peptides in the combined vaccine comprises an amino acid sequence 80, 81, 82, 83, 84, 85, 86, 87, 88, 89, 90, 91, 92, 93, 94, 95, 96, 97, 98 or 99% identical to the peptides listed in Table 1 in the "b2a2 Vaccine" column (SEQ ID NOs: 34 to 44).

Additional amino acid sequences of MHC class I vaccine peptides are provided in Sequence Listings (SEQ ID NOs: 113 to 700). In some embodiments, any combination of MHC class I peptides disclosed herein (SEQ ID NOs: 1 to 45 and SEQ ID NOs: 113 to 700) may be used to create a combined peptide vaccine having between about 1 and about 40 peptides. In some embodiments, any one of the peptides (SEQ ID NOs: 1 to 45 and SEQ ID NOs: 113 to 700) in the combined vaccine comprises or contains an amino acid sequence 80, 81, 82, 83, 84, 85, 86, 87, 88, 89, 90, 91, 92, 93, 94, 95, 96, 97, 98 or 99% identical to any of SEQ ID NOs: 1 to 45 or SEQ ID NOs: 113 to 700.

TABLE 1

Example Vaccine Peptides (MHC class 1)

| SEQ ID NO | Sequence corresponding to SEQ ID | Seed | Heteroclitic Modification P2 | Heteroclitic Modification C-term | Present in b3a2 Vaccine Sizes | Present in b2a2 Vaccine Sizes |
|---|---|---|---|---|---|---|
| SEQ ID NO: 1 | STTGFKQSSK | SATGFKQSSK | A2T | — | 1-30 | |
| SEQ ID NO: 2 | STKALQRPV | SSKALQRPV | S2T | — | 11-19, 23-30 | |
| SEQ ID NO: 3 | KQLQRPVASDF | KALQRPVASDF | A2Q | — | 12-30 | |
| SEQ ID NO: 4 | SVTGFKQSSR | SATGFKQSSK | A2V | K10R | 13-30 | |
| SEQ ID NO: 5 | GYKQSSKAL | GFKQSSKAL | F2Y | — | 14-30 | |
| SEQ ID NO: 6 | KVSSKALQR | KQSSKALQR | Q2V | — | 15-30 | |

TABLE 1-continued

Example Vaccine Peptides (MHC class 1)

| SEQ ID NO | Sequence | Sequence corresponding to SEQ ID Seed | Heteroclitic Modifi-P2 | Heteroclitic Modifi-C-term | Present in b3a2 Vaccine Sizes | Present in b2a2 Vaccine Sizes |
|---|---|---|---|---|---|---|
| SEQ ID NO: 7 | SAKALQRPF | SSKALQRPV | S2A | V9F | 16-30 | |
| SEQ ID NO: 8 | SSKALQRPA | SSKALQRPV | — | V9A | 17-19, 23-30 | |
| SEQ ID NO: 9 | SATGFKQSSR | SATGFKQSSK | — | K10R | 18-30 | |
| SEQ ID NO: 10 | GYKQSSKAF | GFKQSSKAL | F2Y | L9F | 19-30 | |
| SEQ ID NO: 11 | AMGFKQSSK | ATGFKQSSK | T2M | — | 2-30 | |
| SEQ ID NO: 12 | SGKALQRPK | SSKALQRPV | S2G | V9K | 20-22 | |
| SEQ ID NO: 13 | SIKALQRPA | SSKALQRPV | S2I | V9A | 20-22 | |
| SEQ ID NO: 14 | KSSSKALQR | KQSSKALQR | Q2S | — | 20-30 | |
| SEQ ID NO: 15 | STKALQRPK | SSKALQRPV | S2T | V9K | 21-22, 29-30 | |
| SEQ ID NO: 16 | HTATGFKQSSR | HSATGFKQSSK | S2T | K11R | 22-30 | |
| SEQ ID NO: 17 | KMSSKALQR | KQSSKALQR | Q2M | — | 23-30 | |
| SEQ ID NO: 18 | STKALQRPVK | SSKALQRPVA | S2T | A10K | 23-30 | |
| SEQ ID NO: 19 | SQKALQRPK | SSKALQRPV | S2Q | V9K | 24-30 | |
| SEQ ID NO: 20 | KTSSKALQR | KQSSKALQR | Q2T | — | 25-30 | |
| SEQ ID NO: 21 | KLSSKALQR | KQSSKALQR | Q2L | — | 27-30 | |
| SEQ ID NO: 22 | SVKALQRPV | SSKALQRPV | S2V | — | 28 | |
| SEQ ID NO: 23 | KISSKALQR | KQSSKALQR | Q2I | — | 29-30 | |
| SEQ ID NO: 24 | SAKALQRPY | SSKALQRPV | S2A | V9Y | 3-7, 10-30 | |
| SEQ ID NO: 25 | SVKALQRPK | SSKALQRPV | S2V | V9K | 30 | |
| SEQ ID NO: 26 | STKALQRPS | SSKALQRPV | S2T | V9S | 4-7, 26, 29-30 | |
| SEQ ID NO: 27 | KQLQRPVASDY | KALQRPVASDF | A2Q | F11Y | 5-30 | |
| SEQ ID NO: 28 | STTGFKQSSR | SATGFKQSSK | A2T | K10R | 6-30 | |
| SEQ ID NO: 29 | GYKQSSKAM | GFKQSSKAL | F2Y | L9M | 7-30 | |
| SEQ ID NO: 30 | STKALQRPL | SSKALQRPV | S2T | V9L | 8-19, 23-30 | |
| SEQ ID NO: 31 | KYSSKALQR | KQSSKALQR | Q2Y | — | 8-30 | |
| SEQ ID NO: 32 | SAKALQRPM | SSKALQRPV | S2A | V9M | 8-30 | |
| SEQ ID NO: 33 | KTLQRPVASDW | KALQRPVASDF | A2T | F11W | 9-30 | |
| SEQ ID NO: 34 | LAINKEEAM | LTINKEEAL | T2A | L9M | | 1-10 |
| SEQ ID NO: 35 | KEEALQRPVL | KEEALQRPVA | — | A10L | | 10 |
| SEQ ID NO: 36 | LSINKEEAW | LTINKEEAL | T2S | L9W | | 10 |
| SEQ ID NO: 37 | KEEALQRPL | KEEALQRPV | — | V9L | | 2-10 |
| SEQ ID NO: 38 | KEEALQRPA | KEEALQRPV | — | V9A | | 3-10 |
| SEQ ID NO: 39 | LTINKEEAW | LTINKEEAL | — | L9W | | 4, 7-10 |
| SEQ ID NO: 40 | LAINKEEAL | LTINKEEAL | T2A | — | | 5-10 |
| SEQ ID NO: 41 | KEEALQRPM | KEEALQRPV | — | V9M | | 5-6, 9 |
| SEQ ID NO: 42 | LAINKEEAY | LTINKEEAL | T2A | L9Y | | 6-10 |

TABLE 1-continued

Example Vaccine Peptides (MHC class 1)

| SEQ ID NO | Sequence corresponding to SEQ ID | Seed | Heteroclitic Modification P2 | Heteroclitic Modification C-term | Present in b3a2 Vaccine Sizes | Present in b2a2 Vaccine Sizes |
|---|---|---|---|---|---|---|
| SEQ ID NO: 43 | LTINKEEAF | LTINKEEAL | — | L9F | | 7-10 |
| SEQ ID NO: 44 | LAINKEEAF | LTINKEEAL | T2A | L9F | | 8-10 |
| SEQ ID NO: 45 | SSKALQRPVA | SSKALQRPVA | — | | 20-22, 27-28 | |

MHC Class II Peptide Sequences

In some embodiments, a peptide vaccine (single target or combined multiple target vaccine) comprises about 1 to 40 MHC class II peptides with each peptide consisting of about 20 amino acids. In some embodiments, an MHC class II peptide vaccine is intended for a BCR-ABL gene fusion. In some embodiments, the BCR-ABL gene fusion is selected from the group consisting of b3a2 and b2a2. In some embodiments, an MHC class II peptide vaccine is intended to prevent cancer. In some embodiments, an MHC class II peptide vaccine is intended to treat cancer. In some embodiments, an MHC class I peptide vaccine is intended to prevent chronic myelogenous leukemia (CML), acute lymphoblastic leukemia (ALL), acute myelogenous leukemia (AML), or breast invasive ductal carcinoma. In some embodiments, an MHC class I peptide vaccine is intended to treat chronic myelogenous leukemia (CIVIL), acute lymphoblastic leukemia (ALL), acute myelogenous leukemia (AML), or breast invasive ductal carcinoma.

In some embodiments, the amino acid sequence vaccine for a MHC class II peptide vaccine for BCR-ABL comprises one or more of the SEQ ID NOs: 46 to 112. In some embodiments, any one of the peptides in the BCR-ABL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 46 to 112.

In some embodiments, the amino acid sequence vaccine for a MHC class II peptide vaccine for BCR-ABL comprises two or more of the SEQ ID NOs: 46 to 112. In some embodiments, any one of the peptides in the BCR-ABL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 46 to 112.

Table 2 summarizes MHC class II peptide sequences described herein including the respective SEQ ID NO, amino acid sequence corresponding to the SEQ ID NO, the amino acid sequence corresponding to the peptide's binding core, the seed amino acid sequence (i.e., the amino acid sequence of the wild type BCR-ABL protein fusion fragment), the seed amino acid sequence of the binding core, and the amino acid substitution (if any) for heteroclitic peptides at positions 1, 4, 6, and 9. Table 2 includes peptide sequences comprising SEQ ID NOs: 46 to 112. SEQ ID NOs: 46 to 112 (Table 2) encode for recombinant peptides. SEQ ID NOs: 46-78 are derived from BCR-ABL b3a2, while SEQ IS NOs: 79-112 are derived from BCR-ABL b2a2. In some embodiments, any combination of peptides listed in Table 2 (SEQ ID NOs: 46 to 112) may be used to create a single target (individual) or combined peptide vaccine having between about 1 and about 40 peptides. In some embodiments, any one of the peptides (peptides 46 to 112; SEQ ID NOs: 46 to 112) in the combined vaccine comprises an amino acid sequence 80, 81, 82, 83, 84, 85, 86, 87, 88, 89, 90, 91, 92, 93, 94, 95, 96, 97, 98 or 99% identical to any of SEQ ID NOs: 46 to 112.

In some embodiments, any combination of the peptides listed in Table 2 in the "b3a2 Vaccine" column (SEQ ID NOs: 46 to 78) may be used to create a combined peptide vaccine having between about 1 and about 40 peptides. In some embodiments, any one of these peptides in the combined vaccine comprises an amino acid sequence 80, 81, 82, 83, 84, 85, 86, 87, 88, 89, 90, 91, 92, 93, 94, 95, 96, 97, 98 or 99% identical to the peptides listed in Table 2 in the "b3a2 Vaccine" column (SEQ ID NOs: 46 to 78).

In some embodiments, any combination of the peptides listed in Table 2 in the "b2a2 Vaccine" column (SEQ ID NOs: 79 to 112) may be used to create a combined peptide vaccine having between about 1 and about 40 peptides. In some embodiments, any one of these peptides in the combined vaccine comprises an amino acid sequence 80, 81, 82, 83, 84, 85, 86, 87, 88, 89, 90, 91, 92, 93, 94, 95, 96, 97, 98 or 99% identical to the peptides listed in Table 2 in the "b2a2 Vaccine" column (SEQ ID NOs: 79 to 112).

Additional amino acid sequences of MHC class II vaccine peptides are provided in Sequence Listings (SEQ ID NOs: 701 to 62112). In some embodiments, any combination of MHC class II peptides disclosed herein (SEQ ID NOs: 46 to 112 and SEQ ID NOs: 701 to 62112) may be used to create a combined peptide vaccine having between about 1 and about 40 peptides. In some embodiments, any one of the peptides (SEQ ID NOs: 46 to 112 and SEQ ID NOs: 701 to 62112) in the combined vaccine comprises or contains an amino acid sequence 80, 81, 82, 83, 84, 85, 86, 87, 88, 89, 90, 91, 92, 93, 94, 95, 96, 97, 98 or 99% identical to any of SEQ ID NOs: 46 to 112 or SEQ ID NOs: 701 to 62112.

In some embodiments, any combination of WIC class I and/or MEW class II peptides disclosed herein (SEQ ID NOs: 1 to 62113) may be used to create a single target (individual) or combined peptide vaccine having between about 2 and about 40 peptides. In some embodiments, any one of the peptides (peptides 1 to 62113; SEQ ID NOs: 1 to 62113) in the combined vaccine comprises an amino acid sequence 80, 81, 82, 83, 84, 85, 86, 87, 88, 89, 90, 91, 92, 93, 94, 95, 96, 97, 98 or 99% identical to any of SEQ ID NOs: 1 to 62113.

TABLE 2

Example Vaccine Peptides (MHC class II)

| SEQ ID NO | Sequence corresponding to SEQ ID | Core | Seed | Seed Core | Heteroclitic Modification P1 | Heteroclitic Modification P4 | Heteroclitic Modification P6 | Heteroclitic Modification P9 | Present in b3a2 Vaccine Sizes | Present in b2a2 Vaccine Sizes |
|---|---|---|---|---|---|---|---|---|---|---|
| SEQ ID NO: 46 | LNVIVHSATGFKQIS AALARPVASD | FKQIS AALA | LNVIVHSATGFKQS SKALQRPVASD | FKQSS KALQ | — | S4I | K6A | Q9A | 1-2, 18-30 | |
| SEQ ID NO: 47 | LNVIVHSATGIKQISA ALIRPVASD | IKQISA ALI | LNVIVHSATGFKQS SKALQRPVASD | FKQSS KALQ | F1I | S4I | K6A | Q9I | 10-30 | |
| SEQ ID NO: 48 | SATGFKQISRALARP VASDF | FKQISR ALA | SATGFKQSSKALQR PVASDF | FKQSS KALQ | — | S4I | K6R | Q9A | 12-30 | |
| SEQ ID NO: 49 | YGFLNVIVHSATGYK QFSWALMRPV | YKQFS WALM | YGFLNVIVHSATGF KQSSKALQRPV | FKQSS KALQ | F1Y | S4F | K6W | Q9M | 13-14, 16-17 | |
| SEQ ID NO: 50 | SATGFKQTSFALIRPV ASDF | FKQTS FALI | SATGFKQSSKALQR PVASDF | FKQSS KALQ | — | S4T | K6F | Q9I | 13-30 | |
| SEQ ID NO: 51 | YGFLNVIVHSATGFK QNSTALARPV | FKQNS TALA | YGFLNVIVHSATGF KQSSKALQRPV | FKQSS KALQ | — | S4N | K6T | Q9A | 14-30 | |
| SEQ ID NO: 52 | SATGFKQSSRALARA VAADF | RALAR AVAA | SATGFKQSSKALQR PVASDF | KALQR PVAS | K1R | Q4A | P6A | S9A | 15-30 | |
| SEQ ID NO: 53 | LNVIVHSATGMKQFS AALVRPVASD | MKQFS AALV | LNVIVHSATGFKQS SKALQRPVASD | FKQSS KALQ | F1M | S4F | K6A | Q9V | 16-17, 22 | |
| SEQ ID NO: 54 | SATGFNQSAKVLQGP VASDF | NQSAK VLQG | SATGFKQSSKALQR PVASDF | KQSSK ALQR | K1N | S4A | A6V | R9G | 17-30 | |
| SEQ ID NO: 55 | LNVIVHSATGYKQFS AALTRPVASD | YKQFS AALT | LNVIVHSATGFKQS SKALQRPVASD | FKQSS KALQ | F1Y | S4F | K6A | Q9T | 18-21, 23-30 | |
| SEQ ID NO: 56 | SATGFKQFSLALRRP VASDF | FKQFS LALR | SATGFKQSSKALQR PVASDF | FKQSS KALQ | — | S4F | K6L | Q9R | 19-30 | |
| SEQ ID NO: 57 | SATGFKQFSVALRRP VASDF | FKQFS VALR | SATGFKQSSKALQR PVASDF | FKQSS KALQ | — | S4F | K6V | Q9R | 2-4, 11-30 | |
| SEQ ID NO: 58 | SATGFKQISYALIRPV ASDF | FKQIS YALI | SATGFKQSSKALQR PVASDF | FKQSS KALQ | — | S4I | K6Y | Q9I | 20-30 | |
| SEQ ID NO: 59 | YGFLNVIVHSATGFK QISTALARPV | FKQIST ALA | YGFLNVIVHSATGF KQSSKALQRPV | FKQSS KALQ | — | S4I | K6T | Q9A | 21-30 | |
| SEQ ID NO: 60 | LNVIVHSATGIKQISR ALARPVASD | IKQISR ALA | LNVIVHSATGFKQS SKALQRPVASD | FKQSS KALQ | F1I | S4I | K6R | Q9A | 22-30 | |
| SEQ ID NO: 61 | SATGFKQSSRALIRPV ATDF | RALIRP VAT | SATGFKQSSKALQR PVASDF | KALQR PVAS | K1R | Q4I | — | S9T | 23-30 | |
| SEQ ID NO: 62 | LNVIVHSATGYKQIS AALARPVASD | YKQIS AALA | LNVIVHSATGFKQS SKALQRPVASD | FKQSS KALQ | F1Y | S4I | K6A | Q9A | 24, 29-30 | |
| SEQ ID NO: 63 | LNVIVHSATGWKQFS AALVRPVASD | WKQFS AALV | LNVIVHSATGFKQS SKALQRPVASD | FKQSS KALQ | F1W | S4F | K6A | Q9V | 25-30 | |
| SEQ ID NO: 64 | SATGFKQFSLALKRP VASDF | FKQFS LALK | SATGFKQSSKALQR PVASDF | FKQSS KALQ | — | S4F | K6L | Q9K | 25-30 | |
| SEQ ID NO: 65 | SATGFKQESFALIRPV ASDF | FKQES FALI | SATGFKQSSKALQR PVASDF | FKQSS KALQ | — | S4E | K6F | Q9I | 26-30 | |
| SEQ ID NO: 66 | SATGFKQISRALTRP VASDF | FKQISR ALT | SATGFKQSSKALQR PVASDF | FKQSS KALQ | — | S4I | K6R | Q9T | 27-30 | |
| SEQ ID NO: 67 | YGFLNVIVHSATGFK QNSNALARPV | FKQNS NALA | YGFLNVIVHSATGF KQSSKALQRPV | FKQSS KALQ | — | S4N | K6N | Q9A | 28-30 | |
| SEQ ID NO: 68 | LNVIVHSATGIKQISS ALIRPVASD | IKQISS ALI | LNVIVHSATGFKQS SKALQRPVASD | FKQSS KALQ | F1I | S4I | K6S | Q9I | 3-30 | |
| SEQ ID NO: 69 | SATGFKQISRALSRPV ASDF | FKQISR ALS | SATGFKQSSKALQR PVASDF | FKQSS KALQ | — | S4I | K6R | Q9S | 3-30 | |

TABLE 2-continued

Example Vaccine Peptides (MHC class II)

| SEQ ID NO | Sequence corresponding to SEQ ID | Core | Seed | Seed Core | Heteroclitic Modification P1 | Heteroclitic Modification P4 | Heteroclitic Modification P6 | Heteroclitic Modification P9 | Present in b3a2 Vaccine Sizes | Present in b2a2 Vaccine Sizes |
|---|---|---|---|---|---|---|---|---|---|---|
| SEQ ID NO: 70 | SATGFKQASFALVRP VASDF | FKQAS FALV | SATGFKQSSKALQR PVASDF | FKQSS KALQ | — | S4A | K6F | Q9V | 30 | |
| SEQ ID NO: 71 | SATGFKQSSFALIRPV ASDF | FKQSS FALI | SATGFKQSSKALQR PVASDF | FKQSS KALQ | — | | K6F | Q9I | 4-30 | |
| SEQ ID NO: 72 | YGFLNVIVHSATGFK QISAALARPV | FKQIS AALA | YGFLNVIVHSATGF KQSSKALQRPV | FKQSS KALQ | — | S4I | K6A | Q9A | 5, 7 | |
| SEQ ID NO: 73 | SATGFKQFSIALRRPV ASDF | FKQFSI ALR | SATGFKQSSKALQR PVASDF | FKQSS KALQ | — | S4F | K6I | Q9R | 5-30 | |
| SEQ ID NO: 74 | YGFLNVIVHSATGIK QASNALARPV | IKQAS NALA | YGFLNVIVHSATGF KQSSKALQRPV | FKQSS KALQ | F1I | S4A | K6N | Q9A | 6, 8-30 | |
| SEQ ID NO: 75 | SATGFKQSSRALSRA VANDF | RALSR AVAN | SATGFKQSSKALQR PVASDF | KALQR PVAS | K1R | Q4S | P6A | S9N | 6-30 | |
| SEQ ID NO: 76 | SATGFNQSAKVLQAP VASDF | NQSAK VLQA | SATGFKQSSKALQR PVASDF | KQSSK ALQR | K1N | S4A | A6V | R9A | 7-30 | |
| SEQ ID NO: 77 | SATGFFQSKKFLQVP VASDF | FQSKK FLQV | SATGFKQSSKALQR PVASDF | KQSSK ALQR | K1F | S4K | A6F | R9V | 8-30 | |
| SEQ ID NO: 78 | YGFLNVIVHSATGFK QTSFALNRPV | FKQTS FALN | YGFLNVIVHSATGF KQSSKALQRPV | FKQSS KALQ | — | S4T | K6F | Q9N | 9-12, 15, 18-30 | |
| SEQ ID NO: 79 | NSCVKLQTVHSIPFTI NKFEAIQRP | FTINKF EAI | NSCVKLQTVHSIPL TINKEEALQRP | LTINK EEAL | L1F | — | E6F | L9I | 1-30 | |
| SEQ ID NO: 80 | VKLQTVHSIPLTINKI ETLQAPVAS | INKIET LQA | VKLQTVHSIPLT INKEEALQRPVAS | INKEE ALQR | — | E4I | A6T | R9A | 10-30 | |
| SEQ ID NO: 81 | QTVHSIPLTINKEFAL MRPVANDFE | FALMR PVAN | QTVHSIPLTINK EEALQRPVASDFE | EALQR PVAS | E1F | Q4M | — | S9N | 11-30 | |
| SEQ ID NO: 82 | NSCVKLQTVHSIPFTI SKFEALQRP | FTISKF EAL | NSCVKLQTVHSIPL TINKEEALQRP | LTINK EEAL | L1F | N4S | E6F | — | 12-30 | |
| SEQ ID NO: 83 | VKLQTVHSIPITIIK AEAYQRPVAS | ITIIKA EAY | VKLQTVHSIPLT INKEEALQRPVAS | LTINK EEAL | L1I | N4I | E6A | L9Y | 12-30 | |
| SEQ ID NO: 84 | LQTVHSIPFTITKAEA IQR | FTITKA EAI | LQTVHSIPLTIN KEEALQRP | LTINK EEAL | L1F | N4T | E6A | L9I | 13, 21-22, 25-30 | |
| SEQ ID NO: 85 | LQTVHSIPFTIIKA EAIQR | FTIIKA EAI | LQTVHSIPLTINK EEALQR | LTINK EEAL | L1F | N4I | E6A | L9I | 14-30 | |
| SEQ ID NO: 86 | VKLQTVHSIPLTINKF ESLQIPVAS | INKFES LQI | VKLQTVHSIPLT INKEEALQRPVAS | INKEE ALQR | — | E4F | A6S | R9I | 14-30 | |
| SEQ ID NO: 87 | NSCVKLQTVHSIPFTI IKNEAVQRP | FTIIKN EAV | NSCVKLQTVHSIPL TINKEEALQRP | LTINK EEAL | L1F | N4I | E6N | L9V | 15-30 | |
| SEQ ID NO: 88 | VKLQTVHSIPLTFNK FESLQAPVAS | FNKFE SLQA | VKLQTVHSIPLT INKEEALQRPVAS | INKEE ALQR | I1F | E4F | A6S | R9A | 16-30 | |
| SEQ ID NO: 89 | NSCVKLQTVHSIP ITIIKAEALQRP | ITIIKA EAL | NSCVKLQTVHSIPL TINKEEALQRP | LTINK EEAL | L1I | N4I | E6A | — | 17-30 | |
| SEQ ID NO: 90 | VKLQTVHSIPLTIFKS EAVQRPVAS | LITFKS EAV | VKLQTVHSIPLT INKEEALQRPVAS | LTINK EEAL | — | N4F | E6S | L9V | 18 | |
| SEQ ID NO: 91 | NSCVKLQTVHSIPITI FKNEALQRP | ITIFKN EAL | NSCVKLQTVHSIPL TINKEEALQRP | LTINK EEAL | L1I | N4F | E6N | — | 19-30 | |
| SEQ ID NO: 92 | VKLQTVHSIPITIF KSEAIQRPVAS | ITIFKS EAI | VKLQTVHSIPLT INKEEALQRPVAS | LTINK EEAL | LII | N4F | E6S | L9I | 19-30 | |

TABLE 2-continued

Example Vaccine Peptides (MHC class II)

| SEQ ID NO | Sequence corresponding to SEQ ID | Core | Seed | Seed Core | Heteroclitic Modification P1 | Heteroclitic Modification P4 | Heteroclitic Modification P6 | Heteroclitic Modification P9 | Present in b3a2 Vaccine Sizes | Present in b2a2 Vaccine Sizes |
|---|---|---|---|---|---|---|---|---|---|---|
| SEQ ID NO: 93 | VKLQTVHSIPLTFNKFESLQVPVAS | FNKFESLQV | VKLQTVHSIPLTINKEEALQRPVAS | INKEEALQR | I1F | E4F | A6S | R9V | | 2-30 |
| SEQ ID NO: 94 | VKLQTVHSIPITILKSEAFQRPVAS | ITILKSEAF | VKLQTVHSIPLTINKEEALQRPVAS | LTINKEEAL | L1I | N4L | E6S | L9F | | 20 |
| SEQ ID NO: 95 | NSCVKLQTVHSIPITILKSEAFQRP | ITILKSEAF | NSCVKLQTVHSIPLTINKEEALQRP | LTINKEEAL | L1I | N4L | E6S | L9F | | 21-24, 26-30 |
| SEQ ID NO: 96 | VKLQTVHSIPLTINKFEALQIPVAS | INKFEALQI | VKLQTVHSIPLTINKEEALQRPVAS | INKEEALQR | — | E4F | — | R9I | | 22-30 |
| SEQ ID NO: 97 | LQTVHSIPFTIIKAEAVQR | FTIIKAEAV | LQTVHSIPLTINKEEALQR | LTINKEEAL | L1F | N4I | E6A | L9V | | 23-24, 30 |
| SEQ ID NO: 98 | NSCVKLQTVHSIPFTIMKSEAAQRP | FTIMKSEAA | NSCVKLQTVHSIPLTINKEEALQRP | LTINKEEAL | L1F | N4M | E6S | L9A | | 23-30 |
| SEQ ID NO: 99 | VKLQTVHSIPLTFNKLESLQAPVAS | FNKLESLQA | VKLQTVHSIPLTINKEEALQRPVAS | INKEEALQR | I1F | E4L | A6S | R9A | | 24-30 |
| SEQ ID NO: 100 | VKLQTVHSIPITILKNEAFQRPVAS | ITILKNEAF | VKLQTVHSIPLTINKEEALQRPVAS | LTINKEEAL | L1I | N4L | E6N | L9F | | 25 |
| SEQ ID NO: 101 | NSCVKLQTVHSIPFTINKFEALQRP | FTINKFEAL | NSCVKLQTVHSIPLTINKEEALQRP | LTINKEEAL | L1F | — | E6F | — | | 25-30 |
| SEQ ID NO: 102 | VKLQTVHSIPLTINKIERLQKPVAS | INKIERLQK | VKLQTVHSIPLTINKEEALQRPVAS | INKEEALQR | — | E4I | A6R | R9K | | 26-30 |
| SEQ ID NO: 103 | VKLQTVHSIPFTIFKSEALQRPVAS | FTIFKSEAL | VKLQTVHSIPLTINKEEALQRPVAS | LTINKEEAL | L1F | N4F | E6S | — | | 27-30 |
| SEQ ID NO: 104 | NSCVKLQTVHSIPITIFKSEALQRP | ITIFKSEAL | NSCVKLQTVHSIPLTINKEEALQRP | LTINKEEAL | L1I | N4F | E6S | — | | 28-30 |
| SEQ ID NO: 105 | VKLQTVHSIPLTILKSEAYQRPVAS | LTILKSEAY | VKLQTVHSIPLTINKEEALQRPVAS | LTINKEEAL | — | N4L | E6S | L9Y | | 29-30 |
| SEQ ID NO: 106 | LQTVHSIPFTITKSEAIQR | FTITKSEAI | LQTVHSIPLTINKEEALQR | LTINKEEAL | L1F | N4T | E6S | L9I | | 3-30 |
| SEQ ID NO: 107 | QTVHSIPLTINKDEPLQFPVASDFE | INKDEPLQF | QTVHSIPLTINKEEALQRPVASDFE | INKEEALQR | — | E4D | A6P | R9F | | 4-30 |
| SEQ ID NO: 108 | NSCVKLQTVHSIPFTIMKSEAVQRP | FTIMKSEAV | NSCVKLQTVHSIPLTINKEEALQRP | LTINKEEAL | L1F | N4M | E6S | L9V | | 5-30 |
| SEQ ID NO: 109 | VKLQTVHSIPLTINKIERLQRPVAS | INKIERLQR | VKLQTVHSIPLTINKEEALQRPVAS | INKEEALQR | — | E4I | A6R | — | | 6-30 |
| SEQ ID NO: 110 | VKLQTVHSIPITIFKSEALQRPVAS | ITIFKSEAL | VKLQTVHSIPLTINKEEALQRPVAS | LTINKEEAL | L1I | N4F | E6S | — | | 7-30 |
| SEQ ID NO: 111 | NSCVKLQTVHSIPITIYKAEALQRP | ITIYKAEAL | NSCVKLQTVHSIPLTINKEEALQRP | LTINKEEAL | L1I | N4Y | E6A | — | | 8-30 |
| SEQ ID NO: 112 | NSCVKLQTVHSIPITILKAEAFQRP | ITILKAEAF | NSCVKLQTVHSIPLTINKEEALQRP | LTINKEEAL | L1I | N4L | E6A | L9F | | 9-11 |

Compositions

In some embodiments, a peptide vaccine comprises one or more peptides of this disclosure and is administered in a pharmaceutical composition that includes a pharmaceutically acceptable carrier. In some embodiments, the peptide vaccine is comprised of the third peptide set, as described in this disclosure. In some embodiments, the pharmaceutical composition is in the form of a spray, aerosol, gel, solution, emulsion, lipid nanoparticle, nanoparticle, or suspension. In some embodiments, the pharmaceutical composition is in the form of a cationic nanoemulsion, one example of which is described by Brito et al. (2014) that is incorporated herein by reference.

The composition is preferably administered to a subject with a pharmaceutically acceptable carrier. Typically, in some embodiments, an appropriate amount of a pharmaceutically acceptable salt is used in the formulation, which in some embodiments can render the formulation isotonic.

In certain embodiments, the peptides are provided as an immunogenic composition comprising any one of the peptides described herein and a pharmaceutically acceptable carrier. In certain embodiments, the immunogenic composition further comprises an adjuvant. In certain embodiments, the peptides are conjugated with other molecules to increase their effectiveness as is known by those practiced in the art. For example, peptides can be coupled to antibodies that recognize cell surface proteins on antigen presenting cells to enhance vaccine effectiveness. One such method for increasing the effectiveness of peptide delivery is described in Woodham, et al. (2018). In certain embodiments for the treatment of autoimmune disorders, the peptides are delivered with a composition and protocol designed to induce tolerance as is known in the art. Example methods for using peptides for immune tolerization are described in Alhadj Ali, et al. (2017) and Gibson, et al. (2015).

In some embodiments, the pharmaceutically acceptable carrier is selected from the group consisting of saline, Ringer's solution, dextrose solution, and a combination thereof. Other suitable pharmaceutically acceptable carriers known in the art are contemplated. Suitable carriers and their formulations are described in Remington's Pharmaceutical Sciences, 2005, Mack Publishing Co. The pH of the solution is preferably from about 5 to about 8, and more preferably from about 7 to about 7.5. The formulation may also comprise a lyophilized powder. Further carriers include sustained release preparations such as semipermeable matrices of solid hydrophobic polymers, which matrices are in the form of shaped articles, e.g., films, liposomes or microparticles. It will be apparent to those persons skilled in the art that certain carriers may be more preferable depending upon, for instance, the route of administration and concentration of peptides being administered.

The phrase pharmaceutically acceptable carrier as used herein means a pharmaceutically acceptable material, composition or vehicle, such as a liquid or solid filler, diluent, excipient, solvent or encapsulating material, involved in carrying or transporting the subject pharmaceutical agent from one organ, or portion of the body, to another organ, or portion of the body. Each carrier is acceptable in the sense of being compatible with the other ingredients of the formulation and not injurious to the patient. Some examples of materials which can serve as pharmaceutically acceptable carriers include: sugars, such as lactose, glucose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as butylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; phosphate buffer solutions; and other non-toxic compatible substances employed in pharmaceutical formulations. The term carrier denotes an organic or inorganic ingredient, natural or synthetic, with which the active ingredient is combined to facilitate the application. The components of the pharmaceutical compositions also are capable of being comingled with the compounds of the present invention, and with each other, in a manner such that there is no interaction which would substantially impair the desired pharmaceutical efficiency. The composition may also include additional agents such as an isotonicity agent, a preservative, a surfactant, and, a divalent cation, preferably, zinc.

The composition can also include an excipient, or an agent for stabilization of a peptide composition, such as a buffer, a reducing agent, a bulk protein, amino acids (such as e.g., glycine or praline) or a carbohydrate. Bulk proteins useful in formulating peptide compositions include albumin. Typical carbohydrates useful in formulating peptides include but are not limited to sucrose, mannitol, lactose, trehalose, or glucose.

Surfactants may also be used to prevent soluble and insoluble aggregation and/or precipitation of peptides or proteins included in the composition. Suitable surfactants include but are not limited to sorbitan trioleate, soya lecithin, and oleic acid. In certain cases, solution aerosols are preferred using solvents such as ethanol. Thus, formulations including peptides can also include a surfactant that can reduce or prevent surface-induced aggregation of peptides by atomization of the solution in forming an aerosol. Various conventional surfactants can be employed, such as polyoxyethylene fatty acid esters and alcohols, and polyoxyethylene sorbitol fatty acid esters. Amounts will generally range between 0.001% and 4% by weight of the formulation. In some embodiments, surfactants used with the present disclosure are polyoxyethylene sorbitan mono-oleate, polysorbate 80, polysorbate 20. Additional agents known in the art can also be included in the composition.

In some embodiments, the pharmaceutical compositions and dosage forms further comprise one or more compounds that reduce the rate by which an active ingredient will decay, or the composition will change in character. So called stabilizers or preservatives may include, but are not limited to, amino acids, antioxidants, pH buffers, or salt buffers. Nonlimiting examples of antioxidants include butylated hydroxy anisole (BHA), ascorbic acid and derivatives thereof, tocopherol and derivatives thereof, butylated hydroxy anisole and cysteine. Nonlimiting examples of preservatives include parabens, such as methyl or propyl p-hydroxybenzoate and benzalkonium chloride. Additional nonlimiting examples of amino acids include glycine or proline.

The present invention also teaches the stabilization (preventing or minimizing thermally or mechanically induced soluble or insoluble aggregation and/or precipitation of an inhibitor protein) of liquid solutions containing peptides at neutral pH or less than neutral pH by the use of amino acids including proline or glycine, with or without divalent cations resulting in clear or nearly clear solutions that are stable at room temperature or preferred for pharmaceutical administration.

In one embodiment, the composition is a pharmaceutical composition of single unit or multiple unit dosage forms. Pharmaceutical compositions of single unit or multiple unit dosage forms of the invention comprise a prophylactically or therapeutically effective amount of one or more compositions (e.g., a compound of the invention, or other prophylactic or therapeutic agent), typically, one or more vehicles, carriers, or excipients, stabilizing agents, and/or preservatives. Preferably, the vehicles, carriers, excipients, stabilizing agents and preservatives are pharmaceutically acceptable.

In some embodiments, the pharmaceutical compositions and dosage forms comprise anhydrous pharmaceutical compositions and dosage forms. Anhydrous pharmaceutical compositions and dosage forms of the invention can be prepared using anhydrous or low moisture containing ingredients and low moisture or low humidity conditions. Pharmaceutical compositions and dosage forms that comprise lactose and at least one active ingredient that comprise a primary or secondary amine are preferably anhydrous if substantial contact with moisture and/or humidity during manufacturing, packaging, and/or storage is expected. An anhydrous pharmaceutical composition should be prepared and stored such that its anhydrous nature is maintained. Accordingly, anhydrous compositions are preferably packaged using materials known to prevent exposure to water such that they can be included in suitable formulary kits. Examples of suitable packaging include, but are not limited to, hermetically sealed foils, plastics, unit dose containers (e.g., vials), blister packs, and strip packs.

Suitable vehicles are well known to those skilled in the art of pharmacy, and non-limiting examples of suitable vehicles include glucose, sucrose, starch, lactose, gelatin, rice, silica gel, glycerol, talc, sodium chloride, dried skim milk, propylene glycol, water, sodium stearate, ethanol, and similar substances well known in the art. Saline solutions and aqueous dextrose and glycerol solutions can also be employed as liquid vehicles. Whether a particular vehicle is suitable for incorporation into a pharmaceutical composition or dosage form depends on a variety of factors well known in the art including, but not limited to, the way in which the dosage form will be administered to a patient and the specific active ingredients in the dosage form. Pharmaceutical vehicles can be sterile liquids, such as water and oils, including those of petroleum, animal, vegetable or synthetic origin, such as peanut oil, soybean oil, mineral oil, sesame oil and the like.

The invention also provides that a pharmaceutical composition can be packaged in a hermetically sealed container such as an ampoule or sachette indicating the quantity. In one embodiment, the pharmaceutical composition can be supplied as a dry sterilized lyophilized powder in a delivery device suitable for administration to the lower airways of a patient. The pharmaceutical compositions can, if desired, be presented in a pack or dispenser device that can contain one or more unit dosage forms containing the active ingredient. The pack can for example comprise metal or plastic foil, such as a blister pack. The pack or dispenser device can be accompanied by instructions for administration.

Methods of preparing these formulations or compositions include the step of bringing into association a compound of the present invention with the carrier and, optionally, one or more accessory ingredients. In general, the formulations are prepared by uniformly and intimately bringing into association a compound of the present invention with liquid carriers, or finely divided solid carriers, or both, and then, if necessary, shaping the product.

Formulations of the invention suitable for administration may be in the form of powders, granules, or as a solution or a suspension in an aqueous or non-aqueous liquid, or as an oil-in-water or water-in-oil liquid emulsion, or as an elixir or syrup, or as pastilles (using an inert base, such as gelatin and glycerin, or sucrose and acacia) and/or as mouthwashes and the like, each containing a predetermined amount of a compound of the present invention (e.g., peptides) as an active ingredient.

A liquid composition herein can be used as such with a delivery device, or they can be used for the preparation of pharmaceutically acceptable formulations comprising peptides that are prepared for example by the method of spray drying. The methods of spray freeze-drying peptides/proteins for pharmaceutical administration disclosed in Maa et al., Curr. Pharm. Biotechnol., 2001, 1, 283-302, are incorporated herein. In another embodiment, the liquid solutions herein are freeze spray dried and the spray-dried product is collected as a dispersible peptide-containing powder that is therapeutically effective when administered to an individual.

The compounds and pharmaceutical compositions of the present invention can be employed in combination therapies, that is, the compounds and pharmaceutical compositions can be administered concurrently with, prior to, or subsequent to, one or more other desired therapeutics or medical procedures (e.g., peptide vaccine can be used in combination therapy with another treatment such as chemotherapy, radiation, pharmaceutical agents, and/or another treatment). The particular combination of therapies (therapeutics or procedures) to employ in a combination regimen will take into account compatibility of the desired therapeutics and/or procedures and the desired therapeutic effect to be achieved. It will also be appreciated that the therapies employed may achieve a desired effect for the same disorder (for example, the compound of the present invention may be administered concurrently with another therapeutic or prophylactic).

The invention also provides a pharmaceutical pack or kit comprising one or more containers filled with one or more of the ingredients of the pharmaceutical compositions of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

The current invention provides for dosage forms comprising peptides suitable for treating cancer or other diseases. The dosage forms can be formulated, e.g., as sprays, aerosols, nanoparticles, liposomes, or other forms known to one of skill in the art. See, e.g., Remington's Pharmaceutical Sciences; Remington: The Science and Practice of Pharmacy supra; Pharmaceutical Dosage Forms and Drug Delivery Systems by Howard C., Ansel et al., Lippincott Williams & Wilkins; 7th edition (Oct. 1, 1999).

Generally, a dosage form used in the acute treatment of a disease may contain larger amounts of one or more of the active ingredients it comprises than a dosage form used in the chronic treatment of the same disease. In addition, the prophylactically and therapeutically effective dosage form may vary among different conditions. For example, a therapeutically effective dosage form may contain peptides that has an appropriate immunogenic action when intending to treat cancer or other disease. On the other hand, a different effective dosage may contain peptides that has an appropriate immunogenic action when intending to use the peptides of the invention as a prophylactic (e.g., vaccine) against cancer or another disease/condition. These and other ways in which specific dosage forms encompassed by this invention will vary from one another and will be readily apparent to those skilled in the art. See, e.g., Remington's Pharmaceutical Sciences, 2005, Mack Publishing Co.; Remington: The Science and Practice of Pharmacy by Gennaro, Lippincott Williams & Wilkins; 20th edition (2003); Pharmaceutical Dosage Forms and Drug Delivery Systems by Howard C. Ansel et al., Lippincott Williams & Wilkins; 7th edition (Oct. 1, 1999); and Encyclopedia of Pharmaceutical Technology, edited by Swarbrick, J. & J. C. Boylan, Marcel Dekker, Inc., New York, 1988, which are incorporated herein by reference in their entirety.

The pH of a pharmaceutical composition or dosage form may also be adjusted to improve delivery and/or stability of one or more active ingredients. Similarly, the polarity of a solvent carrier, its ionic strength, or tonicity can be adjusted to improve delivery. Compounds such as stearates can also be added to pharmaceutical compositions or dosage forms to alter advantageously the hydrophilicity or lipophilicity of one or more active ingredients to improve delivery. In this regard, stearates can also serve as a lipid vehicle for the formulation, as an emulsifying agent or surfactant, and as a delivery enhancing or penetration-enhancing agent. Different salts, hydrates, or solvates of the active ingredients can be used to adjust further the properties of the resulting composition.

Compositions can be formulated with appropriate carriers and adjuvants using techniques to yield compositions suitable for immunization. The compositions can include an adjuvant, such as, for example but not limited to, alum, poly IC, MF-59, squalene-based adjuvants, or liposomal based adjuvants suitable for immunization.

In some embodiments, the compositions and methods comprise any suitable agent or immune modulation which could modulate mechanisms of host immune tolerance and release of the induced antibodies. In certain embodiments, an immunomodulatory agent is administered in at time and in an amount sufficient for transient modulation of the subject's immune response so as to induce an immune response which comprises antibodies against for example tumor neoantigens (i.e., tumor-specific antigens (TSA)).

Expression Systems

In certain aspects, the invention provides culturing a cell line that expresses any one of the peptides of the invention in a culture medium comprising any of the peptides described herein.

Various expression systems for producing recombinant proteins/peptides are known in the art, and include, prokaryotic (e.g., bacteria), plant, insect, yeast, and mammalian expression systems. Suitable cell lines, can be transformed, transduced, or transfected with nucleic acids containing coding sequences for the peptides of the invention in order to produce the molecule of interest. Expression vectors containing such a nucleic acid sequence, which can be linked to at least one regulatory sequence in a manner that allows expression of the nucleotide sequence in a host cell, can be introduced via methods known in the art. Practitioners in the art understand that designing an expression vector can depend on factors, such as the choice of host cell to be transfected and/or the type and/or amount of desired protein to be expressed. Enhancer regions, which are those sequences found upstream or downstream of the promoter region in non-coding DNA regions, are also known in the art to be important in optimizing expression. If needed, origins of replication from viral sources can be employed, such as if a prokaryotic host is utilized for introduction of plasmid DNA. However, in eukaryotic organisms, chromosome integration is a common mechanism for DNA replication. For stable transfection of mammalian cells, a small fraction of cells can integrate introduced DNA into their genomes. The expression vector and transfection method utilized can be factors that contribute to a successful integration event. For stable amplification and expression of a desired protein, a vector containing DNA encoding a protein of interest is stably integrated into the genome of eukaryotic cells (for example mammalian cells), resulting in the stable expression of transfected genes. A gene that encodes a selectable marker (for example, resistance to antibiotics or drugs) can be introduced into host cells along with the gene of interest in order to identify and select clones that stably express a gene encoding a protein of interest. Cells containing the gene of interest can be identified by drug selection wherein cells that have incorporated the selectable marker gene will survive in the presence of the drug. Cells that have not incorporated the gene for the selectable marker die. Surviving cells can then be screened for the production of the desired protein molecule.

A host cell strain, which modulates the expression of the inserted sequences, or modifies and processes the nucleic acid in a specific fashion desired also may be chosen. Such modifications (for example, glycosylation and other post-translational modifications) and processing (for example, cleavage) of peptide/protein products may be important for the function of the peptide/protein. Different host cell strains have characteristic and specific mechanisms for the post-translational processing and modification of proteins and gene products. As such, appropriate host systems or cell lines can be chosen to ensure the correct modification and processing of the target protein expressed. Thus, eukaryotic host cells possessing the cellular machinery for proper processing of the primary transcript, glycosylation, and phosphorylation of the gene product may be used.

Various culturing parameters can be used with respect to the host cell being cultured. Appropriate culture conditions for mammalian cells are well known in the art (Cleveland W L, et al., J Immunol Methods, 1983, 56(2): 221-234) or can be determined by the skilled artisan (see, for example, Animal Cell Culture: A Practical Approach 2nd Ed., Rickwood, D. and Hames, B. D., eds. (Oxford University Press: New York, 1992)). Cell culturing conditions can vary according to the type of host cell selected. Commercially available medium can be utilized.

Peptides of the invention can be purified from any human or non-human cell which expresses the polypeptide, including those which have been transfected with expression constructs that express peptides of the invention. For protein recovery, isolation and/or purification, the cell culture medium or cell lysate is centrifuged to remove particulate cells and cell debris. The desired polypeptide molecule is isolated or purified away from contaminating soluble proteins and polypeptides by suitable purification techniques. Non-limiting purification methods for proteins include: size exclusion chromatography; affinity chromatography; ion exchange chromatography; ethanol precipitation; reverse phase HPLC; chromatography on a resin, such as silica, or cation exchange resin, e.g., DEAE; chromatofocusing; SDS-PAGE; ammonium sulfate precipitation; gel filtration using, e.g., Sephadex G-75, Sepharose; protein A sepharose chromatography for removal of immunoglobulin contaminants; and the like. Other additives, such as protease inhibitors (e.g., PMSF or proteinase K) can be used to inhibit proteolytic degradation during purification. Purification procedures that can select for carbohydrates can also be used, e.g., ion-exchange soft gel chromatography, or HPLC using cation- or anionexchange resins, in which the more acidic fraction(s) is/are collected.

Methods of Treatment

In one embodiment, the subject matter disclosed herein relates to a preventive medical treatment started after following diagnosis of cancer in order to prevent the disease from worsening or curing the disease. In one embodiment, the subject matter disclosed herein relates to prophylaxis of subjects who are believed to be at risk for cancer or have previously been diagnosed with cancer (or another disease). In one embodiment, said subjects can be administered the peptide vaccine described herein or pharmaceutical compositions thereof. The invention contemplates using any of the peptides produced by the systems and methods described herein. In one embodiment, the peptide vaccines described herein can be administered subcutaneously via syringe or any other suitable method know in the art.

The compound(s) or combination of compounds disclosed herein, or pharmaceutical compositions may be administered to a cell, mammal, or human by any suitable means. Non-limiting examples of methods of administration include, among others, (a) administration though oral pathways, which includes administration in capsule, tablet, granule, spray, syrup, or other such forms; (b) administration through non-oral pathways such as intraocular, intranasal, intraauricular, rectal, vaginal, intraurethral, transmucosal, buccal, or transdermal, which includes administration as an aqueous suspension, an oily preparation or the like or as a drip, spray, suppository, salve, ointment or the like; (c) administration via injection, including subcutaneously, intraperitoneally, intravenously, intramuscularly, intradermally, intraorbitally, intracapsularly, intraspinally, intrasternally, or the like, including infusion pump delivery; (d) administration locally such as by injection directly in the renal or cardiac area, e.g., by depot implantation; (e) administration topically; as deemed appropriate by those of skill in the art for bringing the compound or combination of compounds disclosed herein into contact with living tissue; (f) administration via inhalation, including through aerosolized, nebulized, and powdered formulations; and (g) administration through implantation.

As will be readily apparent to one skilled in the art, the effective in vivo dose to be administered and the particular mode of administration will vary depending upon the age, weight and species treated, and the specific use for which the compound or combination of compounds disclosed herein are employed. The determination of effective dose levels, that is the dose levels necessary to achieve the desired result, can be accomplished by one skilled in the art using routine pharmacological methods. Typically, human clinical applications of products are commenced at lower dose levels, with dose level being increased until the desired effect is achieved. Alternatively, acceptable in vitro studies can be used to establish useful doses and routes of administration of the compositions identified by the present methods using established pharmacological methods. Effective animal doses from in vivo studies can be converted to appropriate human doses using conversion methods known in the art (e.g., see Nair A B, Jacob S. A simple practice guide for dose conversion between animals and human. Journal of basic and clinical pharmacy. 2016 March; 7(2):27.)

Methods of Prevention

In some embodiments, the peptides prepared using methods of the invention can be used as a vaccine to promote an immune response against cancer (e.g., against tumor neoantigens). In some embodiments, the invention provides compositions and methods for induction of immune response, for example induction of antibodies to tumor neoantigens. In some embodiments, the antibodies are broadly neutralizing antibodies. In some embodiments, the peptides prepared using methods of the invention can be used as a vaccine to promote an immune response against a pathogen. In some embodiments, the peptides prepared using methods of the invention can be used to promote immune tolerance as an autoimmune disease therapeutic.

In some embodiments, the peptides prepared using methods of the invention can be combined with additional vaccine components. In some embodiments, these combined vaccines can be encoded in one or more nucleic acids that encode the peptides produced with the methods described herein and additional vaccine components (e.g. peptides or proteins) that are known in the art. In some embodiments, these combined vaccines are created by adding the peptides or proteins that encode the additional vaccine components of the peptides that result from the methods described here for combined formulation and packaging. An example of the combination of vaccine components is the creation of BCL-ABL vaccines that use one or more nucleic acids to encode the components of vaccines for BCL-ABL b2a2 and b3a2 and packaging the nucleic acids in a mRNA-LNP or DNA formulation, or separately formulating different components as mRNA-LNP or DNA and then combining them for packaging or immediately before administration to a person.

The compositions, systems, and methods disclosed herein are not to be limited in scope to the specific embodiments described herein. Indeed, various modifications of the compositions, systems, and methods in addition to those described will become apparent to those of skill in the art from the foregoing description.

SEQUENCE LISTING (62113 sequences)

SEQ ID NO: 1 - protein, 10 aa, synthetic construct
  source 1..10: note = Seed: SATGFKQSSK
STTGFKQSSK

SEQ ID NO: 2 - protein, 9 aa, synthetic construct
  source 1..9: note = Seed: SSKALQRPV
STKALQRPV

SEQ ID NO: 3 - protein, 11 aa, synthetic construct
  source 1..11: note = Seed: KALQRPVASDF
KQLQRPVASDF

SEQ ID NO: 4 - protein, 10 aa, synthetic construct
  source 1..10: note = Seed: SATGFKQSSK
SVTGFKQSSR

SEQ ID NO: 5 - protein, 9 aa, synthetic construct
  source 1..9: note = Seed: GFKQSSKAL
GYKQSSKAL

SEQ ID NO: 6 - protein, 9 aa, synthetic construct
  source 1..9: note = Seed: KQSSKALQR
KVSSKALQR

SEQ ID NO: 7 - protein, 9 aa, synthetic construct
  source 1..9: note = Seed: SSKALQRPV
SAKALQRPF

SEQ ID NO: 8 - protein, 9 aa, synthetic construct
  source 1..9: note = Seed: SSKALQRPV
SSKALQRPA

SEQ ID NO: 9 - protein, 10 aa, synthetic construct
  source 1..10: note = Seed: SATGFKQSSK
SATGFKQSSR

SEQ ID NO: 10 - protein, 9 aa, synthetic construct
  source 1..9: note = Seed: GFKQSSKAL
GYKQSSKAF

SEQ ID NO: 11 - protein, 9 aa, synthetic construct
  source 1..9: note = Seed: ATGFKQSSK
AMGFKQSSK

SEQ ID NO: 12 - protein, 9 aa, synthetic construct
  source 1..9: note = Seed: SSKALQRPV
SGKALQRPK

SEQ ID NO: 13 - protein, 9 aa, synthetic construct
  source 1..9: note = Seed: SSKALQRPV
SIKALQRPA

SEQ ID NO: 14 - protein, 9 aa, synthetic construct
  source 1..9: note = Seed: KQSSKALQR
KSSSKALQR

SEQ ID NO: 15 - protein, 9 aa, synthetic construct
  source 1..9: note = Seed: SSKALQRPV
STKALQRPK

SEQ ID NO: 16 - protein, 11 aa, synthetic construct
  source 1..11: note = Seed: HSATGFKQSSK
HTATGFKQSSR

SEQ ID NO: 17 - protein, 9 aa, synthetic construct
  source 1..9: note = Seed: KQSSKALQR
KMSSKALQR

SEQ ID NO: 18 - protein, 10 aa, synthetic construct
  source 1..10: note = Seed: SSKALQRPVA
STKALQRPVK

SEQ ID NO: 19 - protein, 9 aa, synthetic construct
  source 1..9: note = Seed: SSKALQRPV
SQKALQRPK

SEQ ID NO: 20 - protein, 9 aa, synthetic construct
  source 1..9: note = Seed: KQSSKALQR
KTSSKALQR

SEQ ID NO: 21 - protein, 9 aa, synthetic construct
  source 1..9: note = Seed: KQSSKALQR
KLSSKALQR

SEQ ID NO: 22 - protein, 9 aa, synthetic construct
  source 1..9: note = Seed: SSKALQRPV
SVKALQRPV

SEQ ID NO: 23 - protein, 9 aa, synthetic construct
  source 1..9: note = Seed: KQSSKALQR
KISSKALQR

SEQ ID NO: 24 - protein, 9 aa, synthetic construct
  source 1..9: note = Seed: SSKALQRPV
SAKALQRPY

SEQ ID NO: 25 - protein, 9 aa, synthetic construct
  source 1..9: note = Seed: SSKALQRPV
SVKALQRPK

SEQ ID NO: 26 - protein, 9 aa, synthetic construct
  source 1..9: note = Seed: SSKALQRPV
STKALQRPS

SEQ ID NO: 27 - protein, 11 aa, synthetic construct
  source 1..11: note = Seed: KALQRPVASDF
KQLQRPVASDY

SEQ ID NO: 28 - protein, 10 aa, synthetic construct
  source 1..10: note = Seed: SATGFKQSSK
STTGFKQSSR

SEQ ID NO: 29 - protein, 9 aa, synthetic construct
  source 1..9: note = Seed: GFKQSSKAL
GYKQSSKAM

SEQ ID NO: 30 - protein, 9 aa, synthetic construct
  source 1..9: note = Seed: SSKALQRPV
STKALQRPL

SEQ ID NO: 31 - protein, 9 aa, synthetic construct
  source 1..9: note = Seed: KQSSKALQR
KYSSKALQR

SEQ ID NO: 32 - protein, 9 aa, synthetic construct
  source 1..9: note = Seed: SSKALQRPV
SAKALQRPM

SEQ ID NO: 33 - protein, 11 aa, synthetic construct
  source 1..11: note = Seed: KALQRPVASDF
KTLQRPVASDW

SEQ ID NO: 34 - protein, 9 aa, synthetic construct
  source 1..9: note = Seed: LTINKEEAL
LAINKEEAM

SEQ ID NO: 35 - protein, 10 aa, synthetic construct
  source 1..10: note = Seed: KEEALQRPVA
KEEALQRPVL

SEQ ID NO: 36 - protein, 9 aa, synthetic construct
  source 1..9: note = Seed: LTINKEEAL
LSINKEEAW

SEQ ID NO: 37 - protein, 9 aa, synthetic construct
  source 1..9: note = Seed: KEEALQRPV
KEEALQRPL

SEQ ID NO: 38 - protein, 9 aa, synthetic construct
  source 1..9: note = Seed: KEEALQRPV
KEEALQRPA

SEQ ID NO: 39 - protein, 9 aa, synthetic construct
  source 1..9: note = Seed: LTINKEEAL
LTINKEEAW

SEQ ID NO: 40 - protein, 9 aa, synthetic construct
  source 1..9: note = Seed: LTINKEEAL
LAINKEEAL

SEQ ID NO: 41 - protein, 9 aa, synthetic construct
  source 1..9: note = Seed: KEEALQRPV
KEEALQRPM

SEQ ID NO: 42 - protein, 9 aa, synthetic construct
  source 1..9: note = Seed: LTINKEEAL
LAINKEEAY

SEQ ID NO: 43 - protein, 9 aa, synthetic construct
  source 1..9: note = Seed: LTINKEEAL
LTINKEEAF

SEQ ID NO: 44 - protein, 9 aa, synthetic construct
  source 1..9: note = Seed: LTINKEEAL
LAINKEEAF

SEQ ID NO: 45 - protein, 10 aa, Homo sapiens
SSKALQRPVA

SEQ ID NO: 46 - protein, 25 aa, synthetic construct
  source 1..25: note = Seed: LNVIVHSATGFKQSSKALQRPVASD
LNVIVHSATGFKQISAALARPVASD

SEQ ID NO: 47 - protein, 25 aa, synthetic construct
  source 1..25: note = Seed: LNVIVHSATGFKQSSKALQRPVASD
LNVIVHSATGIKQISAALIRPVASD

SEQ ID NO: 48 - protein, 20 aa, synthetic construct
  source 1..20: note = Seed: SATGFKQSSKALQRPVASDF
SATGFKQISRALARPVASDF

SEQ ID NO: 49 - protein, 25 aa, synthetic construct
  source 1..25: note = Seed: YGFLNVIVHSATGFKQSSKALQRPV
YGFLNVIVHSATGYKQFSWALMRPV

SEQ ID NO: 50 - protein, 20 aa, synthetic construct
  source 1..20: note = Seed: SATGFKQSSKALQRPVASDF
SATGFKQTSFALIRPVASDF

SEQ ID NO: 51 - protein, 25 aa, synthetic construct
  source 1..25: note = Seed: YGFLNVIVHSATGFKQSSKALQRPV
YGFLNVIVHSATGFKQNSTALARPV

SEQ ID NO: 52 - protein, 20 aa, synthetic construct
  source 1..20: note = Seed: SATGFKQSSKALQRPVASDF
SATGFKQSSRALARAVAADF

SEQ ID NO: 53 - protein, 25 aa, synthetic construct
  source 1..25: note = Seed: LNVIVHSATGFKQSSKALQRPVASD
LNVIVHSATGMKQFSAALVRPVASD

SEQ ID NO: 54 - protein, 20 aa, synthetic construct
  source 1..20: note = Seed: SATGFKQSSKALQRPVASDF
SATGFNQSAKVLQGPVASDF

SEQ ID NO: 55 - protein, 25 aa, synthetic construct
  source 1..25: note = Seed: LNVIVHSATGFKQSSKALQRPVASD
LNVIVHSATGYKQFSAALTRPVASD

SEQ ID NO: 56 - protein, 20 aa, synthetic construct
  source 1..20: note = Seed: SATGFKQSSKALQRPVASDF
SATGFKQFSLALRRPVASDF

SEQ ID NO: 57 - protein, 20 aa, synthetic construct
  source 1..20: note = Seed: SATGFKQSSKALQRPVASDF
SATGFKQFSVALRRPVASDF

SEQ ID NO: 58 - protein, 20 aa, synthetic construct
  source 1..20: note = Seed: SATGFKQSSKALQRPVASDF
SATGFKQISYALIRPVASDF

SEQ ID NO: 59 - protein, 25 aa, synthetic construct
  source 1..25: note = Seed: YGFLNVIVHSATGFKQSSKALQRPV
YGFLNVIVHSATGFKQISTALARPV

SEQ ID NO: 60 - protein, 25 aa, synthetic construct
  source 1..25: note = Seed: LNVIVHSATGFKQSSKALQRPVASD
LNVIVHSATGIKQISRALARPVASD

SEQ ID NO: 61 - protein, 20 aa, synthetic construct
  source 1..20: note = Seed: SATGFKQSSKALQRPVASDF
SATGFKQSSRALIRPVATDF

SEQ ID NO: 62 - protein, 25 aa, synthetic construct
  source 1..25: note = Seed: LNVIVHSATGFKQSSKALQRPVASD
LNVIVHSATGYKQISAALARPVASD

SEQ ID NO: 63 - protein, 25 aa, synthetic construct
  source 1..25: note = Seed: LNVIVHSATGFKQSSKALQRPVASD
LNVIVHSATGWKQFSAALVRPVASD

SEQ ID NO: 64 - protein, 20 aa, synthetic construct
  source 1..20: note = Seed: SATGFKQSSKALQRPVASDF
SATGFKQFSLALKRPVASDF

SEQ ID NO: 65 - protein, 20 aa, synthetic construct
  source 1..20: note = Seed: SATGFKQSSKALQRPVASDF
SATGFKQESFALIRPVASDF

SEQ ID NO: 66 - protein, 20 aa, synthetic construct
  source 1..20: note = Seed: SATGFKQSSKALQRPVASDF
SATGFKQISRALTRPVASDF

SEQ ID NO: 67 - protein, 25 aa, synthetic construct
  source 1..25: note = Seed: YGFLNVIVHSATGFKQSSKALQRPV
YGFLNVIVHSATGFKQNSNALARPV

SEQ ID NO: 68 - protein, 25 aa, synthetic construct
  source 1..25: note = Seed: LNVIVHSATGFKQSSKALQRPVASD
LNVIVHSATGIKQISSALIRPVASD

SEQ ID NO: 69 - protein, 20 aa, synthetic construct
  source 1..20: note = Seed: SATGFKQSSKALQRPVASDF
SATGFKQISRALSRPVASDF

SEQ ID NO: 70 - protein, 20 aa, synthetic construct
  source 1..20: note = Seed: SATGFKQSSKALQRPVASDF
SATGFKQASFALVRPVASDF

SEQ ID NO: 71 - protein, 20 aa, synthetic construct
  source 1..20: note = Seed: SATGFKQSSKALQRPVASDF
SATGFKQSSFALIRPVASDF

SEQ ID NO: 72 - protein, 25 aa, synthetic construct
  source 1..25: note = Seed: YGFLNVIVHSATGFKQSSKALQRPV
YGFLNVIVHSATGFKQISAALARPV

SEQ ID NO: 73 - protein, 20 aa, synthetic construct
  source 1..20: note = Seed: SATGFKQSSKALQRPVASDF
SATGFKQFSIALRRPVASDF

SEQ ID NO: 74 - protein, 25 aa, synthetic construct
  source 1..25: note = Seed: YGFLNVIVHSATGFKQSSKALQRPV
YGFLNVIVHSATGIKQASNALARPV

SEQ ID NO: 75 - protein, 20 aa, synthetic construct
  source 1..20: note = Seed: SATGFKQSSKALQRPVASDF
SATGFKQSSRALSRAVANDF

SEQ ID NO: 76 - protein, 20 aa, synthetic construct
  source 1..20: note = Seed: SATGFKQSSKALQRPVASDF
SATGFNQSAKVLQAPVASDF

SEQ ID NO: 77 - protein, 20 aa, synthetic construct
  source 1..20: note = Seed: SATGFKQSSKALQRPVASDF
SATGFFQSKKFLQVPVASDF

SEQ ID NO: 78 - protein, 25 aa, synthetic construct
  source 1..25: note = Seed: YGFLNVIVHSATGFKQSSKALQRPV
YGFLNVIVHSATGFKQTSFALNRPV

SEQ ID NO: 79 - protein, 25 aa, synthetic construct
  source 1..25: note = Seed: NSCVKLQTVHSIPLTINKEEALQRP
NSCVKLQTVHSIPFTINKFEAIQRP

SEQ ID NO: 80 - protein, 25 aa, synthetic construct
  source 1..25: note = Seed: VKLQTVHSIPLTINKEEALQRPVAS
VKLQTVHSIPLTINKIETLQAPVAS

SEQ ID NO: 81 - protein, 25 aa, synthetic construct
  source 1..25: note = Seed: QTVHSIPLTINKEEALQRPVASDFE
QTVHSIPLTINKEFALMRPVANDFE

SEQ ID NO: 82 - protein, 25 aa, synthetic construct
  source 1..25: note = Seed: NSCVKLQTVHSIPLTINKEEALQRP
NSCVKLQTVHSIPFTISKFEALQRP

SEQ ID NO: 83 - protein, 25 aa, synthetic construct
  source 1..25: note = Seed: VKLQTVHSIPLTINKEEALQRPVAS
VKLQTVHSIPITIIKAEAYQRPVAS

SEQ ID NO: 84 - protein, 19 aa, synthetic construct
  source 1..19: note = Seed: LQTVHSIPLTINKEEALQR
LQTVHSIPFTITKAEAIQR

SEQ ID NO: 85 - protein, 19 aa, synthetic construct
  source 1..19: note = Seed: LQTVHSIPLTINKEEALQR
LQTVHSIPFTIIKAEAIQR

SEQ ID NO: 86 - protein, 25 aa, synthetic construct
  source 1..25: note = Seed: VKLQTVHSIPLTINKEEALQRPVAS
VKLQTVHSIPLTINKFESLQIPVAS

SEQ ID NO: 87 - protein, 25 aa, synthetic construct
  source 1..25: note = Seed: NSCVKLQTVHSIPLTINKEEALQRP
NSCVKLQTVHSIPFTIIKNEAVQRP

SEQ ID NO: 88 - protein, 25 aa, synthetic construct
  source 1..25: note = Seed: VKLQTVHSIPLTINKEEALQRPVAS
VKLQTVHSIPLTFNKFESLQAPVAS

SEQ ID NO: 89 - protein, 25 aa, synthetic construct
  source 1..25: note = Seed: NSCVKLQTVHSIPLTINKEEALQRP
NSCVKLQTVHSIPITIIKAEALQRP

SEQ ID NO: 90 - protein, 25 aa, synthetic construct
  source 1..25: note = Seed: VKLQTVHSIPLTINKEEALQRPVAS
VKLQTVHSIPLTIFKSEAVQRPVAS

SEQ ID NO: 91 - protein, 25 aa, synthetic construct
  source 1..25: note = Seed: NSCVKLQTVHSIPLTINKEEALQRP
NSCVKLQTVHSIPITIFKNEALQRP

SEQ ID NO: 92 - protein, 25 aa, synthetic construct
  source 1..25: note = Seed: VKLQTVHSIPLTINKEEALQRPVAS
VKLQTVHSIPITIFKSEAIQRPVAS

SEQ ID NO: 93 - protein, 25 aa, synthetic construct
  source 1..25: note = Seed: VKLQTVHSIPLTINKEEALQRPVAS
VKLQTVHSIPLTFNKFESLQVPVAS

SEQ ID NO: 94 - protein, 25 aa, synthetic construct
  source 1..25: note = Seed: VKLQTVHSIPLTINKEEALQRPVAS
VKLQTVHSIPITILKSEAFQRPVAS

SEQ ID NO: 95 - protein, 25 aa, synthetic construct
  source 1..25: note = Seed: NSCVKLQTVHSIPLTINKEEALQRP
NSCVKLQTVHSIPITILKSEAFQRP

SEQ ID NO: 96 - protein, 25 aa, synthetic construct
  source 1..25: note = Seed: VKLQTVHSIPLTINKEEALQRPVAS
VKLQTVHSIPLTINKFEALQIPVAS

SEQ ID NO: 97 - protein, 19 aa, synthetic construct
  source 1..19: note = Seed: LQTVHSIPLTINKEEALQR
LQTVHSIPFTIIKAEAVQR

SEQ ID NO: 98 - protein, 25 aa, synthetic construct
  source 1..25: note = Seed: NSCVKLQTVHSIPLTINKEEALQRP
NSCVKLQTVHSIPFTIMKSEAAQRP

SEQ ID NO: 99 - protein, 25 aa, synthetic construct
  source 1..25: note = Seed: VKLQTVHSIPLTINKEEALQRPVAS
VKLQTVHSIPLTFNKLESLQAPVAS

SEQ ID NO: 100 - protein, 25 aa, synthetic construct
  source 1..25: note = Seed: VKLQTVHSIPLTINKEEALQRPVAS
VKLQTVHSIPITILKNEAFQRPVAS

SEQ ID NO: 101 - protein, 25 aa, synthetic construct
  source 1..25: note = Seed: NSCVKLQTVHSIPLTINKEEALQRP
NSCVKLQTVHSIPFTINKFEALQRP

SEQ ID NO: 102 - protein, 25 aa, synthetic construct
  source 1..25: note = Seed: VKLQTVHSIPLTINKEEALQRPVAS
VKLQTVHSIPLTINKIERLQKPVAS

SEQ ID NO: 103 - protein, 25 aa, synthetic construct
  source 1..25: note = Seed: VKLQTVHSIPLTINKEEALQRPVAS
VKLQTVHSIPFTIFKSEALQRPVAS

SEQ ID NO: 104 - protein, 25 aa, synthetic construct
  source 1..25: note = Seed: NSCVKLQTVHSIPLTINKEEALQRP
NSCVKLQTVHSIPITIFKSEALQRP

SEQ ID NO: 105 - protein, 25 aa, synthetic construct
  source 1..25: note = Seed: VKLQTVHSIPLTINKEEALQRPVAS
VKLQTVHSIPLTILKSEAYQRPVAS

SEQ ID NO: 106 - protein, 19 aa, synthetic construct
  source 1..19: note = Seed: LQTVHSIPLTINKEEALQR
LQTVHSIPFTITKSEAIQR

SEQ ID NO: 107 - protein, 25 aa, synthetic construct
  source 1..25: note = Seed: QTVHSIPLTINKEEALQRPVASDFE
QTVHSIPLTINKDEPLQFPVASDFE

SEQ ID NO: 108 - protein, 25 aa, synthetic construct
  source 1..25: note = Seed: NSCVKLQTVHSIPLTINKEEALQRP
NSCVKLQTVHSIPFTIMKSEAVQRP

SEQ ID NO: 109 - protein, 25 aa, synthetic construct
  source 1..25: note = Seed: VKLQTVHSIPLTINKEEALQRPVAS
VKLQTVHSIPLTINKIERLQRPVAS

SEQ ID NO: 110 - protein, 25 aa, synthetic construct
  source 1..25: note = Seed: VKLQTVHSIPLTINKEEALQRPVAS
VKLQTVHSIPITIFKSEALQRPVAS

SEQ ID NO: 111 - protein, 25 aa, synthetic construct
  source 1..25: note = Seed: NSCVKLQTVHSIPLTINKEEALQRP
NSCVKLQTVHSIPITIYKAEALQRP

SEQ ID NO: 112 - protein, 25 aa, synthetic construct
  source 1..25: note = Seed: NSCVKLQTVHSIPLTINKEEALQRP
NSCVKLQTVHSIPITILKAEAFQRP

SEQ ID NO: 113 - protein, 9 aa, Homo sapiens
ATGFKQSSK

SEQ ID NO: 114 - protein, 10 aa, Homo sapiens
FKQSSKALQR

SEQ ID NO: 115 - protein, 9 aa, Homo sapiens
GFKQSSKAL

SEQ ID NO: 116 - protein, 11 aa, Homo sapiens
GFKQSSKALQR

SEQ ID NO: 117 - protein, 11 aa, Homo sapiens
HSATGFKQSSK

SEQ ID NO: 118 - protein, 11 aa, Homo sapiens
KALQRPVASDF

SEQ ID NO: 119 - protein, 9 aa, Homo sapiens
KQSSKALQR

SEQ ID NO: 120 - protein, 11 aa, Homo sapiens
KQSSKALQRPV

SEQ ID NO: 121 - protein, 10 aa, Homo sapiens
SATGFKQSSK

SEQ ID NO: 122 - protein, 9 aa, Homo sapiens
SSKALQRPV

SEQ ID NO: 123 - protein, 10 aa, Homo sapiens
IPLTINKEEA

SEQ ID NO: 124 - protein, 11 aa, Homo sapiens
IPLTINKEEAL

SEQ ID NO: 125 - protein, 9 aa, Homo sapiens
KEEALQRPV

SEQ ID NO: 126 - protein, 10 aa, Homo sapiens
KEEALQRPVA

SEQ ID NO: 127 - protein, 9 aa, Homo sapiens
LTINKEEAL

SEQ ID NO: 128 - protein, 11 aa, Homo sapiens
LTINKEEALQR

SEQ ID NO: 129 - protein, 10 aa, Homo sapiens
TINKEEALQR

SEQ ID NO: 130 - protein, 9 aa, synthetic construct
  source 1..9: note = Seed: ATGFKQSSK
AAGFKQSSK

SEQ ID NO: 131 - protein, 9 aa, synthetic construct
  source 1..9: note = Seed: ATGFKQSSK
AIGFKQSSK

SEQ ID NO: 132 - protein, 9 aa, synthetic construct
  source 1..9: note = Seed: ATGFKQSSK
ALGFKQSSK

SEQ ID NO: 133 - protein, 9 aa, synthetic construct
  source 1..9: note = Seed: ATGFKQSSK
AQGFKQSSK

SEQ ID NO: 134 - protein, 9 aa, synthetic construct
  source 1..9: note = Seed: ATGFKQSSK
ASGFKQSSK

SEQ ID NO: 135 - protein, 9 aa, synthetic construct
  source 1..9: note = Seed: ATGFKQSSK
AVGFKQSSK

SEQ ID NO: 136 - protein, 10 aa, synthetic construct
  source 1..10: note = Seed: FKQSSKALQR
FAQSSKALQR

SEQ ID NO: 137 - protein, 10 aa, synthetic construct
  source 1..10: note = Seed: FKQSSKALQR
FCQSSKALQR

SEQ ID NO: 138 - protein, 10 aa, synthetic construct
  source 1..10: note = Seed: FKQSSKALQR
FFQSSKALQK

SEQ ID NO: 139 - protein, 10 aa, synthetic construct
  source 1..10: note = Seed: FKQSSKALQR
FFQSSKALQR

SEQ ID NO: 140 - protein, 10 aa, synthetic construct
  source 1..10: note = Seed: FKQSSKALQR
FGQSSKALQR

SEQ ID NO: 141 - protein, 10 aa, synthetic construct
  source 1..10: note = Seed: FKQSSKALQR
FHQSSKALQR

SEQ ID NO: 142 - protein, 10 aa, synthetic construct
  source 1..10: note = Seed: FKQSSKALQR
FIQSSKALQK

SEQ ID NO: 143 - protein, 10 aa, synthetic construct
  source 1..10: note = Seed: FKQSSKALQR
FIQSSKALQR

SEQ ID NO: 144 - protein, 10 aa, synthetic construct
  source 1..10: note = Seed: FKQSSKALQR
FLQSSKALQK

SEQ ID NO: 145 - protein, 10 aa, synthetic construct
  source 1..10: note = Seed: FKQSSKALQR
FLQSSKALQR

SEQ ID NO: 146 - protein, 10 aa, synthetic construct
  source 1..10: note = Seed: FKQSSKALQR
FMQSSKALQK

SEQ ID NO: 147 - protein, 10 aa, synthetic construct
  source 1..10: note = Seed: FKQSSKALQR
FMQSSKALQR

SEQ ID NO: 148 - protein, 10 aa, synthetic construct
  source 1..10: note = Seed: FKQSSKALQR
FNQSSKALQR

SEQ ID NO: 149 - protein, 10 aa, synthetic construct
  source 1..10: note = Seed: FKQSSKALQR
FQQSSKALQR

SEQ ID NO: 150 - protein, 10 aa, synthetic construct
  source 1..10: note = Seed: FKQSSKALQR
FRQSSKALQR

SEQ ID NO: 151 - protein, 10 aa, synthetic construct
  source 1..10: note = Seed: FKQSSKALQR
FSQSSKALQK

SEQ ID NO: 152 - protein, 10 aa, synthetic construct
  source 1..10: note = Seed: FKQSSKALQR
FSQSSKALQR

SEQ ID NO: 153 - protein, 10 aa, synthetic construct
  source 1..10: note = Seed: FKQSSKALQR
FTQSSKALQK

SEQ ID NO: 154 - protein, 10 aa, synthetic construct
  source 1..10: note = Seed: FKQSSKALQR
FTQSSKALQR

SEQ ID NO: 155 - protein, 10 aa, synthetic construct
  source 1..10: note = Seed: FKQSSKALQR
FVQSSKALQK

SEQ ID NO: 156 - protein, 10 aa, synthetic construct
  source 1..10: note = Seed: FKQSSKALQR
FVQSSKALQR

SEQ ID NO: 157 - protein, 10 aa, synthetic construct
  source 1..10: note = Seed: FKQSSKALQR
FWQSSKALQK

SEQ ID NO: 158 - protein, 10 aa, synthetic construct
  source 1..10: note = Seed: FKQSSKALQR
FWQSSKALQR

SEQ ID NO: 159 - protein, 10 aa, synthetic construct
  source 1..10: note = Seed: FKQSSKALQR
FYQSSKALQK

SEQ ID NO: 160 - protein, 10 aa, synthetic construct
  source 1..10: note = Seed: FKQSSKALQR
FYQSSKALQR

SEQ ID NO: 161 - protein, 9 aa, synthetic construct
  source 1..9: note = Seed: GFKQSSKAL
GFKQSSKAF

SEQ ID NO: 162 - protein, 9 aa, synthetic construct
  source 1..9: note = Seed: GFKQSSKAL
GFKQSSKAM

SEQ ID NO: 163 - protein, 9 aa, synthetic construct
  source 1..9: note = Seed: GFKQSSKAL
GFKQSSKAY

SEQ ID NO: 164 - protein, 11 aa, synthetic construct
  source 1..11: note = Seed: GFKQSSKALQR
GMKQSSKALQR

SEQ ID NO: 165 - protein, 11 aa, synthetic construct
  source 1..11: note = Seed: GFKQSSKALQR
GTKQSSKALQR

SEQ ID NO: 166 - protein, 11 aa, synthetic construct
  source 1..11: note = Seed: GFKQSSKALQR
GVKQSSKALQR

SEQ ID NO: 167 - protein, 9 aa, synthetic construct
  source 1..9: note = Seed: GFKQSSKAL
GWKQSSKAF

SEQ ID NO: 168 - protein, 9 aa, synthetic construct
  source 1..9: note = Seed: GFKQSSKAL
GWKQSSKAL

SEQ ID NO: 169 - protein, 9 aa, synthetic construct
  source 1..9: note = Seed: GFKQSSKAL
GWKQSSKAM

SEQ ID NO: 170 - protein, 9 aa, synthetic construct
  source 1..9: note = Seed: GFKQSSKAL
GYKQSSKAI

SEQ ID NO: 171 - protein, 11 aa, synthetic construct
  source 1..11: note = Seed: GFKQSSKALQR
GYKQSSKALQR

SEQ ID NO: 172 - protein, 9 aa, synthetic construct
  source 1..9: note = Seed: GFKQSSKAL
GYKQSSKAV

SEQ ID NO: 173 - protein, 9 aa, synthetic construct
  source 1..9: note = Seed: GFKQSSKAL
GYKQSSKAY

SEQ ID NO: 174 - protein, 11 aa, synthetic construct
  source 1..11: note = Seed: HSATGFKQSSK
HAATGFKQSSK

SEQ ID NO: 175 - protein, 11 aa, synthetic construct
  source 1..11: note = Seed: HSATGFKQSSK
HAATGFKQSSR

SEQ ID NO: 176 - protein, 11 aa, synthetic construct
  source 1..11: note = Seed: HSATGFKQSSK
HIATGFKQSSK

SEQ ID NO: 177 - protein, 11 aa, synthetic construct
  source 1..11: note = Seed: HSATGFKQSSK
HIATGFKQSSR

SEQ ID NO: 178 - protein, 11 aa, synthetic construct
  source 1..11: note = Seed: HSATGFKQSSK
HMATGFKQSSK

SEQ ID NO: 179 - protein, 11 aa, synthetic construct
  source 1..11: note = Seed: HSATGFKQSSK
HMATGFKQSSR

SEQ ID NO: 180 - protein, 11 aa, synthetic construct
  source 1..11: note = Seed: HSATGFKQSSK
HSATGFKQSSR

SEQ ID NO: 181 - protein, 11 aa, synthetic construct
  source 1..11: note = Seed: HSATGFKQSSK
HTATGFKQSSK

SEQ ID NO: 182 - protein, 11 aa, synthetic construct
  source 1..11: note = Seed: HSATGFKQSSK
HVATGFKQSSK

SEQ ID NO: 183 - protein, 11 aa, synthetic construct
  source 1..11: note = Seed: HSATGFKQSSK
HVATGFKQSSR

SEQ ID NO: 184 - protein, 11 aa, synthetic construct
  source 1..11: note = Seed: KALQRPVASDF
KALQRPVASDW

SEQ ID NO: 185 - protein, 11 aa, synthetic construct
  source 1..11: note = Seed: KALQRPVASDF
KALQRPVASDY

SEQ ID NO: 186 - protein, 9 aa, synthetic construct
  source 1..9: note = Seed: KQSSKALQR
KASSKALQK

SEQ ID NO: 187 - protein, 9 aa, synthetic construct
  source 1..9: note = Seed: KQSSKALQR
KASSKALQR

SEQ ID NO: 188 - protein, 11 aa, synthetic construct
  source 1..11: note = Seed: KQSSKALQRPV
KASSKALQRPA

SEQ ID NO: 189 - protein, 11 aa, synthetic construct
  source 1..11: note = Seed: KQSSKALQRPV
KASSKALQRPK

SEQ ID NO: 190 - protein, 11 aa, synthetic construct
  source 1..11: note = Seed: KQSSKALQRPV
KASSKALQRPV

SEQ ID NO: 191 - protein, 11 aa, synthetic construct
  source 1..11: note = Seed: KALQRPVASDF
KCLQRPVASDF

SEQ ID NO: 192 - protein, 11 aa, synthetic construct
  source 1..11: note = Seed: KALQRPVASDF
KCLQRPVASDY

SEQ ID NO: 193 - protein, 9 aa, synthetic construct
  source 1..9: note = Seed: KQSSKALQR
KCSSKALQR

SEQ ID NO: 194 - protein, 11 aa, synthetic construct
  source 1..11: note = Seed: KQSSKALQRPV
KCSSKALQRPA

SEQ ID NO: 195 - protein, 11 aa, synthetic construct
  source 1..11: note = Seed: KQSSKALQRPV
KCSSKALQRPK

SEQ ID NO: 196 - protein, 11 aa, synthetic construct
  source 1..11: note = Seed: KQSSKALQRPV
KCSSKALQRPV

SEQ ID NO: 197 - protein, 11 aa, synthetic construct
  source 1..11: note = Seed: KALQRPVASDF
KDLQRPVASDF

SEQ ID NO: 198 - protein, 11 aa, synthetic construct
  source 1..11: note = Seed: KALQRPVASDF
KDLQRPVASDY

SEQ ID NO: 199 - protein, 11 aa, synthetic construct
  source 1..11: note = Seed: KQSSKALQRPV
KDSSKALQRPA

SEQ ID NO: 200 - protein, 11 aa, synthetic construct
  source 1..11: note = Seed: KQSSKALQRPV
KDSSKALQRPK

SEQ ID NO: 201 - protein, 11 aa, synthetic construct
  source 1..11: note = Seed: KQSSKALQRPV
KDSSKALQRPV

SEQ ID NO: 202 - protein, 11 aa, synthetic construct
  source 1..11: note = Seed: KALQRPVASDF
KELQRPVASDF

SEQ ID NO: 203 - protein, 11 aa, synthetic construct
  source 1..11: note = Seed: KALQRPVASDF
KELQRPVASDY

SEQ ID NO: 204 - protein, 11 aa, synthetic construct
  source 1..11: note = Seed: KQSSKALQRPV
KESSKALQRPA

SEQ ID NO: 205 - protein, 11 aa, synthetic construct
  source 1..11: note = Seed: KQSSKALQRPV
KESSKALQRPK

SEQ ID NO: 206 - protein, 11 aa, synthetic construct
  source 1..11: note = Seed: KQSSKALQRPV
KESSKALQRPV

SEQ ID NO: 207 - protein, 11 aa, synthetic construct
  source 1..11: note = Seed: KALQRPVASDF
KFLQRPVASDF

SEQ ID NO: 208 - protein, 11 aa, synthetic construct
  source 1..11: note = Seed: KALQRPVASDF
KFLQRPVASDY

SEQ ID NO: 209 - protein, 9 aa, synthetic construct
  source 1..9: note = Seed: KQSSKALQR
KFSSKALQK

SEQ ID NO: 210 - protein, 9 aa, synthetic construct
  source 1..9: note = Seed: KQSSKALQR
KFSSKALQR

SEQ ID NO: 211 - protein, 11 aa, synthetic construct
  source 1..11: note = Seed: KQSSKALQRPV
KFSSKALQRPA

SEQ ID NO: 212 - protein, 11 aa, synthetic construct
  source 1..11: note = Seed: KQSSKALQRPV
KFSSKALQRPI

SEQ ID NO: 213 - protein, 11 aa, synthetic construct
  source 1..11: note = Seed: KQSSKALQRPV
KFSSKALQRPK

SEQ ID NO: 214 - protein, 11 aa, synthetic construct
  source 1..11: note = Seed: KQSSKALQRPV
KFSSKALQRPV

SEQ ID NO: 215 - protein, 11 aa, synthetic construct
  source 1..11: note = Seed: KALQRPVASDF
KGLQRPVASDF

SEQ ID NO: 216 - protein, 11 aa, synthetic construct
  source 1..11: note = Seed: KALQRPVASDF
KGLQRPVASDY

SEQ ID NO: 217 - protein, 9 aa, synthetic construct
  source 1..9: note = Seed: KQSSKALQR
KGSSKALQR

SEQ ID NO: 218 - protein, 11 aa, synthetic construct
  source 1..11: note = Seed: KQSSKALQRPV
KGSSKALQRPA

SEQ ID NO: 219 - protein, 11 aa, synthetic construct
  source 1..11: note = Seed: KQSSKALQRPV
KGSSKALQRPK

SEQ ID NO: 220 - protein, 11 aa, synthetic construct
  source 1..11: note = Seed: KQSSKALQRPV
KGSSKALQRPV

SEQ ID NO: 221 - protein, 11 aa, synthetic construct
  source 1..11: note = Seed: KALQRPVASDF
KHLQRPVASDF

SEQ ID NO: 222 - protein, 11 aa, synthetic construct
  source 1..11: note = Seed: KALQRPVASDF
KHLQRPVASDY

SEQ ID NO: 223 - protein, 11 aa, synthetic construct
  source 1..11: note = Seed: KQSSKALQRPV
KHSSKALQRPA

SEQ ID NO: 224 - protein, 11 aa, synthetic construct
  source 1..11: note = Seed: KQSSKALQRPV
KHSSKALQRPK

SEQ ID NO: 225 - protein, 11 aa, synthetic construct
  source 1..11: note = Seed: KQSSKALQRPV
KHSSKALQRPV

SEQ ID NO: 226 - protein, 11 aa, synthetic construct
  source 1..11: note = Seed: KALQRPVASDF
KILQRPVASDF

SEQ ID NO: 227 - protein, 11 aa, synthetic construct
  source 1..11: note = Seed: KALQRPVASDF
KILQRPVASDY

SEQ ID NO: 228 - protein, 9 aa, synthetic construct
  source 1..9: note = Seed: KQSSKALQR
KISSKALQK

SEQ ID NO: 229 - protein, 11 aa, synthetic construct
  source 1..11: note = Seed: KQSSKALQRPV
KISSKALQRPA

SEQ ID NO: 230 - protein, 11 aa, synthetic construct
  source 1..11: note = Seed: KQSSKALQRPV
KISSKALQRPI

SEQ ID NO: 231 - protein, 11 aa, synthetic construct
  source 1..11: note = Seed: KQSSKALQRPV
KISSKALQRPK

SEQ ID NO: 232 - protein, 11 aa, synthetic construct
  source 1..11: note = Seed: KQSSKALQRPV
KISSKALQRPV

SEQ ID NO: 233 - protein, 11 aa, synthetic construct
  source 1..11: note = Seed: KALQRPVASDF
KKLQRPVASDF

SEQ ID NO: 234 - protein, 11 aa, synthetic construct
  source 1..11: note = Seed: KALQRPVASDF
KKLQRPVASDM

SEQ ID NO: 235 - protein, 11 aa, synthetic construct
  source 1..11: note = Seed: KALQRPVASDF
KKLQRPVASDY

SEQ ID NO: 236 - protein, 11 aa, synthetic construct
  source 1..11: note = Seed: KQSSKALQRPV
KKSSKALQRPA

SEQ ID NO: 237 - protein, 11 aa, synthetic construct
  source 1..11: note = Seed: KQSSKALQRPV
KKSSKALQRPK

SEQ ID NO: 238 - protein, 11 aa, synthetic construct
  source 1..11: note = Seed: KQSSKALQRPV
KKSSKALQRPV

SEQ ID NO: 239 - protein, 11 aa, synthetic construct
  source 1..11: note = Seed: KALQRPVASDF
KLLQRPVASDF

SEQ ID NO: 240 - protein, 11 aa, synthetic construct
  source 1..11: note = Seed: KALQRPVASDF
KLLQRPVASDY

SEQ ID NO: 241 - protein, 9 aa, synthetic construct
  source 1..9: note = Seed: KQSSKALQR
KLSSKALQK

SEQ ID NO: 242 - protein, 11 aa, synthetic construct
  source 1..11: note = Seed: KQSSKALQRPV
KLSSKALQRPA

SEQ ID NO: 243 - protein, 11 aa, synthetic construct
  source 1..11: note = Seed: KQSSKALQRPV
KLSSKALQRPK

SEQ ID NO: 244 - protein, 11 aa, synthetic construct
  source 1..11: note = Seed: KQSSKALQRPV
KLSSKALQRPV

SEQ ID NO: 245 - protein, 11 aa, synthetic construct
  source 1..11: note = Seed: KALQRPVASDF
KMLQRPVASDF

SEQ ID NO: 246 - protein, 11 aa, synthetic construct
  source 1..11: note = Seed: KALQRPVASDF
KMLQRPVASDM

SEQ ID NO: 247 - protein, 11 aa, synthetic construct
  source 1..11: note = Seed: KALQRPVASDF
KMLQRPVASDY

SEQ ID NO: 248 - protein, 9 aa, synthetic construct
  source 1..9: note = Seed: KQSSKALQR
KMSSKALQK

SEQ ID NO: 249 - protein, 11 aa, synthetic construct
  source 1..11: note = Seed: KQSSKALQRPV
KMSSKALQRPA

SEQ ID NO: 250 - protein, 11 aa, synthetic construct
  source 1..11: note = Seed: KQSSKALQRPV
KMSSKALQRPI

SEQ ID NO: 251 - protein, 11 aa, synthetic construct
  source 1..11: note = Seed: KQSSKALQRPV
KMSSKALQRPK

SEQ ID NO: 252 - protein, 11 aa, synthetic construct
  source 1..11: note = Seed: KQSSKALQRPV
KMSSKALQRPV

SEQ ID NO: 253 - protein, 11 aa, synthetic construct
  source 1..11: note = Seed: KALQRPVASDF
KNLQRPVASDF

SEQ ID NO: 254 - protein, 11 aa, synthetic construct
  source 1..11: note = Seed: KALQRPVASDF
KNLQRPVASDY

SEQ ID NO: 255 - protein, 9 aa, synthetic construct
  source 1..9: note = Seed: KQSSKALQR
KNSSKALQR

SEQ ID NO: 256 - protein, 11 aa, synthetic construct
  source 1..11: note = Seed: KQSSKALQRPV
KNSSKALQRPA

SEQ ID NO: 257 - protein, 11 aa, synthetic construct
  source 1..11: note = Seed: KQSSKALQRPV
KNSSKALQRPK

SEQ ID NO: 258 - protein, 11 aa, synthetic construct
  source 1..11: note = Seed: KQSSKALQRPV
KNSSKALQRPV

SEQ ID NO: 259 - protein, 11 aa, synthetic construct
  source 1..11: note = Seed: KALQRPVASDF
KPLQRPVASDF

SEQ ID NO: 260 - protein, 11 aa, synthetic construct
  source 1..11: note = Seed: KALQRPVASDF
KPLQRPVASDY

SEQ ID NO: 261 - protein, 11 aa, synthetic construct
  source 1..11: note = Seed: KQSSKALQRPV
KPSSKALQRPA

SEQ ID NO: 262 - protein, 11 aa, synthetic construct
  source 1..11: note = Seed: KQSSKALQRPV
KPSSKALQRPK

SEQ ID NO: 263 - protein, 11 aa, synthetic construct
  source 1..11: note = Seed: KQSSKALQRPV
KPSSKALQRPV

SEQ ID NO: 264 - protein, 11 aa, synthetic construct
  source 1..11: note = Seed: KALQRPVASDF
KQLQRPVASDM

SEQ ID NO: 265 - protein, 9 aa, synthetic construct
  source 1..9: note = Seed: KQSSKALQR
KQSSKALQK

SEQ ID NO: 266 - protein, 11 aa, synthetic construct
  source 1..11: note = Seed: KQSSKALQRPV
KQSSKALQRPA

SEQ ID NO: 267 - protein, 11 aa, synthetic construct
  source 1..11: note = Seed: KQSSKALQRPV
KQSSKALQRPK

SEQ ID NO: 268 - protein, 11 aa, synthetic construct
  source 1..11: note = Seed: KALQRPVASDF
KRLQRPVASDF

SEQ ID NO: 269 - protein, 11 aa, synthetic construct
  source 1..11: note = Seed: KALQRPVASDF
KRLQRPVASDY

SEQ ID NO: 270 - protein, 11 aa, synthetic construct
  source 1..11: note = Seed: KQSSKALQRPV
KRSSKALQRPA

SEQ ID NO: 271 - protein, 11 aa, synthetic construct
  source 1..11: note = Seed: KQSSKALQRPV
KRSSKALQRPK

SEQ ID NO: 272 - protein, 11 aa, synthetic construct
  source 1..11: note = Seed: KQSSKALQRPV
KRSSKALQRPV

SEQ ID NO: 273 - protein, 11 aa, synthetic construct
  source 1..11: note = Seed: KALQRPVASDF
KSLQRPVASDF

SEQ ID NO: 274 - protein, 11 aa, synthetic construct
  source 1..11: note = Seed: KALQRPVASDF
KSLQRPVASDM

SEQ ID NO: 275 - protein, 11 aa, synthetic construct
  source 1..11: note = Seed: KALQRPVASDF
KSLQRPVASDW

SEQ ID NO: 276 - protein, 11 aa, synthetic construct
  source 1..11: note = Seed: KALQRPVASDF
KSLQRPVASDY

SEQ ID NO: 277 - protein, 9 aa, synthetic construct
  source 1..9: note = Seed: KQSSKALQR
KSSSKALQK

SEQ ID NO: 278 - protein, 11 aa, synthetic construct
  source 1..11: note = Seed: KQSSKALQRPV
KSSSKALQRPA

SEQ ID NO: 279 - protein, 11 aa, synthetic construct
  source 1..11: note = Seed: KQSSKALQRPV
KSSSKALQRPK

SEQ ID NO: 280 - protein, 11 aa, synthetic construct
  source 1..11: note = Seed: KQSSKALQRPV
KSSSKALQRPV

SEQ ID NO: 281 - protein, 11 aa, synthetic construct
  source 1..11: note = Seed: KALQRPVASDF
KTLQRPVASDF

SEQ ID NO: 282 - protein, 11 aa, synthetic construct
  source 1..11: note = Seed: KALQRPVASDF
KTLQRPVASDL

SEQ ID NO: 283 - protein, 11 aa, synthetic construct
  source 1..11: note = Seed: KALQRPVASDF
KTLQRPVASDM

SEQ ID NO: 284 - protein, 11 aa, synthetic construct
  source 1..11: note = Seed: KALQRPVASDF
KTLQRPVASDY

SEQ ID NO: 285 - protein, 9 aa, synthetic construct
  source 1..9: note = Seed: KQSSKALQR
KTSSKALQK

SEQ ID NO: 286 - protein, 11 aa, synthetic construct
  source 1..11: note = Seed: KQSSKALQRPV
KTSSKALQRPA

SEQ ID NO: 287 - protein, 11 aa, synthetic construct
  source 1..11: note = Seed: KQSSKALQRPV
KTSSKALQRPI

SEQ ID NO: 288 - protein, 11 aa, synthetic construct
  source 1..11: note = Seed: KQSSKALQRPV
KTSSKALQRPK

SEQ ID NO: 289 - protein, 11 aa, synthetic construct
  source 1..11: note = Seed: KQSSKALQRPV
KTSSKALQRPL

SEQ ID NO: 290 - protein, 11 aa, synthetic construct
  source 1..11: note = Seed: KQSSKALQRPV
KTSSKALQRPM

SEQ ID NO: 291 - protein, 11 aa, synthetic construct
  source 1..11: note = Seed: KQSSKALQRPV
KTSSKALQRPS

SEQ ID NO: 292 - protein, 11 aa, synthetic construct
  source 1..11: note = Seed: KQSSKALQRPV
KTSSKALQRPV

SEQ ID NO: 293 - protein, 11 aa, synthetic construct
  source 1..11: note = Seed: KALQRPVASDF
KVLQRPVASDF

SEQ ID NO: 294 - protein, 11 aa, synthetic construct
  source 1..11: note = Seed: KALQRPVASDF
KVLQRPVASDW

SEQ ID NO: 295 - protein, 11 aa, synthetic construct
  source 1..11: note = Seed: KALQRPVASDF
KVLQRPVASDY

SEQ ID NO: 296 - protein, 9 aa, synthetic construct
  source 1..9: note = Seed: KQSSKALQR
KVSSKALQK

SEQ ID NO: 297 - protein, 11 aa, synthetic construct
  source 1..11: note = Seed: KQSSKALQRPV
KVSSKALQRPA

SEQ ID NO: 298 - protein, 11 aa, synthetic construct
  source 1..11: note = Seed: KQSSKALQRPV
KVSSKALQRPI

SEQ ID NO: 299 - protein, 11 aa, synthetic construct
  source 1..11: note = Seed: KQSSKALQRPV
KVSSKALQRPK

SEQ ID NO: 300 - protein, 11 aa, synthetic construct
  source 1..11: note = Seed: KQSSKALQRPV
KVSSKALQRPV

SEQ ID NO: 301 - protein, 11 aa, synthetic construct
  source 1..11: note = Seed: KALQRPVASDF
KWLQRPVASDF

SEQ ID NO: 302 - protein, 11 aa, synthetic construct
  source 1..11: note = Seed: KALQRPVASDF
KWLQRPVASDY

SEQ ID NO: 303 - protein, 9 aa, synthetic construct
  source 1..9: note = Seed: KQSSKALQR
KWSSKALQK

SEQ ID NO: 304 - protein, 9 aa, synthetic construct
  source 1..9: note = Seed: KQSSKALQR
KWSSKALQR

SEQ ID NO: 305 - protein, 11 aa, synthetic construct
  source 1..11: note = Seed: KQSSKALQRPV
KWSSKALQRPA

SEQ ID NO: 306 - protein, 11 aa, synthetic construct
  source 1..11: note = Seed: KQSSKALQRPV
KWSSKALQRPI

SEQ ID NO: 307 - protein, 11 aa, synthetic construct
  source 1..11: note = Seed: KQSSKALQRPV
KWSSKALQRPK

SEQ ID NO: 308 - protein, 11 aa, synthetic construct
  source 1..11: note = Seed: KQSSKALQRPV
KWSSKALQRPV

SEQ ID NO: 309 - protein, 11 aa, synthetic construct
  source 1..11: note = Seed: KALQRPVASDF
KYLQRPVASDF

SEQ ID NO: 310 - protein, 11 aa, synthetic construct
  source 1..11: note = Seed: KALQRPVASDF
KYLQRPVASDY

SEQ ID NO: 311 - protein, 9 aa, synthetic construct
  source 1..9: note = Seed: KQSSKALQR
KYSSKALQK

SEQ ID NO: 312 - protein, 11 aa, synthetic construct
  source 1..11: note = Seed: KQSSKALQRPV
KYSSKALQRPA

SEQ ID NO: 313 - protein, 11 aa, synthetic construct
  source 1..11: note = Seed: KQSSKALQRPV
KYSSKALQRPI

SEQ ID NO: 314 - protein, 11 aa, synthetic construct
  source 1..11: note = Seed: KQSSKALQRPV
KYSSKALQRPK

SEQ ID NO: 315 - protein, 11 aa, synthetic construct
  source 1..11: note = Seed: KQSSKALQRPV
KYSSKALQRPV

SEQ ID NO: 316 - protein, 9 aa, synthetic construct
  source 1..9: note = Seed: SSKALQRPV
SAKALQRPA

SEQ ID NO: 317 - protein, 9 aa, synthetic construct
  source 1..9: note = Seed: SSKALQRPV
SAKALQRPG

SEQ ID NO: 318 - protein, 9 aa, synthetic construct
  source 1..9: note = Seed: SSKALQRPV
SAKALQRPI

SEQ ID NO: 319 - protein, 9 aa, synthetic construct
  source 1..9: note = Seed: SSKALQRPV
SAKALQRPK

SEQ ID NO: 320 - protein, 9 aa, synthetic construct
  source 1..9: note = Seed: SSKALQRPV
SAKALQRPL

SEQ ID NO: 321 - protein, 9 aa, synthetic construct
  source 1..9: note = Seed: SSKALQRPV
SAKALQRPR

SEQ ID NO: 322 - protein, 9 aa, synthetic construct
  source 1..9: note = Seed: SSKALQRPV
SAKALQRPS

SEQ ID NO: 323 - protein, 9 aa, synthetic construct
  source 1..9: note = Seed: SSKALQRPV
SAKALQRPV

SEQ ID NO: 324 - protein, 10 aa, synthetic construct
  source 1..10: note = Seed: SSKALQRPVA
SAKALQRPVA

SEQ ID NO: 325 - protein, 10 aa, synthetic construct
  source 1..10: note = Seed: SSKALQRPVA
SAKALQRPVK

SEQ ID NO: 326 - protein, 10 aa, synthetic construct
  source 1..10: note = Seed: SSKALQRPVA
SAKALQRPVV

SEQ ID NO: 327 - protein, 9 aa, synthetic construct
  source 1..9: note = Seed: SSKALQRPV
SCKALQRPK

SEQ ID NO: 328 - protein, 10 aa, synthetic construct
  source 1..10: note = Seed: SSKALQRPVA
SCKALQRPVK

SEQ ID NO: 329 - protein, 10 aa, synthetic construct
  source 1..10: note = Seed: SATGFKQSSK
SCTGFKQSSK

SEQ ID NO: 330 - protein, 10 aa, synthetic construct
  source 1..10: note = Seed: SATGFKQSSK
SDTGFKQSSK

SEQ ID NO: 331 - protein, 10 aa, synthetic construct
  source 1..10: note = Seed: SATGFKQSSK
SETGFKQSSK

SEQ ID NO: 332 - protein, 9 aa, synthetic construct
  source 1..9: note = Seed: SSKALQRPV
SFKALQRPA

SEQ ID NO: 333 - protein, 9 aa, synthetic construct
  source 1..9: note = Seed: SSKALQRPV
SFKALQRPG

SEQ ID NO: 334 - protein, 9 aa, synthetic construct
  source 1..9: note = Seed: SSKALQRPV
SFKALQRPI

SEQ ID NO: 335 - protein, 9 aa, synthetic construct
  source 1..9: note = Seed: SSKALQRPV
SFKALQRPK

SEQ ID NO: 336 - protein, 9 aa, synthetic construct
  source 1..9: note = Seed: SSKALQRPV
SFKALQRPL

SEQ ID NO: 337 - protein, 9 aa, synthetic construct
  source 1..9: note = Seed: SSKALQRPV
SFKALQRPM

SEQ ID NO: 338 - protein, 9 aa, synthetic construct
  source 1..9: note = Seed: SSKALQRPV
SFKALQRPR

SEQ ID NO: 339 - protein, 9 aa, synthetic construct
  source 1..9: note = Seed: SSKALQRPV
SFKALQRPS

SEQ ID NO: 340 - protein, 9 aa, synthetic construct
  source 1..9: note = Seed: SSKALQRPV
SFKALQRPV

SEQ ID NO: 341 - protein, 10 aa, synthetic construct
  source 1..10: note = Seed: SSKALQRPVA
SFKALQRPVA

SEQ ID NO: 342 - protein, 10 aa, synthetic construct
  source 1..10: note = Seed: SSKALQRPVA
SFKALQRPVI

SEQ ID NO: 343 - protein, 10 aa, synthetic construct
  source 1..10: note = Seed: SSKALQRPVA
SFKALQRPVK

SEQ ID NO: 344 - protein, 10 aa, synthetic construct
  source 1..10: note = Seed: SSKALQRPVA
SFKALQRPVV

SEQ ID NO: 345 - protein, 10 aa, synthetic construct
  source 1..10: note = Seed: SATGFKQSSK
SFTGFKQSSK

SEQ ID NO: 346 - protein, 10 aa, synthetic construct
  source 1..10: note = Seed: SATGFKQSSK
SFTGFKQSSR

SEQ ID NO: 347 - protein, 9 aa, synthetic construct
  source 1..9: note = Seed: SSKALQRPV
SGKALQRPA

SEQ ID NO: 348 - protein, 9 aa, synthetic construct
  source 1..9: note = Seed: SSKALQRPV
SGKALQRPI

SEQ ID NO: 349 - protein, 9 aa, synthetic construct
  source 1..9: note = Seed: SSKALQRPV
SGKALQRPV

SEQ ID NO: 350 - protein, 10 aa, synthetic construct
  source 1..10: note = Seed: SSKALQRPVA
SGKALQRPVA

SEQ ID NO: 351 - protein, 10 aa, synthetic construct
  source 1..10: note = Seed: SSKALQRPVA
SGKALQRPVK

SEQ ID NO: 352 - protein, 10 aa, synthetic construct
  source 1..10: note = Seed: SATGFKQSSK
SGTGFKQSSK

SEQ ID NO: 353 - protein, 9 aa, synthetic construct
  source 1..9: note = Seed: SSKALQRPV
SHKALQRPK

SEQ ID NO: 354 - protein, 10 aa, synthetic construct
  source 1..10: note = Seed: SATGFKQSSK
SHTGFKQSSK

SEQ ID NO: 355 - protein, 9 aa, synthetic construct
  source 1..9: note = Seed: SSKALQRPV
SIKALQRPG

SEQ ID NO: 356 - protein, 9 aa, synthetic construct
  source 1..9: note = Seed: SSKALQRPV
SIKALQRPI

SEQ ID NO: 357 - protein, 9 aa, synthetic construct
  source 1..9: note = Seed: SSKALQRPV
SIKALQRPK

SEQ ID NO: 358 - protein, 9 aa, synthetic construct
  source 1..9: note = Seed: SSKALQRPV
SIKALQRPL

SEQ ID NO: 359 - protein, 9 aa, synthetic construct
  source 1..9: note = Seed: SSKALQRPV
SIKALQRPM

SEQ ID NO: 360 - protein, 9 aa, synthetic construct
  source 1..9: note = Seed: SSKALQRPV
SIKALQRPS

SEQ ID NO: 361 - protein, 9 aa, synthetic construct
  source 1..9: note = Seed: SSKALQRPV
SIKALQRPT

SEQ ID NO: 362 - protein, 9 aa, synthetic construct
  source 1..9: note = Seed: SSKALQRPV
SIKALQRPV

SEQ ID NO: 363 - protein, 10 aa, synthetic construct
  source 1..10: note = Seed: SSKALQRPVA
SIKALQRPVA

SEQ ID NO: 364 - protein, 10 aa, synthetic construct
  source 1..10: note = Seed: SSKALQRPVA
SIKALQRPVI

SEQ ID NO: 365 - protein, 10 aa, synthetic construct
  source 1..10: note = Seed: SSKALQRPVA
SIKALQRPVK

SEQ ID NO: 366 - protein, 10 aa, synthetic construct
  source 1..10: note = Seed: SSKALQRPVA
SIKALQRPVV

SEQ ID NO: 367 - protein, 9 aa, synthetic construct
  source 1..9: note = Seed: SSKALQRPV
SIKALQRPY

SEQ ID NO: 368 - protein, 10 aa, synthetic construct
  source 1..10: note = Seed: SATGFKQSSK
SITGFKQSSK

SEQ ID NO: 369 - protein, 10 aa, synthetic construct
  source 1..10: note = Seed: SATGFKQSSK
SITGFKQSSR

SEQ ID NO: 370 - protein, 10 aa, synthetic construct
  source 1..10: note = Seed: SATGFKQSSK
SKTGFKQSSK

SEQ ID NO: 371 - protein, 9 aa, synthetic construct
  source 1..9: note = Seed: SSKALQRPV
SLKALQRPA

SEQ ID NO: 372 - protein, 9 aa, synthetic construct
  source 1..9: note = Seed: SSKALQRPV
SLKALQRPG

SEQ ID NO: 373 - protein, 9 aa, synthetic construct
  source 1..9: note = Seed: SSKALQRPV
SLKALQRPI

SEQ ID NO: 374 - protein, 9 aa, synthetic construct
  source 1..9: note = Seed: SSKALQRPV
SLKALQRPK

SEQ ID NO: 375 - protein, 9 aa, synthetic construct
  source 1..9: note = Seed: SSKALQRPV
SLKALQRPL

SEQ ID NO: 376 - protein, 9 aa, synthetic construct
  source 1..9: note = Seed: SSKALQRPV
SLKALQRPM

SEQ ID NO: 377 - protein, 9 aa, synthetic construct
  source 1..9: note = Seed: SSKALQRPV
SLKALQRPS

SEQ ID NO: 378 - protein, 9 aa, synthetic construct
  source 1..9: note = Seed: SSKALQRPV
SLKALQRPV

SEQ ID NO: 379 - protein, 10 aa, synthetic construct
  source 1..10: note = Seed: SSKALQRPVA
SLKALQRPVA

SEQ ID NO: 380 - protein, 10 aa, synthetic construct
  source 1..10: note = Seed: SSKALQRPVA
SLKALQRPVK

SEQ ID NO: 381 - protein, 9 aa, synthetic construct
  source 1..9: note = Seed: SSKALQRPV
SLKALQRPY

SEQ ID NO: 382 - protein, 10 aa, synthetic construct
  source 1..10: note = Seed: SATGFKQSSK
SLTGFKQSSK

SEQ ID NO: 383 - protein, 10 aa, synthetic construct
  source 1..10: note = Seed: SATGFKQSSK
SLTGFKQSSR

SEQ ID NO: 384 - protein, 9 aa, synthetic construct
  source 1..9: note = Seed: SSKALQRPV
SMKALQRPA

SEQ ID NO: 385 - protein, 9 aa, synthetic construct
  source 1..9: note = Seed: SSKALQRPV
SMKALQRPG

SEQ ID NO: 386 - protein, 9 aa, synthetic construct
  source 1..9: note = Seed: SSKALQRPV
SMKALQRPI

SEQ ID NO: 387 - protein, 9 aa, synthetic construct
  source 1..9: note = Seed: SSKALQRPV
SMKALQRPK

SEQ ID NO: 388 - protein, 9 aa, synthetic construct
  source 1..9: note = Seed: SSKALQRPV
SMKALQRPL

SEQ ID NO: 389 - protein, 9 aa, synthetic construct
  source 1..9: note = Seed: SSKALQRPV
SMKALQRPM

SEQ ID NO: 390 - protein, 9 aa, synthetic construct
  source 1..9: note = Seed: SSKALQRPV
SMKALQRPP

SEQ ID NO: 391 - protein, 9 aa, synthetic construct
  source 1..9: note = Seed: SSKALQRPV
SMKALQRPR

SEQ ID NO: 392 - protein, 9 aa, synthetic construct
  source 1..9: note = Seed: SSKALQRPV
SMKALQRPS

SEQ ID NO: 393 - protein, 9 aa, synthetic construct
  source 1..9: note = Seed: SSKALQRPV
SMKALQRPT

SEQ ID NO: 394 - protein, 9 aa, synthetic construct
  source 1..9: note = Seed: SSKALQRPV
SMKALQRPV

SEQ ID NO: 395 - protein, 10 aa, synthetic construct
  source 1..10: note = Seed: SSKALQRPVA
SMKALQRPVA

SEQ ID NO: 396 - protein, 10 aa, synthetic construct
  source 1..10: note = Seed: SSKALQRPVA
SMKALQRPVI

SEQ ID NO: 397 - protein, 10 aa, synthetic construct
  source 1..10: note = Seed: SSKALQRPVA
SMKALQRPVK

SEQ ID NO: 398 - protein, 10 aa, synthetic construct
  source 1..10: note = Seed: SSKALQRPVA
SMKALQRPVV

SEQ ID NO: 399 - protein, 10 aa, synthetic construct
  source 1..10: note = Seed: SSKALQRPVA
SMKALQRPVY

SEQ ID NO: 400 - protein, 9 aa, synthetic construct
  source 1..9: note = Seed: SSKALQRPV
SMKALQRPY

SEQ ID NO: 401 - protein, 10 aa, synthetic construct
  source 1..10: note = Seed: SATGFKQSSK
SMTGFKQSSK

SEQ ID NO: 402 - protein, 10 aa, synthetic construct
  source 1..10: note = Seed: SATGFKQSSK
SMTGFKQSSR

SEQ ID NO: 403 - protein, 9 aa, synthetic construct
  source 1..9: note = Seed: SSKALQRPV
SNKALQRPA

SEQ ID NO: 404 - protein, 9 aa, synthetic construct
  source 1..9: note = Seed: SSKALQRPV
SNKALQRPK

SEQ ID NO: 405 - protein, 9 aa, synthetic construct
  source 1..9: note = Seed: SSKALQRPV
SNKALQRPV

SEQ ID NO: 406 - protein, 10 aa, synthetic construct
  source 1..10: note = Seed: SSKALQRPVA
SNKALQRPVK

SEQ ID NO: 407 - protein, 10 aa, synthetic construct
  source 1..10: note = Seed: SATGFKQSSK
SNTGFKQSSK

SEQ ID NO: 408 - protein, 10 aa, synthetic construct
  source 1..10: note = Seed: SATGFKQSSK
SNTGFKQSSR

SEQ ID NO: 409 - protein, 10 aa, synthetic construct
  source 1..10: note = Seed: SATGFKQSSK
SPTGFKQSSK

SEQ ID NO: 410 - protein, 9 aa, synthetic construct
  source 1..9: note = Seed: SSKALQRPV
SQKALQRPA

SEQ ID NO: 411 - protein, 9 aa, synthetic construct
  source 1..9: note = Seed: SSKALQRPV
SQKALQRPI

SEQ ID NO: 412 - protein, 9 aa, synthetic construct
  source 1..9: note = Seed: SSKALQRPV
SQKALQRPL

SEQ ID NO: 413 - protein, 9 aa, synthetic construct
  source 1..9: note = Seed: SSKALQRPV
SQKALQRPM

SEQ ID NO: 414 - protein, 9 aa, synthetic construct
  source 1..9: note = Seed: SSKALQRPV
SQKALQRPR

SEQ ID NO: 415 - protein, 9 aa, synthetic construct
  source 1..9: note = Seed: SSKALQRPV
SQKALQRPS

SEQ ID NO: 416 - protein, 9 aa, synthetic construct
  source 1..9: note = Seed: SSKALQRPV
SQKALQRPV

SEQ ID NO: 417 - protein, 10 aa, synthetic construct
  source 1..10: note = Seed: SSKALQRPVA
SQKALQRPVA

SEQ ID NO: 418 - protein, 10 aa, synthetic construct
  source 1..10: note = Seed: SSKALQRPVA
SQKALQRPVK

SEQ ID NO: 419 - protein, 10 aa, synthetic construct
  source 1..10: note = Seed: SATGFKQSSK
SQTGFKQSSK

SEQ ID NO: 420 - protein, 10 aa, synthetic construct
  source 1..10: note = Seed: SATGFKQSSK
SRTGFKQSSK

SEQ ID NO: 421 - protein, 9 aa, synthetic construct
  source 1..9: note = Seed: SSKALQRPV
SSKALQRPC

SEQ ID NO: 422 - protein, 9 aa, synthetic construct
  source 1..9: note = Seed: SSKALQRPV
SSKALQRPE

SEQ ID NO: 423 - protein, 9 aa, synthetic construct
  source 1..9: note = Seed: SSKALQRPV
SSKALQRPF

SEQ ID NO: 424 - protein, 9 aa, synthetic construct
  source 1..9: note = Seed: SSKALQRPV
SSKALQRPG

SEQ ID NO: 425 - protein, 9 aa, synthetic construct
  source 1..9: note = Seed: SSKALQRPV
SSKALQRPH

SEQ ID NO: 426 - protein, 9 aa, synthetic construct
  source 1..9: note = Seed: SSKALQRPV
SSKALQRPI

SEQ ID NO: 427 - protein, 9 aa, synthetic construct
  source 1..9: note = Seed: SSKALQRPV
SSKALQRPK

SEQ ID NO: 428 - protein, 9 aa, synthetic construct
  source 1..9: note = Seed: SSKALQRPV
SSKALQRPL

SEQ ID NO: 429 - protein, 9 aa, synthetic construct
  source 1..9: note = Seed: SSKALQRPV
SSKALQRPM

SEQ ID NO: 430 - protein, 9 aa, synthetic construct
  source 1..9: note = Seed: SSKALQRPV
SSKALQRPN

SEQ ID NO: 431 - protein, 9 aa, synthetic construct
  source 1..9: note = Seed: SSKALQRPV
SSKALQRPP

SEQ ID NO: 432 - protein, 9 aa, synthetic construct
  source 1..9: note = Seed: SSKALQRPV
SSKALQRPQ

SEQ ID NO: 433 - protein, 9 aa, synthetic construct
  source 1..9: note = Seed: SSKALQRPV
SSKALQRPR

SEQ ID NO: 434 - protein, 9 aa, synthetic construct
  source 1..9: note = Seed: SSKALQRPV
SSKALQRPS

SEQ ID NO: 435 - protein, 9 aa, synthetic construct
  source 1..9: note = Seed: SSKALQRPV
SSKALQRPT

SEQ ID NO: 436 - protein, 10 aa, synthetic construct
  source 1..10: note = Seed: SSKALQRPVA
SSKALQRPVG

SEQ ID NO: 437 - protein, 10 aa, synthetic construct
  source 1..10: note = Seed: SSKALQRPVA
SSKALQRPVI

SEQ ID NO: 438 - protein, 10 aa, synthetic construct
  source 1..10: note = Seed: SSKALQRPVA
SSKALQRPVK

SEQ ID NO: 439 - protein, 10 aa, synthetic construct
  source 1..10: note = Seed: SSKALQRPVA
SSKALQRPVL

SEQ ID NO: 440 - protein, 10 aa, synthetic construct
  source 1..10: note = Seed: SSKALQRPVA
SSKALQRPVM

SEQ ID NO: 441 - protein, 10 aa, synthetic construct
  source 1..10: note = Seed: SSKALQRPVA
SSKALQRPVR

SEQ ID NO: 442 - protein, 10 aa, synthetic construct
  source 1..10: note = Seed: SSKALQRPVA
SSKALQRPVS

SEQ ID NO: 443 - protein, 10 aa, synthetic construct
  source 1..10: note = Seed: SSKALQRPVA
SSKALQRPVT

SEQ ID NO: 444 - protein, 10 aa, synthetic construct
  source 1..10: note = Seed: SSKALQRPVA
SSKALQRPVV

SEQ ID NO: 445 - protein, 10 aa, synthetic construct
  source 1..10: note = Seed: SSKALQRPVA
SSKALQRPVY

SEQ ID NO: 446 - protein, 9 aa, synthetic construct
  source 1..9: note = Seed: SSKALQRPV
SSKALQRPY

SEQ ID NO: 447 - protein, 10 aa, synthetic construct
  source 1..10: note = Seed: SATGFKQSSK
SSTGFKQSSK

SEQ ID NO: 448 - protein, 10 aa, synthetic construct
  source 1..10: note = Seed: SATGFKQSSK
SSTGFKQSSR

SEQ ID NO: 449 - protein, 9 aa, synthetic construct
  source 1..9: note = Seed: SSKALQRPV
STKALQRPA

SEQ ID NO: 450 - protein, 9 aa, synthetic construct
  source 1..9: note = Seed: SSKALQRPV
STKALQRPC

SEQ ID NO: 451 - protein, 9 aa, synthetic construct
  source 1..9: note = Seed: SSKALQRPV
STKALQRPE

SEQ ID NO: 452 - protein, 9 aa, synthetic construct
  source 1..9: note = Seed: SSKALQRPV
STKALQRPF

SEQ ID NO: 453 - protein, 9 aa, synthetic construct
  source 1..9: note = Seed: SSKALQRPV
STKALQRPG

SEQ ID NO: 454 - protein, 9 aa, synthetic construct
  source 1..9: note = Seed: SSKALQRPV
STKALQRPH

SEQ ID NO: 455 - protein, 9 aa, synthetic construct
  source 1..9: note = Seed: SSKALQRPV
STKALQRPI

SEQ ID NO: 456 - protein, 9 aa, synthetic construct
  source 1..9: note = Seed: SSKALQRPV
STKALQRPM

SEQ ID NO: 457 - protein, 9 aa, synthetic construct
  source 1..9: note = Seed: SSKALQRPV
STKALQRPN

SEQ ID NO: 458 - protein, 9 aa, synthetic construct
  source 1..9: note = Seed: SSKALQRPV
STKALQRPP

SEQ ID NO: 459 - protein, 9 aa, synthetic construct
  source 1..9: note = Seed: SSKALQRPV
STKALQRPQ

SEQ ID NO: 460 - protein, 9 aa, synthetic construct
  source 1..9: note = Seed: SSKALQRPV
STKALQRPR

SEQ ID NO: 461 - protein, 9 aa, synthetic construct
  source 1..9: note = Seed: SSKALQRPV
STKALQRPT

SEQ ID NO: 462 - protein, 10 aa, synthetic construct
  source 1..10: note = Seed: SSKALQRPVA
STKALQRPVA

SEQ ID NO: 463 - protein, 10 aa, synthetic construct
  source 1..10: note = Seed: SSKALQRPVA
STKALQRPVC

SEQ ID NO: 464 - protein, 10 aa, synthetic construct
  source 1..10: note = Seed: SSKALQRPVA
STKALQRPVF

SEQ ID NO: 465 - protein, 10 aa, synthetic construct
  source 1..10: note = Seed: SSKALQRPVA
STKALQRPVG

SEQ ID NO: 466 - protein, 10 aa, synthetic construct
  source 1..10: note = Seed: SSKALQRPVA
STKALQRPVI

SEQ ID NO: 467 - protein, 10 aa, synthetic construct
  source 1..10: note = Seed: SSKALQRPVA
STKALQRPVL

SEQ ID NO: 468 - protein, 10 aa, synthetic construct
  source 1..10: note = Seed: SSKALQRPVA
STKALQRPVM

SEQ ID NO: 469 - protein, 10 aa, synthetic construct
  source 1..10: note = Seed: SSKALQRPVA
STKALQRPVP

SEQ ID NO: 470 - protein, 10 aa, synthetic construct
  source 1..10: note = Seed: SSKALQRPVA
STKALQRPVQ

SEQ ID NO: 471 - protein, 10 aa, synthetic construct
  source 1..10: note = Seed: SSKALQRPVA
STKALQRPVR

SEQ ID NO: 472 - protein, 10 aa, synthetic construct
  source 1..10: note = Seed: SSKALQRPVA
STKALQRPVS

SEQ ID NO: 473 - protein, 10 aa, synthetic construct
  source 1..10: note = Seed: SSKALQRPVA
STKALQRPVT

SEQ ID NO: 474 - protein, 10 aa, synthetic construct
  source 1..10: note = Seed: SSKALQRPVA
STKALQRPVV

SEQ ID NO: 475 - protein, 10 aa, synthetic construct
  source 1..10: note = Seed: SSKALQRPVA
STKALQRPVY

SEQ ID NO: 476 - protein, 9 aa, synthetic construct
  source 1..9: note = Seed: SSKALQRPV
STKALQRPY

SEQ ID NO: 477 - protein, 9 aa, synthetic construct
  source 1..9: note = Seed: SSKALQRPV
SVKALQRPA

SEQ ID NO: 478 - protein, 9 aa, synthetic construct
  source 1..9: note = Seed: SSKALQRPV
SVKALQRPC

SEQ ID NO: 479 - protein, 9 aa, synthetic construct
  source 1..9: note = Seed: SSKALQRPV
SVKALQRPF

SEQ ID NO: 480 - protein, 9 aa, synthetic construct
  source 1..9: note = Seed: SSKALQRPV
SVKALQRPG

SEQ ID NO: 481 - protein, 9 aa, synthetic construct
  source 1..9: note = Seed: SSKALQRPV
SVKALQRPI

SEQ ID NO: 482 - protein, 9 aa, synthetic construct
  source 1..9: note = Seed: SSKALQRPV
SVKALQRPL

SEQ ID NO: 483 - protein, 9 aa, synthetic construct
  source 1..9: note = Seed: SSKALQRPV
SVKALQRPM

SEQ ID NO: 484 - protein, 9 aa, synthetic construct
  source 1..9: note = Seed: SSKALQRPV
SVKALQRPN

SEQ ID NO: 485 - protein, 9 aa, synthetic construct
  source 1..9: note = Seed: SSKALQRPV
SVKALQRPP

SEQ ID NO: 486 - protein, 9 aa, synthetic construct
  source 1..9: note = Seed: SSKALQRPV
SVKALQRPQ

SEQ ID NO: 487 - protein, 9 aa, synthetic construct
  source 1..9: note = Seed: SSKALQRPV
SVKALQRPR

SEQ ID NO: 488 - protein, 9 aa, synthetic construct
  source 1..9: note = Seed: SSKALQRPV
SVKALQRPS

SEQ ID NO: 489 - protein, 9 aa, synthetic construct
  source 1..9: note = Seed: SSKALQRPV
SVKALQRPT

SEQ ID NO: 490 - protein, 10 aa, synthetic construct
  source 1..10: note = Seed: SSKALQRPVA
SVKALQRPVA

SEQ ID NO: 491 - protein, 10 aa, synthetic construct
  source 1..10: note = Seed: SSKALQRPVA
SVKALQRPVG

SEQ ID NO: 492 - protein, 10 aa, synthetic construct
  source 1..10: note = Seed: SSKALQRPVA
SVKALQRPVI

SEQ ID NO: 493 - protein, 10 aa, synthetic construct
  source 1..10: note = Seed: SSKALQRPVA
SVKALQRPVK

SEQ ID NO: 494 - protein, 10 aa, synthetic construct
  source 1..10: note = Seed: SSKALQRPVA
SVKALQRPVL

SEQ ID NO: 495 - protein, 10 aa, synthetic construct
  source 1..10: note = Seed: SSKALQRPVA
SVKALQRPVM

SEQ ID NO: 496 - protein, 10 aa, synthetic construct
  source 1..10: note = Seed: SSKALQRPVA
SVKALQRPVS

SEQ ID NO: 497 - protein, 10 aa, synthetic construct
  source 1..10: note = Seed: SSKALQRPVA
SVKALQRPVV

SEQ ID NO: 498 - protein, 10 aa, synthetic construct
  source 1..10: note = Seed: SSKALQRPVA
SVKALQRPVY

SEQ ID NO: 499 - protein, 9 aa, synthetic construct
  source 1..9: note = Seed: SSKALQRPV
SVKALQRPY

SEQ ID NO: 500 - protein, 10 aa, synthetic construct
  source 1..10: note = Seed: SATGFKQSSK
SVTGFKQSSK

SEQ ID NO: 501 - protein, 9 aa, synthetic construct
  source 1..9: note = Seed: SSKALQRPV
SWKALQRPA

SEQ ID NO: 502 - protein, 9 aa, synthetic construct
  source 1..9: note = Seed: SSKALQRPV
SWKALQRPI

SEQ ID NO: 503 - protein, 9 aa, synthetic construct
  source 1..9: note = Seed: SSKALQRPV
SWKALQRPK

SEQ ID NO: 504 - protein, 9 aa, synthetic construct
  source 1..9: note = Seed: SSKALQRPV
SWKALQRPL

SEQ ID NO: 505 - protein, 9 aa, synthetic construct
  source 1..9: note = Seed: SSKALQRPV
SWKALQRPM

SEQ ID NO: 506 - protein, 9 aa, synthetic construct
  source 1..9: note = Seed: SSKALQRPV
SWKALQRPV

SEQ ID NO: 507 - protein, 10 aa, synthetic construct
  source 1..10: note = Seed: SSKALQRPVA
SWKALQRPVA

SEQ ID NO: 508 - protein, 10 aa, synthetic construct
  source 1..10: note = Seed: SSKALQRPVA
SWKALQRPVK

SEQ ID NO: 509 - protein, 10 aa, synthetic construct
  source 1..10: note = Seed: SATGFKQSSK
SWTGFKQSSK

SEQ ID NO: 510 - protein, 9 aa, synthetic construct
  source 1..9: note = Seed: SSKALQRPV
SYKALQRPA

SEQ ID NO: 511 - protein, 9 aa, synthetic construct
  source 1..9: note = Seed: SSKALQRPV
SYKALQRPG

SEQ ID NO: 512 - protein, 9 aa, synthetic construct
  source 1..9: note = Seed: SSKALQRPV
SYKALQRPI

SEQ ID NO: 513 - protein, 9 aa, synthetic construct
  source 1..9: note = Seed: SSKALQRPV
SYKALQRPK

SEQ ID NO: 514 - protein, 9 aa, synthetic construct
  source 1..9: note = Seed: SSKALQRPV
SYKALQRPL

SEQ ID NO: 515 - protein, 9 aa, synthetic construct
  source 1..9: note = Seed: SSKALQRPV
SYKALQRPM

SEQ ID NO: 516 - protein, 9 aa, synthetic construct
  source 1..9: note = Seed: SSKALQRPV
SYKALQRPR

SEQ ID NO: 517 - protein, 9 aa, synthetic construct
  source 1..9: note = Seed: SSKALQRPV
SYKALQRPS

SEQ ID NO: 518 - protein, 9 aa, synthetic construct
  source 1..9: note = Seed: SSKALQRPV
SYKALQRPT

SEQ ID NO: 519 - protein, 9 aa, synthetic construct
  source 1..9: note = Seed: SSKALQRPV
SYKALQRPV

SEQ ID NO: 520 - protein, 10 aa, synthetic construct
  source 1..10: note = Seed: SSKALQRPVA
SYKALQRPVA

SEQ ID NO: 521 - protein, 10 aa, synthetic construct
  source 1..10: note = Seed: SSKALQRPVA
SYKALQRPVI

SEQ ID NO: 522 - protein, 10 aa, synthetic construct
  source 1..10: note = Seed: SSKALQRPVA
SYKALQRPVK

SEQ ID NO: 523 - protein, 10 aa, synthetic construct
  source 1..10: note = Seed: SSKALQRPVA
SYKALQRPVL

SEQ ID NO: 524 - protein, 10 aa, synthetic construct
  source 1..10: note = Seed: SSKALQRPVA
SYKALQRPVM

SEQ ID NO: 525 - protein, 10 aa, synthetic construct
  source 1..10: note = Seed: SSKALQRPVA
SYKALQRPVS

SEQ ID NO: 526 - protein, 10 aa, synthetic construct
  source 1..10: note = Seed: SSKALQRPVA
SYKALQRPVV

SEQ ID NO: 527 - protein, 10 aa, synthetic construct
  source 1..10: note = Seed: SATGFKQSSK
SYTGFKQSSK

SEQ ID NO: 528 - protein, 11 aa, synthetic construct
  source 1..11: note = Seed: IPLTINKEEAL
IPLTINKEEAM

SEQ ID NO: 529 - protein, 10 aa, synthetic construct
  source 1..10: note = Seed: KEEALQRPVA
KAEALQRPVA

SEQ ID NO: 530 - protein, 10 aa, synthetic construct
  source 1..10: note = Seed: KEEALQRPVA
KAEALQRPVF

SEQ ID NO: 531 - protein, 10 aa, synthetic construct
  source 1..10: note = Seed: KEEALQRPVA
KAEALQRPVI

SEQ ID NO: 532 - protein, 10 aa, synthetic construct
  source 1..10: note = Seed: KEEALQRPVA
KAEALQRPVL

SEQ ID NO: 533 - protein, 10 aa, synthetic construct
  source 1..10: note = Seed: KEEALQRPVA
KAEALQRPVM

SEQ ID NO: 534 - protein, 10 aa, synthetic construct
  source 1..10: note = Seed: KEEALQRPVA
KAEALQRPVV

SEQ ID NO: 535 - protein, 10 aa, synthetic construct
  source 1..10: note = Seed: KEEALQRPVA
KCEALQRPVA

SEQ ID NO: 536 - protein, 10 aa, synthetic construct
  source 1..10: note = Seed: KEEALQRPVA
KCEALQRPVF

SEQ ID NO: 537 - protein, 10 aa, synthetic construct
  source 1..10: note = Seed: KEEALQRPVA
KCEALQRPVI

SEQ ID NO: 538 - protein, 10 aa, synthetic construct
  source 1..10: note = Seed: KEEALQRPVA
KCEALQRPVL

SEQ ID NO: 539 - protein, 10 aa, synthetic construct
  source 1..10: note = Seed: KEEALQRPVA
KCEALQRPVM

SEQ ID NO: 540 - protein, 10 aa, synthetic construct
  source 1..10: note = Seed: KEEALQRPVA
KCEALQRPVV

SEQ ID NO: 541 - protein, 9 aa, synthetic construct
  source 1..9: note = Seed: KEEALQRPV
KDEALQRPL

SEQ ID NO: 542 - protein, 10 aa, synthetic construct
  source 1..10: note = Seed: KEEALQRPVA
KDEALQRPVA

SEQ ID NO: 543 - protein, 10 aa, synthetic construct
  source 1..10: note = Seed: KEEALQRPVA
KDEALQRPVF

SEQ ID NO: 544 - protein, 10 aa, synthetic construct
  source 1..10: note = Seed: KEEALQRPVA
KDEALQRPVI

SEQ ID NO: 545 - protein, 10 aa, synthetic construct
  source 1..10: note = Seed: KEEALQRPVA
KDEALQRPVL

SEQ ID NO: 546 - protein, 10 aa, synthetic construct
  source 1..10: note = Seed: KEEALQRPVA
KDEALQRPVM

SEQ ID NO: 547 - protein, 10 aa, synthetic construct
  source 1..10: note = Seed: KEEALQRPVA
KDEALQRPVV

SEQ ID NO: 548 - protein, 9 aa, synthetic construct
  source 1..9: note = Seed: KEEALQRPV
KEEALQRPC

SEQ ID NO: 549 - protein, 9 aa, synthetic construct
  source 1..9: note = Seed: KEEALQRPV
KEEALQRPF

SEQ ID NO: 550 - protein, 9 aa, synthetic construct
  source 1..9: note = Seed: KEEALQRPV
KEEALQRPI

SEQ ID NO: 551 - protein, 9 aa, synthetic construct
  source 1..9: note = Seed: KEEALQRPV
KEEALQRPP

SEQ ID NO: 552 - protein, 9 aa, synthetic construct
  source 1..9: note = Seed: KEEALQRPV
KEEALQRPS

SEQ ID NO: 553 - protein, 9 aa, synthetic construct
  source 1..9: note = Seed: KEEALQRPV
KEEALQRPT

SEQ ID NO: 554 - protein, 10 aa, synthetic construct
  source 1..10: note = Seed: KEEALQRPVA
KEEALQRPVF

SEQ ID NO: 555 - protein, 10 aa, synthetic construct
  source 1..10: note = Seed: KEEALQRPVA
KEEALQRPVI

SEQ ID NO: 556 - protein, 10 aa, synthetic construct
  source 1..10: note = Seed: KEEALQRPVA
KEEALQRPVM

SEQ ID NO: 557 - protein, 10 aa, synthetic construct
  source 1..10: note = Seed: KEEALQRPVA
KEEALQRPVP

SEQ ID NO: 558 - protein, 10 aa, synthetic construct
  source 1..10: note = Seed: KEEALQRPVA
KEEALQRPVV

SEQ ID NO: 559 - protein, 10 aa, synthetic construct
  source 1..10: note = Seed: KEEALQRPVA
KFEALQRPVA

SEQ ID NO: 560 - protein, 10 aa, synthetic construct
  source 1..10: note = Seed: KEEALQRPVA
KFEALQRPVF

SEQ ID NO: 561 - protein, 10 aa, synthetic construct
  source 1..10: note = Seed: KEEALQRPVA
KFEALQRPVI

SEQ ID NO: 562 - protein, 10 aa, synthetic construct
  source 1..10: note = Seed: KEEALQRPVA
KFEALQRPVL

SEQ ID NO: 563 - protein, 10 aa, synthetic construct
  source 1..10: note = Seed: KEEALQRPVA
KFEALQRPVM

SEQ ID NO: 564 - protein, 10 aa, synthetic construct
  source 1..10: note = Seed: KEEALQRPVA
KFEALQRPVV

SEQ ID NO: 565 - protein, 10 aa, synthetic construct
  source 1..10: note = Seed: KEEALQRPVA
KGEALQRPVA

SEQ ID NO: 566 - protein, 10 aa, synthetic construct
  source 1..10: note = Seed: KEEALQRPVA
KGEALQRPVF

SEQ ID NO: 567 - protein, 10 aa, synthetic construct
  source 1..10: note = Seed: KEEALQRPVA
KGEALQRPVI

SEQ ID NO: 568 - protein, 10 aa, synthetic construct
  source 1..10: note = Seed: KEEALQRPVA
KGEALQRPVL

SEQ ID NO: 569 - protein, 10 aa, synthetic construct
  source 1..10: note = Seed: KEEALQRPVA
KGEALQRPVM

SEQ ID NO: 570 - protein, 10 aa, synthetic construct
  source 1..10: note = Seed: KEEALQRPVA
KGEALQRPVV

SEQ ID NO: 571 - protein, 10 aa, synthetic construct
  source 1..10: note = Seed: KEEALQRPVA
KHEALQRPVA

SEQ ID NO: 572 - protein, 10 aa, synthetic construct
  source 1..10: note = Seed: KEEALQRPVA
KHEALQRPVF

SEQ ID NO: 573 - protein, 10 aa, synthetic construct
  source 1..10: note = Seed: KEEALQRPVA
KHEALQRPVI

SEQ ID NO: 574 - protein, 10 aa, synthetic construct
  source 1..10: note = Seed: KEEALQRPVA
KHEALQRPVL

SEQ ID NO: 575 - protein, 10 aa, synthetic construct
  source 1..10: note = Seed: KEEALQRPVA
KHEALQRPVM

SEQ ID NO: 576 - protein, 10 aa, synthetic construct
  source 1..10: note = Seed: KEEALQRPVA
KHEALQRPVV

SEQ ID NO: 577 - protein, 10 aa, synthetic construct
  source 1..10: note = Seed: KEEALQRPVA
KIEALQRPVA

SEQ ID NO: 578 - protein, 10 aa, synthetic construct
  source 1..10: note = Seed: KEEALQRPVA
KIEALQRPVF

SEQ ID NO: 579 - protein, 10 aa, synthetic construct
  source 1..10: note = Seed: KEEALQRPVA
KIEALQRPVI

SEQ ID NO: 580 - protein, 10 aa, synthetic construct
  source 1..10: note = Seed: KEEALQRPVA
KIEALQRPVL

SEQ ID NO: 581 - protein, 10 aa, synthetic construct
  source 1..10: note = Seed: KEEALQRPVA
KIEALQRPVM

SEQ ID NO: 582 - protein, 10 aa, synthetic construct
  source 1..10: note = Seed: KEEALQRPVA
KIEALQRPVV

SEQ ID NO: 583 - protein, 10 aa, synthetic construct
  source 1..10: note = Seed: KEEALQRPVA
KKEALQRPVA

SEQ ID NO: 584 - protein, 10 aa, synthetic construct
  source 1..10: note = Seed: KEEALQRPVA
KKEALQRPVF

SEQ ID NO: 585 - protein, 10 aa, synthetic construct
  source 1..10: note = Seed: KEEALQRPVA
KKEALQRPVI

SEQ ID NO: 586 - protein, 10 aa, synthetic construct
  source 1..10: note = Seed: KEEALQRPVA
KKEALQRPVL

SEQ ID NO: 587 - protein, 10 aa, synthetic construct
  source 1..10: note = Seed: KEEALQRPVA
KKEALQRPVM

SEQ ID NO: 588 - protein, 10 aa, synthetic construct
  source 1..10: note = Seed: KEEALQRPVA
KKEALQRPVV

SEQ ID NO: 589 - protein, 10 aa, synthetic construct
  source 1..10: note = Seed: KEEALQRPVA
KLEALQRPVA

SEQ ID NO: 590 - protein, 10 aa, synthetic construct
  source 1..10: note = Seed: KEEALQRPVA
KLEALQRPVF

SEQ ID NO: 591 - protein, 10 aa, synthetic construct
  source 1..10: note = Seed: KEEALQRPVA
KLEALQRPVI

SEQ ID NO: 592 - protein, 10 aa, synthetic construct
  source 1..10: note = Seed: KEEALQRPVA
KLEALQRPVL

SEQ ID NO: 593 - protein, 10 aa, synthetic construct
  source 1..10: note = Seed: KEEALQRPVA
KLEALQRPVM

SEQ ID NO: 594 - protein, 10 aa, synthetic construct
  source 1..10: note = Seed: KEEALQRPVA
KLEALQRPVV

SEQ ID NO: 595 - protein, 10 aa, synthetic construct
  source 1..10: note = Seed: KEEALQRPVA
KMEALQRPVA

SEQ ID NO: 596 - protein, 10 aa, synthetic construct
  source 1..10: note = Seed: KEEALQRPVA
KMEALQRPVF

SEQ ID NO: 597 - protein, 10 aa, synthetic construct
  source 1..10: note = Seed: KEEALQRPVA
KMEALQRPVI

SEQ ID NO: 598 - protein, 10 aa, synthetic construct
  source 1..10: note = Seed: KEEALQRPVA
KMEALQRPVL

SEQ ID NO: 599 - protein, 10 aa, synthetic construct
  source 1..10: note = Seed: KEEALQRPVA
KMEALQRPVM

SEQ ID NO: 600 - protein, 10 aa, synthetic construct
  source 1..10: note = Seed: KEEALQRPVA
KMEALQRPVV

SEQ ID NO: 601 - protein, 10 aa, synthetic construct
  source 1..10: note = Seed: KEEALQRPVA
KNEALQRPVA

SEQ ID NO: 602 - protein, 10 aa, synthetic construct
  source 1..10: note = Seed: KEEALQRPVA
KNEALQRPVF

SEQ ID NO: 603 - protein, 10 aa, synthetic construct
  source 1..10: note = Seed: KEEALQRPVA
KNEALQRPVI

SEQ ID NO: 604 - protein, 10 aa, synthetic construct
  source 1..10: note = Seed: KEEALQRPVA
KNEALQRPVL

SEQ ID NO: 605 - protein, 10 aa, synthetic construct
  source 1..10: note = Seed: KEEALQRPVA
KNEALQRPVM

SEQ ID NO: 606 - protein, 10 aa, synthetic construct
  source 1..10: note = Seed: KEEALQRPVA
KNEALQRPVV

SEQ ID NO: 607 - protein, 10 aa, synthetic construct
  source 1..10: note = Seed: KEEALQRPVA
KPEALQRPVA

SEQ ID NO: 608 - protein, 10 aa, synthetic construct
  source 1..10: note = Seed: KEEALQRPVA
KPEALQRPVF

SEQ ID NO: 609 - protein, 10 aa, synthetic construct
  source 1..10: note = Seed: KEEALQRPVA
KPEALQRPVI

SEQ ID NO: 610 - protein, 10 aa, synthetic construct
  source 1..10: note = Seed: KEEALQRPVA
KPEALQRPVL

SEQ ID NO: 611 - protein, 10 aa, synthetic construct
  source 1..10: note = Seed: KEEALQRPVA
KPEALQRPVM

SEQ ID NO: 612 - protein, 10 aa, synthetic construct
  source 1..10: note = Seed: KEEALQRPVA
KPEALQRPVV

SEQ ID NO: 613 - protein, 9 aa, synthetic construct
  source 1..9: note = Seed: KEEALQRPV
KQEALQRPL

SEQ ID NO: 614 - protein, 10 aa, synthetic construct
  source 1..10: note = Seed: KEEALQRPVA
KQEALQRPVA

SEQ ID NO: 615 - protein, 10 aa, synthetic construct
  source 1..10: note = Seed: KEEALQRPVA
KQEALQRPVF

SEQ ID NO: 616 - protein, 10 aa, synthetic construct
  source 1..10: note = Seed: KEEALQRPVA
KQEALQRPVI

SEQ ID NO: 617 - protein, 10 aa, synthetic construct
  source 1..10: note = Seed: KEEALQRPVA
KQEALQRPVL

SEQ ID NO: 618 - protein, 10 aa, synthetic construct
  source 1..10: note = Seed: KEEALQRPVA
KQEALQRPVM

SEQ ID NO: 619 - protein, 10 aa, synthetic construct
  source 1..10: note = Seed: KEEALQRPVA
KQEALQRPVV

SEQ ID NO: 620 - protein, 10 aa, synthetic construct
  source 1..10: note = Seed: KEEALQRPVA
KREALQRPVA

SEQ ID NO: 621 - protein, 10 aa, synthetic construct
  source 1..10: note = Seed: KEEALQRPVA
KREALQRPVF

SEQ ID NO: 622 - protein, 10 aa, synthetic construct
  source 1..10: note = Seed: KEEALQRPVA
KREALQRPVI

SEQ ID NO: 623 - protein, 10 aa, synthetic construct
  source 1..10: note = Seed: KEEALQRPVA
KREALQRPVL

SEQ ID NO: 624 - protein, 10 aa, synthetic construct
  source 1..10: note = Seed: KEEALQRPVA
KREALQRPVM

SEQ ID NO: 625 - protein, 10 aa, synthetic construct
  source 1..10: note = Seed: KEEALQRPVA
KREALQRPVV

SEQ ID NO: 626 - protein, 10 aa, synthetic construct
  source 1..10: note = Seed: KEEALQRPVA
KSEALQRPVA

SEQ ID NO: 627 - protein, 10 aa, synthetic construct
  source 1..10: note = Seed: KEEALQRPVA
KSEALQRPVF

SEQ ID NO: 628 - protein, 10 aa, synthetic construct
  source 1..10: note = Seed: KEEALQRPVA
KSEALQRPVI

SEQ ID NO: 629 - protein, 10 aa, synthetic construct
  source 1..10: note = Seed: KEEALQRPVA
KSEALQRPVL

SEQ ID NO: 630 - protein, 10 aa, synthetic construct
  source 1..10: note = Seed: KEEALQRPVA
KSEALQRPVM

SEQ ID NO: 631 - protein, 10 aa, synthetic construct
  source 1..10: note = Seed: KEEALQRPVA
KSEALQRPVV

SEQ ID NO: 632 - protein, 10 aa, synthetic construct
  source 1..10: note = Seed: KEEALQRPVA
KTEALQRPVA

SEQ ID NO: 633 - protein, 10 aa, synthetic construct
  source 1..10: note = Seed: KEEALQRPVA
KTEALQRPVF

SEQ ID NO: 634 - protein, 10 aa, synthetic construct
  source 1..10: note = Seed: KEEALQRPVA
KTEALQRPVI

SEQ ID NO: 635 - protein, 10 aa, synthetic construct
  source 1..10: note = Seed: KEEALQRPVA
KTEALQRPVL

SEQ ID NO: 636 - protein, 10 aa, synthetic construct
  source 1..10: note = Seed: KEEALQRPVA
KTEALQRPVM

SEQ ID NO: 637 - protein, 10 aa, synthetic construct
  source 1..10: note = Seed: KEEALQRPVA
KTEALQRPVV

SEQ ID NO: 638 - protein, 10 aa, synthetic construct
  source 1..10: note = Seed: KEEALQRPVA
KVEALQRPVA

SEQ ID NO: 639 - protein, 10 aa, synthetic construct
  source 1..10: note = Seed: KEEALQRPVA
KVEALQRPVF

SEQ ID NO: 640 - protein, 10 aa, synthetic construct
  source 1..10: note = Seed: KEEALQRPVA
KVEALQRPVI

SEQ ID NO: 641 - protein, 10 aa, synthetic construct
  source 1..10: note = Seed: KEEALQRPVA
KVEALQRPVL

SEQ ID NO: 642 - protein, 10 aa, synthetic construct
  source 1..10: note = Seed: KEEALQRPVA
KVEALQRPVM

SEQ ID NO: 643 - protein, 10 aa, synthetic construct
  source 1..10: note = Seed: KEEALQRPVA
KVEALQRPVV

SEQ ID NO: 644 - protein, 10 aa, synthetic construct
  source 1..10: note = Seed: KEEALQRPVA
KWEALQRPVA

SEQ ID NO: 645 - protein, 10 aa, synthetic construct
  source 1..10: note = Seed: KEEALQRPVA
KWEALQRPVF

SEQ ID NO: 646 - protein, 10 aa, synthetic construct
  source 1..10: note = Seed: KEEALQRPVA
KWEALQRPVI

SEQ ID NO: 647 - protein, 10 aa, synthetic construct
  source 1..10: note = Seed: KEEALQRPVA
KWEALQRPVL

SEQ ID NO: 648 - protein, 10 aa, synthetic construct
  source 1..10: note = Seed: KEEALQRPVA
KWEALQRPVM

SEQ ID NO: 649 - protein, 10 aa, synthetic construct
  source 1..10: note = Seed: KEEALQRPVA
KWEALQRPVV

SEQ ID NO: 650 - protein, 10 aa, synthetic construct
  source 1..10: note = Seed: KEEALQRPVA
KYEALQRPVA

SEQ ID NO: 651 - protein, 10 aa, synthetic construct
  source 1..10: note = Seed: KEEALQRPVA
KYEALQRPVF

SEQ ID NO: 652 - protein, 10 aa, synthetic construct
  source 1..10: note = Seed: KEEALQRPVA
KYEALQRPVI

SEQ ID NO: 653 - protein, 10 aa, synthetic construct
  source 1..10: note = Seed: KEEALQRPVA
KYEALQRPVL

SEQ ID NO: 654 - protein, 10 aa, synthetic construct
  source 1..10: note = Seed: KEEALQRPVA
KYEALQRPVM

SEQ ID NO: 655 - protein, 10 aa, synthetic construct
  source 1..10: note = Seed: KEEALQRPVA
KYEALQRPVV

SEQ ID NO: 656 - protein, 9 aa, synthetic construct
  source 1..9: note = Seed: LTINKEEAL
LAINKEEAI

SEQ ID NO: 657 - protein, 9 aa, synthetic construct
  source 1..9: note = Seed: LTINKEEAL
LAINKEEAV

SEQ ID NO: 658 - protein, 9 aa, synthetic construct
  source 1..9: note = Seed: LTINKEEAL
LAINKEEAW

SEQ ID NO: 659 - protein, 11 aa, synthetic construct
  source 1..11: note = Seed: LTINKEEALQR
LFINKEEALQR

SEQ ID NO: 660 - protein, 9 aa, synthetic construct
  source 1..9: note = Seed: LTINKEEAL
LIINKEEAW

SEQ ID NO: 661 - protein, 11 aa, synthetic construct
  source 1..11: note = Seed: LTINKEEALQR
LLINKEEALQR

SEQ ID NO: 662 - protein, 11 aa, synthetic construct
  source 1..11: note = Seed: LTINKEEALQR
LMINKEEALQR

SEQ ID NO: 663 - protein, 9 aa, synthetic construct
  source 1..9: note = Seed: LTINKEEAL
LMINKEEAW

SEQ ID NO: 664 - protein, 9 aa, synthetic construct
  source 1..9: note = Seed: LTINKEEAL
LSINKEEAF

SEQ ID NO: 665 - protein, 9 aa, synthetic construct
  source 1..9: note = Seed: LTINKEEAL
LSINKEEAI

SEQ ID NO: 666 - protein, 9 aa, synthetic construct
  source 1..9: note = Seed: LTINKEEAL
LSINKEEAL

SEQ ID NO: 667 - protein, 9 aa, synthetic construct
  source 1..9: note = Seed: LTINKEEAL
LSINKEEAM

SEQ ID NO: 668 - protein, 9 aa, synthetic construct
  source 1..9: note = Seed: LTINKEEAL
LSINKEEAV

SEQ ID NO: 669 - protein, 9 aa, synthetic construct
  source 1..9: note = Seed: LTINKEEAL
LSINKEEAY

SEQ ID NO: 670 - protein, 9 aa, synthetic construct
  source 1..9: note = Seed: LTINKEEAL
LTINKEEAM

SEQ ID NO: 671 - protein, 9 aa, synthetic construct
  source 1..9: note = Seed: LTINKEEAL
LTINKEEAY

SEQ ID NO: 672 - protein, 9 aa, synthetic construct
  source 1..9: note = Seed: LTINKEEAL
LVINKEEAL

SEQ ID NO: 673 - protein, 11 aa, synthetic construct
  source 1..11: note = Seed: LTINKEEALQR
LVINKEEALQR

SEQ ID NO: 674 - protein, 9 aa, synthetic construct
  source 1..9: note = Seed: LTINKEEAL
LVINKEEAM

SEQ ID NO: 675 - protein, 9 aa, synthetic construct
  source 1..9: note = Seed: LTINKEEAL
LVINKEEAW

SEQ ID NO: 676 - protein, 11 aa, synthetic construct
  source 1..11: note = Seed: LTINKEEALQR
LYINKEEALQR

SEQ ID NO: 677 - protein, 10 aa, synthetic construct
  source 1..10: note = Seed: TINKEEALQR
TANKEEALQR

SEQ ID NO: 678 - protein, 10 aa, synthetic construct
  source 1..10: note = Seed: TINKEEALQR
TSNKEEALQR

SEQ ID NO: 679 - protein, 10 aa, synthetic construct
  source 1..10: note = Seed: TINKEEALQR
TTNKEEALQK

SEQ ID NO: 680 - protein, 10 aa, synthetic construct
  source 1..10: note = Seed: TINKEEALQR
TTNKEEALQR

SEQ ID NO: 681 - protein, 10 aa, synthetic construct
  source 1..10: note = Seed: TINKEEALQR
TVNKEEALQK

SEQ ID NO: 682 - protein, 10 aa, synthetic construct
  source 1..10: note = Seed: TINKEEALQR
TVNKEEALQR

SEQ ID NO: 683 - protein, 9 aa, synthetic construct
  source 1..9: note = Seed: ATGFKQSSK
  VARIANT 2: note = T, A, I, L, M, Q, S, or V
  VARIANT 9: note = K
AXGFKQSSX

SEQ ID NO: 684 - protein, 9 aa, synthetic construct
  source 1..9: note = Seed: GFKQSSKAL
  VARIANT 2: note = Y, F, or W
  VARIANT 9: note = L, F, M, Y, I, or V
GXKQSSKAX

SEQ ID NO: 685 - protein, 11 aa, synthetic construct
  source 1..11: note = Seed: GFKQSSKALQR
  VARIANT 2: note = F, M, T, V, or Y
  VARIANT 11: note = R
GXKQSSKALQX

SEQ ID NO: 686 - protein, 11 aa, synthetic construct
  source 1..11: note = Seed: HSATGFKQSSK
  VARIANT 2: note = S, A, I, M, T, or V
  VARIANT 11: note = K or R
HXATGFKQSSX

SEQ ID NO: 687 - protein, 10 aa, synthetic construct
  source 1..10: note = Seed: SSKALQRPVA
  VARIANT 2: note = T, S, V, Y, M, F, I, A, G, L, Q, W, C, or N
  VARIANT 10: note = K, A, V, I, Y, L, M, S, G, R, T, C, F, P, or Q
SXKALQRPVX

SEQ ID NO: 688 - protein, 9 aa, synthetic construct
  source 1..9: note = Seed: SSKALQRPV
  VARIANT 2: note = S, T, V, M, A, I, Y, F, L, Q, W, G, N, C, or H
  VARIANT 9: note = K, V, A, I, L, M, S, G, R, Y, T, F, P, C, N, Q, E, or H
SXKALQRPX

SEQ ID NO: 689 - protein, 11 aa, synthetic construct
  source 1..11: note = Seed: KALQRPVASDF
  VARIANT 2: note = T, S, A, K, M, Q, V, C, D, E, F, G, H, I, L, N, P, R, W, or Y
  VARIANT 11: note = F, Y, M, W, or L
KXLQRPVASDX

SEQ ID NO: 690 - protein, 10 aa, synthetic construct
  source 1..10: note = Seed: SATGFKQSSK
  VARIANT 2: note = A, F, I, L, M, N, S, T, V, C, D, E, G, H, K, P, Q, R, W, or Y
  VARIANT 10: note = K or R
SXTGFKQSSX

SEQ ID NO: 691 - protein, 10 aa, synthetic construct
  source 1..10: note = Seed: FKQSSKALQR
  VARIANT 2: note = F, I, L, M, S, T, V, W, Y, K, A, C, G, H, N, Q, or R
  VARIANT 10: note = R or K
FXQSSKALQX

SEQ ID NO: 692 - protein, 9 aa, synthetic construct
  source 1..9: note = Seed: KQSSKALQR
  VARIANT 2: note = Q, A, F, I, L, M, S, T, V, W, Y, C, G, or N
  VARIANT 9: note = R or K
KXSSKALQX

SEQ ID NO: 693 - protein, 11 aa, synthetic construct
  source 1..11: note = Seed: KQSSKALQRPV
  VARIANT 2: note = T, F, I, M, V, W, Y, Q, A, C, D, E, G, H, K, L, N, P, R, or S
  VARIANT 11: note = V, A, K, I, L, M, or S
KXSSKALQRPX

SEQ ID NO: 694 - protein, 11 aa, synthetic construct
  source 1..11: note = Seed: LTINKEEALQR
  VARIANT 2: note = T, F, L, M, V, or Y
  VARIANT 11: note = R
LXINKEEALQX

SEQ ID NO: 695 - protein, 10 aa, synthetic construct
  source 1..10: note = Seed: KEEALQRPVA
  VARIANT 2: note = E, A, C, D, F, G, H, I, K, L, M, N, P, Q, R, S, T, V, W, or Y
  VARIANT 10: note = A, F, I, L, M, V, or P
KXEALQRPVX

SEQ ID NO: 696 - protein, 9 aa, synthetic construct
  source 1..9: note = Seed: LTINKEEAL
  VARIANT 2: note = A, S, T, V, I, or M
  VARIANT 9: note = W, L, M, F, Y, I, or V
LXINKEEAX

SEQ ID NO: 697 - protein, 9 aa, synthetic construct
  source 1..9: note = Seed: KEEALQRPV
  VARIANT 2: note = E, D, or Q
  VARIANT 9: note = L, V, A, C, F, I, M, P, S, or T
KXEALQRPX

SEQ ID NO: 698 - protein, 11 aa, synthetic construct
  source 1..11: note = Seed: IPLTINKEEAL
  VARIANT 2: note = P
  VARIANT 11: note = L or M
IXLTINKEEAX

SEQ ID NO: 699 - protein, 10 aa, synthetic construct
  source 1..10: note = Seed: IPLTINKEEA
  VARIANT 2: note = P
  VARIANT 10: note = A
IXLTINKEEX

SEQ ID NO: 700 - protein, 10 aa, synthetic construct
  source 1..10: note = Seed: TINKEEALQR
  VARIANT 2: note = T, V, I, A, or S
  VARIANT 10: note = R or K
TXNKEEALQX

SEQ ID NO: 701 - protein, 13 aa, Homo sapiens
ATGFKQSSKALQR

SEQ ID NO: 702 - protein, 14 aa, Homo sapiens
ATGFKQSSKALQRP

SEQ ID NO: 703 - protein, 15 aa, Homo sapiens
ATGFKQSSKALQRPV

SEQ ID NO: 704 - protein, 16 aa, Homo sapiens
ATGFKQSSKALQRPVA

SEQ ID NO: 705 - protein, 17 aa, Homo sapiens
ATGFKQSSKALQRPVAS

SEQ ID NO: 706 - protein, 18 aa, Homo sapiens
ATGFKQSSKALQRPVASD

SEQ ID NO: 707 - protein, 19 aa, Homo sapiens
ATGFKQSSKALQRPVASDF

SEQ ID NO: 708 - protein, 20 aa, Homo sapiens
ATGFKQSSKALQRPVASDFE

SEQ ID NO: 709 - protein, 21 aa, Homo sapiens
ATGFKQSSKALQRPVASDFEP

SEQ ID NO: 710 - protein, 22 aa, Homo sapiens
ATGFKQSSKALQRPVASDFEPQ

SEQ ID NO: 711 - protein, 23 aa, Homo sapiens
ATGFKQSSKALQRPVASDFEPQG

SEQ ID NO: 712 - protein, 24 aa, Homo sapiens
ATGFKQSSKALQRPVASDFEPQGL

SEQ ID NO: 713 - protein, 25 aa, Homo sapiens
ATGFKQSSKALQRPVASDFEPQGLS

SEQ ID NO: 714 - protein, 25 aa, Homo sapiens
DESPGLYGFLNVIVHSATGFKQSSK

SEQ ID NO: 715 - protein, 24 aa, Homo sapiens
ESPGLYGFLNVIVHSATGFKQSSK

SEQ ID NO: 716 - protein, 25 aa, Homo sapiens
ESPGLYGFLNVIVHSATGFKQSSKA

SEQ ID NO: 717 - protein, 14 aa, Homo sapiens
FKQSSKALQRPVAS

SEQ ID NO: 718 - protein, 15 aa, Homo sapiens
FKQSSKALQRPVASD

SEQ ID NO: 719 - protein, 16 aa, Homo sapiens
FKQSSKALQRPVASDF

SEQ ID NO: 720 - protein, 17 aa, Homo sapiens
FKQSSKALQRPVASDFE

SEQ ID NO: 721 - protein, 19 aa, Homo sapiens
FKQSSKALQRPVASDFEPQ

SEQ ID NO: 722 - protein, 20 aa, Homo sapiens
FKQSSKALQRPVASDFEPQG

SEQ ID NO: 723 - protein, 21 aa, Homo sapiens
FKQSSKALQRPVASDFEPQGL

SEQ ID NO: 724 - protein, 22 aa, Homo sapiens
FKQSSKALQRPVASDFEPQGLS

SEQ ID NO: 725 - protein, 23 aa, Homo sapiens
FKQSSKALQRPVASDFEPQGLSE

SEQ ID NO: 726 - protein, 24 aa, Homo sapiens
FKQSSKALQRPVASDFEPQGLSEA

SEQ ID NO: 727 - protein, 25 aa, Homo sapiens
FKQSSKALQRPVASDFEPQGLSEAA

SEQ ID NO: 728 - protein, 17 aa, Homo sapiens
FLNVIVHSATGFKQSSK

SEQ ID NO: 729 - protein, 18 aa, Homo sapiens
FLNVIVHSATGFKQSSKA

SEQ ID NO: 730 - protein, 19 aa, Homo sapiens
FLNVIVHSATGFKQSSKAL

SEQ ID NO: 731 - protein, 20 aa, Homo sapiens
FLNVIVHSATGFKQSSKALQ

SEQ ID NO: 732 - protein, 21 aa, Homo sapiens
FLNVIVHSATGFKQSSKALQR

SEQ ID NO: 733 - protein, 22 aa, Homo sapiens
FLNVIVHSATGFKQSSKALQRP

SEQ ID NO: 734 - protein, 23 aa, Homo sapiens
FLNVIVHSATGFKQSSKALQRPV

SEQ ID NO: 735 - protein, 24 aa, Homo sapiens
FLNVIVHSATGFKQSSKALQRPVA

SEQ ID NO: 736 - protein, 25 aa, Homo sapiens
FLNVIVHSATGFKQSSKALQRPVAS

SEQ ID NO: 737 - protein, 13 aa, Homo sapiens
GFKQSSKALQRPV

SEQ ID NO: 738 - protein, 14 aa, Homo sapiens
GFKQSSKALQRPVA

SEQ ID NO: 739 - protein, 15 aa, Homo sapiens
GFKQSSKALQRPVAS

SEQ ID NO: 740 - protein, 16 aa, Homo sapiens
GFKQSSKALQRPVASD

SEQ ID NO: 741 - protein, 17 aa, Homo sapiens
GFKQSSKALQRPVASDF

SEQ ID NO: 742 - protein, 18 aa, Homo sapiens
GFKQSSKALQRPVASDFE

SEQ ID NO: 743 - protein, 19 aa, Homo sapiens
GFKQSSKALQRPVASDFEP

SEQ ID NO: 744 - protein, 20 aa, Homo sapiens
GFKQSSKALQRPVASDFEPQ

SEQ ID NO: 745 - protein, 21 aa, Homo sapiens
GFKQSSKALQRPVASDFEPQG

SEQ ID NO: 746 - protein, 22 aa, Homo sapiens
GFKQSSKALQRPVASDFEPQGL

SEQ ID NO: 747 - protein, 23 aa, Homo sapiens
GFKQSSKALQRPVASDFEPQGLS

SEQ ID NO: 748 - protein, 24 aa, Homo sapiens
GFKQSSKALQRPVASDFEPQGLSE

SEQ ID NO: 749 - protein, 25 aa, Homo sapiens
GFKQSSKALQRPVASDFEPQGLSEA

SEQ ID NO: 750 - protein, 18 aa, Homo sapiens
GFLNVIVHSATGFKQSSK

SEQ ID NO: 751 - protein, 19 aa, Homo sapiens
GFLNVIVHSATGFKQSSKA

SEQ ID NO: 752 - protein, 20 aa, Homo sapiens
GFLNVIVHSATGFKQSSKAL

SEQ ID NO: 753 - protein, 21 aa, Homo sapiens
GFLNVIVHSATGFKQSSKALQ

SEQ ID NO: 754 - protein, 22 aa, Homo sapiens
GFLNVIVHSATGFKQSSKALQR

SEQ ID NO: 755 - protein, 23 aa, Homo sapiens
GFLNVIVHSATGFKQSSKALQRP

SEQ ID NO: 756 - protein, 24 aa, Homo sapiens
GFLNVIVHSATGFKQSSKALQRPV

SEQ ID NO: 757 - protein, 25 aa, Homo sapiens
GFLNVIVHSATGFKQSSKALQRPVA

SEQ ID NO: 758 - protein, 21 aa, Homo sapiens
GLYGFLNVIVHSATGFKQSSK

SEQ ID NO: 759 - protein, 22 aa, Homo sapiens
GLYGFLNVIVHSATGFKQSSKA

SEQ ID NO: 760 - protein, 23 aa, Homo sapiens
GLYGFLNVIVHSATGFKQSSKAL

SEQ ID NO: 761 - protein, 24 aa, Homo sapiens
GLYGFLNVIVHSATGFKQSSKALQ

SEQ ID NO: 762 - protein, 25 aa, Homo sapiens
GLYGFLNVIVHSATGFKQSSKALQR

SEQ ID NO: 763 - protein, 14 aa, Homo sapiens
HSATGFKQSSKALQ

SEQ ID NO: 764 - protein, 15 aa, Homo sapiens
HSATGFKQSSKALQR

SEQ ID NO: 765 - protein, 16 aa, Homo sapiens
HSATGFKQSSKALQRP

SEQ ID NO: 766 - protein, 17 aa, Homo sapiens
HSATGFKQSSKALQRPV

SEQ ID NO: 767 - protein, 18 aa, Homo sapiens
HSATGFKQSSKALQRPVA

SEQ ID NO: 768 - protein, 19 aa, Homo sapiens
HSATGFKQSSKALQRPVAS

SEQ ID NO: 769 - protein, 20 aa, Homo sapiens
HSATGFKQSSKALQRPVASD

SEQ ID NO: 770 - protein, 21 aa, Homo sapiens
HSATGFKQSSKALQRPVASDF

SEQ ID NO: 771 - protein, 22 aa, Homo sapiens
HSATGFKQSSKALQRPVASDFE

SEQ ID NO: 772 - protein, 23 aa, Homo sapiens
HSATGFKQSSKALQRPVASDFEP

SEQ ID NO: 773 - protein, 24 aa, Homo sapiens
HSATGFKQSSKALQRPVASDFEPQ

SEQ ID NO: 774 - protein, 25 aa, Homo sapiens
HSATGFKQSSKALQRPVASDFEPQG

SEQ ID NO: 775 - protein, 14 aa, Homo sapiens
IVHSATGFKQSSKA

SEQ ID NO: 776 - protein, 15 aa, Homo sapiens
IVHSATGFKQSSKAL

SEQ ID NO: 777 - protein, 16 aa, Homo sapiens
IVHSATGFKQSSKALQ

SEQ ID NO: 778 - protein, 17 aa, Homo sapiens
IVHSATGFKQSSKALQR

SEQ ID NO: 779 - protein, 18 aa, Homo sapiens
IVHSATGFKQSSKALQRP

SEQ ID NO: 780 - protein, 19 aa, Homo sapiens
IVHSATGFKQSSKALQRPV

SEQ ID NO: 781 - protein, 20 aa, Homo sapiens
IVHSATGFKQSSKALQRPVA

SEQ ID NO: 782 - protein, 21 aa, Homo sapiens
IVHSATGFKQSSKALQRPVAS

SEQ ID NO: 783 - protein, 22 aa, Homo sapiens
IVHSATGFKQSSKALQRPVASD

SEQ ID NO: 784 - protein, 23 aa, Homo sapiens
IVHSATGFKQSSKALQRPVASDF

SEQ ID NO: 785 - protein, 24 aa, Homo sapiens
IVHSATGFKQSSKALQRPVASDFE

SEQ ID NO: 786 - protein, 25 aa, Homo sapiens
IVHSATGFKQSSKALQRPVASDFEP

SEQ ID NO: 787 - protein, 20 aa, Homo sapiens
KALQRPVASDFEPQGLSEAA

SEQ ID NO: 788 - protein, 15 aa, Homo sapiens
KQSSKALQRPVASDF

SEQ ID NO: 789 - protein, 16 aa, Homo sapiens
KQSSKALQRPVASDFE

SEQ ID NO: 790 - protein, 17 aa, Homo sapiens
KQSSKALQRPVASDFEP

SEQ ID NO: 791 - protein, 20 aa, Homo sapiens
KQSSKALQRPVASDFEPQGL

SEQ ID NO: 792 - protein, 21 aa, Homo sapiens
KQSSKALQRPVASDFEPQGLS

SEQ ID NO: 793 - protein, 22 aa, Homo sapiens
KQSSKALQRPVASDFEPQGLSE

SEQ ID NO: 794 - protein, 23 aa, Homo sapiens
KQSSKALQRPVASDFEPQGLSEA

SEQ ID NO: 795 - protein, 24 aa, Homo sapiens
KQSSKALQRPVASDFEPQGLSEAA

SEQ ID NO: 796 - protein, 25 aa, Homo sapiens
KQSSKALQRPVASDFEPQGLSEAAR

SEQ ID NO: 797 - protein, 16 aa, Homo sapiens
LNVIVHSATGFKQSSK

SEQ ID NO: 798 - protein, 17 aa, Homo sapiens
LNVIVHSATGFKQSSKA

SEQ ID NO: 799 - protein, 18 aa, Homo sapiens
LNVIVHSATGFKQSSKAL

SEQ ID NO: 800 - protein, 19 aa, Homo sapiens
LNVIVHSATGFKQSSKALQ

SEQ ID NO: 801 - protein, 20 aa, Homo sapiens
LNVIVHSATGFKQSSKALQR

SEQ ID NO: 802 - protein, 21 aa, Homo sapiens
LNVIVHSATGFKQSSKALQRP

SEQ ID NO: 803 - protein, 22 aa, Homo sapiens
LNVIVHSATGFKQSSKALQRPV

SEQ ID NO: 804 - protein, 23 aa, Homo sapiens
LNVIVHSATGFKQSSKALQRPVA

SEQ ID NO: 805 - protein, 24 aa, Homo sapiens
LNVIVHSATGFKQSSKALQRPVAS

SEQ ID NO: 806 - protein, 25 aa, Homo sapiens
LNVIVHSATGFKQSSKALQRPVASD

SEQ ID NO: 807 - protein, 20 aa, Homo sapiens
LYGFLNVIVHSATGFKQSSK

SEQ ID NO: 808 - protein, 21 aa, Homo sapiens
LYGFLNVIVHSATGFKQSSKA

SEQ ID NO: 809 - protein, 22 aa, Homo sapiens
LYGFLNVIVHSATGFKQSSKAL

SEQ ID NO: 810 - protein, 23 aa, Homo sapiens
LYGFLNVIVHSATGFKQSSKALQ

SEQ ID NO: 811 - protein, 24 aa, Homo sapiens
LYGFLNVIVHSATGFKQSSKALQR

SEQ ID NO: 812 - protein, 25 aa, Homo sapiens
LYGFLNVIVHSATGFKQSSKALQRP

SEQ ID NO: 813 - protein, 15 aa, Homo sapiens
NVIVHSATGFKQSSK

SEQ ID NO: 814 - protein, 16 aa, Homo sapiens
NVIVHSATGFKQSSKA

SEQ ID NO: 815 - protein, 17 aa, Homo sapiens
NVIVHSATGFKQSSKAL

SEQ ID NO: 816 - protein, 18 aa, Homo sapiens
NVIVHSATGFKQSSKALQ

SEQ ID NO: 817 - protein, 19 aa, Homo sapiens
NVIVHSATGFKQSSKALQR

SEQ ID NO: 818 - protein, 20 aa, Homo sapiens
NVIVHSATGFKQSSKALQRP

SEQ ID NO: 819 - protein, 21 aa, Homo sapiens
NVIVHSATGFKQSSKALQRPV

SEQ ID NO: 820 - protein, 22 aa, Homo sapiens
NVIVHSATGFKQSSKALQRPVA

SEQ ID NO: 821 - protein, 23 aa, Homo sapiens
NVIVHSATGFKQSSKALQRPVAS

SEQ ID NO: 822 - protein, 24 aa, Homo sapiens
NVIVHSATGFKQSSKALQRPVASD

SEQ ID NO: 823 - protein, 25 aa, Homo sapiens
NVIVHSATGFKQSSKALQRPVASDF

SEQ ID NO: 824 - protein, 22 aa, Homo sapiens
PGLYGFLNVIVHSATGFKQSSK

SEQ ID NO: 825 - protein, 23 aa, Homo sapiens
PGLYGFLNVIVHSATGFKQSSKA

SEQ ID NO: 826 - protein, 24 aa, Homo sapiens
PGLYGFLNVIVHSATGFKQSSKAL

SEQ ID NO: 827 - protein, 25 aa, Homo sapiens
PGLYGFLNVIVHSATGFKQSSKALQ

SEQ ID NO: 828 - protein, 15 aa, Homo sapiens
QSSKALQRPVASDFE

SEQ ID NO: 829 - protein, 20 aa, Homo sapiens
QSSKALQRPVASDFEPQGLS

SEQ ID NO: 830 - protein, 24 aa, Homo sapiens
QSSKALQRPVASDFEPQGLSEAAR

SEQ ID NO: 831 - protein, 25 aa, Homo sapiens
QSSKALQRPVASDFEPQGLSEAARW

SEQ ID NO: 832 - protein, 14 aa, Homo sapiens
SATGFKQSSKALQR

SEQ ID NO: 833 - protein, 15 aa, Homo sapiens
SATGFKQSSKALQRP

SEQ ID NO: 834 - protein, 16 aa, Homo sapiens
SATGFKQSSKALQRPV

SEQ ID NO: 835 - protein, 17 aa, Homo sapiens
SATGFKQSSKALQRPVA

SEQ ID NO: 836 - protein, 18 aa, Homo sapiens
SATGFKQSSKALQRPVAS

SEQ ID NO: 837 - protein, 19 aa, Homo sapiens
SATGFKQSSKALQRPVASD

SEQ ID NO: 838 - protein, 20 aa, Homo sapiens
SATGFKQSSKALQRPVASDF

SEQ ID NO: 839 - protein, 21 aa, Homo sapiens
SATGFKQSSKALQRPVASDFE

SEQ ID NO: 840 - protein, 22 aa, Homo sapiens
SATGFKQSSKALQRPVASDFEP

SEQ ID NO: 841 - protein, 23 aa, Homo sapiens
SATGFKQSSKALQRPVASDFEPQ

SEQ ID NO: 842 - protein, 24 aa, Homo sapiens
SATGFKQSSKALQRPVASDFEPQG

SEQ ID NO: 843 - protein, 25 aa, Homo sapiens
SATGFKQSSKALQRPVASDFEPQGL

SEQ ID NO: 844 - protein, 20 aa, Homo sapiens
SKALQRPVASDFEPQGLSEA

SEQ ID NO: 845 - protein, 25 aa, Homo sapiens
SKALQRPVASDFEPQGLSEAARWNS

SEQ ID NO: 846 - protein, 23 aa, Homo sapiens
SPGLYGFLNVIVHSATGFKQSSK

SEQ ID NO: 847 - protein, 24 aa, Homo sapiens
SPGLYGFLNVIVHSATGFKQSSKA

SEQ ID NO: 848 - protein, 25 aa, Homo sapiens
SPGLYGFLNVIVHSATGFKQSSKAL

SEQ ID NO: 849 - protein, 15 aa, Homo sapiens
SSKALQRPVASDFEP

SEQ ID NO: 850 - protein, 20 aa, Homo sapiens
SSKALQRPVASDFEPQGLSE

SEQ ID NO: 851 - protein, 24 aa, Homo sapiens
SSKALQRPVASDFEPQGLSEAARW

SEQ ID NO: 852 - protein, 25 aa, Homo sapiens
SSKALQRPVASDFEPQGLSEAARWN

SEQ ID NO: 853 - protein, 13 aa, Homo sapiens
TGFKQSSKALQRP

SEQ ID NO: 854 - protein, 14 aa, Homo sapiens
TGFKQSSKALQRPV

SEQ ID NO: 855 - protein, 15 aa, Homo sapiens
TGFKQSSKALQRPVA

SEQ ID NO: 856 - protein, 16 aa, Homo sapiens
TGFKQSSKALQRPVAS

SEQ ID NO: 857 - protein, 17 aa, Homo sapiens
TGFKQSSKALQRPVASD

SEQ ID NO: 858 - protein, 18 aa, Homo sapiens
TGFKQSSKALQRPVASDF

SEQ ID NO: 859 - protein, 19 aa, Homo sapiens
TGFKQSSKALQRPVASDFE

SEQ ID NO: 860 - protein, 20 aa, Homo sapiens
TGFKQSSKALQRPVASDFEP

SEQ ID NO: 861 - protein, 21 aa, Homo sapiens
TGFKQSSKALQRPVASDFEPQ

SEQ ID NO: 862 - protein, 22 aa, Homo sapiens
TGFKQSSKALQRPVASDFEPQG

SEQ ID NO: 863 - protein, 23 aa, Homo sapiens
TGFKQSSKALQRPVASDFEPQGL

SEQ ID NO: 864 - protein, 24 aa, Homo sapiens
TGFKQSSKALQRPVASDFEPQGLS

SEQ ID NO: 865 - protein, 25 aa, Homo sapiens
TGFKQSSKALQRPVASDFEPQGLSE

SEQ ID NO: 866 - protein, 15 aa, Homo sapiens
VHSATGFKQSSKALQ

SEQ ID NO: 867 - protein, 16 aa, Homo sapiens
VHSATGFKQSSKALQR

SEQ ID NO: 868 - protein, 17 aa, Homo sapiens
VHSATGFKQSSKALQRP

SEQ ID NO: 869 - protein, 18 aa, Homo sapiens
VHSATGFKQSSKALQRPV

SEQ ID NO: 870 - protein, 19 aa, Homo sapiens
VHSATGFKQSSKALQRPVA

SEQ ID NO: 871 - protein, 20 aa, Homo sapiens
VHSATGFKQSSKALQRPVAS

SEQ ID NO: 872 - protein, 21 aa, Homo sapiens
VHSATGFKQSSKALQRPVASD

SEQ ID NO: 873 - protein, 22 aa, Homo sapiens
VHSATGFKQSSKALQRPVASDF

SEQ ID NO: 874 - protein, 23 aa, Homo sapiens
VHSATGFKQSSKALQRPVASDFE

SEQ ID NO: 875 - protein, 24 aa, Homo sapiens
VHSATGFKQSSKALQRPVASDFEP

SEQ ID NO: 876 - protein, 25 aa, Homo sapiens
VHSATGFKQSSKALQRPVASDFEPQ

SEQ ID NO: 877 - protein, 14 aa, Homo sapiens
VIVHSATGFKQSSK

SEQ ID NO: 878 - protein, 15 aa, Homo sapiens
VIVHSATGFKQSSKA

SEQ ID NO: 879 - protein, 16 aa, Homo sapiens
VIVHSATGFKQSSKAL

SEQ ID NO: 880 - protein, 17 aa, Homo sapiens
VIVHSATGFKQSSKALQ

SEQ ID NO: 881 - protein, 18 aa, Homo sapiens
VIVHSATGFKQSSKALQR

SEQ ID NO: 882 - protein, 19 aa, Homo sapiens
VIVHSATGFKQSSKALQRP

SEQ ID NO: 883 - protein, 20 aa, Homo sapiens
VIVHSATGFKQSSKALQRPV

SEQ ID NO: 884 - protein, 21 aa, Homo sapiens
VIVHSATGFKQSSKALQRPVA

SEQ ID NO: 885 - protein, 22 aa, Homo sapiens
VIVHSATGFKQSSKALQRPVAS

SEQ ID NO: 886 - protein, 23 aa, Homo sapiens
VIVHSATGFKQSSKALQRPVASD

SEQ ID NO: 887 - protein, 24 aa, Homo sapiens
VIVHSATGFKQSSKALQRPVASDF

SEQ ID NO: 888 - protein, 25 aa, Homo sapiens
VIVHSATGFKQSSKALQRPVASDFE

SEQ ID NO: 889 - protein, 19 aa, Homo sapiens
YGFLNVIVHSATGFKQSSK

SEQ ID NO: 890 - protein, 20 aa, Homo sapiens
YGFLNVIVHSATGFKQSSKA

SEQ ID NO: 891 - protein, 21 aa, Homo sapiens
YGFLNVIVHSATGFKQSSKAL

SEQ ID NO: 892 - protein, 22 aa, Homo sapiens
YGFLNVIVHSATGFKQSSKALQ

SEQ ID NO: 893 - protein, 23 aa, Homo sapiens
YGFLNVIVHSATGFKQSSKALQR

SEQ ID NO: 894 - protein, 24 aa, Homo sapiens
YGFLNVIVHSATGFKQSSKALQRP

SEQ ID NO: 895 - protein, 25 aa, Homo sapiens
YGFLNVIVHSATGFKQSSKALQRPV

SEQ ID NO: 896 - protein, 18 aa, Homo sapiens
CVKLQTVHSIPLTINKEE

SEQ ID NO: 897 - protein, 19 aa, Homo sapiens
CVKLQTVHSIPLTINKEEA

SEQ ID NO: 898 - protein, 20 aa, Homo sapiens
CVKLQTVHSIPLTINKEEAL

SEQ ID NO: 899 - protein, 21 aa, Homo sapiens
CVKLQTVHSIPLTINKEEALQ

SEQ ID NO: 900 - protein, 22 aa, Homo sapiens
CVKLQTVHSIPLTINKEEALQR

SEQ ID NO: 901 - protein, 23 aa, Homo sapiens
CVKLQTVHSIPLTINKEEALQRP

SEQ ID NO: 902 - protein, 24 aa, Homo sapiens
CVKLQTVHSIPLTINKEEALQRPV

SEQ ID NO: 903 - protein, 25 aa, Homo sapiens
CVKLQTVHSIPLTINKEEALQRPVA

SEQ ID NO: 904 - protein, 14 aa, Homo sapiens
HSIPLTINKEEALQ

SEQ ID NO: 905 - protein, 15 aa, Homo sapiens
HSIPLTINKEEALQR

SEQ ID NO: 906 - protein, 16 aa, Homo sapiens
HSIPLTINKEEALQRP

SEQ ID NO: 907 - protein, 17 aa, Homo sapiens
HSIPLTINKEEALQRPV

SEQ ID NO: 908 - protein, 19 aa, Homo sapiens
HSIPLTINKEEALQRPVAS

SEQ ID NO: 909 - protein, 20 aa, Homo sapiens
HSIPLTINKEEALQRPVASD

SEQ ID NO: 910 - protein, 21 aa, Homo sapiens
HSIPLTINKEEALQRPVASDF

SEQ ID NO: 911 - protein, 22 aa, Homo sapiens
HSIPLTINKEEALQRPVASDFE

SEQ ID NO: 912 - protein, 23 aa, Homo sapiens
HSIPLTINKEEALQRPVASDFEP

SEQ ID NO: 913 - protein, 24 aa, Homo sapiens
HSIPLTINKEEALQRPVASDFEPQ

SEQ ID NO: 914 - protein, 25 aa, Homo sapiens
HSIPLTINKEEALQRPVASDFEPQG

SEQ ID NO: 915 - protein, 13 aa, Homo sapiens
IPLTINKEEALQR

SEQ ID NO: 916 - protein, 14 aa, Homo sapiens
IPLTINKEEALQRP

SEQ ID NO: 917 - protein, 15 aa, Homo sapiens
IPLTINKEEALQRPV

SEQ ID NO: 918 - protein, 16 aa, Homo sapiens
IPLTINKEEALQRPVA

SEQ ID NO: 919 - protein, 17 aa, Homo sapiens
IPLTINKEEALQRPVAS

SEQ ID NO: 920 - protein, 19 aa, Homo sapiens
IPLTINKEEALQRPVASDF

SEQ ID NO: 921 - protein, 20 aa, Homo sapiens
IPLTINKEEALQRPVASDFE

SEQ ID NO: 922 - protein, 21 aa, Homo sapiens
IPLTINKEEALQRPVASDFEP

SEQ ID NO: 923 - protein, 22 aa, Homo sapiens
IPLTINKEEALQRPVASDFEPQ

SEQ ID NO: 924 - protein, 23 aa, Homo sapiens
IPLTINKEEALQRPVASDFEPQG

SEQ ID NO: 925 - protein, 24 aa, Homo sapiens
IPLTINKEEALQRPVASDFEPQGL

SEQ ID NO: 926 - protein, 25 aa, Homo sapiens
IPLTINKEEALQRPVASDFEPQGLS

SEQ ID NO: 927 - protein, 20 aa, Homo sapiens
KEEALQRPVASDFEPQGLSE

SEQ ID NO: 928 - protein, 16 aa, Homo sapiens
KLQTVHSIPLTINKEE

SEQ ID NO: 929 - protein, 17 aa, Homo sapiens
KLQTVHSIPLTINKEEA

SEQ ID NO: 930 - protein, 18 aa, Homo sapiens
KLQTVHSIPLTINKEEAL

SEQ ID NO: 931 - protein, 19 aa, Homo sapiens
KLQTVHSIPLTINKEEALQ

SEQ ID NO: 932 - protein, 20 aa, Homo sapiens
KLQTVHSIPLTINKEEALQR

SEQ ID NO: 933 - protein, 21 aa, Homo sapiens
KLQTVHSIPLTINKEEALQRP

SEQ ID NO: 934 - protein, 22 aa, Homo sapiens
KLQTVHSIPLTINKEEALQRPV

SEQ ID NO: 935 - protein, 23 aa, Homo sapiens
KLQTVHSIPLTINKEEALQRPVA

SEQ ID NO: 936 - protein, 24 aa, Homo sapiens
KLQTVHSIPLTINKEEALQRPVAS

SEQ ID NO: 937 - protein, 25 aa, Homo sapiens
KLQTVHSIPLTINKEEALQRPVASD

SEQ ID NO: 938 - protein, 25 aa, Homo sapiens
LQMLTNSCVKLQTVHSIPLTINKEE

SEQ ID NO: 939 - protein, 15 aa, Homo sapiens
LQTVHSIPLTINKEE

SEQ ID NO: 940 - protein, 16 aa, Homo sapiens
LQTVHSIPLTINKEEA

SEQ ID NO: 941 - protein, 17 aa, Homo sapiens
LQTVHSIPLTINKEEAL

SEQ ID NO: 942 - protein, 18 aa, Homo sapiens
LQTVHSIPLTINKEEALQ

SEQ ID NO: 943 - protein, 19 aa, Homo sapiens
LQTVHSIPLTINKEEALQR

SEQ ID NO: 944 - protein, 20 aa, Homo sapiens
LQTVHSIPLTINKEEALQRP

SEQ ID NO: 945 - protein, 21 aa, Homo sapiens
LQTVHSIPLTINKEEALQRPV

SEQ ID NO: 946 - protein, 22 aa, Homo sapiens
LQTVHSIPLTINKEEALQRPVA

SEQ ID NO: 947 - protein, 23 aa, Homo sapiens
LQTVHSIPLTINKEEALQRPVAS

SEQ ID NO: 948 - protein, 24 aa, Homo sapiens
LQTVHSIPLTINKEEALQRPVASD

SEQ ID NO: 949 - protein, 25 aa, Homo sapiens
LQTVHSIPLTINKEEALQRPVASDF

SEQ ID NO: 950 - protein, 14 aa, Homo sapiens
LTINKEEALQRPVA

SEQ ID NO: 951 - protein, 15 aa, Homo sapiens
LTINKEEALQRPVAS

SEQ ID NO: 952 - protein, 16 aa, Homo sapiens
LTINKEEALQRPVASD

SEQ ID NO: 953 - protein, 17 aa, Homo sapiens
LTINKEEALQRPVASDF

SEQ ID NO: 954 - protein, 20 aa, Homo sapiens
LTINKEEALQRPVASDFEPQ

SEQ ID NO: 955 - protein, 21 aa, Homo sapiens
LTINKEEALQRPVASDFEPQG

SEQ ID NO: 956 - protein, 22 aa, Homo sapiens
LTINKEEALQRPVASDFEPQGL

SEQ ID NO: 957 - protein, 23 aa, Homo sapiens
LTINKEEALQRPVASDFEPQGLS

SEQ ID NO: 958 - protein, 24 aa, Homo sapiens
LTINKEEALQRPVASDFEPQGLSE

SEQ ID NO: 959 - protein, 25 aa, Homo sapiens
LTINKEEALQRPVASDFEPQGLSEA

SEQ ID NO: 960 - protein, 22 aa, Homo sapiens
LTNSCVKLQTVHSIPLTINKEE

SEQ ID NO: 961 - protein, 23 aa, Homo sapiens
LTNSCVKLQTVHSIPLTINKEEA

SEQ ID NO: 962 - protein, 24 aa, Homo sapiens
LTNSCVKLQTVHSIPLTINKEEAL

SEQ ID NO: 963 - protein, 25 aa, Homo sapiens
LTNSCVKLQTVHSIPLTINKEEALQ

SEQ ID NO: 964 - protein, 23 aa, Homo sapiens
MLTNSCVKLQTVHSIPLTINKEE

SEQ ID NO: 965 - protein, 24 aa, Homo sapiens
MLTNSCVKLQTVHSIPLTINKEEA

SEQ ID NO: 966 - protein, 25 aa, Homo sapiens
MLTNSCVKLQTVHSIPLTINKEEAL

SEQ ID NO: 967 - protein, 20 aa, Homo sapiens
NKEEALQRPVASDFEPQGLS

SEQ ID NO: 968 - protein, 20 aa, Homo sapiens
NSCVKLQTVHSIPLTINKEE

SEQ ID NO: 969 - protein, 21 aa, Homo sapiens
NSCVKLQTVHSIPLTINKEEA

SEQ ID NO: 970 - protein, 22 aa, Homo sapiens
NSCVKLQTVHSIPLTINKEEAL

SEQ ID NO: 971 - protein, 23 aa, Homo sapiens
NSCVKLQTVHSIPLTINKEEALQ

SEQ ID NO: 972 - protein, 24 aa, Homo sapiens
NSCVKLQTVHSIPLTINKEEALQR

SEQ ID NO: 973 - protein, 25 aa, Homo sapiens
NSCVKLQTVHSIPLTINKEEALQRP

SEQ ID NO: 974 - protein, 14 aa, Homo sapiens
PLTINKEEALQRPV

SEQ ID NO: 975 - protein, 15 aa, Homo sapiens
PLTINKEEALQRPVA

SEQ ID NO: 976 - protein, 16 aa, Homo sapiens
PLTINKEEALQRPVAS

SEQ ID NO: 977 - protein, 17 aa, Homo sapiens
PLTINKEEALQRPVASD

SEQ ID NO: 978 - protein, 19 aa, Homo sapiens
PLTINKEEALQRPVASDFE

SEQ ID NO: 979 - protein, 20 aa, Homo sapiens
PLTINKEEALQRPVASDFEP

SEQ ID NO: 980 - protein, 21 aa, Homo sapiens
PLTINKEEALQRPVASDFEPQ

SEQ ID NO: 981 - protein, 22 aa, Homo sapiens
PLTINKEEALQRPVASDFEPQG

SEQ ID NO: 982 - protein, 23 aa, Homo sapiens
PLTINKEEALQRPVASDFEPQGL

SEQ ID NO: 983 - protein, 24 aa, Homo sapiens
PLTINKEEALQRPVASDFEPQGLS

SEQ ID NO: 984 - protein, 25 aa, Homo sapiens
PLTINKEEALQRPVASDFEPQGLSE

SEQ ID NO: 985 - protein, 24 aa, Homo sapiens
QMLTNSCVKLQTVHSIPLTINKEE

SEQ ID NO: 986 - protein, 25 aa, Homo sapiens
QMLTNSCVKLQTVHSIPLTINKEEA

SEQ ID NO: 987 - protein, 14 aa, Homo sapiens
QTVHSIPLTINKEE

SEQ ID NO: 988 - protein, 15 aa, Homo sapiens
QTVHSIPLTINKEEA

SEQ ID NO: 989 - protein, 16 aa, Homo sapiens
QTVHSIPLTINKEEAL

SEQ ID NO: 990 - protein, 17 aa, Homo sapiens
QTVHSIPLTINKEEALQ

SEQ ID NO: 991 - protein, 19 aa, Homo sapiens
QTVHSIPLTINKEEALQRP

SEQ ID NO: 992 - protein, 20 aa, Homo sapiens
QTVHSIPLTINKEEALQRPV

SEQ ID NO: 993 - protein, 21 aa, Homo sapiens
QTVHSIPLTINKEEALQRPVA

SEQ ID NO: 994 - protein, 22 aa, Homo sapiens
QTVHSIPLTINKEEALQRPVAS

SEQ ID NO: 995 - protein, 23 aa, Homo sapiens
QTVHSIPLTINKEEALQRPVASD

SEQ ID NO: 996 - protein, 24 aa, Homo sapiens
QTVHSIPLTINKEEALQRPVASDF

SEQ ID NO: 997 - protein, 25 aa, Homo sapiens
QTVHSIPLTINKEEALQRPVASDFE

SEQ ID NO: 998 - protein, 19 aa, Homo sapiens
SCVKLQTVHSIPLTINKEE

SEQ ID NO: 999 - protein, 20 aa, Homo sapiens
SCVKLQTVHSIPLTINKEEA

SEQ ID NO: 1000 - protein, 21 aa, Homo sapiens
SCVKLQTVHSIPLTINKEEAL

SEQ ID NO: 1001 - protein, 22 aa, Homo sapiens
SCVKLQTVHSIPLTINKEEALQ

SEQ ID NO: 1002 - protein, 23 aa, Homo sapiens
SCVKLQTVHSIPLTINKEEALQR

SEQ ID NO: 1003 - protein, 24 aa, Homo sapiens
SCVKLQTVHSIPLTINKEEALQRP

SEQ ID NO: 1004 - protein, 25 aa, Homo sapiens
SCVKLQTVHSIPLTINKEEALQRPV

SEQ ID NO: 1005 - protein, 14 aa, Homo sapiens
SIPLTINKEEALQR

SEQ ID NO: 1006 - protein, 15 aa, Homo sapiens
SIPLTINKEEALQRP

SEQ ID NO: 1007 - protein, 16 aa, Homo sapiens
SIPLTINKEEALQRPV

SEQ ID NO: 1008 - protein, 17 aa, Homo sapiens
SIPLTINKEEALQRPVA

SEQ ID NO: 1009 - protein, 19 aa, Homo sapiens
SIPLTINKEEALQRPVASD

SEQ ID NO: 1010 - protein, 20 aa, Homo sapiens
SIPLTINKEEALQRPVASDF

SEQ ID NO: 1011 - protein, 21 aa, Homo sapiens
SIPLTINKEEALQRPVASDFE

SEQ ID NO: 1012 - protein, 22 aa, Homo sapiens
SIPLTINKEEALQRPVASDFEP

SEQ ID NO: 1013 - protein, 23 aa, Homo sapiens
SIPLTINKEEALQRPVASDFEPQ

SEQ ID NO: 1014 - protein, 24 aa, Homo sapiens
SIPLTINKEEALQRPVASDFEPQG

SEQ ID NO: 1015 - protein, 25 aa, Homo sapiens
SIPLTINKEEALQRPVASDFEPQGL

SEQ ID NO: 1016 - protein, 15 aa, Homo sapiens
TINKEEALQRPVASD

SEQ ID NO: 1017 - protein, 21 aa, Homo sapiens
TNSCVKLQTVHSIPLTINKEE

SEQ ID NO: 1018 - protein, 22 aa, Homo sapiens
TNSCVKLQTVHSIPLTINKEEA

SEQ ID NO: 1019 - protein, 23 aa, Homo sapiens
TNSCVKLQTVHSIPLTINKEEAL

SEQ ID NO: 1020 - protein, 24 aa, Homo sapiens
TNSCVKLQTVHSIPLTINKEEALQ

SEQ ID NO: 1021 - protein, 25 aa, Homo sapiens
TNSCVKLQTVHSIPLTINKEEALQR

SEQ ID NO: 1022 - protein, 15 aa, Homo sapiens
TVHSIPLTINKEEAL

SEQ ID NO: 1023 - protein, 16 aa, Homo sapiens
TVHSIPLTINKEEALQ

SEQ ID NO: 1024 - protein, 17 aa, Homo sapiens
TVHSIPLTINKEEALQR

SEQ ID NO: 1025 - protein, 19 aa, Homo sapiens
TVHSIPLTINKEEALQRPV

SEQ ID NO: 1026 - protein, 20 aa, Homo sapiens
TVHSIPLTINKEEALQRPVA

SEQ ID NO: 1027 - protein, 21 aa, Homo sapiens
TVHSIPLTINKEEALQRPVAS

SEQ ID NO: 1028 - protein, 22 aa, Homo sapiens
TVHSIPLTINKEEALQRPVASD

SEQ ID NO: 1029 - protein, 23 aa, Homo sapiens
TVHSIPLTINKEEALQRPVASDF

SEQ ID NO: 1030 - protein, 24 aa, Homo sapiens
TVHSIPLTINKEEALQRPVASDFE

SEQ ID NO: 1031 - protein, 25 aa, Homo sapiens
TVHSIPLTINKEEALQRPVASDFEP

SEQ ID NO: 1032 - protein, 15 aa, Homo sapiens
VHSIPLTINKEEALQ

SEQ ID NO: 1033 - protein, 16 aa, Homo sapiens
VHSIPLTINKEEALQR

SEQ ID NO: 1034 - protein, 17 aa, Homo sapiens
VHSIPLTINKEEALQRP

SEQ ID NO: 1035 - protein, 19 aa, Homo sapiens
VHSIPLTINKEEALQRPVA

SEQ ID NO: 1036 - protein, 20 aa, Homo sapiens
VHSIPLTINKEEALQRPVAS

SEQ ID NO: 1037 - protein, 21 aa, Homo sapiens
VHSIPLTINKEEALQRPVASD

SEQ ID NO: 1038 - protein, 22 aa, Homo sapiens
VHSIPLTINKEEALQRPVASDF

SEQ ID NO: 1039 - protein, 23 aa, Homo sapiens
VHSIPLTINKEEALQRPVASDFE

SEQ ID NO: 1040 - protein, 24 aa, Homo sapiens
VHSIPLTINKEEALQRPVASDFEP

SEQ ID NO: 1041 - protein, 25 aa, Homo sapiens
VHSIPLTINKEEALQRPVASDFEPQ

SEQ ID NO: 1042 - protein, 17 aa, Homo sapiens
VKLQTVHSIPLTINKEE

SEQ ID NO: 1043 - protein, 18 aa, Homo sapiens
VKLQTVHSIPLTINKEEA

SEQ ID NO: 1044 - protein, 19 aa, Homo sapiens
VKLQTVHSIPLTINKEEAL

SEQ ID NO: 1045 - protein, 20 aa, Homo sapiens
VKLQTVHSIPLTINKEEALQ

SEQ ID NO: 1046 - protein, 21 aa, Homo sapiens
VKLQTVHSIPLTINKEEALQR

SEQ ID NO: 1047 - protein, 22 aa, Homo sapiens
VKLQTVHSIPLTINKEEALQRP

SEQ ID NO: 1048 - protein, 23 aa, Homo sapiens
VKLQTVHSIPLTINKEEALQRPV

SEQ ID NO: 1049 - protein, 24 aa, Homo sapiens
VKLQTVHSIPLTINKEEALQRPVA

SEQ ID NO: 1050 - protein, 25 aa, Homo sapiens
VKLQTVHSIPLTINKEEALQRPVAS

SEQ ID NO: 1051 - protein, 25 aa, synthetic construct
  source 1..25: note = Seed: LNVIVHSATGFKQSSKALQRPVASD
LNVIVHSATGAKQFSRALRRPVASD

SEQ ID NO: 1052 - protein, 25 aa, synthetic construct
  source 1..25: note = Seed: LNVIVHSATGFKQSSKALQRPVASD
LNVIVHSATGAKQLSAALIRPVASD

SEQ ID NO: 1053 - protein, 25 aa, synthetic construct
  source 1..25: note = Seed: LNVIVHSATGFKQSSKALQRPVASD
LNVIVHSATGAKQLSAALLRPVASD

SEQ ID NO: 1054 - protein, 25 aa, synthetic construct
  source 1..25: note = Seed: LNVIVHSATGFKQSSKALQRPVASD
LNVIVHSATGAKQLSAALSRPVASD

SEQ ID NO: 1055 - protein, 25 aa, synthetic construct
  source 1..25: note = Seed: LNVIVHSATGFKQSSKALQRPVASD
LNVIVHSATGAKQLSAALVRPVASD

SEQ ID NO: 1056 - protein, 25 aa, synthetic construct
  source 1..25: note = Seed: LNVIVHSATGFKQSSKALQRPVASD
LNVIVHSATGAKQLSGALIRPVASD

SEQ ID NO: 1057 - protein, 25 aa, synthetic construct
  source 1..25: note = Seed: LNVIVHSATGFKQSSKALQRPVASD
LNVIVHSATGAKQLSGALVRPVASD

SEQ ID NO: 1058 - protein, 25 aa, synthetic construct
  source 1..25: note = Seed: LNVIVHSATGFKQSSKALQRPVASD
LNVIVHSATGAKQLSSALIRPVASD

SEQ ID NO: 1059 - protein, 25 aa, synthetic construct
  source 1..25: note = Seed: LNVIVHSATGFKQSSKALQRPVASD
LNVIVHSATGAKQLSSALVRPVASD

SEQ ID NO: 1060 - protein, 25 aa, synthetic construct
  source 1..25: note = Seed: LNVIVHSATGFKQSSKALQRPVASD
LNVIVHSATGAKQMSAALARPVASD

SEQ ID NO: 1061 - protein, 25 aa, synthetic construct
  source 1..25: note = Seed: LNVIVHSATGFKQSSKALQRPVASD
LNVIVHSATGAKQMSAALIRPVASD

SEQ ID NO: 1062 - protein, 25 aa, synthetic construct
  source 1..25: note = Seed: LNVIVHSATGFKQSSKALQRPVASD
LNVIVHSATGAKQMSAALVRPVASD

SEQ ID NO: 1063 - protein, 25 aa, synthetic construct
  source 1..25: note = Seed: LNVIVHSATGFKQSSKALQRPVASD
LNVIVHSATGAKQMSGALVRPVASD

SEQ ID NO: 1064 - protein, 25 aa, synthetic construct
  source 1..25: note = Seed: LNVIVHSATGFKQSSKALQRPVASD
LNVIVHSATGAKQMSKALRRPVASD

SEQ ID NO: 1065 - protein, 25 aa, synthetic construct
  source 1..25: note = Seed: LNVIVHSATGFKQSSKALQRPVASD
LNVIVHSATGAKQMSRALRRPVASD

SEQ ID NO: 1066 - protein, 25 aa, synthetic construct
  source 1..25: note = Seed: LNVIVHSATGFKQSSKALQRPVASD
LNVIVHSATGCKQISAALIRPVASD

SEQ ID NO: 1067 - protein, 25 aa, synthetic construct
  source 1..25: note = Seed: LNVIVHSATGFKQSSKALQRPVASD
LNVIVHSATGCKQISAALLRPVASD

SEQ ID NO: 1068 - protein, 25 aa, synthetic construct
  source 1..25: note = Seed: LNVIVHSATGFKQSSKALQRPVASD
LNVIVHSATGCKQISGALIRPVASD

SEQ ID NO: 1069 - protein, 25 aa, synthetic construct
  source 1..25: note = Seed: LNVIVHSATGFKQSSKALQRPVASD
LNVIVHSATGCKQISGALVRPVASD

SEQ ID NO: 1070 - protein, 25 aa, synthetic construct
  source 1..25: note = Seed: LNVIVHSATGFKQSSKALQRPVASD
LNVIVHSATGCKQLSAALIRPVASD

SEQ ID NO: 1071 - protein, 25 aa, synthetic construct
  source 1..25: note = Seed: LNVIVHSATGFKQSSKALQRPVASD
LNVIVHSATGCKQLSAALLRPVASD

SEQ ID NO: 1072 - protein, 25 aa, synthetic construct
  source 1..25: note = Seed: LNVIVHSATGFKQSSKALQRPVASD
LNVIVHSATGCKQLSAALMRPVASD

SEQ ID NO: 1073 - protein, 25 aa, synthetic construct
  source 1..25: note = Seed: LNVIVHSATGFKQSSKALQRPVASD
LNVIVHSATGCKQLSAALTRPVASD

SEQ ID NO: 1074 - protein, 25 aa, synthetic construct
  source 1..25: note = Seed: LNVIVHSATGFKQSSKALQRPVASD
LNVIVHSATGCKQLSAALVRPVASD

SEQ ID NO: 1075 - protein, 25 aa, synthetic construct
  source 1..25: note = Seed: LNVIVHSATGFKQSSKALQRPVASD
LNVIVHSATGCKQLSGALARPVASD

SEQ ID NO: 1076 - protein, 25 aa, synthetic construct
  source 1..25: note = Seed: LNVIVHSATGFKQSSKALQRPVASD
LNVIVHSATGCKQLSGALIRPVASD

SEQ ID NO: 1077 - protein, 25 aa, synthetic construct
  source 1..25: note = Seed: LNVIVHSATGFKQSSKALQRPVASD
LNVIVHSATGCKQLSGALLRPVASD

SEQ ID NO: 1078 - protein, 25 aa, synthetic construct
  source 1..25: note = Seed: LNVIVHSATGFKQSSKALQRPVASD
LNVIVHSATGCKQLSGALTRPVASD

SEQ ID NO: 1079 - protein, 25 aa, synthetic construct
  source 1..25: note = Seed: LNVIVHSATGFKQSSKALQRPVASD
LNVIVHSATGCKQLSGALVRPVASD

SEQ ID NO: 1080 - protein, 25 aa, synthetic construct
  source 1..25: note = Seed: LNVIVHSATGFKQSSKALQRPVASD
LNVIVHSATGCKQLSPALIRPVASD

SEQ ID NO: 1081 - protein, 25 aa, synthetic construct
  source 1..25: note = Seed: LNVIVHSATGFKQSSKALQRPVASD
LNVIVHSATGCKQLSPALLRPVASD

SEQ ID NO: 1082 - protein, 25 aa, synthetic construct
  source 1..25: note = Seed: LNVIVHSATGFKQSSKALQRPVASD
LNVIVHSATGCKQLSPALVRPVASD

SEQ ID NO: 1083 - protein, 25 aa, synthetic construct
  source 1..25: note = Seed: LNVIVHSATGFKQSSKALQRPVASD
LNVIVHSATGCKQLSSALIRPVASD

SEQ ID NO: 1084 - protein, 25 aa, synthetic construct
  source 1..25: note = Seed: LNVIVHSATGFKQSSKALQRPVASD
LNVIVHSATGCKQLSSALLRPVASD

SEQ ID NO: 1085 - protein, 25 aa, synthetic construct
  source 1..25: note = Seed: LNVIVHSATGFKQSSKALQRPVASD
LNVIVHSATGCKQLSSALVRPVASD

SEQ ID NO: 1086 - protein, 25 aa, synthetic construct
  source 1..25: note = Seed: LNVIVHSATGFKQSSKALQRPVASD
LNVIVHSATGCKQLSTALVRPVASD

SEQ ID NO: 1087 - protein, 25 aa, synthetic construct
  source 1..25: note = Seed: LNVIVHSATGFKQSSKALQRPVASD
LNVIVHSATGCKQMSAALIRPVASD

SEQ ID NO: 1088 - protein, 25 aa, synthetic construct
  source 1..25: note = Seed: LNVIVHSATGFKQSSKALQRPVASD
LNVIVHSATGCKQMSAALLRPVASD

SEQ ID NO: 1089 - protein, 25 aa, synthetic construct
  source 1..25: note = Seed: LNVIVHSATGFKQSSKALQRPVASD
LNVIVHSATGCKQMSAALMRPVASD

SEQ ID NO: 1090 - protein, 25 aa, synthetic construct
  source 1..25: note = Seed: LNVIVHSATGFKQSSKALQRPVASD
LNVIVHSATGCKQMSAALTRPVASD

SEQ ID NO: 1091 - protein, 25 aa, synthetic construct
  source 1..25: note = Seed: LNVIVHSATGFKQSSKALQRPVASD
LNVIVHSATGCKQMSAALVRPVASD

SEQ ID NO: 1092 - protein, 25 aa, synthetic construct
  source 1..25: note = Seed: LNVIVHSATGFKQSSKALQRPVASD
LNVIVHSATGCKQMSGALARPVASD

SEQ ID NO: 1093 - protein, 25 aa, synthetic construct
  source 1..25: note = Seed: LNVIVHSATGFKQSSKALQRPVASD
LNVIVHSATGCKQMSGALIRPVASD

SEQ ID NO: 1094 - protein, 25 aa, synthetic construct
  source 1..25: note = Seed: LNVIVHSATGFKQSSKALQRPVASD
LNVIVHSATGCKQMSGALLRPVASD

SEQ ID NO: 1095 - protein, 25 aa, synthetic construct
  source 1..25: note = Seed: LNVIVHSATGFKQSSKALQRPVASD
LNVIVHSATGCKQMSGALVRPVASD

SEQ ID NO: 1096 - protein, 25 aa, synthetic construct
  source 1..25: note = Seed: LNVIVHSATGFKQSSKALQRPVASD
LNVIVHSATGCKQMSKALRRPVASD

SEQ ID NO: 1097 - protein, 25 aa, synthetic construct
  source 1..25: note = Seed: LNVIVHSATGFKQSSKALQRPVASD
LNVIVHSATGCKQMSPALIRPVASD

SEQ ID NO: 1098 - protein, 25 aa, synthetic construct
  source 1..25: note = Seed: LNVIVHSATGFKQSSKALQRPVASD
LNVIVHSATGCKQMSPALLRPVASD

SEQ ID NO: 1099 - protein, 25 aa, synthetic construct
  source 1..25: note = Seed: LNVIVHSATGFKQSSKALQRPVASD
LNVIVHSATGCKQMSPALVRPVASD

SEQ ID NO: 1100 - protein, 25 aa, synthetic construct
  source 1..25: note = Seed: LNVIVHSATGFKQSSKALQRPVASD
LNVIVHSATGCKQMSRALRRPVASD

SEQ ID NO: 1101 - protein, 25 aa, synthetic construct
  source 1..25: note = Seed: LNVIVHSATGFKQSSKALQRPVASD
LNVIVHSATGCKQMSSALIRPVASD

SEQ ID NO: 1102 - protein, 25 aa, synthetic construct
  source 1..25: note = Seed: LNVIVHSATGFKQSSKALQRPVASD
LNVIVHSATGCKQMSSALLRPVASD

SEQ ID NO: 1103 - protein, 25 aa, synthetic construct
  source 1..25: note = Seed: LNVIVHSATGFKQSSKALQRPVASD
LNVIVHSATGCKQMSSALVRPVASD

SEQ ID NO: 1104 - protein, 25 aa, synthetic construct
  source 1..25: note = Seed: LNVIVHSATGFKQSSKALQRPVASD
LNVIVHSATGCKQTSSALIRPVASD

SEQ ID NO: 1105 - protein, 25 aa, synthetic construct
  source 1..25: note = Seed: LNVIVHSATGFKQSSKALQRPVASD
LNVIVHSATGDKQLSAALVRPVASD

SEQ ID NO: 1106 - protein, 25 aa, synthetic construct
  source 1..25: note = Seed: LNVIVHSATGFKQSSKALQRPVASD
LNVIVHSATGEKQLSAALVRPVASD

SEQ ID NO: 1107 - protein, 25 aa, synthetic construct
  source 1..25: note = Seed: LNVIVHSATGFKQSSKALQRPVASD
LNVIVHSATGFKQASAALARPVASD

SEQ ID NO: 1108 - protein, 25 aa, synthetic construct
  source 1..25: note = Seed: LNVIVHSATGFKQSSKALQRPVASD
LNVIVHSATGFKQASAALCRPVASD

SEQ ID NO: 1109 - protein, 25 aa, synthetic construct
  source 1..25: note = Seed: LNVIVHSATGFKQSSKALQRPVASD
LNVIVHSATGFKQASAALDRPVASD

SEQ ID NO: 1110 - protein, 25 aa, synthetic construct
  source 1..25: note = Seed: LNVIVHSATGFKQSSKALQRPVASD
LNVIVHSATGFKQASAALERPVASD

SEQ ID NO: 1111 - protein, 25 aa, synthetic construct
  source 1..25: note = Seed: LNVIVHSATGFKQSSKALQRPVASD
LNVIVHSATGFKQASAALFRPVASD

SEQ ID NO: 1112 - protein, 25 aa, synthetic construct
  source 1..25: note = Seed: LNVIVHSATGFKQSSKALQRPVASD
LNVIVHSATGFKQASAALGRPVASD

SEQ ID NO: 1113 - protein, 25 aa, synthetic construct
  source 1..25: note = Seed: LNVIVHSATGFKQSSKALQRPVASD
LNVIVHSATGFKQASAALHRPVASD

SEQ ID NO: 1114 - protein, 25 aa, synthetic construct
  source 1..25: note = Seed: LNVIVHSATGFKQSSKALQRPVASD
LNVIVHSATGFKQASAALIRPVASD

SEQ ID NO: 1115 - protein, 25 aa, synthetic construct
  source 1..25: note = Seed: LNVIVHSATGFKQSSKALQRPVASD
LNVIVHSATGFKQASAALKRPVASD

SEQ ID NO: 1116 - protein, 25 aa, synthetic construct
  source 1..25: note = Seed: LNVIVHSATGFKQSSKALQRPVASD
LNVIVHSATGFKQASAALLRPVASD

SEQ ID NO: 1117 - protein, 25 aa, synthetic construct
  source 1..25: note = Seed: LNVIVHSATGFKQSSKALQRPVASD
LNVIVHSATGFKQASAALMRPVASD

SEQ ID NO: 1118 - protein, 25 aa, synthetic construct
  source 1..25: note = Seed: LNVIVHSATGFKQSSKALQRPVASD
LNVIVHSATGFKQASAALNRPVASD

SEQ ID NO: 1119 - protein, 25 aa, synthetic construct
  source 1..25: note = Seed: LNVIVHSATGFKQSSKALQRPVASD
LNVIVHSATGFKQASAALPRPVASD

SEQ ID NO: 1120 - protein, 25 aa, synthetic construct
  source 1..25: note = Seed: LNVIVHSATGFKQSSKALQRPVASD
LNVIVHSATGFKQASAALQRPVASD

SEQ ID NO: 1121 - protein, 25 aa, synthetic construct
  source 1..25: note = Seed: LNVIVHSATGFKQSSKALQRPVASD
LNVIVHSATGFKQASAALRRPVASD

SEQ ID NO: 1122 - protein, 25 aa, synthetic construct
  source 1..25: note = Seed: LNVIVHSATGFKQSSKALQRPVASD
LNVIVHSATGFKQASAALSRPVASD

SEQ ID NO: 1123 - protein, 25 aa, synthetic construct
  source 1..25: note = Seed: LNVIVHSATGFKQSSKALQRPVASD
LNVIVHSATGFKQASAALTRPVASD

SEQ ID NO: 1124 - protein, 25 aa, synthetic construct
  source 1..25: note = Seed: LNVIVHSATGFKQSSKALQRPVASD
LNVIVHSATGFKQASAALVRPVASD

SEQ ID NO: 1125 - protein, 25 aa, synthetic construct
  source 1..25: note = Seed: LNVIVHSATGFKQSSKALQRPVASD
LNVIVHSATGFKQASAALWRPVASD

SEQ ID NO: 1126 - protein, 25 aa, synthetic construct
  source 1..25: note = Seed: LNVIVHSATGFKQSSKALQRPVASD
LNVIVHSATGFKQASAALYRPVASD

SEQ ID NO: 1127 - protein, 25 aa, synthetic construct
  source 1..25: note = Seed: LNVIVHSATGFKQSSKALQRPVASD
LNVIVHSATGFKQASCALARPVASD

SEQ ID NO: 1128 - protein, 25 aa, synthetic construct
  source 1..25: note = Seed: LNVIVHSATGFKQSSKALQRPVASD
LNVIVHSATGFKQASCALNRPVASD

SEQ ID NO: 1129 - protein, 25 aa, synthetic construct
  source 1..25: note = Seed: LNVIVHSATGFKQSSKALQRPVASD
LNVIVHSATGFKQASCALSRPVASD

SEQ ID NO: 1130 - protein, 25 aa, synthetic construct
  source 1..25: note = Seed: LNVIVHSATGFKQSSKALQRPVASD
LNVIVHSATGFKQASCALVRPVASD

SEQ ID NO: 1131 - protein, 25 aa, synthetic construct
  source 1..25: note = Seed: LNVIVHSATGFKQSSKALQRPVASD
LNVIVHSATGFKQASDALARPVASD

SEQ ID NO: 1132 - protein, 25 aa, synthetic construct
  source 1..25: note = Seed: LNVIVHSATGFKQSSKALQRPVASD
LNVIVHSATGFKQASEALARPVASD

SEQ ID NO: 1133 - protein, 25 aa, synthetic construct
  source 1..25: note = Seed: LNVIVHSATGFKQSSKALQRPVASD
LNVIVHSATGFKQASEALNRPVASD

SEQ ID NO: 1134 - protein, 25 aa, synthetic construct
  source 1..25: note = Seed: LNVIVHSATGFKQSSKALQRPVASD
LNVIVHSATGFKQASEALSRPVASD

SEQ ID NO: 1135 - protein, 25 aa, synthetic construct
  source 1..25: note = Seed: LNVIVHSATGFKQSSKALQRPVASD
LNVIVHSATGFKQASEALVRPVASD

SEQ ID NO: 1136 - protein, 25 aa, synthetic construct
  source 1..25: note = Seed: LNVIVHSATGFKQSSKALQRPVASD
LNVIVHSATGFKQASFALARPVASD

SEQ ID NO: 1137 - protein, 25 aa, synthetic construct
  source 1..25: note = Seed: LNVIVHSATGFKQSSKALQRPVASD
LNVIVHSATGFKQASFALDRPVASD

SEQ ID NO: 1138 - protein, 25 aa, synthetic construct
  source 1..25: note = Seed: LNVIVHSATGFKQSSKALQRPVASD
LNVIVHSATGFKQASFALERPVASD

SEQ ID NO: 1139 - protein, 25 aa, synthetic construct
  source 1..25: note = Seed: LNVIVHSATGFKQSSKALQRPVASD
LNVIVHSATGFKQASFALFRPVASD

SEQ ID NO: 1140 - protein, 25 aa, synthetic construct
  source 1..25: note = Seed: LNVIVHSATGFKQSSKALQRPVASD
LNVIVHSATGFKQASFALIRPVASD

SEQ ID NO: 1141 - protein, 25 aa, synthetic construct
  source 1..25: note = Seed: LNVIVHSATGFKQSSKALQRPVASD
LNVIVHSATGFKQASFALLRPVASD

SEQ ID NO: 1142 - protein, 25 aa, synthetic construct
  source 1..25: note = Seed: LNVIVHSATGFKQSSKALQRPVASD
LNVIVHSATGFKQASFALMRPVASD

SEQ ID NO: 1143 - protein, 25 aa, synthetic construct
  source 1..25: note = Seed: LNVIVHSATGFKQSSKALQRPVASD
LNVIVHSATGFKQASFALNRPVASD

SEQ ID NO: 1144 - protein, 25 aa, synthetic construct
  source 1..25: note = Seed: LNVIVHSATGFKQSSKALQRPVASD
LNVIVHSATGFKQASFALVRPVASD

SEQ ID NO: 1145 - protein, 25 aa, synthetic construct
  source 1..25: note = Seed: LNVIVHSATGFKQSSKALQRPVASD
LNVIVHSATGFKQASGALARPVASD

SEQ ID NO: 1146 - protein, 25 aa, synthetic construct
  source 1..25: note = Seed: LNVIVHSATGFKQSSKALQRPVASD
LNVIVHSATGFKQASGALCRPVASD

SEQ ID NO: 1147 - protein, 25 aa, synthetic construct
  source 1..25: note = Seed: LNVIVHSATGFKQSSKALQRPVASD
LNVIVHSATGFKQASGALDRPVASD

SEQ ID NO: 1148 - protein, 25 aa, synthetic construct
  source 1..25: note = Seed: LNVIVHSATGFKQSSKALQRPVASD
LNVIVHSATGFKQASGALERPVASD

SEQ ID NO: 1149 - protein, 25 aa, synthetic construct
  source 1..25: note = Seed: LNVIVHSATGFKQSSKALQRPVASD
LNVIVHSATGFKQASGALFRPVASD

SEQ ID NO: 1150 - protein, 25 aa, synthetic construct
  source 1..25: note = Seed: LNVIVHSATGFKQSSKALQRPVASD
LNVIVHSATGFKQASGALGRPVASD

SEQ ID NO: 1151 - protein, 25 aa, synthetic construct
  source 1..25: note = Seed: LNVIVHSATGFKQSSKALQRPVASD
LNVIVHSATGFKQASGALHRPVASD

SEQ ID NO: 1152 - protein, 25 aa, synthetic construct
  source 1..25: note = Seed: LNVIVHSATGFKQSSKALQRPVASD
LNVIVHSATGFKQASGALIRPVASD

SEQ ID NO: 1153 - protein, 25 aa, synthetic construct
  source 1..25: note = Seed: LNVIVHSATGFKQSSKALQRPVASD
LNVIVHSATGFKQASGALLRPVASD

SEQ ID NO: 1154 - protein, 25 aa, synthetic construct
  source 1..25: note = Seed: LNVIVHSATGFKQSSKALQRPVASD
LNVIVHSATGFKQASGALMRPVASD

SEQ ID NO: 1155 - protein, 25 aa, synthetic construct
  source 1..25: note = Seed: LNVIVHSATGFKQSSKALQRPVASD
LNVIVHSATGFKQASGALNRPVASD

SEQ ID NO: 1156 - protein, 25 aa, synthetic construct
  source 1..25: note = Seed: LNVIVHSATGFKQSSKALQRPVASD
LNVIVHSATGFKQASGALPRPVASD

SEQ ID NO: 1157 - protein, 25 aa, synthetic construct
  source 1..25: note = Seed: LNVIVHSATGFKQSSKALQRPVASD
LNVIVHSATGFKQASGALQRPVASD

SEQ ID NO: 1158 - protein, 25 aa, synthetic construct
  source 1..25: note = Seed: LNVIVHSATGFKQSSKALQRPVASD
LNVIVHSATGFKQASGALSRPVASD

SEQ ID NO: 1159 - protein, 25 aa, synthetic construct
  source 1..25: note = Seed: LNVIVHSATGFKQSSKALQRPVASD
LNVIVHSATGFKQASGALTRPVASD

SEQ ID NO: 1160 - protein, 25 aa, synthetic construct
  source 1..25: note = Seed: LNVIVHSATGFKQSSKALQRPVASD
LNVIVHSATGFKQASGALVRPVASD

SEQ ID NO: 1161 - protein, 25 aa, synthetic construct
  source 1..25: note = Seed: LNVIVHSATGFKQSSKALQRPVASD
LNVIVHSATGFKQASGALYRPVASD

SEQ ID NO: 1162 - protein, 25 aa, synthetic construct
  source 1..25: note = Seed: LNVIVHSATGFKQSSKALQRPVASD
LNVIVHSATGFKQASHALARPVASD

SEQ ID NO: 1163 - protein, 25 aa, synthetic construct
  source 1..25: note = Seed: LNVIVHSATGFKQSSKALQRPVASD
LNVIVHSATGFKQASHALIRPVASD

SEQ ID NO: 1164 - protein, 25 aa, synthetic construct
  source 1..25: note = Seed: LNVIVHSATGFKQSSKALQRPVASD
LNVIVHSATGFKQASHALLRPVASD

SEQ ID NO: 1165 - protein, 25 aa, synthetic construct
  source 1..25: note = Seed: LNVIVHSATGFKQSSKALQRPVASD
LNVIVHSATGFKQASHALNRPVASD

SEQ ID NO: 1166 - protein, 25 aa, synthetic construct
  source 1..25: note = Seed: LNVIVHSATGFKQSSKALQRPVASD
LNVIVHSATGFKQASHALSRPVASD

SEQ ID NO: 1167 - protein, 25 aa, synthetic construct
  source 1..25: note = Seed: LNVIVHSATGFKQSSKALQRPVASD
LNVIVHSATGFKQASHALVRPVASD

SEQ ID NO: 1168 - protein, 25 aa, synthetic construct
  source 1..25: note = Seed: LNVIVHSATGFKQSSKALQRPVASD
LNVIVHSATGFKQASIALARPVASD

SEQ ID NO: 1169 - protein, 25 aa, synthetic construct
  source 1..25: note = Seed: LNVIVHSATGFKQSSKALQRPVASD
LNVIVHSATGFKQASIALCRPVASD

SEQ ID NO: 1170 - protein, 25 aa, synthetic construct
  source 1..25: note = Seed: LNVIVHSATGFKQSSKALQRPVASD
LNVIVHSATGFKQASIALDRPVASD

SEQ ID NO: 1171 - protein, 25 aa, synthetic construct
  source 1..25: note = Seed: LNVIVHSATGFKQSSKALQRPVASD
LNVIVHSATGFKQASIALERPVASD

SEQ ID NO: 1172 - protein, 25 aa, synthetic construct
  source 1..25: note = Seed: LNVIVHSATGFKQSSKALQRPVASD
LNVIVHSATGFKQASIALFRPVASD

SEQ ID NO: 1173 - protein, 25 aa, synthetic construct
  source 1..25: note = Seed: LNVIVHSATGFKQSSKALQRPVASD
LNVIVHSATGFKQASIALGRPVASD

SEQ ID NO: 1174 - protein, 25 aa, synthetic construct
  source 1..25: note = Seed: LNVIVHSATGFKQSSKALQRPVASD
LNVIVHSATGFKQASIALHRPVASD

SEQ ID NO: 1175 - protein, 25 aa, synthetic construct
  source 1..25: note = Seed: LNVIVHSATGFKQSSKALQRPVASD
LNVIVHSATGFKQASIALIRPVASD

SEQ ID NO: 1176 - protein, 25 aa, synthetic construct
  source 1..25: note = Seed: LNVIVHSATGFKQSSKALQRPVASD
LNVIVHSATGFKQASIALKRPVASD

SEQ ID NO: 1177 - protein, 25 aa, synthetic construct
  source 1..25: note = Seed: LNVIVHSATGFKQSSKALQRPVASD
LNVIVHSATGFKQASIALLRPVASD

SEQ ID NO: 1178 - protein, 25 aa, synthetic construct
  source 1..25: note = Seed: LNVIVHSATGFKQSSKALQRPVASD
LNVIVHSATGFKQASIALMRPVASD

SEQ ID NO: 1179 - protein, 25 aa, synthetic construct
  source 1..25: note = Seed: LNVIVHSATGFKQSSKALQRPVASD
LNVIVHSATGFKQASIALNRPVASD

SEQ ID NO: 1180 - protein, 25 aa, synthetic construct
  source 1..25: note = Seed: LNVIVHSATGFKQSSKALQRPVASD
LNVIVHSATGFKQASIALPRPVASD

SEQ ID NO: 1181 - protein, 25 aa, synthetic construct
  source 1..25: note = Seed: LNVIVHSATGFKQSSKALQRPVASD
LNVIVHSATGFKQASIALQRPVASD

SEQ ID NO: 1182 - protein, 25 aa, synthetic construct
  source 1..25: note = Seed: LNVIVHSATGFKQSSKALQRPVASD
LNVIVHSATGFKQASIALSRPVASD

SEQ ID NO: 1183 - protein, 25 aa, synthetic construct
  source 1..25: note = Seed: LNVIVHSATGFKQSSKALQRPVASD
LNVIVHSATGFKQASIALTRPVASD

SEQ ID NO: 1184 - protein, 25 aa, synthetic construct
  source 1..25: note = Seed: LNVIVHSATGFKQSSKALQRPVASD
LNVIVHSATGFKQASIALVRPVASD

SEQ ID NO: 1185 - protein, 25 aa, synthetic construct
  source 1..25: note = Seed: LNVIVHSATGFKQSSKALQRPVASD
LNVIVHSATGFKQASIALYRPVASD

SEQ ID NO: 1186 - protein, 25 aa, synthetic construct
  source 1..25: note = Seed: LNVIVHSATGFKQSSKALQRPVASD
LNVIVHSATGFKQASKALARPVASD

SEQ ID NO: 1187 - protein, 25 aa, synthetic construct
  source 1..25: note = Seed: LNVIVHSATGFKQSSKALQRPVASD
LNVIVHSATGFKQASKALGRPVASD

SEQ ID NO: 1188 - protein, 25 aa, synthetic construct
  source 1..25: note = Seed: LNVIVHSATGFKQSSKALQRPVASD
LNVIVHSATGFKQASKALHRPVASD

SEQ ID NO: 1189 - protein, 25 aa, synthetic construct
  source 1..25: note = Seed: LNVIVHSATGFKQSSKALQRPVASD
LNVIVHSATGFKQASKALIRPVASD

SEQ ID NO: 1190 - protein, 25 aa, synthetic construct
  source 1..25: note = Seed: LNVIVHSATGFKQSSKALQRPVASD
LNVIVHSATGFKQASKALKRPVASD

SEQ ID NO: 1191 - protein, 25 aa, synthetic construct
  source 1..25: note = Seed: LNVIVHSATGFKQSSKALQRPVASD
LNVIVHSATGFKQASKALLRPVASD

SEQ ID NO: 1192 - protein, 25 aa, synthetic construct
  source 1..25: note = Seed: LNVIVHSATGFKQSSKALQRPVASD
LNVIVHSATGFKQASKALMRPVASD

SEQ ID NO: 1193 - protein, 25 aa, synthetic construct
  source 1..25: note = Seed: LNVIVHSATGFKQSSKALQRPVASD
LNVIVHSATGFKQASKALNRPVASD

SEQ ID NO: 1194 - protein, 25 aa, synthetic construct
  source 1..25: note = Seed: LNVIVHSATGFKQSSKALQRPVASD
LNVIVHSATGFKQASKALPRPVASD

SEQ ID NO: 1195 - protein, 25 aa, synthetic construct
  source 1..25: note = Seed: LNVIVHSATGFKQSSKALQRPVASD
LNVIVHSATGFKQASKALQRPVASD

SEQ ID NO: 1196 - protein, 25 aa, synthetic construct
  source 1..25: note = Seed: LNVIVHSATGFKQSSKALQRPVASD
LNVIVHSATGFKQASKALRRPVASD

SEQ ID NO: 1197 - protein, 25 aa, synthetic construct
  source 1..25: note = Seed: LNVIVHSATGFKQSSKALQRPVASD
LNVIVHSATGFKQASKALSRPVASD

SEQ ID NO: 1198 - protein, 25 aa, synthetic construct
  source 1..25: note = Seed: LNVIVHSATGFKQSSKALQRPVASD
LNVIVHSATGFKQASKALTRPVASD

SEQ ID NO: 1199 - protein, 25 aa, synthetic construct
  source 1..25: note = Seed: LNVIVHSATGFKQSSKALQRPVASD
LNVIVHSATGFKQASKALVRPVASD

SEQ ID NO: 1200 - protein, 25 aa, synthetic construct
  source 1..25: note = Seed: LNVIVHSATGFKQSSKALQRPVASD
LNVIVHSATGFKQASKALYRPVASD

SEQ ID NO: 1201 - protein, 25 aa, synthetic construct
  source 1..25: note = Seed: LNVIVHSATGFKQSSKALQRPVASD
LNVIVHSATGFKQASLALARPVASD

SEQ ID NO: 1202 - protein, 25 aa, synthetic construct
  source 1..25: note = Seed: LNVIVHSATGFKQSSKALQRPVASD
LNVIVHSATGFKQASLALDRPVASD

SEQ ID NO: 1203 - protein, 25 aa, synthetic construct
  source 1..25: note = Seed: LNVIVHSATGFKQSSKALQRPVASD
LNVIVHSATGFKQASLALERPVASD

SEQ ID NO: 1204 - protein, 25 aa, synthetic construct
  source 1..25: note = Seed: LNVIVHSATGFKQSSKALQRPVASD
LNVIVHSATGFKQASLALGRPVASD

SEQ ID NO: 1205 - protein, 25 aa, synthetic construct
  source 1..25: note = Seed: LNVIVHSATGFKQSSKALQRPVASD
LNVIVHSATGFKQASLALHRPVASD

SEQ ID NO: 1206 - protein, 25 aa, synthetic construct
  source 1..25: note = Seed: LNVIVHSATGFKQSSKALQRPVASD
LNVIVHSATGFKQASLALIRPVASD

SEQ ID NO: 1207 - protein, 25 aa, synthetic construct
  source 1..25: note = Seed: LNVIVHSATGFKQSSKALQRPVASD
LNVIVHSATGFKQASLALLRPVASD

SEQ ID NO: 1208 - protein, 25 aa, synthetic construct
  source 1..25: note = Seed: LNVIVHSATGFKQSSKALQRPVASD
LNVIVHSATGFKQASLALMRPVASD

SEQ ID NO: 1209 - protein, 25 aa, synthetic construct
  source 1..25: note = Seed: LNVIVHSATGFKQSSKALQRPVASD
LNVIVHSATGFKQASLALNRPVASD

SEQ ID NO: 1210 - protein, 25 aa, synthetic construct
  source 1..25: note = Seed: LNVIVHSATGFKQSSKALQRPVASD
LNVIVHSATGFKQASLALQRPVASD

SEQ ID NO: 1211 - protein, 25 aa, synthetic construct
  source 1..25: note = Seed: LNVIVHSATGFKQSSKALQRPVASD
LNVIVHSATGFKQASLALSRPVASD

SEQ ID NO: 1212 - protein, 25 aa, synthetic construct
  source 1..25: note = Seed: LNVIVHSATGFKQSSKALQRPVASD
LNVIVHSATGFKQASLALTRPVASD

SEQ ID NO: 1213 - protein, 25 aa, synthetic construct
  source 1..25: note = Seed: LNVIVHSATGFKQSSKALQRPVASD
LNVIVHSATGFKQASLALVRPVASD

SEQ ID NO: 1214 - protein, 25 aa, synthetic construct
  source 1..25: note = Seed: LNVIVHSATGFKQSSKALQRPVASD
LNVIVHSATGFKQASMALARPVASD

SEQ ID NO: 1215 - protein, 25 aa, synthetic construct
  source 1..25: note = Seed: LNVIVHSATGFKQSSKALQRPVASD
LNVIVHSATGFKQASMALGRPVASD

SEQ ID NO: 1216 - protein, 25 aa, synthetic construct
  source 1..25: note = Seed: LNVIVHSATGFKQSSKALQRPVASD
LNVIVHSATGFKQASMALHRPVASD

SEQ ID NO: 1217 - protein, 25 aa, synthetic construct
  source 1..25: note = Seed: LNVIVHSATGFKQSSKALQRPVASD
LNVIVHSATGFKQASMALIRPVASD

SEQ ID NO: 1218 - protein, 25 aa, synthetic construct
  source 1..25: note = Seed: LNVIVHSATGFKQSSKALQRPVASD
LNVIVHSATGFKQASMALLRPVASD

SEQ ID NO: 1219 - protein, 25 aa, synthetic construct
  source 1..25: note = Seed: LNVIVHSATGFKQSSKALQRPVASD
LNVIVHSATGFKQASMALMRPVASD

SEQ ID NO: 1220 - protein, 25 aa, synthetic construct
  source 1..25: note = Seed: LNVIVHSATGFKQSSKALQRPVASD
LNVIVHSATGFKQASMALNRPVASD

SEQ ID NO: 1221 - protein, 25 aa, synthetic construct
  source 1..25: note = Seed: LNVIVHSATGFKQSSKALQRPVASD
LNVIVHSATGFKQASMALQRPVASD

SEQ ID NO: 1222 - protein, 25 aa, synthetic construct
  source 1..25: note = Seed: LNVIVHSATGFKQSSKALQRPVASD
LNVIVHSATGFKQASMALSRPVASD

SEQ ID NO: 1223 - protein, 25 aa, synthetic construct
  source 1..25: note = Seed: LNVIVHSATGFKQSSKALQRPVASD
LNVIVHSATGFKQASMALTRPVASD

SEQ ID NO: 1224 - protein, 25 aa, synthetic construct
  source 1..25: note = Seed: LNVIVHSATGFKQSSKALQRPVASD
LNVIVHSATGFKQASMALVRPVASD

SEQ ID NO: 1225 - protein, 25 aa, synthetic construct
  source 1..25: note = Seed: LNVIVHSATGFKQSSKALQRPVASD
LNVIVHSATGFKQASNALARPVASD

SEQ ID NO: 1226 - protein, 25 aa, synthetic construct
  source 1..25: note = Seed: LNVIVHSATGFKQSSKALQRPVASD
LNVIVHSATGFKQASNALCRPVASD

SEQ ID NO: 1227 - protein, 25 aa, synthetic construct
  source 1..25: note = Seed: LNVIVHSATGFKQSSKALQRPVASD
LNVIVHSATGFKQASNALDRPVASD

SEQ ID NO: 1228 - protein, 25 aa, synthetic construct
  source 1..25: note = Seed: LNVIVHSATGFKQSSKALQRPVASD
LNVIVHSATGFKQASNALERPVASD

SEQ ID NO: 1229 - protein, 25 aa, synthetic construct
  source 1..25: note = Seed: LNVIVHSATGFKQSSKALQRPVASD
LNVIVHSATGFKQASNALFRPVASD

SEQ ID NO: 1230 - protein, 25 aa, synthetic construct
  source 1..25: note = Seed: LNVIVHSATGFKQSSKALQRPVASD
LNVIVHSATGFKQASNALGRPVASD

SEQ ID NO: 1231 - protein, 25 aa, synthetic construct
  source 1..25: note = Seed: LNVIVHSATGFKQSSKALQRPVASD
LNVIVHSATGFKQASNALHRPVASD

SEQ ID NO: 1232 - protein, 25 aa, synthetic construct
  source 1..25: note = Seed: LNVIVHSATGFKQSSKALQRPVASD
LNVIVHSATGFKQASNALIRPVASD

SEQ ID NO: 1233 - protein, 25 aa, synthetic construct
  source 1..25: note = Seed: LNVIVHSATGFKQSSKALQRPVASD
LNVIVHSATGFKQASNALLRPVASD

SEQ ID NO: 1234 - protein, 25 aa, synthetic construct
  source 1..25: note = Seed: LNVIVHSATGFKQSSKALQRPVASD
LNVIVHSATGFKQASNALMRPVASD

SEQ ID NO: 1235 - protein, 25 aa, synthetic construct
  source 1..25: note = Seed: LNVIVHSATGFKQSSKALQRPVASD
LNVIVHSATGFKQASNALNRPVASD

SEQ ID NO: 1236 - protein, 25 aa, synthetic construct
  source 1..25: note = Seed: LNVIVHSATGFKQSSKALQRPVASD
LNVIVHSATGFKQASNALPRPVASD

SEQ ID NO: 1237 - protein, 25 aa, synthetic construct
  source 1..25: note = Seed: LNVIVHSATGFKQSSKALQRPVASD
LNVIVHSATGFKQASNALQRPVASD

SEQ ID NO: 1238 - protein, 25 aa, synthetic construct
  source 1..25: note = Seed: LNVIVHSATGFKQSSKALQRPVASD
LNVIVHSATGFKQASNALSRPVASD

SEQ ID NO: 1239 - protein, 25 aa, synthetic construct
  source 1..25: note = Seed: LNVIVHSATGFKQSSKALQRPVASD
LNVIVHSATGFKQASNALTRPVASD

SEQ ID NO: 1240 - protein, 25 aa, synthetic construct
  source 1..25: note = Seed: LNVIVHSATGFKQSSKALQRPVASD
LNVIVHSATGFKQASNALVRPVASD

SEQ ID NO: 1241 - protein, 25 aa, synthetic construct
  source 1..25: note = Seed: LNVIVHSATGFKQSSKALQRPVASD
LNVIVHSATGFKQASPALARPVASD

SEQ ID NO: 1242 - protein, 25 aa, synthetic construct
  source 1..25: note = Seed: LNVIVHSATGFKQSSKALQRPVASD
LNVIVHSATGFKQASPALCRPVASD

SEQ ID NO: 1243 - protein, 25 aa, synthetic construct
  source 1..25: note = Seed: LNVIVHSATGFKQSSKALQRPVASD
LNVIVHSATGFKQASPALDRPVASD

SEQ ID NO: 1244 - protein, 25 aa, synthetic construct
  source 1..25: note = Seed: LNVIVHSATGFKQSSKALQRPVASD
LNVIVHSATGFKQASPALERPVASD

SEQ ID NO: 1245 - protein, 25 aa, synthetic construct
  source 1..25: note = Seed: LNVIVHSATGFKQSSKALQRPVASD
LNVIVHSATGFKQASPALFRPVASD

SEQ ID NO: 1246 - protein, 25 aa, synthetic construct
  source 1..25: note = Seed: LNVIVHSATGFKQSSKALQRPVASD
LNVIVHSATGFKQASPALGRPVASD

SEQ ID NO: 1247 - protein, 25 aa, synthetic construct
  source 1..25: note = Seed: LNVIVHSATGFKQSSKALQRPVASD
LNVIVHSATGFKQASPALHRPVASD

SEQ ID NO: 1248 - protein, 25 aa, synthetic construct
  source 1..25: note = Seed: LNVIVHSATGFKQSSKALQRPVASD
LNVIVHSATGFKQASPALIRPVASD

SEQ ID NO: 1249 - protein, 25 aa, synthetic construct
  source 1..25: note = Seed: LNVIVHSATGFKQSSKALQRPVASD
LNVIVHSATGFKQASPALKRPVASD

SEQ ID NO: 1250 - protein, 25 aa, synthetic construct
  source 1..25: note = Seed: LNVIVHSATGFKQSSKALQRPVASD
LNVIVHSATGFKQASPALLRPVASD

SEQ ID NO: 1251 - protein, 25 aa, synthetic construct
  source 1..25: note = Seed: LNVIVHSATGFKQSSKALQRPVASD
LNVIVHSATGFKQASPALMRPVASD

SEQ ID NO: 1252 - protein, 25 aa, synthetic construct
  source 1..25: note = Seed: LNVIVHSATGFKQSSKALQRPVASD
LNVIVHSATGFKQASPALNRPVASD

SEQ ID NO: 1253 - protein, 25 aa, synthetic construct
  source 1..25: note = Seed: LNVIVHSATGFKQSSKALQRPVASD
LNVIVHSATGFKQASPALPRPVASD

SEQ ID NO: 1254 - protein, 25 aa, synthetic construct
  source 1..25: note = Seed: LNVIVHSATGFKQSSKALQRPVASD
LNVIVHSATGFKQASPALQRPVASD

SEQ ID NO: 1255 - protein, 25 aa, synthetic construct
  source 1..25: note = Seed: LNVIVHSATGFKQSSKALQRPVASD
LNVIVHSATGFKQASPALRRPVASD

SEQ ID NO: 1256 - protein, 25 aa, synthetic construct
  source 1..25: note = Seed: LNVIVHSATGFKQSSKALQRPVASD
LNVIVHSATGFKQASPALSRPVASD

SEQ ID NO: 1257 - protein, 25 aa, synthetic construct
  source 1..25: note = Seed: LNVIVHSATGFKQSSKALQRPVASD
LNVIVHSATGFKQASPALTRPVASD

SEQ ID NO: 1258 - protein, 25 aa, synthetic construct
  source 1..25: note = Seed: LNVIVHSATGFKQSSKALQRPVASD
LNVIVHSATGFKQASPALVRPVASD

SEQ ID NO: 1259 - protein, 25 aa, synthetic construct
  source 1..25: note = Seed: LNVIVHSATGFKQSSKALQRPVASD
LNVIVHSATGFKQASPALWRPVASD

SEQ ID NO: 1260 - protein, 25 aa, synthetic construct
  source 1..25: note = Seed: LNVIVHSATGFKQSSKALQRPVASD
LNVIVHSATGFKQASPALYRPVASD

SEQ ID NO: 1261 - protein, 25 aa, synthetic construct
  source 1..25: note = Seed: LNVIVHSATGFKQSSKALQRPVASD
LNVIVHSATGFKQASQALARPVASD

SEQ ID NO: 1262 - protein, 25 aa, synthetic construct
  source 1..25: note = Seed: LNVIVHSATGFKQSSKALQRPVASD
LNVIVHSATGFKQASQALIRPVASD

SEQ ID NO: 1263 - protein, 25 aa, synthetic construct
  source 1..25: note = Seed: LNVIVHSATGFKQSSKALQRPVASD
LNVIVHSATGFKQASQALLRPVASD

SEQ ID NO: 1264 - protein, 25 aa, synthetic construct
  source 1..25: note = Seed: LNVIVHSATGFKQSSKALQRPVASD
LNVIVHSATGFKQASQALNRPVASD

SEQ ID NO: 1265 - protein, 25 aa, synthetic construct
  source 1..25: note = Seed: LNVIVHSATGFKQSSKALQRPVASD
LNVIVHSATGFKQASQALSRPVASD

SEQ ID NO: 1266 - protein, 25 aa, synthetic construct
  source 1..25: note = Seed: LNVIVHSATGFKQSSKALQRPVASD
LNVIVHSATGFKQASQALVRPVASD

SEQ ID NO: 1267 - protein, 25 aa, synthetic construct
  source 1..25: note = Seed: LNVIVHSATGFKQSSKALQRPVASD
LNVIVHSATGFKQASRALARPVASD

SEQ ID NO: 1268 - protein, 25 aa, synthetic construct
  source 1..25: note = Seed: LNVIVHSATGFKQSSKALQRPVASD
LNVIVHSATGFKQASRALGRPVASD

SEQ ID NO: 1269 - protein, 25 aa, synthetic construct
  source 1..25: note = Seed: LNVIVHSATGFKQSSKALQRPVASD
LNVIVHSATGFKQASRALHRPVASD

SEQ ID NO: 1270 - protein, 25 aa, synthetic construct
  source 1..25: note = Seed: LNVIVHSATGFKQSSKALQRPVASD
LNVIVHSATGFKQASRALIRPVASD

SEQ ID NO: 1271 - protein, 25 aa, synthetic construct
  source 1..25: note = Seed: LNVIVHSATGFKQSSKALQRPVASD
LNVIVHSATGFKQASRALKRPVASD

SEQ ID NO: 1272 - protein, 25 aa, synthetic construct
  source 1..25: note = Seed: LNVIVHSATGFKQSSKALQRPVASD
LNVIVHSATGFKQASRALLRPVASD

SEQ ID NO: 1273 - protein, 25 aa, synthetic construct
  source 1..25: note = Seed: LNVIVHSATGFKQSSKALQRPVASD
LNVIVHSATGFKQASRALMRPVASD

SEQ ID NO: 1274 - protein, 25 aa, synthetic construct
  source 1..25: note = Seed: LNVIVHSATGFKQSSKALQRPVASD
LNVIVHSATGFKQASRALNRPVASD

SEQ ID NO: 1275 - protein, 25 aa, synthetic construct
  source 1..25: note = Seed: LNVIVHSATGFKQSSKALQRPVASD
LNVIVHSATGFKQASRALPRPVASD

SEQ ID NO: 1276 - protein, 25 aa, synthetic construct
  source 1..25: note = Seed: LNVIVHSATGFKQSSKALQRPVASD
LNVIVHSATGFKQASRALQRPVASD

SEQ ID NO: 1277 - protein, 25 aa, synthetic construct
  source 1..25: note = Seed: LNVIVHSATGFKQSSKALQRPVASD
LNVIVHSATGFKQASRALRRPVASD

SEQ ID NO: 1278 - protein, 25 aa, synthetic construct
  source 1..25: note = Seed: LNVIVHSATGFKQSSKALQRPVASD
LNVIVHSATGFKQASRALSRPVASD

SEQ ID NO: 1279 - protein, 25 aa, synthetic construct
  source 1..25: note = Seed: LNVIVHSATGFKQSSKALQRPVASD
LNVIVHSATGFKQASRALTRPVASD

SEQ ID NO: 1280 - protein, 25 aa, synthetic construct
  source 1..25: note = Seed: LNVIVHSATGFKQSSKALQRPVASD
LNVIVHSATGFKQASRALVRPVASD

SEQ ID NO: 1281 - protein, 25 aa, synthetic construct
  source 1..25: note = Seed: LNVIVHSATGFKQSSKALQRPVASD
LNVIVHSATGFKQASRALYRPVASD

SEQ ID NO: 1282 - protein, 25 aa, synthetic construct
  source 1..25: note = Seed: LNVIVHSATGFKQSSKALQRPVASD
LNVIVHSATGFKQASSALARPVASD

SEQ ID NO: 1283 - protein, 25 aa, synthetic construct
  source 1..25: note = Seed: LNVIVHSATGFKQSSKALQRPVASD
LNVIVHSATGFKQASSALCRPVASD

SEQ ID NO: 1284 - protein, 25 aa, synthetic construct
  source 1..25: note = Seed: LNVIVHSATGFKQSSKALQRPVASD
LNVIVHSATGFKQASSALDRPVASD

SEQ ID NO: 1285 - protein, 25 aa, synthetic construct
  source 1..25: note = Seed: LNVIVHSATGFKQSSKALQRPVASD
LNVIVHSATGFKQASSALERPVASD

SEQ ID NO: 1286 - protein, 25 aa, synthetic construct
  source 1..25: note = Seed: LNVIVHSATGFKQSSKALQRPVASD
LNVIVHSATGFKQASSALFRPVASD

SEQ ID NO: 1287 - protein, 25 aa, synthetic construct
  source 1..25: note = Seed: LNVIVHSATGFKQSSKALQRPVASD
LNVIVHSATGFKQASSALGRPVASD

SEQ ID NO: 1288 - protein, 25 aa, synthetic construct
  source 1..25: note = Seed: LNVIVHSATGFKQSSKALQRPVASD
LNVIVHSATGFKQASSALHRPVASD

SEQ ID NO: 1289 - protein, 25 aa, synthetic construct
  source 1..25: note = Seed: LNVIVHSATGFKQSSKALQRPVASD
LNVIVHSATGFKQASSALIRPVASD

SEQ ID NO: 1290 - protein, 25 aa, synthetic construct
  source 1..25: note = Seed: LNVIVHSATGFKQSSKALQRPVASD
LNVIVHSATGFKQASSALLRPVASD

SEQ ID NO: 1291 - protein, 25 aa, synthetic construct
  source 1..25: note = Seed: LNVIVHSATGFKQSSKALQRPVASD
LNVIVHSATGFKQASSALMRPVASD

SEQ ID NO: 1292 - protein, 25 aa, synthetic construct
  source 1..25: note = Seed: LNVIVHSATGFKQSSKALQRPVASD
LNVIVHSATGFKQASSALNRPVASD

SEQ ID NO: 1293 - protein, 25 aa, synthetic construct
  source 1..25: note = Seed: LNVIVHSATGFKQSSKALQRPVASD
LNVIVHSATGFKQASSALPRPVASD

SEQ ID NO: 1294 - protein, 25 aa, synthetic construct
  source 1..25: note = Seed: LNVIVHSATGFKQSSKALQRPVASD
LNVIVHSATGFKQASSALQRPVASD

SEQ ID NO: 1295 - protein, 25 aa, synthetic construct
  source 1..25: note = Seed: LNVIVHSATGFKQSSKALQRPVASD
LNVIVHSATGFKQASSALRRPVASD

SEQ ID NO: 1296 - protein, 25 aa, synthetic construct
  source 1..25: note = Seed: LNVIVHSATGFKQSSKALQRPVASD
LNVIVHSATGFKQASSALSRPVASD

SEQ ID NO: 1297 - protein, 25 aa, synthetic construct
  source 1..25: note = Seed: LNVIVHSATGFKQSSKALQRPVASD
LNVIVHSATGFKQASSALTRPVASD

SEQ ID NO: 1298 - protein, 25 aa, synthetic construct
  source 1..25: note = Seed: LNVIVHSATGFKQSSKALQRPVASD
LNVIVHSATGFKQASSALVRPVASD

SEQ ID NO: 1299 - protein, 25 aa, synthetic construct
  source 1..25: note = Seed: LNVIVHSATGFKQSSKALQRPVASD
LNVIVHSATGFKQASSALWRPVASD

SEQ ID NO: 1300 - protein, 25 aa, synthetic construct
  source 1..25: note = Seed: LNVIVHSATGFKQSSKALQRPVASD
LNVIVHSATGFKQASSALYRPVASD

SEQ ID NO: 1301 - protein, 25 aa, synthetic construct
  source 1..25: note = Seed: LNVIVHSATGFKQSSKALQRPVASD
LNVIVHSATGFKQASTALARPVASD

SEQ ID NO: 1302 - protein, 25 aa, synthetic construct
  source 1..25: note = Seed: LNVIVHSATGFKQSSKALQRPVASD
LNVIVHSATGFKQASTALCRPVASD

SEQ ID NO: 1303 - protein, 25 aa, synthetic construct
  source 1..25: note = Seed: LNVIVHSATGFKQSSKALQRPVASD
LNVIVHSATGFKQASTALDRPVASD

SEQ ID NO: 1304 - protein, 25 aa, synthetic construct
  source 1..25: note = Seed: LNVIVHSATGFKQSSKALQRPVASD
LNVIVHSATGFKQASTALERPVASD

SEQ ID NO: 1305 - protein, 25 aa, synthetic construct
  source 1..25: note = Seed: LNVIVHSATGFKQSSKALQRPVASD
LNVIVHSATGFKQASTALFRPVASD

SEQ ID NO: 1306 - protein, 25 aa, synthetic construct
  source 1..25: note = Seed: LNVIVHSATGFKQSSKALQRPVASD
LNVIVHSATGFKQASTALGRPVASD

SEQ ID NO: 1307 - protein, 25 aa, synthetic construct
  source 1..25: note = Seed: LNVIVHSATGFKQSSKALQRPVASD
LNVIVHSATGFKQASTALHRPVASD

SEQ ID NO: 1308 - protein, 25 aa, synthetic construct
  source 1..25: note = Seed: LNVIVHSATGFKQSSKALQRPVASD
LNVIVHSATGFKQASTALIRPVASD

SEQ ID NO: 1309 - protein, 25 aa, synthetic construct
  source 1..25: note = Seed: LNVIVHSATGFKQSSKALQRPVASD
LNVIVHSATGFKQASTALLRPVASD

SEQ ID NO: 1310 - protein, 25 aa, synthetic construct
  source 1..25: note = Seed: LNVIVHSATGFKQSSKALQRPVASD
LNVIVHSATGFKQASTALMRPVASD

SEQ ID NO: 1311 - protein, 25 aa, synthetic construct
  source 1..25: note = Seed: LNVIVHSATGFKQSSKALQRPVASD
LNVIVHSATGFKQASTALNRPVASD

SEQ ID NO: 1312 - protein, 25 aa, synthetic construct
  source 1..25: note = Seed: LNVIVHSATGFKQSSKALQRPVASD
LNVIVHSATGFKQASTALPRPVASD

SEQ ID NO: 1313 - protein, 25 aa, synthetic construct
  source 1..25: note = Seed: LNVIVHSATGFKQSSKALQRPVASD
LNVIVHSATGFKQASTALQRPVASD

SEQ ID NO: 1314 - protein, 25 aa, synthetic construct
  source 1..25: note = Seed: LNVIVHSATGFKQSSKALQRPVASD
LNVIVHSATGFKQASTALSRPVASD

SEQ ID NO: 1315 - protein, 25 aa, synthetic construct
  source 1..25: note = Seed: LNVIVHSATGFKQSSKALQRPVASD
LNVIVHSATGFKQASTALTRPVASD

SEQ ID NO: 1316 - protein, 25 aa, synthetic construct
  source 1..25: note = Seed: LNVIVHSATGFKQSSKALQRPVASD
LNVIVHSATGFKQASTALVRPVASD

SEQ ID NO: 1317 - protein, 25 aa, synthetic construct
  source 1..25: note = Seed: LNVIVHSATGFKQSSKALQRPVASD
LNVIVHSATGFKQASTALYRPVASD

SEQ ID NO: 1318 - protein, 25 aa, synthetic construct
  source 1..25: note = Seed: LNVIVHSATGFKQSSKALQRPVASD
LNVIVHSATGFKQASVALARPVASD

SEQ ID NO: 1319 - protein, 25 aa, synthetic construct
  source 1..25: note = Seed: LNVIVHSATGFKQSSKALQRPVASD
LNVIVHSATGFKQASVALCRPVASD

SEQ ID NO: 1320 - protein, 25 aa, synthetic construct
  source 1..25: note = Seed: LNVIVHSATGFKQSSKALQRPVASD
LNVIVHSATGFKQASVALDRPVASD

SEQ ID NO: 1321 - protein, 25 aa, synthetic construct
  source 1..25: note = Seed: LNVIVHSATGFKQSSKALQRPVASD
LNVIVHSATGFKQASVALERPVASD

SEQ ID NO: 1322 - protein, 25 aa, synthetic construct
  source 1..25: note = Seed: LNVIVHSATGFKQSSKALQRPVASD
LNVIVHSATGFKQASVALFRPVASD

SEQ ID NO: 1323 - protein, 25 aa, synthetic construct
  source 1..25: note = Seed: LNVIVHSATGFKQSSKALQRPVASD
LNVIVHSATGFKQASVALGRPVASD

SEQ ID NO: 1324 - protein, 25 aa, synthetic construct
  source 1..25: note = Seed: LNVIVHSATGFKQSSKALQRPVASD
LNVIVHSATGFKQASVALHRPVASD

SEQ ID NO: 1325 - protein, 25 aa, synthetic construct
  source 1..25: note = Seed: LNVIVHSATGFKQSSKALQRPVASD
LNVIVHSATGFKQASVALIRPVASD

SEQ ID NO: 1326 - protein, 25 aa, synthetic construct
  source 1..25: note = Seed: LNVIVHSATGFKQSSKALQRPVASD
LNVIVHSATGFKQASVALKRPVASD

SEQ ID NO: 1327 - protein, 25 aa, synthetic construct
  source 1..25: note = Seed: LNVIVHSATGFKQSSKALQRPVASD
LNVIVHSATGFKQASVALLRPVASD

SEQ ID NO: 1328 - protein, 25 aa, synthetic construct
  source 1..25: note = Seed: LNVIVHSATGFKQSSKALQRPVASD
LNVIVHSATGFKQASVALMRPVASD

SEQ ID NO: 1329 - protein, 25 aa, synthetic construct
  source 1..25: note = Seed: LNVIVHSATGFKQSSKALQRPVASD
LNVIVHSATGFKQASVALNRPVASD

SEQ ID NO: 1330 - protein, 25 aa, synthetic construct
  source 1..25: note = Seed: LNVIVHSATGFKQSSKALQRPVASD
LNVIVHSATGFKQASVALPRPVASD

SEQ ID NO: 1331 - protein, 25 aa, synthetic construct
  source 1..25: note = Seed: LNVIVHSATGFKQSSKALQRPVASD
LNVIVHSATGFKQASVALQRPVASD

SEQ ID NO: 1332 - protein, 25 aa, synthetic construct
  source 1..25: note = Seed: LNVIVHSATGFKQSSKALQRPVASD
LNVIVHSATGFKQASVALRRPVASD

SEQ ID NO: 1333 - protein, 25 aa, synthetic construct
  source 1..25: note = Seed: LNVIVHSATGFKQSSKALQRPVASD
LNVIVHSATGFKQASVALSRPVASD

SEQ ID NO: 1334 - protein, 25 aa, synthetic construct
  source 1..25: note = Seed: LNVIVHSATGFKQSSKALQRPVASD
LNVIVHSATGFKQASVALTRPVASD

SEQ ID NO: 1335 - protein, 25 aa, synthetic construct
  source 1..25: note = Seed: LNVIVHSATGFKQSSKALQRPVASD
LNVIVHSATGFKQASVALVRPVASD

SEQ ID NO: 1336 - protein, 25 aa, synthetic construct
  source 1..25: note = Seed: LNVIVHSATGFKQSSKALQRPVASD
LNVIVHSATGFKQASVALYRPVASD

SEQ ID NO: 1337 - protein, 25 aa, synthetic construct
  source 1..25: note = Seed: LNVIVHSATGFKQSSKALQRPVASD
LNVIVHSATGFKQASWALSRPVASD

SEQ ID NO: 1338 - protein, 25 aa, synthetic construct
  source 1..25: note = Seed: LNVIVHSATGFKQSSKALQRPVASD
LNVIVHSATGFKQASWALVRPVASD

SEQ ID NO: 1339 - protein, 25 aa, synthetic construct
  source 1..25: note = Seed: LNVIVHSATGFKQSSKALQRPVASD
LNVIVHSATGFKQASYALFRPVASD

SEQ ID NO: 1340 - protein, 25 aa, synthetic construct
  source 1..25: note = Seed: LNVIVHSATGFKQSSKALQRPVASD
LNVIVHSATGFKQCSAALARPVASD

SEQ ID NO: 1341 - protein, 25 aa, synthetic construct
  source 1..25: note = Seed: LNVIVHSATGFKQSSKALQRPVASD
LNVIVHSATGFKQCSAALGRPVASD

SEQ ID NO: 1342 - protein, 25 aa, synthetic construct
  source 1..25: note = Seed: LNVIVHSATGFKQSSKALQRPVASD
LNVIVHSATGFKQCSAALIRPVASD

SEQ ID NO: 1343 - protein, 25 aa, synthetic construct
  source 1..25: note = Seed: LNVIVHSATGFKQSSKALQRPVASD
LNVIVHSATGFKQCSAALLRPVASD

SEQ ID NO: 1344 - protein, 25 aa, synthetic construct
  source 1..25: note = Seed: LNVIVHSATGFKQSSKALQRPVASD
LNVIVHSATGFKQCSAALMRPVASD

SEQ ID NO: 1345 - protein, 25 aa, synthetic construct
  source 1..25: note = Seed: LNVIVHSATGFKQSSKALQRPVASD
LNVIVHSATGFKQCSAALNRPVASD

SEQ ID NO: 1346 - protein, 25 aa, synthetic construct
  source 1..25: note = Seed: LNVIVHSATGFKQSSKALQRPVASD
LNVIVHSATGFKQCSAALSRPVASD

SEQ ID NO: 1347 - protein, 25 aa, synthetic construct
  source 1..25: note = Seed: LNVIVHSATGFKQSSKALQRPVASD
LNVIVHSATGFKQCSAALTRPVASD

SEQ ID NO: 1348 - protein, 25 aa, synthetic construct
  source 1..25: note = Seed: LNVIVHSATGFKQSSKALQRPVASD
LNVIVHSATGFKQCSAALVRPVASD

SEQ ID NO: 1349 - protein, 25 aa, synthetic construct
  source 1..25: note = Seed: LNVIVHSATGFKQSSKALQRPVASD
LNVIVHSATGFKQCSFALFRPVASD

SEQ ID NO: 1350 - protein, 25 aa, synthetic construct
  source 1..25: note = Seed: LNVIVHSATGFKQSSKALQRPVASD
LNVIVHSATGFKQCSGALARPVASD

SEQ ID NO: 1351 - protein, 25 aa, synthetic construct
  source 1..25: note = Seed: LNVIVHSATGFKQSSKALQRPVASD
LNVIVHSATGFKQCSGALIRPVASD

SEQ ID NO: 1352 - protein, 25 aa, synthetic construct
  source 1..25: note = Seed: LNVIVHSATGFKQSSKALQRPVASD
LNVIVHSATGFKQCSGALLRPVASD

SEQ ID NO: 1353 - protein, 25 aa, synthetic construct
  source 1..25: note = Seed: LNVIVHSATGFKQSSKALQRPVASD
LNVIVHSATGFKQCSGALMRPVASD

SEQ ID NO: 1354 - protein, 25 aa, synthetic construct
  source 1..25: note = Seed: LNVIVHSATGFKQSSKALQRPVASD
LNVIVHSATGFKQCSGALVRPVASD

SEQ ID NO: 1355 - protein, 25 aa, synthetic construct
  source 1..25: note = Seed: LNVIVHSATGFKQSSKALQRPVASD
LNVIVHSATGFKQCSIALARPVASD

SEQ ID NO: 1356 - protein, 25 aa, synthetic construct
  source 1..25: note = Seed: LNVIVHSATGFKQSSKALQRPVASD
LNVIVHSATGFKQCSIALIRPVASD

SEQ ID NO: 1357 - protein, 25 aa, synthetic construct
  source 1..25: note = Seed: LNVIVHSATGFKQSSKALQRPVASD
LNVIVHSATGFKQCSIALLRPVASD

SEQ ID NO: 1358 - protein, 25 aa, synthetic construct
  source 1..25: note = Seed: LNVIVHSATGFKQSSKALQRPVASD
LNVIVHSATGFKQCSIALMRPVASD

SEQ ID NO: 1359 - protein, 25 aa, synthetic construct
  source 1..25: note = Seed: LNVIVHSATGFKQSSKALQRPVASD
LNVIVHSATGFKQCSIALSRPVASD

SEQ ID NO: 1360 - protein, 25 aa, synthetic construct
  source 1..25: note = Seed: LNVIVHSATGFKQSSKALQRPVASD
LNVIVHSATGFKQCSKALARPVASD

SEQ ID NO: 1361 - protein, 25 aa, synthetic construct
  source 1..25: note = Seed: LNVIVHSATGFKQSSKALQRPVASD
LNVIVHSATGFKQCSKALGRPVASD

SEQ ID NO: 1362 - protein, 25 aa, synthetic construct
  source 1..25: note = Seed: LNVIVHSATGFKQSSKALQRPVASD
LNVIVHSATGFKQCSKALSRPVASD

SEQ ID NO: 1363 - protein, 25 aa, synthetic construct
  source 1..25: note = Seed: LNVIVHSATGFKQSSKALQRPVASD
LNVIVHSATGFKQCSLALARPVASD

SEQ ID NO: 1364 - protein, 25 aa, synthetic construct
  source 1..25: note = Seed: LNVIVHSATGFKQSSKALQRPVASD
LNVIVHSATGFKQCSLALSRPVASD

SEQ ID NO: 1365 - protein, 25 aa, synthetic construct
  source 1..25: note = Seed: LNVIVHSATGFKQSSKALQRPVASD
LNVIVHSATGFKQCSMALARPVASD

SEQ ID NO: 1366 - protein, 25 aa, synthetic construct
  source 1..25: note = Seed: LNVIVHSATGFKQSSKALQRPVASD
LNVIVHSATGFKQCSNALARPVASD

SEQ ID NO: 1367 - protein, 25 aa, synthetic construct
  source 1..25: note = Seed: LNVIVHSATGFKQSSKALQRPVASD
LNVIVHSATGFKQCSPALARPVASD

SEQ ID NO: 1368 - protein, 25 aa, synthetic construct
  source 1..25: note = Seed: LNVIVHSATGFKQSSKALQRPVASD
LNVIVHSATGFKQCSPALIRPVASD

SEQ ID NO: 1369 - protein, 25 aa, synthetic construct
  source 1..25: note = Seed: LNVIVHSATGFKQSSKALQRPVASD
LNVIVHSATGFKQCSPALLRPVASD

SEQ ID NO: 1370 - protein, 25 aa, synthetic construct
  source 1..25: note = Seed: LNVIVHSATGFKQSSKALQRPVASD
LNVIVHSATGFKQCSPALNRPVASD

SEQ ID NO: 1371 - protein, 25 aa, synthetic construct
  source 1..25: note = Seed: LNVIVHSATGFKQSSKALQRPVASD
LNVIVHSATGFKQCSPALSRPVASD

SEQ ID NO: 1372 - protein, 25 aa, synthetic construct
  source 1..25: note = Seed: LNVIVHSATGFKQSSKALQRPVASD
LNVIVHSATGFKQCSPALVRPVASD

SEQ ID NO: 1373 - protein, 25 aa, synthetic construct
  source 1..25: note = Seed: LNVIVHSATGFKQSSKALQRPVASD
LNVIVHSATGFKQCSRALARPVASD

SEQ ID NO: 1374 - protein, 25 aa, synthetic construct
  source 1..25: note = Seed: LNVIVHSATGFKQSSKALQRPVASD
LNVIVHSATGFKQCSRALGRPVASD

SEQ ID NO: 1375 - protein, 25 aa, synthetic construct
  source 1..25: note = Seed: LNVIVHSATGFKQSSKALQRPVASD
LNVIVHSATGFKQCSRALQRPVASD

SEQ ID NO: 1376 - protein, 25 aa, synthetic construct
  source 1..25: note = Seed: LNVIVHSATGFKQSSKALQRPVASD
LNVIVHSATGFKQCSRALSRPVASD

SEQ ID NO: 1377 - protein, 25 aa, synthetic construct
  source 1..25: note = Seed: LNVIVHSATGFKQSSKALQRPVASD
LNVIVHSATGFKQCSSALARPVASD

SEQ ID NO: 1378 - protein, 25 aa, synthetic construct
  source 1..25: note = Seed: LNVIVHSATGFKQSSKALQRPVASD
LNVIVHSATGFKQCSSALIRPVASD

SEQ ID NO: 1379 - protein, 25 aa, synthetic construct
  source 1..25: note = Seed: LNVIVHSATGFKQSSKALQRPVASD
LNVIVHSATGFKQCSSALLRPVASD

SEQ ID NO: 1380 - protein, 25 aa, synthetic construct
  source 1..25: note = Seed: LNVIVHSATGFKQSSKALQRPVASD
LNVIVHSATGFKQCSSALMRPVASD

SEQ ID NO: 1381 - protein, 25 aa, synthetic construct
  source 1..25: note = Seed: LNVIVHSATGFKQSSKALQRPVASD
LNVIVHSATGFKQCSSALSRPVASD

SEQ ID NO: 1382 - protein, 25 aa, synthetic construct
  source 1..25: note = Seed: LNVIVHSATGFKQSSKALQRPVASD
LNVIVHSATGFKQCSSALTRPVASD

SEQ ID NO: 1383 - protein, 25 aa, synthetic construct
  source 1..25: note = Seed: LNVIVHSATGFKQSSKALQRPVASD
LNVIVHSATGFKQCSSALVRPVASD

SEQ ID NO: 1384 - protein, 25 aa, synthetic construct
  source 1..25: note = Seed: LNVIVHSATGFKQSSKALQRPVASD
LNVIVHSATGFKQCSTALARPVASD

SEQ ID NO: 1385 - protein, 25 aa, synthetic construct
  source 1..25: note = Seed: LNVIVHSATGFKQSSKALQRPVASD
LNVIVHSATGFKQCSTALLRPVASD

SEQ ID NO: 1386 - protein, 25 aa, synthetic construct
  source 1..25: note = Seed: LNVIVHSATGFKQSSKALQRPVASD
LNVIVHSATGFKQCSTALVRPVASD

SEQ ID NO: 1387 - protein, 25 aa, synthetic construct
  source 1..25: note = Seed: LNVIVHSATGFKQSSKALQRPVASD
LNVIVHSATGFKQCSVALARPVASD

SEQ ID NO: 1388 - protein, 25 aa, synthetic construct
  source 1..25: note = Seed: LNVIVHSATGFKQSSKALQRPVASD
LNVIVHSATGFKQCSVALMRPVASD

SEQ ID NO: 1389 - protein, 25 aa, synthetic construct
  source 1..25: note = Seed: LNVIVHSATGFKQSSKALQRPVASD
LNVIVHSATGFKQCSVALNRPVASD

SEQ ID NO: 1390 - protein, 25 aa, synthetic construct
  source 1..25: note = Seed: LNVIVHSATGFKQSSKALQRPVASD
LNVIVHSATGFKQCSVALSRPVASD

SEQ ID NO: 1391 - protein, 25 aa, synthetic construct
  source 1..25: note = Seed: LNVIVHSATGFKQSSKALQRPVASD
LNVIVHSATGFKQDSAALARPVASD

SEQ ID NO: 1392 - protein, 25 aa, synthetic construct
  source 1..25: note = Seed: LNVIVHSATGFKQSSKALQRPVASD
LNVIVHSATGFKQDSAALIRPVASD

SEQ ID NO: 1393 - protein, 25 aa, synthetic construct
  source 1..25: note = Seed: LNVIVHSATGFKQSSKALQRPVASD
LNVIVHSATGFKQDSAALLRPVASD

SEQ ID NO: 1394 - protein, 25 aa, synthetic construct
  source 1..25: note = Seed: LNVIVHSATGFKQSSKALQRPVASD
LNVIVHSATGFKQDSAALVRPVASD

SEQ ID NO: 1395 - protein, 25 aa, synthetic construct
  source 1..25: note = Seed: LNVIVHSATGFKQSSKALQRPVASD
LNVIVHSATGFKQDSFALIRPVASD

SEQ ID NO: 1396 - protein, 25 aa, synthetic construct
  source 1..25: note = Seed: LNVIVHSATGFKQSSKALQRPVASD
LNVIVHSATGFKQDSFALLRPVASD

SEQ ID NO: 1397 - protein, 25 aa, synthetic construct
  source 1..25: note = Seed: LNVIVHSATGFKQSSKALQRPVASD
LNVIVHSATGFKQDSFALVRPVASD

SEQ ID NO: 1398 - protein, 25 aa, synthetic construct
  source 1..25: note = Seed: LNVIVHSATGFKQSSKALQRPVASD
LNVIVHSATGFKQDSIALARPVASD

SEQ ID NO: 1399 - protein, 25 aa, synthetic construct
  source 1..25: note = Seed: LNVIVHSATGFKQSSKALQRPVASD
LNVIVHSATGFKQESAALARPVASD

SEQ ID NO: 1400 - protein, 25 aa, synthetic construct
  source 1..25: note = Seed: LNVIVHSATGFKQSSKALQRPVASD
LNVIVHSATGFKQESAALCRPVASD

SEQ ID NO: 1401 - protein, 25 aa, synthetic construct
  source 1..25: note = Seed: LNVIVHSATGFKQSSKALQRPVASD
LNVIVHSATGFKQESAALFRPVASD

SEQ ID NO: 1402 - protein, 25 aa, synthetic construct
  source 1..25: note = Seed: LNVIVHSATGFKQSSKALQRPVASD
LNVIVHSATGFKQESAALGRPVASD

SEQ ID NO: 1403 - protein, 25 aa, synthetic construct
  source 1..25: note = Seed: LNVIVHSATGFKQSSKALQRPVASD
LNVIVHSATGFKQESAALHRPVASD

SEQ ID NO: 1404 - protein, 25 aa, synthetic construct
  source 1..25: note = Seed: LNVIVHSATGFKQSSKALQRPVASD
LNVIVHSATGFKQESAALIRPVASD

SEQ ID NO: 1405 - protein, 25 aa, synthetic construct
  source 1..25: note = Seed: LNVIVHSATGFKQSSKALQRPVASD
LNVIVHSATGFKQESAALLRPVASD

SEQ ID NO: 1406 - protein, 25 aa, synthetic construct
  source 1..25: note = Seed: LNVIVHSATGFKQSSKALQRPVASD
LNVIVHSATGFKQESAALMRPVASD

SEQ ID NO: 1407 - protein, 25 aa, synthetic construct
  source 1..25: note = Seed: LNVIVHSATGFKQSSKALQRPVASD
LNVIVHSATGFKQESAALNRPVASD

SEQ ID NO: 1408 - protein, 25 aa, synthetic construct
  source 1..25: note = Seed: LNVIVHSATGFKQSSKALQRPVASD
LNVIVHSATGFKQESAALQRPVASD

SEQ ID NO: 1409 - protein, 25 aa, synthetic construct
  source 1..25: note = Seed: LNVIVHSATGFKQSSKALQRPVASD
LNVIVHSATGFKQESAALSRPVASD

SEQ ID NO: 1410 - protein, 25 aa, synthetic construct
  source 1..25: note = Seed: LNVIVHSATGFKQSSKALQRPVASD
LNVIVHSATGFKQESAALTRPVASD

SEQ ID NO: 1411 - protein, 25 aa, synthetic construct
  source 1..25: note = Seed: LNVIVHSATGFKQSSKALQRPVASD
LNVIVHSATGFKQESAALVRPVASD

SEQ ID NO: 1412 - protein, 25 aa, synthetic construct
  source 1..25: note = Seed: LNVIVHSATGFKQSSKALQRPVASD
LNVIVHSATGFKQESFALARPVASD

SEQ ID NO: 1413 - protein, 25 aa, synthetic construct
  source 1..25: note = Seed: LNVIVHSATGFKQSSKALQRPVASD
LNVIVHSATGFKQESFALDRPVASD

SEQ ID NO: 1414 - protein, 25 aa, synthetic construct
  source 1..25: note = Seed: LNVIVHSATGFKQSSKALQRPVASD
LNVIVHSATGFKQESFALERPVASD

SEQ ID NO: 1415 - protein, 25 aa, synthetic construct
  source 1..25: note = Seed: LNVIVHSATGFKQSSKALQRPVASD
LNVIVHSATGFKQESFALFRPVASD

SEQ ID NO: 1416 - protein, 25 aa, synthetic construct
  source 1..25: note = Seed: LNVIVHSATGFKQSSKALQRPVASD
LNVIVHSATGFKQESFALIRPVASD

SEQ ID NO: 1417 - protein, 25 aa, synthetic construct
  source 1..25: note = Seed: LNVIVHSATGFKQSSKALQRPVASD
LNVIVHSATGFKQESFALLRPVASD

SEQ ID NO: 1418 - protein, 25 aa, synthetic construct
  source 1..25: note = Seed: LNVIVHSATGFKQSSKALQRPVASD
LNVIVHSATGFKQESFALMRPVASD

SEQ ID NO: 1419 - protein, 25 aa, synthetic construct
  source 1..25: note = Seed: LNVIVHSATGFKQSSKALQRPVASD
LNVIVHSATGFKQESFALNRPVASD

SEQ ID NO: 1420 - protein, 25 aa, synthetic construct
  source 1..25: note = Seed: LNVIVHSATGFKQSSKALQRPVASD
LNVIVHSATGFKQESFALVRPVASD

SEQ ID NO: 1421 - protein, 25 aa, synthetic construct
  source 1..25: note = Seed: LNVIVHSATGFKQSSKALQRPVASD
LNVIVHSATGFKQESGALARPVASD

SEQ ID NO: 1422 - protein, 25 aa, synthetic construct
  source 1..25: note = Seed: LNVIVHSATGFKQSSKALQRPVASD
LNVIVHSATGFKQESGALGRPVASD

SEQ ID NO: 1423 - protein, 25 aa, synthetic construct
  source 1..25: note = Seed: LNVIVHSATGFKQSSKALQRPVASD
LNVIVHSATGFKQESGALIRPVASD

SEQ ID NO: 1424 - protein, 25 aa, synthetic construct
  source 1..25: note = Seed: LNVIVHSATGFKQSSKALQRPVASD
LNVIVHSATGFKQESGALLRPVASD

SEQ ID NO: 1425 - protein, 25 aa, synthetic construct
  source 1..25: note = Seed: LNVIVHSATGFKQSSKALQRPVASD
LNVIVHSATGFKQESGALMRPVASD

SEQ ID NO: 1426 - protein, 25 aa, synthetic construct
  source 1..25: note = Seed: LNVIVHSATGFKQSSKALQRPVASD
LNVIVHSATGFKQESGALSRPVASD

SEQ ID NO: 1427 - protein, 25 aa, synthetic construct
  source 1..25: note = Seed: LNVIVHSATGFKQSSKALQRPVASD
LNVIVHSATGFKQESGALTRPVASD

SEQ ID NO: 1428 - protein, 25 aa, synthetic construct
  source 1..25: note = Seed: LNVIVHSATGFKQSSKALQRPVASD
LNVIVHSATGFKQESGALVRPVASD

SEQ ID NO: 1429 - protein, 25 aa, synthetic construct
  source 1..25: note = Seed: LNVIVHSATGFKQSSKALQRPVASD
LNVIVHSATGFKQESIALARPVASD

SEQ ID NO: 1430 - protein, 25 aa, synthetic construct
  source 1..25: note = Seed: LNVIVHSATGFKQSSKALQRPVASD
LNVIVHSATGFKQESIALGRPVASD

SEQ ID NO: 1431 - protein, 25 aa, synthetic construct
  source 1..25: note = Seed: LNVIVHSATGFKQSSKALQRPVASD
LNVIVHSATGFKQESIALIRPVASD

SEQ ID NO: 1432 - protein, 25 aa, synthetic construct
  source 1..25: note = Seed: LNVIVHSATGFKQSSKALQRPVASD
LNVIVHSATGFKQESIALLRPVASD

SEQ ID NO: 1433 - protein, 25 aa, synthetic construct
  source 1..25: note = Seed: LNVIVHSATGFKQSSKALQRPVASD
LNVIVHSATGFKQESIALMRPVASD

SEQ ID NO: 1434 - protein, 25 aa, synthetic construct
  source 1..25: note = Seed: LNVIVHSATGFKQSSKALQRPVASD
LNVIVHSATGFKQESIALNRPVASD

SEQ ID NO: 1435 - protein, 25 aa, synthetic construct
  source 1..25: note = Seed: LNVIVHSATGFKQSSKALQRPVASD
LNVIVHSATGFKQESIALQRPVASD

SEQ ID NO: 1436 - protein, 25 aa, synthetic construct
  source 1..25: note = Seed: LNVIVHSATGFKQSSKALQRPVASD
LNVIVHSATGFKQESIALSRPVASD

SEQ ID NO: 1437 - protein, 25 aa, synthetic construct
  source 1..25: note = Seed: LNVIVHSATGFKQSSKALQRPVASD
LNVIVHSATGFKQESIALTRPVASD

SEQ ID NO: 1438 - protein, 25 aa, synthetic construct
  source 1..25: note = Seed: LNVIVHSATGFKQSSKALQRPVASD
LNVIVHSATGFKQESIALVRPVASD

SEQ ID NO: 1439 - protein, 25 aa, synthetic construct
  source 1..25: note = Seed: LNVIVHSATGFKQSSKALQRPVASD
LNVIVHSATGFKQESLALARPVASD

SEQ ID NO: 1440 - protein, 25 aa, synthetic construct
  source 1..25: note = Seed: LNVIVHSATGFKQSSKALQRPVASD
LNVIVHSATGFKQESLALIRPVASD

SEQ ID NO: 1441 - protein, 25 aa, synthetic construct
  source 1..25: note = Seed: LNVIVHSATGFKQSSKALQRPVASD
LNVIVHSATGFKQESLALMRPVASD

SEQ ID NO: 1442 - protein, 25 aa, synthetic construct
  source 1..25: note = Seed: LNVIVHSATGFKQSSKALQRPVASD
LNVIVHSATGFKQESLALSRPVASD

SEQ ID NO: 1443 - protein, 25 aa, synthetic construct
  source 1..25: note = Seed: LNVIVHSATGFKQSSKALQRPVASD
LNVIVHSATGFKQESMALARPVASD

SEQ ID NO: 1444 - protein, 25 aa, synthetic construct
  source 1..25: note = Seed: LNVIVHSATGFKQSSKALQRPVASD
LNVIVHSATGFKQESMALIRPVASD

SEQ ID NO: 1445 - protein, 25 aa, synthetic construct
  source 1..25: note = Seed: LNVIVHSATGFKQSSKALQRPVASD
LNVIVHSATGFKQESMALSRPVASD

SEQ ID NO: 1446 - protein, 25 aa, synthetic construct
  source 1..25: note = Seed: LNVIVHSATGFKQSSKALQRPVASD
LNVIVHSATGFKQESNALARPVASD

SEQ ID NO: 1447 - protein, 25 aa, synthetic construct
  source 1..25: note = Seed: LNVIVHSATGFKQSSKALQRPVASD
LNVIVHSATGFKQESNALIRPVASD

SEQ ID NO: 1448 - protein, 25 aa, synthetic construct
  source 1..25: note = Seed: LNVIVHSATGFKQSSKALQRPVASD
LNVIVHSATGFKQESNALLRPVASD

SEQ ID NO: 1449 - protein, 25 aa, synthetic construct
  source 1..25: note = Seed: LNVIVHSATGFKQSSKALQRPVASD
LNVIVHSATGFKQESNALSRPVASD

SEQ ID NO: 1450 - protein, 25 aa, synthetic construct
  source 1..25: note = Seed: LNVIVHSATGFKQSSKALQRPVASD
LNVIVHSATGFKQESNALVRPVASD

SEQ ID NO: 1451 - protein, 25 aa, synthetic construct
  source 1..25: note = Seed: LNVIVHSATGFKQSSKALQRPVASD
LNVIVHSATGFKQESPALARPVASD

SEQ ID NO: 1452 - protein, 25 aa, synthetic construct
  source 1..25: note = Seed: LNVIVHSATGFKQSSKALQRPVASD
LNVIVHSATGFKQESPALGRPVASD

SEQ ID NO: 1453 - protein, 25 aa, synthetic construct
  source 1..25: note = Seed: LNVIVHSATGFKQSSKALQRPVASD
LNVIVHSATGFKQESPALIRPVASD

SEQ ID NO: 1454 - protein, 25 aa, synthetic construct
  source 1..25: note = Seed: LNVIVHSATGFKQSSKALQRPVASD
LNVIVHSATGFKQESPALLRPVASD

SEQ ID NO: 1455 - protein, 25 aa, synthetic construct
  source 1..25: note = Seed: LNVIVHSATGFKQSSKALQRPVASD
LNVIVHSATGFKQESPALMRPVASD

SEQ ID NO: 1456 - protein, 25 aa, synthetic construct
  source 1..25: note = Seed: LNVIVHSATGFKQSSKALQRPVASD
LNVIVHSATGFKQESPALNRPVASD

SEQ ID NO: 1457 - protein, 25 aa, synthetic construct
  source 1..25: note = Seed: LNVIVHSATGFKQSSKALQRPVASD
LNVIVHSATGFKQESPALQRPVASD

SEQ ID NO: 1458 - protein, 25 aa, synthetic construct
  source 1..25: note = Seed: LNVIVHSATGFKQSSKALQRPVASD
LNVIVHSATGFKQESPALSRPVASD

SEQ ID NO: 1459 - protein, 25 aa, synthetic construct
  source 1..25: note = Seed: LNVIVHSATGFKQSSKALQRPVASD
LNVIVHSATGFKQESPALTRPVASD

SEQ ID NO: 1460 - protein, 25 aa, synthetic construct
  source 1..25: note = Seed: LNVIVHSATGFKQSSKALQRPVASD
LNVIVHSATGFKQESPALVRPVASD

SEQ ID NO: 1461 - protein, 25 aa, synthetic construct
  source 1..25: note = Seed: LNVIVHSATGFKQSSKALQRPVASD
LNVIVHSATGFKQESSALARPVASD

SEQ ID NO: 1462 - protein, 25 aa, synthetic construct
  source 1..25: note = Seed: LNVIVHSATGFKQSSKALQRPVASD
LNVIVHSATGFKQESSALGRPVASD

SEQ ID NO: 1463 - protein, 25 aa, synthetic construct
  source 1..25: note = Seed: LNVIVHSATGFKQSSKALQRPVASD
LNVIVHSATGFKQESSALIRPVASD

SEQ ID NO: 1464 - protein, 25 aa, synthetic construct
  source 1..25: note = Seed: LNVIVHSATGFKQSSKALQRPVASD
LNVIVHSATGFKQESSALLRPVASD

SEQ ID NO: 1465 - protein, 25 aa, synthetic construct
  source 1..25: note = Seed: LNVIVHSATGFKQSSKALQRPVASD
LNVIVHSATGFKQESSALMRPVASD

SEQ ID NO: 1466 - protein, 25 aa, synthetic construct
  source 1..25: note = Seed: LNVIVHSATGFKQSSKALQRPVASD
LNVIVHSATGFKQESSALNRPVASD

SEQ ID NO: 1467 - protein, 25 aa, synthetic construct
  source 1..25: note = Seed: LNVIVHSATGFKQSSKALQRPVASD
LNVIVHSATGFKQESSALSRPVASD

SEQ ID NO: 1468 - protein, 25 aa, synthetic construct
  source 1..25: note = Seed: LNVIVHSATGFKQSSKALQRPVASD
LNVIVHSATGFKQESSALTRPVASD

SEQ ID NO: 1469 - protein, 25 aa, synthetic construct
  source 1..25: note = Seed: LNVIVHSATGFKQSSKALQRPVASD
LNVIVHSATGFKQESSALVRPVASD

SEQ ID NO: 1470 - protein, 25 aa, synthetic construct
  source 1..25: note = Seed: LNVIVHSATGFKQSSKALQRPVASD
LNVIVHSATGFKQESTALARPVASD

SEQ ID NO: 1471 - protein, 25 aa, synthetic construct
  source 1..25: note = Seed: LNVIVHSATGFKQSSKALQRPVASD
LNVIVHSATGFKQESTALIRPVASD

SEQ ID NO: 1472 - protein, 25 aa, synthetic construct
  source 1..25: note = Seed: LNVIVHSATGFKQSSKALQRPVASD
LNVIVHSATGFKQESTALLRPVASD

SEQ ID NO: 1473 - protein, 25 aa, synthetic construct
  source 1..25: note = Seed: LNVIVHSATGFKQSSKALQRPVASD
LNVIVHSATGFKQESTALMRPVASD

SEQ ID NO: 1474 - protein, 25 aa, synthetic construct
  source 1..25: note = Seed: LNVIVHSATGFKQSSKALQRPVASD
LNVIVHSATGFKQESTALNRPVASD

SEQ ID NO: 1475 - protein, 25 aa, synthetic construct
  source 1..25: note = Seed: LNVIVHSATGFKQSSKALQRPVASD
LNVIVHSATGFKQESTALSRPVASD

SEQ ID NO: 1476 - protein, 25 aa, synthetic construct
  source 1..25: note = Seed: LNVIVHSATGFKQSSKALQRPVASD
LNVIVHSATGFKQESTALTRPVASD

SEQ ID NO: 1477 - protein, 25 aa, synthetic construct
  source 1..25: note = Seed: LNVIVHSATGFKQSSKALQRPVASD
LNVIVHSATGFKQESTALVRPVASD

SEQ ID NO: 1478 - protein, 25 aa, synthetic construct
  source 1..25: note = Seed: LNVIVHSATGFKQSSKALQRPVASD
LNVIVHSATGFKQESVALARPVASD

SEQ ID NO: 1479 - protein, 25 aa, synthetic construct
  source 1..25: note = Seed: LNVIVHSATGFKQSSKALQRPVASD
LNVIVHSATGFKQESVALGRPVASD

SEQ ID NO: 1480 - protein, 25 aa, synthetic construct
  source 1..25: note = Seed: LNVIVHSATGFKQSSKALQRPVASD
LNVIVHSATGFKQESVALHRPVASD

SEQ ID NO: 1481 - protein, 25 aa, synthetic construct
  source 1..25: note = Seed: LNVIVHSATGFKQSSKALQRPVASD
LNVIVHSATGFKQESVALIRPVASD

SEQ ID NO: 1482 - protein, 25 aa, synthetic construct
  source 1..25: note = Seed: LNVIVHSATGFKQSSKALQRPVASD
LNVIVHSATGFKQESVALLRPVASD

SEQ ID NO: 1483 - protein, 25 aa, synthetic construct
  source 1..25: note = Seed: LNVIVHSATGFKQSSKALQRPVASD
LNVIVHSATGFKQESVALMRPVASD

SEQ ID NO: 1484 - protein, 25 aa, synthetic construct
  source 1..25: note = Seed: LNVIVHSATGFKQSSKALQRPVASD
LNVIVHSATGFKQESVALNRPVASD

SEQ ID NO: 1485 - protein, 25 aa, synthetic construct
  source 1..25: note = Seed: LNVIVHSATGFKQSSKALQRPVASD
LNVIVHSATGFKQESVALQRPVASD

SEQ ID NO: 1486 - protein, 25 aa, synthetic construct
  source 1..25: note = Seed: LNVIVHSATGFKQSSKALQRPVASD
LNVIVHSATGFKQESVALSRPVASD

SEQ ID NO: 1487 - protein, 25 aa, synthetic construct
  source 1..25: note = Seed: LNVIVHSATGFKQSSKALQRPVASD
LNVIVHSATGFKQESVALTRPVASD

SEQ ID NO: 1488 - protein, 25 aa, synthetic construct
  source 1..25: note = Seed: LNVIVHSATGFKQSSKALQRPVASD
LNVIVHSATGFKQESVALVRPVASD

SEQ ID NO: 1489 - protein, 25 aa, synthetic construct
  source 1..25: note = Seed: LNVIVHSATGFKQSSKALQRPVASD
LNVIVHSATGFKQFSAALARPVASD

SEQ ID NO: 1490 - protein, 25 aa, synthetic construct
  source 1..25: note = Seed: LNVIVHSATGFKQSSKALQRPVASD
LNVIVHSATGFKQFSAALCRPVASD

SEQ ID NO: 1491 - protein, 25 aa, synthetic construct
  source 1..25: note = Seed: LNVIVHSATGFKQSSKALQRPVASD
LNVIVHSATGFKQFSAALDRPVASD

SEQ ID NO: 1492 - protein, 25 aa, synthetic construct
  source 1..25: note = Seed: LNVIVHSATGFKQSSKALQRPVASD
LNVIVHSATGFKQFSAALERPVASD

SEQ ID NO: 1493 - protein, 25 aa, synthetic construct
  source 1..25: note = Seed: LNVIVHSATGFKQSSKALQRPVASD
LNVIVHSATGFKQFSAALFRPVASD

SEQ ID NO: 1494 - protein, 25 aa, synthetic construct
  source 1..25: note = Seed: LNVIVHSATGFKQSSKALQRPVASD
LNVIVHSATGFKQFSAALGRPVASD

SEQ ID NO: 1495 - protein, 25 aa, synthetic construct
  source 1..25: note = Seed: LNVIVHSATGFKQSSKALQRPVASD
LNVIVHSATGFKQFSAALHRPVASD

SEQ ID NO: 1496 - protein, 25 aa, synthetic construct
  source 1..25: note = Seed: LNVIVHSATGFKQSSKALQRPVASD
LNVIVHSATGFKQFSAALIRPVASD

SEQ ID NO: 1497 - protein, 25 aa, synthetic construct
  source 1..25: note = Seed: LNVIVHSATGFKQSSKALQRPVASD
LNVIVHSATGFKQFSAALKRPVASD

SEQ ID NO: 1498 - protein, 25 aa, synthetic construct
  source 1..25: note = Seed: LNVIVHSATGFKQSSKALQRPVASD
LNVIVHSATGFKQFSAALLRPVASD

SEQ ID NO: 1499 - protein, 25 aa, synthetic construct
  source 1..25: note = Seed: LNVIVHSATGFKQSSKALQRPVASD
LNVIVHSATGFKQFSAALMRPVASD

SEQ ID NO: 1500 - protein, 25 aa, synthetic construct
  source 1..25: note = Seed: LNVIVHSATGFKQSSKALQRPVASD
LNVIVHSATGFKQFSAALNRPVASD

SEQ ID NO: 1501 - protein, 25 aa, synthetic construct
  source 1..25: note = Seed: LNVIVHSATGFKQSSKALQRPVASD
LNVIVHSATGFKQFSAALPRPVASD

SEQ ID NO: 1502 - protein, 25 aa, synthetic construct
  source 1..25: note = Seed: LNVIVHSATGFKQSSKALQRPVASD
LNVIVHSATGFKQFSAALQRPVASD

SEQ ID NO: 1503 - protein, 25 aa, synthetic construct
  source 1..25: note = Seed: LNVIVHSATGFKQSSKALQRPVASD
LNVIVHSATGFKQFSAALRRPVASD

SEQ ID NO: 1504 - protein, 25 aa, synthetic construct
  source 1..25: note = Seed: LNVIVHSATGFKQSSKALQRPVASD
LNVIVHSATGFKQFSAALSRPVASD

SEQ ID NO: 1505 - protein, 25 aa, synthetic construct
  source 1..25: note = Seed: LNVIVHSATGFKQSSKALQRPVASD
LNVIVHSATGFKQFSAALTRPVASD

SEQ ID NO: 1506 - protein, 25 aa, synthetic construct
  source 1..25: note = Seed: LNVIVHSATGFKQSSKALQRPVASD
LNVIVHSATGFKQFSAALVRPVASD

SEQ ID NO: 1507 - protein, 25 aa, synthetic construct
  source 1..25: note = Seed: LNVIVHSATGFKQSSKALQRPVASD
LNVIVHSATGFKQFSAALWRPVASD

SEQ ID NO: 1508 - protein, 25 aa, synthetic construct
  source 1..25: note = Seed: LNVIVHSATGFKQSSKALQRPVASD
LNVIVHSATGFKQFSAALYRPVASD

SEQ ID NO: 1509 - protein, 25 aa, synthetic construct
  source 1..25: note = Seed: LNVIVHSATGFKQSSKALQRPVASD
LNVIVHSATGFKQFSCALIRPVASD

SEQ ID NO: 1510 - protein, 25 aa, synthetic construct
  source 1..25: note = Seed: LNVIVHSATGFKQSSKALQRPVASD
LNVIVHSATGFKQFSCALMRPVASD

SEQ ID NO: 1511 - protein, 25 aa, synthetic construct
  source 1..25: note = Seed: LNVIVHSATGFKQSSKALQRPVASD
LNVIVHSATGFKQFSCALNRPVASD

SEQ ID NO: 1512 - protein, 25 aa, synthetic construct
  source 1..25: note = Seed: LNVIVHSATGFKQSSKALQRPVASD
LNVIVHSATGFKQFSDALARPVASD

SEQ ID NO: 1513 - protein, 25 aa, synthetic construct
  source 1..25: note = Seed: LNVIVHSATGFKQSSKALQRPVASD
LNVIVHSATGFKQFSEALNRPVASD

SEQ ID NO: 1514 - protein, 25 aa, synthetic construct
  source 1..25: note = Seed: LNVIVHSATGFKQSSKALQRPVASD
LNVIVHSATGFKQFSEALVRPVASD

SEQ ID NO: 1515 - protein, 25 aa, synthetic construct
  source 1..25: note = Seed: LNVIVHSATGFKQSSKALQRPVASD
LNVIVHSATGFKQFSFALARPVASD

SEQ ID NO: 1516 - protein, 25 aa, synthetic construct
  source 1..25: note = Seed: LNVIVHSATGFKQSSKALQRPVASD
LNVIVHSATGFKQFSFALERPVASD

SEQ ID NO: 1517 - protein, 25 aa, synthetic construct
  source 1..25: note = Seed: LNVIVHSATGFKQSSKALQRPVASD
LNVIVHSATGFKQFSFALSRPVASD

SEQ ID NO: 1518 - protein, 25 aa, synthetic construct
  source 1..25: note = Seed: LNVIVHSATGFKQSSKALQRPVASD
LNVIVHSATGFKQFSFALTRPVASD

SEQ ID NO: 1519 - protein, 25 aa, synthetic construct
  source 1..25: note = Seed: LNVIVHSATGFKQSSKALQRPVASD
LNVIVHSATGFKQFSFALVRPVASD

SEQ ID NO: 1520 - protein, 25 aa, synthetic construct
  source 1..25: note = Seed: LNVIVHSATGFKQSSKALQRPVASD
LNVIVHSATGFKQFSGALARPVASD

SEQ ID NO: 1521 - protein, 25 aa, synthetic construct
  source 1..25: note = Seed: LNVIVHSATGFKQSSKALQRPVASD
LNVIVHSATGFKQFSGALFRPVASD

SEQ ID NO: 1522 - protein, 25 aa, synthetic construct
  source 1..25: note = Seed: LNVIVHSATGFKQSSKALQRPVASD
LNVIVHSATGFKQFSGALGRPVASD

SEQ ID NO: 1523 - protein, 25 aa, synthetic construct
  source 1..25: note = Seed: LNVIVHSATGFKQSSKALQRPVASD
LNVIVHSATGFKQFSGALIRPVASD

SEQ ID NO: 1524 - protein, 25 aa, synthetic construct
  source 1..25: note = Seed: LNVIVHSATGFKQSSKALQRPVASD
LNVIVHSATGFKQFSGALLRPVASD

SEQ ID NO: 1525 - protein, 25 aa, synthetic construct
  source 1..25: note = Seed: LNVIVHSATGFKQSSKALQRPVASD
LNVIVHSATGFKQFSGALMRPVASD

SEQ ID NO: 1526 - protein, 25 aa, synthetic construct
  source 1..25: note = Seed: LNVIVHSATGFKQSSKALQRPVASD
LNVIVHSATGFKQFSGALNRPVASD

SEQ ID NO: 1527 - protein, 25 aa, synthetic construct
  source 1..25: note = Seed: LNVIVHSATGFKQSSKALQRPVASD
LNVIVHSATGFKQFSGALQRPVASD

SEQ ID NO: 1528 - protein, 25 aa, synthetic construct
  source 1..25: note = Seed: LNVIVHSATGFKQSSKALQRPVASD
LNVIVHSATGFKQFSGALRRPVASD

SEQ ID NO: 1529 - protein, 25 aa, synthetic construct
  source 1..25: note = Seed: LNVIVHSATGFKQSSKALQRPVASD
LNVIVHSATGFKQFSGALSRPVASD

SEQ ID NO: 1530 - protein, 25 aa, synthetic construct
  source 1..25: note = Seed: LNVIVHSATGFKQSSKALQRPVASD
LNVIVHSATGFKQFSGALTRPVASD

SEQ ID NO: 1531 - protein, 25 aa, synthetic construct
  source 1..25: note = Seed: LNVIVHSATGFKQSSKALQRPVASD
LNVIVHSATGFKQFSGALVRPVASD

SEQ ID NO: 1532 - protein, 25 aa, synthetic construct
  source 1..25: note = Seed: LNVIVHSATGFKQSSKALQRPVASD
LNVIVHSATGFKQFSHALARPVASD

SEQ ID NO: 1533 - protein, 25 aa, synthetic construct
  source 1..25: note = Seed: LNVIVHSATGFKQSSKALQRPVASD
LNVIVHSATGFKQFSHALIRPVASD

SEQ ID NO: 1534 - protein, 25 aa, synthetic construct
  source 1..25: note = Seed: LNVIVHSATGFKQSSKALQRPVASD
LNVIVHSATGFKQFSHALKRPVASD

SEQ ID NO: 1535 - protein, 25 aa, synthetic construct
  source 1..25: note = Seed: LNVIVHSATGFKQSSKALQRPVASD
LNVIVHSATGFKQFSHALLRPVASD

SEQ ID NO: 1536 - protein, 25 aa, synthetic construct
  source 1..25: note = Seed: LNVIVHSATGFKQSSKALQRPVASD
LNVIVHSATGFKQFSHALMRPVASD

SEQ ID NO: 1537 - protein, 25 aa, synthetic construct
  source 1..25: note = Seed: LNVIVHSATGFKQSSKALQRPVASD
LNVIVHSATGFKQFSHALNRPVASD

SEQ ID NO: 1538 - protein, 25 aa, synthetic construct
  source 1..25: note = Seed: LNVIVHSATGFKQSSKALQRPVASD
LNVIVHSATGFKQFSHALRRPVASD

SEQ ID NO: 1539 - protein, 25 aa, synthetic construct
  source 1..25: note = Seed: LNVIVHSATGFKQSSKALQRPVASD
LNVIVHSATGFKQFSHALSRPVASD

SEQ ID NO: 1540 - protein, 25 aa, synthetic construct
  source 1..25: note = Seed: LNVIVHSATGFKQSSKALQRPVASD
LNVIVHSATGFKQFSHALVRPVASD

SEQ ID NO: 1541 - protein, 25 aa, synthetic construct
  source 1..25: note = Seed: LNVIVHSATGFKQSSKALQRPVASD
LNVIVHSATGFKQFSIALCRPVASD

SEQ ID NO: 1542 - protein, 25 aa, synthetic construct
  source 1..25: note = Seed: LNVIVHSATGFKQSSKALQRPVASD
LNVIVHSATGFKQFSIALDRPVASD

SEQ ID NO: 1543 - protein, 25 aa, synthetic construct
  source 1..25: note = Seed: LNVIVHSATGFKQSSKALQRPVASD
LNVIVHSATGFKQFSIALERPVASD

SEQ ID NO: 1544 - protein, 25 aa, synthetic construct
  source 1..25: note = Seed: LNVIVHSATGFKQSSKALQRPVASD
LNVIVHSATGFKQFSIALGRPVASD

SEQ ID NO: 1545 - protein, 25 aa, synthetic construct
  source 1..25: note = Seed: LNVIVHSATGFKQSSKALQRPVASD
LNVIVHSATGFKQFSIALHRPVASD

SEQ ID NO: 1546 - protein, 25 aa, synthetic construct
  source 1..25: note = Seed: LNVIVHSATGFKQSSKALQRPVASD
LNVIVHSATGFKQFSIALKRPVASD

SEQ ID NO: 1547 - protein, 25 aa, synthetic construct
  source 1..25: note = Seed: LNVIVHSATGFKQSSKALQRPVASD
LNVIVHSATGFKQFSIALLRPVASD

SEQ ID NO: 1548 - protein, 25 aa, synthetic construct
  source 1..25: note = Seed: LNVIVHSATGFKQSSKALQRPVASD
LNVIVHSATGFKQFSIALNRPVASD

SEQ ID NO: 1549 - protein, 25 aa, synthetic construct
  source 1..25: note = Seed: LNVIVHSATGFKQSSKALQRPVASD
LNVIVHSATGFKQFSIALQRPVASD

SEQ ID NO: 1550 - protein, 25 aa, synthetic construct
  source 1..25: note = Seed: LNVIVHSATGFKQSSKALQRPVASD
LNVIVHSATGFKQFSKALARPVASD

SEQ ID NO: 1551 - protein, 25 aa, synthetic construct
  source 1..25: note = Seed: LNVIVHSATGFKQSSKALQRPVASD
LNVIVHSATGFKQFSKALGRPVASD

SEQ ID NO: 1552 - protein, 25 aa, synthetic construct
  source 1..25: note = Seed: LNVIVHSATGFKQSSKALQRPVASD
LNVIVHSATGFKQFSKALHRPVASD

SEQ ID NO: 1553 - protein, 25 aa, synthetic construct
  source 1..25: note = Seed: LNVIVHSATGFKQSSKALQRPVASD
LNVIVHSATGFKQFSKALIRPVASD

SEQ ID NO: 1554 - protein, 25 aa, synthetic construct
  source 1..25: note = Seed: LNVIVHSATGFKQSSKALQRPVASD
LNVIVHSATGFKQFSKALKRPVASD

SEQ ID NO: 1555 - protein, 25 aa, synthetic construct
  source 1..25: note = Seed: LNVIVHSATGFKQSSKALQRPVASD
LNVIVHSATGFKQFSKALLRPVASD

SEQ ID NO: 1556 - protein, 25 aa, synthetic construct
  source 1..25: note = Seed: LNVIVHSATGFKQSSKALQRPVASD
LNVIVHSATGFKQFSKALMRPVASD

SEQ ID NO: 1557 - protein, 25 aa, synthetic construct
  source 1..25: note = Seed: LNVIVHSATGFKQSSKALQRPVASD
LNVIVHSATGFKQFSKALNRPVASD

SEQ ID NO: 1558 - protein, 25 aa, synthetic construct
  source 1..25: note = Seed: LNVIVHSATGFKQSSKALQRPVASD
LNVIVHSATGFKQFSKALQRPVASD

SEQ ID NO: 1559 - protein, 25 aa, synthetic construct
  source 1..25: note = Seed: LNVIVHSATGFKQSSKALQRPVASD
LNVIVHSATGFKQFSKALRRPVASD

SEQ ID NO: 1560 - protein, 25 aa, synthetic construct
  source 1..25: note = Seed: LNVIVHSATGFKQSSKALQRPVASD
LNVIVHSATGFKQFSKALSRPVASD

SEQ ID NO: 1561 - protein, 25 aa, synthetic construct
  source 1..25: note = Seed: LNVIVHSATGFKQSSKALQRPVASD
LNVIVHSATGFKQFSKALTRPVASD

SEQ ID NO: 1562 - protein, 25 aa, synthetic construct
  source 1..25: note = Seed: LNVIVHSATGFKQSSKALQRPVASD
LNVIVHSATGFKQFSKALVRPVASD

SEQ ID NO: 1563 - protein, 25 aa, synthetic construct
  source 1..25: note = Seed: LNVIVHSATGFKQSSKALQRPVASD
LNVIVHSATGFKQFSLALDRPVASD

SEQ ID NO: 1564 - protein, 25 aa, synthetic construct
  source 1..25: note = Seed: LNVIVHSATGFKQSSKALQRPVASD
LNVIVHSATGFKQFSLALHRPVASD

SEQ ID NO: 1565 - protein, 25 aa, synthetic construct
  source 1..25: note = Seed: LNVIVHSATGFKQSSKALQRPVASD
LNVIVHSATGFKQFSLALQRPVASD

SEQ ID NO: 1566 - protein, 25 aa, synthetic construct
  source 1..25: note = Seed: LNVIVHSATGFKQSSKALQRPVASD
LNVIVHSATGFKQFSLALVRPVASD

SEQ ID NO: 1567 - protein, 25 aa, synthetic construct
  source 1..25: note = Seed: LNVIVHSATGFKQSSKALQRPVASD
LNVIVHSATGFKQFSNALARPVASD

SEQ ID NO: 1568 - protein, 25 aa, synthetic construct
  source 1..25: note = Seed: LNVIVHSATGFKQSSKALQRPVASD
LNVIVHSATGFKQFSNALGRPVASD

SEQ ID NO: 1569 - protein, 25 aa, synthetic construct
  source 1..25: note = Seed: LNVIVHSATGFKQSSKALQRPVASD
LNVIVHSATGFKQFSNALIRPVASD

SEQ ID NO: 1570 - protein, 25 aa, synthetic construct
  source 1..25: note = Seed: LNVIVHSATGFKQSSKALQRPVASD
LNVIVHSATGFKQFSNALLRPVASD

SEQ ID NO: 1571 - protein, 25 aa, synthetic construct
  source 1..25: note = Seed: LNVIVHSATGFKQSSKALQRPVASD
LNVIVHSATGFKQFSNALMRPVASD

SEQ ID NO: 1572 - protein, 25 aa, synthetic construct
  source 1..25: note = Seed: LNVIVHSATGFKQSSKALQRPVASD
LNVIVHSATGFKQFSNALNRPVASD

SEQ ID NO: 1573 - protein, 25 aa, synthetic construct
  source 1..25: note = Seed: LNVIVHSATGFKQSSKALQRPVASD
LNVIVHSATGFKQFSNALSRPVASD

SEQ ID NO: 1574 - protein, 25 aa, synthetic construct
  source 1..25: note = Seed: LNVIVHSATGFKQSSKALQRPVASD
LNVIVHSATGFKQFSNALTRPVASD

SEQ ID NO: 1575 - protein, 25 aa, synthetic construct
  source 1..25: note = Seed: LNVIVHSATGFKQSSKALQRPVASD
LNVIVHSATGFKQFSNALVRPVASD

SEQ ID NO: 1576 - protein, 25 aa, synthetic construct
  source 1..25: note = Seed: LNVIVHSATGFKQSSKALQRPVASD
LNVIVHSATGFKQFSPALARPVASD

SEQ ID NO: 1577 - protein, 25 aa, synthetic construct
  source 1..25: note = Seed: LNVIVHSATGFKQSSKALQRPVASD
LNVIVHSATGFKQFSPALCRPVASD

SEQ ID NO: 1578 - protein, 25 aa, synthetic construct
  source 1..25: note = Seed: LNVIVHSATGFKQSSKALQRPVASD
LNVIVHSATGFKQFSPALDRPVASD

SEQ ID NO: 1579 - protein, 25 aa, synthetic construct
  source 1..25: note = Seed: LNVIVHSATGFKQSSKALQRPVASD
LNVIVHSATGFKQFSPALERPVASD

SEQ ID NO: 1580 - protein, 25 aa, synthetic construct
  source 1..25: note = Seed: LNVIVHSATGFKQSSKALQRPVASD
LNVIVHSATGFKQFSPALFRPVASD

SEQ ID NO: 1581 - protein, 25 aa, synthetic construct
  source 1..25: note = Seed: LNVIVHSATGFKQSSKALQRPVASD
LNVIVHSATGFKQFSPALGRPVASD

SEQ ID NO: 1582 - protein, 25 aa, synthetic construct
  source 1..25: note = Seed: LNVIVHSATGFKQSSKALQRPVASD
LNVIVHSATGFKQFSPALHRPVASD

SEQ ID NO: 1583 - protein, 25 aa, synthetic construct
  source 1..25: note = Seed: LNVIVHSATGFKQSSKALQRPVASD
LNVIVHSATGFKQFSPALIRPVASD

SEQ ID NO: 1584 - protein, 25 aa, synthetic construct
  source 1..25: note = Seed: LNVIVHSATGFKQSSKALQRPVASD
LNVIVHSATGFKQFSPALLRPVASD

SEQ ID NO: 1585 - protein, 25 aa, synthetic construct
  source 1..25: note = Seed: LNVIVHSATGFKQSSKALQRPVASD
LNVIVHSATGFKQFSPALMRPVASD

SEQ ID NO: 1586 - protein, 25 aa, synthetic construct
  source 1..25: note = Seed: LNVIVHSATGFKQSSKALQRPVASD
LNVIVHSATGFKQFSPALNRPVASD

SEQ ID NO: 1587 - protein, 25 aa, synthetic construct
  source 1..25: note = Seed: LNVIVHSATGFKQSSKALQRPVASD
LNVIVHSATGFKQFSPALQRPVASD

SEQ ID NO: 1588 - protein, 25 aa, synthetic construct
  source 1..25: note = Seed: LNVIVHSATGFKQSSKALQRPVASD
LNVIVHSATGFKQFSPALSRPVASD

SEQ ID NO: 1589 - protein, 25 aa, synthetic construct
  source 1..25: note = Seed: LNVIVHSATGFKQSSKALQRPVASD
LNVIVHSATGFKQFSPALTRPVASD

SEQ ID NO: 1590 - protein, 25 aa, synthetic construct
  source 1..25: note = Seed: LNVIVHSATGFKQSSKALQRPVASD
LNVIVHSATGFKQFSPALVRPVASD

SEQ ID NO: 1591 - protein, 25 aa, synthetic construct
  source 1..25: note = Seed: LNVIVHSATGFKQSSKALQRPVASD
LNVIVHSATGFKQFSQALIRPVASD

SEQ ID NO: 1592 - protein, 25 aa, synthetic construct
  source 1..25: note = Seed: LNVIVHSATGFKQSSKALQRPVASD
LNVIVHSATGFKQFSQALLRPVASD

SEQ ID NO: 1593 - protein, 25 aa, synthetic construct
  source 1..25: note = Seed: LNVIVHSATGFKQSSKALQRPVASD
LNVIVHSATGFKQFSQALMRPVASD

SEQ ID NO: 1594 - protein, 25 aa, synthetic construct
  source 1..25: note = Seed: LNVIVHSATGFKQSSKALQRPVASD
LNVIVHSATGFKQFSQALRRPVASD

SEQ ID NO: 1595 - protein, 25 aa, synthetic construct
  source 1..25: note = Seed: LNVIVHSATGFKQSSKALQRPVASD
LNVIVHSATGFKQFSRALARPVASD

SEQ ID NO: 1596 - protein, 25 aa, synthetic construct
  source 1..25: note = Seed: LNVIVHSATGFKQSSKALQRPVASD
LNVIVHSATGFKQFSRALGRPVASD

SEQ ID NO: 1597 - protein, 25 aa, synthetic construct
  source 1..25: note = Seed: LNVIVHSATGFKQSSKALQRPVASD
LNVIVHSATGFKQFSRALHRPVASD

SEQ ID NO: 1598 - protein, 25 aa, synthetic construct
  source 1..25: note = Seed: LNVIVHSATGFKQSSKALQRPVASD
LNVIVHSATGFKQFSRALIRPVASD

SEQ ID NO: 1599 - protein, 25 aa, synthetic construct
  source 1..25: note = Seed: LNVIVHSATGFKQSSKALQRPVASD
LNVIVHSATGFKQFSRALKRPVASD

SEQ ID NO: 1600 - protein, 25 aa, synthetic construct
  source 1..25: note = Seed: LNVIVHSATGFKQSSKALQRPVASD
LNVIVHSATGFKQFSRALLRPVASD

SEQ ID NO: 1601 - protein, 25 aa, synthetic construct
  source 1..25: note = Seed: LNVIVHSATGFKQSSKALQRPVASD
LNVIVHSATGFKQFSRALMRPVASD

SEQ ID NO: 1602 - protein, 25 aa, synthetic construct
  source 1..25: note = Seed: LNVIVHSATGFKQSSKALQRPVASD
LNVIVHSATGFKQFSRALNRPVASD

SEQ ID NO: 1603 - protein, 25 aa, synthetic construct
  source 1..25: note = Seed: LNVIVHSATGFKQSSKALQRPVASD
LNVIVHSATGFKQFSRALPRPVASD

SEQ ID NO: 1604 - protein, 25 aa, synthetic construct
  source 1..25: note = Seed: LNVIVHSATGFKQSSKALQRPVASD
LNVIVHSATGFKQFSRALQRPVASD

SEQ ID NO: 1605 - protein, 25 aa, synthetic construct
  source 1..25: note = Seed: LNVIVHSATGFKQSSKALQRPVASD
LNVIVHSATGFKQFSRALRRPVASD

SEQ ID NO: 1606 - protein, 25 aa, synthetic construct
  source 1..25: note = Seed: LNVIVHSATGFKQSSKALQRPVASD
LNVIVHSATGFKQFSRALSRPVASD

SEQ ID NO: 1607 - protein, 25 aa, synthetic construct
  source 1..25: note = Seed: LNVIVHSATGFKQSSKALQRPVASD
LNVIVHSATGFKQFSRALTRPVASD

SEQ ID NO: 1608 - protein, 25 aa, synthetic construct
  source 1..25: note = Seed: LNVIVHSATGFKQSSKALQRPVASD
LNVIVHSATGFKQFSRALVRPVASD

SEQ ID NO: 1609 - protein, 25 aa, synthetic construct
  source 1..25: note = Seed: LNVIVHSATGFKQSSKALQRPVASD
LNVIVHSATGFKQFSRALYRPVASD

SEQ ID NO: 1610 - protein, 25 aa, synthetic construct
  source 1..25: note = Seed: LNVIVHSATGFKQSSKALQRPVASD
LNVIVHSATGFKQFSSALARPVASD

SEQ ID NO: 1611 - protein, 25 aa, synthetic construct
  source 1..25: note = Seed: LNVIVHSATGFKQSSKALQRPVASD
LNVIVHSATGFKQFSSALCRPVASD

SEQ ID NO: 1612 - protein, 25 aa, synthetic construct
  source 1..25: note = Seed: LNVIVHSATGFKQSSKALQRPVASD
LNVIVHSATGFKQFSSALDRPVASD

SEQ ID NO: 1613 - protein, 25 aa, synthetic construct
  source 1..25: note = Seed: LNVIVHSATGFKQSSKALQRPVASD
LNVIVHSATGFKQFSSALERPVASD

SEQ ID NO: 1614 - protein, 25 aa, synthetic construct
  source 1..25: note = Seed: LNVIVHSATGFKQSSKALQRPVASD
LNVIVHSATGFKQFSSALFRPVASD

SEQ ID NO: 1615 - protein, 25 aa, synthetic construct
  source 1..25: note = Seed: LNVIVHSATGFKQSSKALQRPVASD
LNVIVHSATGFKQFSSALGRPVASD

SEQ ID NO: 1616 - protein, 25 aa, synthetic construct
  source 1..25: note = Seed: LNVIVHSATGFKQSSKALQRPVASD
LNVIVHSATGFKQFSSALHRPVASD

SEQ ID NO: 1617 - protein, 25 aa, synthetic construct
  source 1..25: note = Seed: LNVIVHSATGFKQSSKALQRPVASD
LNVIVHSATGFKQFSSALIRPVASD

SEQ ID NO: 1618 - protein, 25 aa, synthetic construct
  source 1..25: note = Seed: LNVIVHSATGFKQSSKALQRPVASD
LNVIVHSATGFKQFSSALKRPVASD

SEQ ID NO: 1619 - protein, 25 aa, synthetic construct
  source 1..25: note = Seed: LNVIVHSATGFKQSSKALQRPVASD
LNVIVHSATGFKQFSSALLRPVASD

SEQ ID NO: 1620 - protein, 25 aa, synthetic construct
  source 1..25: note = Seed: LNVIVHSATGFKQSSKALQRPVASD
LNVIVHSATGFKQFSSALMRPVASD

SEQ ID NO: 1621 - protein, 25 aa, synthetic construct
  source 1..25: note = Seed: LNVIVHSATGFKQSSKALQRPVASD
LNVIVHSATGFKQFSSALNRPVASD

SEQ ID NO: 1622 - protein, 25 aa, synthetic construct
  source 1..25: note = Seed: LNVIVHSATGFKQSSKALQRPVASD
LNVIVHSATGFKQFSSALPRPVASD

SEQ ID NO: 1623 - protein, 25 aa, synthetic construct
  source 1..25: note = Seed: LNVIVHSATGFKQSSKALQRPVASD
LNVIVHSATGFKQFSSALQRPVASD

SEQ ID NO: 1624 - protein, 25 aa, synthetic construct
  source 1..25: note = Seed: LNVIVHSATGFKQSSKALQRPVASD
LNVIVHSATGFKQFSSALRRPVASD

SEQ ID NO: 1625 - protein, 25 aa, synthetic construct
  source 1..25: note = Seed: LNVIVHSATGFKQSSKALQRPVASD
LNVIVHSATGFKQFSSALSRPVASD

SEQ ID NO: 1626 - protein, 25 aa, synthetic construct
  source 1..25: note = Seed: LNVIVHSATGFKQSSKALQRPVASD
LNVIVHSATGFKQFSSALTRPVASD

SEQ ID NO: 1627 - protein, 25 aa, synthetic construct
  source 1..25: note = Seed: LNVIVHSATGFKQSSKALQRPVASD
LNVIVHSATGFKQFSSALVRPVASD

SEQ ID NO: 1628 - protein, 25 aa, synthetic construct
  source 1..25: note = Seed: LNVIVHSATGFKQSSKALQRPVASD
LNVIVHSATGFKQFSSALYRPVASD

SEQ ID NO: 1629 - protein, 25 aa, synthetic construct
  source 1..25: note = Seed: LNVIVHSATGFKQSSKALQRPVASD
LNVIVHSATGFKQFSTALARPVASD

SEQ ID NO: 1630 - protein, 25 aa, synthetic construct
  source 1..25: note = Seed: LNVIVHSATGFKQSSKALQRPVASD
LNVIVHSATGFKQFSTALCRPVASD

SEQ ID NO: 1631 - protein, 25 aa, synthetic construct
  source 1..25: note = Seed: LNVIVHSATGFKQSSKALQRPVASD
LNVIVHSATGFKQFSTALDRPVASD

SEQ ID NO: 1632 - protein, 25 aa, synthetic construct
  source 1..25: note = Seed: LNVIVHSATGFKQSSKALQRPVASD
LNVIVHSATGFKQFSTALERPVASD

SEQ ID NO: 1633 - protein, 25 aa, synthetic construct
  source 1..25: note = Seed: LNVIVHSATGFKQSSKALQRPVASD
LNVIVHSATGFKQFSTALFRPVASD

SEQ ID NO: 1634 - protein, 25 aa, synthetic construct
  source 1..25: note = Seed: LNVIVHSATGFKQSSKALQRPVASD
LNVIVHSATGFKQFSTALGRPVASD

SEQ ID NO: 1635 - protein, 25 aa, synthetic construct
  source 1..25: note = Seed: LNVIVHSATGFKQSSKALQRPVASD
LNVIVHSATGFKQFSTALHRPVASD

SEQ ID NO: 1636 - protein, 25 aa, synthetic construct
  source 1..25: note = Seed: LNVIVHSATGFKQSSKALQRPVASD
LNVIVHSATGFKQFSTALIRPVASD

SEQ ID NO: 1637 - protein, 25 aa, synthetic construct
  source 1..25: note = Seed: LNVIVHSATGFKQSSKALQRPVASD
LNVIVHSATGFKQFSTALKRPVASD

SEQ ID NO: 1638 - protein, 25 aa, synthetic construct
  source 1..25: note = Seed: LNVIVHSATGFKQSSKALQRPVASD
LNVIVHSATGFKQFSTALLRPVASD

SEQ ID NO: 1639 - protein, 25 aa, synthetic construct
  source 1..25: note = Seed: LNVIVHSATGFKQSSKALQRPVASD
LNVIVHSATGFKQFSTALMRPVASD

SEQ ID NO: 1640 - protein, 25 aa, synthetic construct
  source 1..25: note = Seed: LNVIVHSATGFKQSSKALQRPVASD
LNVIVHSATGFKQFSTALNRPVASD

SEQ ID NO: 1641 - protein, 25 aa, synthetic construct
  source 1..25: note = Seed: LNVIVHSATGFKQSSKALQRPVASD
LNVIVHSATGFKQFSTALQRPVASD

SEQ ID NO: 1642 - protein, 25 aa, synthetic construct
  source 1..25: note = Seed: LNVIVHSATGFKQSSKALQRPVASD
LNVIVHSATGFKQFSTALRRPVASD

SEQ ID NO: 1643 - protein, 25 aa, synthetic construct
  source 1..25: note = Seed: LNVIVHSATGFKQSSKALQRPVASD
LNVIVHSATGFKQFSTALSRPVASD

SEQ ID NO: 1644 - protein, 25 aa, synthetic construct
  source 1..25: note = Seed: LNVIVHSATGFKQSSKALQRPVASD
LNVIVHSATGFKQFSTALTRPVASD

SEQ ID NO: 1645 - protein, 25 aa, synthetic construct
  source 1..25: note = Seed: LNVIVHSATGFKQSSKALQRPVASD
LNVIVHSATGFKQFSTALVRPVASD

SEQ ID NO: 1646 - protein, 25 aa, synthetic construct
  source 1..25: note = Seed: LNVIVHSATGFKQSSKALQRPVASD
LNVIVHSATGFKQFSVALCRPVASD

SEQ ID NO: 1647 - protein, 25 aa, synthetic construct
  source 1..25: note = Seed: LNVIVHSATGFKQSSKALQRPVASD
LNVIVHSATGFKQFSVALDRPVASD

SEQ ID NO: 1648 - protein, 25 aa, synthetic construct
  source 1..25: note = Seed: LNVIVHSATGFKQSSKALQRPVASD
LNVIVHSATGFKQFSVALERPVASD

SEQ ID NO: 1649 - protein, 25 aa, synthetic construct
  source 1..25: note = Seed: LNVIVHSATGFKQSSKALQRPVASD
LNVIVHSATGFKQFSVALFRPVASD

SEQ ID NO: 1650 - protein, 25 aa, synthetic construct
  source 1..25: note = Seed: LNVIVHSATGFKQSSKALQRPVASD
LNVIVHSATGFKQFSVALGRPVASD

SEQ ID NO: 1651 - protein, 25 aa, synthetic construct
  source 1..25: note = Seed: LNVIVHSATGFKQSSKALQRPVASD
LNVIVHSATGFKQFSVALHRPVASD

SEQ ID NO: 1652 - protein, 25 aa, synthetic construct
  source 1..25: note = Seed: LNVIVHSATGFKQSSKALQRPVASD
LNVIVHSATGFKQFSVALIRPVASD

SEQ ID NO: 1653 - protein, 25 aa, synthetic construct
  source 1..25: note = Seed: LNVIVHSATGFKQSSKALQRPVASD
LNVIVHSATGFKQFSVALKRPVASD

SEQ ID NO: 1654 - protein, 25 aa, synthetic construct
  source 1..25: note = Seed: LNVIVHSATGFKQSSKALQRPVASD
LNVIVHSATGFKQFSVALLRPVASD

SEQ ID NO: 1655 - protein, 25 aa, synthetic construct
  source 1..25: note = Seed: LNVIVHSATGFKQSSKALQRPVASD
LNVIVHSATGFKQFSVALMRPVASD

SEQ ID NO: 1656 - protein, 25 aa, synthetic construct
  source 1..25: note = Seed: LNVIVHSATGFKQSSKALQRPVASD
LNVIVHSATGFKQFSVALNRPVASD

SEQ ID NO: 1657 - protein, 25 aa, synthetic construct
  source 1..25: note = Seed: LNVIVHSATGFKQSSKALQRPVASD
LNVIVHSATGFKQFSVALQRPVASD

SEQ ID NO: 1658 - protein, 25 aa, synthetic construct
  source 1..25: note = Seed: LNVIVHSATGFKQSSKALQRPVASD
LNVIVHSATGFKQFSVALRRPVASD

SEQ ID NO: 1659 - protein, 25 aa, synthetic construct
  source 1..25: note = Seed: LNVIVHSATGFKQSSKALQRPVASD
LNVIVHSATGFKQFSVALSRPVASD

SEQ ID NO: 1660 - protein, 25 aa, synthetic construct
  source 1..25: note = Seed: LNVIVHSATGFKQSSKALQRPVASD
LNVIVHSATGFKQFSVALVRPVASD

SEQ ID NO: 1661 - protein, 25 aa, synthetic construct
  source 1..25: note = Seed: LNVIVHSATGFKQSSKALQRPVASD
LNVIVHSATGFKQFSVALYRPVASD

SEQ ID NO: 1662 - protein, 25 aa, synthetic construct
  source 1..25: note = Seed: LNVIVHSATGFKQSSKALQRPVASD
LNVIVHSATGFKQGSAALARPVASD

SEQ ID NO: 1663 - protein, 25 aa, synthetic construct
  source 1..25: note = Seed: LNVIVHSATGFKQSSKALQRPVASD
LNVIVHSATGFKQGSAALCRPVASD

SEQ ID NO: 1664 - protein, 25 aa, synthetic construct
  source 1..25: note = Seed: LNVIVHSATGFKQSSKALQRPVASD
LNVIVHSATGFKQGSAALFRPVASD

SEQ ID NO: 1665 - protein, 25 aa, synthetic construct
  source 1..25: note = Seed: LNVIVHSATGFKQSSKALQRPVASD
LNVIVHSATGFKQGSAALGRPVASD

SEQ ID NO: 1666 - protein, 25 aa, synthetic construct
  source 1..25: note = Seed: LNVIVHSATGFKQSSKALQRPVASD
LNVIVHSATGFKQGSAALIRPVASD

SEQ ID NO: 1667 - protein, 25 aa, synthetic construct
  source 1..25: note = Seed: LNVIVHSATGFKQSSKALQRPVASD
LNVIVHSATGFKQGSAALLRPVASD

SEQ ID NO: 1668 - protein, 25 aa, synthetic construct
  source 1..25: note = Seed: LNVIVHSATGFKQSSKALQRPVASD
LNVIVHSATGFKQGSAALMRPVASD

SEQ ID NO: 1669 - protein, 25 aa, synthetic construct
  source 1..25: note = Seed: LNVIVHSATGFKQSSKALQRPVASD
LNVIVHSATGFKQGSAALNRPVASD

SEQ ID NO: 1670 - protein, 25 aa, synthetic construct
  source 1..25: note = Seed: LNVIVHSATGFKQSSKALQRPVASD
LNVIVHSATGFKQGSAALSRPVASD

SEQ ID NO: 1671 - protein, 25 aa, synthetic construct
  source 1..25: note = Seed: LNVIVHSATGFKQSSKALQRPVASD
LNVIVHSATGFKQGSAALTRPVASD

SEQ ID NO: 1672 - protein, 25 aa, synthetic construct
  source 1..25: note = Seed: LNVIVHSATGFKQSSKALQRPVASD
LNVIVHSATGFKQGSAALVRPVASD

SEQ ID NO: 1673 - protein, 25 aa, synthetic construct
  source 1..25: note = Seed: LNVIVHSATGFKQSSKALQRPVASD
LNVIVHSATGFKQGSAALYRPVASD

SEQ ID NO: 1674 - protein, 25 aa, synthetic construct
  source 1..25: note = Seed: LNVIVHSATGFKQSSKALQRPVASD
LNVIVHSATGFKQGSGALARPVASD

SEQ ID NO: 1675 - protein, 25 aa, synthetic construct
  source 1..25: note = Seed: LNVIVHSATGFKQSSKALQRPVASD
LNVIVHSATGFKQGSGALIRPVASD

SEQ ID NO: 1676 - protein, 25 aa, synthetic construct
  source 1..25: note = Seed: LNVIVHSATGFKQSSKALQRPVASD
LNVIVHSATGFKQGSGALLRPVASD

SEQ ID NO: 1677 - protein, 25 aa, synthetic construct
  source 1..25: note = Seed: LNVIVHSATGFKQSSKALQRPVASD
LNVIVHSATGFKQGSGALMRPVASD

SEQ ID NO: 1678 - protein, 25 aa, synthetic construct
  source 1..25: note = Seed: LNVIVHSATGFKQSSKALQRPVASD
LNVIVHSATGFKQGSGALSRPVASD

SEQ ID NO: 1679 - protein, 25 aa, synthetic construct
  source 1..25: note = Seed: LNVIVHSATGFKQSSKALQRPVASD
LNVIVHSATGFKQGSGALTRPVASD

SEQ ID NO: 1680 - protein, 25 aa, synthetic construct
  source 1..25: note = Seed: LNVIVHSATGFKQSSKALQRPVASD
LNVIVHSATGFKQGSGALVRPVASD

SEQ ID NO: 1681 - protein, 25 aa, synthetic construct
  source 1..25: note = Seed: LNVIVHSATGFKQSSKALQRPVASD
LNVIVHSATGFKQGSIALARPVASD

SEQ ID NO: 1682 - protein, 25 aa, synthetic construct
  source 1..25: note = Seed: LNVIVHSATGFKQSSKALQRPVASD
LNVIVHSATGFKQGSIALIRPVASD

SEQ ID NO: 1683 - protein, 25 aa, synthetic construct
  source 1..25: note = Seed: LNVIVHSATGFKQSSKALQRPVASD
LNVIVHSATGFKQGSIALNRPVASD

SEQ ID NO: 1684 - protein, 25 aa, synthetic construct
  source 1..25: note = Seed: LNVIVHSATGFKQSSKALQRPVASD
LNVIVHSATGFKQGSIALQRPVASD

SEQ ID NO: 1685 - protein, 25 aa, synthetic construct
  source 1..25: note = Seed: LNVIVHSATGFKQSSKALQRPVASD
LNVIVHSATGFKQGSIALSRPVASD

SEQ ID NO: 1686 - protein, 25 aa, synthetic construct
  source 1..25: note = Seed: LNVIVHSATGFKQSSKALQRPVASD
LNVIVHSATGFKQGSIALTRPVASD

SEQ ID NO: 1687 - protein, 25 aa, synthetic construct
  source 1..25: note = Seed: LNVIVHSATGFKQSSKALQRPVASD
LNVIVHSATGFKQGSIALVRPVASD

SEQ ID NO: 1688 - protein, 25 aa, synthetic construct
  source 1..25: note = Seed: LNVIVHSATGFKQSSKALQRPVASD
LNVIVHSATGFKQGSKALARPVASD

SEQ ID NO: 1689 - protein, 25 aa, synthetic construct
  source 1..25: note = Seed: LNVIVHSATGFKQSSKALQRPVASD
LNVIVHSATGFKQGSLALARPVASD

SEQ ID NO: 1690 - protein, 25 aa, synthetic construct
  source 1..25: note = Seed: LNVIVHSATGFKQSSKALQRPVASD
LNVIVHSATGFKQGSLALVRPVASD

SEQ ID NO: 1691 - protein, 25 aa, synthetic construct
  source 1..25: note = Seed: LNVIVHSATGFKQSSKALQRPVASD
LNVIVHSATGFKQGSMALARPVASD

SEQ ID NO: 1692 - protein, 25 aa, synthetic construct
  source 1..25: note = Seed: LNVIVHSATGFKQSSKALQRPVASD
LNVIVHSATGFKQGSMALLRPVASD

SEQ ID NO: 1693 - protein, 25 aa, synthetic construct
  source 1..25: note = Seed: LNVIVHSATGFKQSSKALQRPVASD
LNVIVHSATGFKQGSMALMRPVASD

SEQ ID NO: 1694 - protein, 25 aa, synthetic construct
  source 1..25: note = Seed: LNVIVHSATGFKQSSKALQRPVASD
LNVIVHSATGFKQGSNALARPVASD

SEQ ID NO: 1695 - protein, 25 aa, synthetic construct
  source 1..25: note = Seed: LNVIVHSATGFKQSSKALQRPVASD
LNVIVHSATGFKQGSNALIRPVASD

SEQ ID NO: 1696 - protein, 25 aa, synthetic construct
  source 1..25: note = Seed: LNVIVHSATGFKQSSKALQRPVASD
LNVIVHSATGFKQGSNALLRPVASD

SEQ ID NO: 1697 - protein, 25 aa, synthetic construct
  source 1..25: note = Seed: LNVIVHSATGFKQSSKALQRPVASD
LNVIVHSATGFKQGSNALMRPVASD

SEQ ID NO: 1698 - protein, 25 aa, synthetic construct
  source 1..25: note = Seed: LNVIVHSATGFKQSSKALQRPVASD
LNVIVHSATGFKQGSNALVRPVASD

SEQ ID NO: 1699 - protein, 25 aa, synthetic construct
  source 1..25: note = Seed: LNVIVHSATGFKQSSKALQRPVASD
LNVIVHSATGFKQGSPALARPVASD

SEQ ID NO: 1700 - protein, 25 aa, synthetic construct
  source 1..25: note = Seed: LNVIVHSATGFKQSSKALQRPVASD
LNVIVHSATGFKQGSPALIRPVASD

SEQ ID NO: 1701 - protein, 25 aa, synthetic construct
  source 1..25: note = Seed: LNVIVHSATGFKQSSKALQRPVASD
LNVIVHSATGFKQGSPALLRPVASD

SEQ ID NO: 1702 - protein, 25 aa, synthetic construct
  source 1..25: note = Seed: LNVIVHSATGFKQSSKALQRPVASD
LNVIVHSATGFKQGSPALMRPVASD

SEQ ID NO: 1703 - protein, 25 aa, synthetic construct
  source 1..25: note = Seed: LNVIVHSATGFKQSSKALQRPVASD
LNVIVHSATGFKQGSPALNRPVASD

SEQ ID NO: 1704 - protein, 25 aa, synthetic construct
  source 1..25: note = Seed: LNVIVHSATGFKQSSKALQRPVASD
LNVIVHSATGFKQGSPALSRPVASD

SEQ ID NO: 1705 - protein, 25 aa, synthetic construct
  source 1..25: note = Seed: LNVIVHSATGFKQSSKALQRPVASD
LNVIVHSATGFKQGSPALTRPVASD

SEQ ID NO: 1706 - protein, 25 aa, synthetic construct
  source 1..25: note = Seed: LNVIVHSATGFKQSSKALQRPVASD
LNVIVHSATGFKQGSPALVRPVASD

SEQ ID NO: 1707 - protein, 25 aa, synthetic construct
  source 1..25: note = Seed: LNVIVHSATGFKQSSKALQRPVASD
LNVIVHSATGFKQGSRALARPVASD

SEQ ID NO: 1708 - protein, 25 aa, synthetic construct
  source 1..25: note = Seed: LNVIVHSATGFKQSSKALQRPVASD
LNVIVHSATGFKQGSRALSRPVASD

SEQ ID NO: 1709 - protein, 25 aa, synthetic construct
  source 1..25: note = Seed: LNVIVHSATGFKQSSKALQRPVASD
LNVIVHSATGFKQGSSALARPVASD

SEQ ID NO: 1710 - protein, 25 aa, synthetic construct
  source 1..25: note = Seed: LNVIVHSATGFKQSSKALQRPVASD
LNVIVHSATGFKQGSSALIRPVASD

SEQ ID NO: 1711 - protein, 25 aa, synthetic construct
  source 1..25: note = Seed: LNVIVHSATGFKQSSKALQRPVASD
LNVIVHSATGFKQGSSALLRPVASD

SEQ ID NO: 1712 - protein, 25 aa, synthetic construct
  source 1..25: note = Seed: LNVIVHSATGFKQSSKALQRPVASD
LNVIVHSATGFKQGSSALMRPVASD

SEQ ID NO: 1713 - protein, 25 aa, synthetic construct
  source 1..25: note = Seed: LNVIVHSATGFKQSSKALQRPVASD
LNVIVHSATGFKQGSSALNRPVASD

SEQ ID NO: 1714 - protein, 25 aa, synthetic construct
  source 1..25: note = Seed: LNVIVHSATGFKQSSKALQRPVASD
LNVIVHSATGFKQGSSALSRPVASD

SEQ ID NO: 1715 - protein, 25 aa, synthetic construct
  source 1..25: note = Seed: LNVIVHSATGFKQSSKALQRPVASD
LNVIVHSATGFKQGSSALTRPVASD

SEQ ID NO: 1716 - protein, 25 aa, synthetic construct
  source 1..25: note = Seed: LNVIVHSATGFKQSSKALQRPVASD
LNVIVHSATGFKQGSSALVRPVASD

SEQ ID NO: 1717 - protein, 25 aa, synthetic construct
  source 1..25: note = Seed: LNVIVHSATGFKQSSKALQRPVASD
LNVIVHSATGFKQGSTALARPVASD

SEQ ID NO: 1718 - protein, 25 aa, synthetic construct
  source 1..25: note = Seed: LNVIVHSATGFKQSSKALQRPVASD
LNVIVHSATGFKQGSTALIRPVASD

SEQ ID NO: 1719 - protein, 25 aa, synthetic construct
  source 1..25: note = Seed: LNVIVHSATGFKQSSKALQRPVASD
LNVIVHSATGFKQGSTALLRPVASD

SEQ ID NO: 1720 - protein, 25 aa, synthetic construct
  source 1..25: note = Seed: LNVIVHSATGFKQSSKALQRPVASD
LNVIVHSATGFKQGSTALMRPVASD

SEQ ID NO: 1721 - protein, 25 aa, synthetic construct
  source 1..25: note = Seed: LNVIVHSATGFKQSSKALQRPVASD
LNVIVHSATGFKQGSTALNRPVASD

SEQ ID NO: 1722 - protein, 25 aa, synthetic construct
  source 1..25: note = Seed: LNVIVHSATGFKQSSKALQRPVASD
LNVIVHSATGFKQGSTALSRPVASD

SEQ ID NO: 1723 - protein, 25 aa, synthetic construct
  source 1..25: note = Seed: LNVIVHSATGFKQSSKALQRPVASD
LNVIVHSATGFKQGSTALVRPVASD

SEQ ID NO: 1724 - protein, 25 aa, synthetic construct
  source 1..25: note = Seed: LNVIVHSATGFKQSSKALQRPVASD
LNVIVHSATGFKQGSVALARPVASD

SEQ ID NO: 1725 - protein, 25 aa, synthetic construct
  source 1..25: note = Seed: LNVIVHSATGFKQSSKALQRPVASD
LNVIVHSATGFKQGSVALIRPVASD

SEQ ID NO: 1726 - protein, 25 aa, synthetic construct
  source 1..25: note = Seed: LNVIVHSATGFKQSSKALQRPVASD
LNVIVHSATGFKQGSVALLRPVASD

SEQ ID NO: 1727 - protein, 25 aa, synthetic construct
  source 1..25: note = Seed: LNVIVHSATGFKQSSKALQRPVASD
LNVIVHSATGFKQGSVALMRPVASD

SEQ ID NO: 1728 - protein, 25 aa, synthetic construct
  source 1..25: note = Seed: LNVIVHSATGFKQSSKALQRPVASD
LNVIVHSATGFKQGSVALNRPVASD

SEQ ID NO: 1729 - protein, 25 aa, synthetic construct
  source 1..25: note = Seed: LNVIVHSATGFKQSSKALQRPVASD
LNVIVHSATGFKQGSVALSRPVASD

SEQ ID NO: 1730 - protein, 25 aa, synthetic construct
  source 1..25: note = Seed: LNVIVHSATGFKQSSKALQRPVASD
LNVIVHSATGFKQGSVALVRPVASD

SEQ ID NO: 1731 - protein, 25 aa, synthetic construct
  source 1..25: note = Seed: LNVIVHSATGFKQSSKALQRPVASD
LNVIVHSATGFKQHSAALARPVASD

SEQ ID NO: 1732 - protein, 25 aa, synthetic construct
  source 1..25: note = Seed: LNVIVHSATGFKQSSKALQRPVASD
LNVIVHSATGFKQHSAALFRPVASD

SEQ ID NO: 1733 - protein, 25 aa, synthetic construct
  source 1..25: note = Seed: LNVIVHSATGFKQSSKALQRPVASD
LNVIVHSATGFKQHSAALGRPVASD

SEQ ID NO: 1734 - protein, 25 aa, synthetic construct
  source 1..25: note = Seed: LNVIVHSATGFKQSSKALQRPVASD
LNVIVHSATGFKQHSAALIRPVASD

SEQ ID NO: 1735 - protein, 25 aa, synthetic construct
  source 1..25: note = Seed: LNVIVHSATGFKQSSKALQRPVASD
LNVIVHSATGFKQHSAALLRPVASD

SEQ ID NO: 1736 - protein, 25 aa, synthetic construct
  source 1..25: note = Seed: LNVIVHSATGFKQSSKALQRPVASD
LNVIVHSATGFKQHSAALMRPVASD

SEQ ID NO: 1737 - protein, 25 aa, synthetic construct
  source 1..25: note = Seed: LNVIVHSATGFKQSSKALQRPVASD
LNVIVHSATGFKQHSAALNRPVASD

SEQ ID NO: 1738 - protein, 25 aa, synthetic construct
  source 1..25: note = Seed: LNVIVHSATGFKQSSKALQRPVASD
LNVIVHSATGFKQHSAALSRPVASD

SEQ ID NO: 1739 - protein, 25 aa, synthetic construct
  source 1..25: note = Seed: LNVIVHSATGFKQSSKALQRPVASD
LNVIVHSATGFKQHSAALTRPVASD

SEQ ID NO: 1740 - protein, 25 aa, synthetic construct
  source 1..25: note = Seed: LNVIVHSATGFKQSSKALQRPVASD
LNVIVHSATGFKQHSAALVRPVASD

SEQ ID NO: 1741 - protein, 25 aa, synthetic construct
  source 1..25: note = Seed: LNVIVHSATGFKQSSKALQRPVASD
LNVIVHSATGFKQHSFALFRPVASD

SEQ ID NO: 1742 - protein, 25 aa, synthetic construct
  source 1..25: note = Seed: LNVIVHSATGFKQSSKALQRPVASD
LNVIVHSATGFKQHSFALIRPVASD

SEQ ID NO: 1743 - protein, 25 aa, synthetic construct
  source 1..25: note = Seed: LNVIVHSATGFKQSSKALQRPVASD
LNVIVHSATGFKQHSFALLRPVASD

SEQ ID NO: 1744 - protein, 25 aa, synthetic construct
  source 1..25: note = Seed: LNVIVHSATGFKQSSKALQRPVASD
LNVIVHSATGFKQHSFALVRPVASD

SEQ ID NO: 1745 - protein, 25 aa, synthetic construct
  source 1..25: note = Seed: LNVIVHSATGFKQSSKALQRPVASD
LNVIVHSATGFKQHSGALARPVASD

SEQ ID NO: 1746 - protein, 25 aa, synthetic construct
  source 1..25: note = Seed: LNVIVHSATGFKQSSKALQRPVASD
LNVIVHSATGFKQHSGALIRPVASD

SEQ ID NO: 1747 - protein, 25 aa, synthetic construct
  source 1..25: note = Seed: LNVIVHSATGFKQSSKALQRPVASD
LNVIVHSATGFKQHSGALLRPVASD

SEQ ID NO: 1748 - protein, 25 aa, synthetic construct
  source 1..25: note = Seed: LNVIVHSATGFKQSSKALQRPVASD
LNVIVHSATGFKQHSGALMRPVASD

SEQ ID NO: 1749 - protein, 25 aa, synthetic construct
  source 1..25: note = Seed: LNVIVHSATGFKQSSKALQRPVASD
LNVIVHSATGFKQHSGALVRPVASD

SEQ ID NO: 1750 - protein, 25 aa, synthetic construct
  source 1..25: note = Seed: LNVIVHSATGFKQSSKALQRPVASD
LNVIVHSATGFKQHSIALARPVASD

SEQ ID NO: 1751 - protein, 25 aa, synthetic construct
  source 1..25: note = Seed: LNVIVHSATGFKQSSKALQRPVASD
LNVIVHSATGFKQHSIALNRPVASD

SEQ ID NO: 1752 - protein, 25 aa, synthetic construct
  source 1..25: note = Seed: LNVIVHSATGFKQSSKALQRPVASD
LNVIVHSATGFKQHSIALQRPVASD

SEQ ID NO: 1753 - protein, 25 aa, synthetic construct
  source 1..25: note = Seed: LNVIVHSATGFKQSSKALQRPVASD
LNVIVHSATGFKQHSIALSRPVASD

SEQ ID NO: 1754 - protein, 25 aa, synthetic construct
  source 1..25: note = Seed: LNVIVHSATGFKQSSKALQRPVASD
LNVIVHSATGFKQHSIALVRPVASD

SEQ ID NO: 1755 - protein, 25 aa, synthetic construct
  source 1..25: note = Seed: LNVIVHSATGFKQSSKALQRPVASD
LNVIVHSATGFKQHSLALARPVASD

SEQ ID NO: 1756 - protein, 25 aa, synthetic construct
  source 1..25: note = Seed: LNVIVHSATGFKQSSKALQRPVASD
LNVIVHSATGFKQHSLALSRPVASD

SEQ ID NO: 1757 - protein, 25 aa, synthetic construct
  source 1..25: note = Seed: LNVIVHSATGFKQSSKALQRPVASD
LNVIVHSATGFKQHSMALARPVASD

SEQ ID NO: 1758 - protein, 25 aa, synthetic construct
  source 1..25: note = Seed: LNVIVHSATGFKQSSKALQRPVASD
LNVIVHSATGFKQHSNALVRPVASD

SEQ ID NO: 1759 - protein, 25 aa, synthetic construct
  source 1..25: note = Seed: LNVIVHSATGFKQSSKALQRPVASD
LNVIVHSATGFKQHSPALARPVASD

SEQ ID NO: 1760 - protein, 25 aa, synthetic construct
  source 1..25: note = Seed: LNVIVHSATGFKQSSKALQRPVASD
LNVIVHSATGFKQHSPALIRPVASD

SEQ ID NO: 1761 - protein, 25 aa, synthetic construct
  source 1..25: note = Seed: LNVIVHSATGFKQSSKALQRPVASD
LNVIVHSATGFKQHSPALLRPVASD

SEQ ID NO: 1762 - protein, 25 aa, synthetic construct
  source 1..25: note = Seed: LNVIVHSATGFKQSSKALQRPVASD
LNVIVHSATGFKQHSPALVRPVASD

SEQ ID NO: 1763 - protein, 25 aa, synthetic construct
  source 1..25: note = Seed: LNVIVHSATGFKQSSKALQRPVASD
LNVIVHSATGFKQHSRALRRPVASD

SEQ ID NO: 1764 - protein, 25 aa, synthetic construct
  source 1..25: note = Seed: LNVIVHSATGFKQSSKALQRPVASD
LNVIVHSATGFKQHSSALARPVASD

SEQ ID NO: 1765 - protein, 25 aa, synthetic construct
  source 1..25: note = Seed: LNVIVHSATGFKQSSKALQRPVASD
LNVIVHSATGFKQHSSALFRPVASD

SEQ ID NO: 1766 - protein, 25 aa, synthetic construct
  source 1..25: note = Seed: LNVIVHSATGFKQSSKALQRPVASD
LNVIVHSATGFKQHSSALIRPVASD

SEQ ID NO: 1767 - protein, 25 aa, synthetic construct
  source 1..25: note = Seed: LNVIVHSATGFKQSSKALQRPVASD
LNVIVHSATGFKQHSSALLRPVASD

SEQ ID NO: 1768 - protein, 25 aa, synthetic construct
  source 1..25: note = Seed: LNVIVHSATGFKQSSKALQRPVASD
LNVIVHSATGFKQHSSALMRPVASD

SEQ ID NO: 1769 - protein, 25 aa, synthetic construct
  source 1..25: note = Seed: LNVIVHSATGFKQSSKALQRPVASD
LNVIVHSATGFKQHSSALVRPVASD

SEQ ID NO: 1770 - protein, 25 aa, synthetic construct
  source 1..25: note = Seed: LNVIVHSATGFKQSSKALQRPVASD
LNVIVHSATGFKQHSTALARPVASD

SEQ ID NO: 1771 - protein, 25 aa, synthetic construct
  source 1..25: note = Seed: LNVIVHSATGFKQSSKALQRPVASD
LNVIVHSATGFKQHSTALIRPVASD

SEQ ID NO: 1772 - protein, 25 aa, synthetic construct
  source 1..25: note = Seed: LNVIVHSATGFKQSSKALQRPVASD
LNVIVHSATGFKQHSTALLRPVASD

SEQ ID NO: 1773 - protein, 25 aa, synthetic construct
  source 1..25: note = Seed: LNVIVHSATGFKQSSKALQRPVASD
LNVIVHSATGFKQHSTALVRPVASD

SEQ ID NO: 1774 - protein, 25 aa, synthetic construct
  source 1..25: note = Seed: LNVIVHSATGFKQSSKALQRPVASD
LNVIVHSATGFKQHSVALARPVASD

SEQ ID NO: 1775 - protein, 25 aa, synthetic construct
  source 1..25: note = Seed: LNVIVHSATGFKQSSKALQRPVASD
LNVIVHSATGFKQHSVALIRPVASD

SEQ ID NO: 1776 - protein, 25 aa, synthetic construct
  source 1..25: note = Seed: LNVIVHSATGFKQSSKALQRPVASD
LNVIVHSATGFKQHSVALLRPVASD

SEQ ID NO: 1777 - protein, 25 aa, synthetic construct
  source 1..25: note = Seed: LNVIVHSATGFKQSSKALQRPVASD
LNVIVHSATGFKQHSVALNRPVASD

SEQ ID NO: 1778 - protein, 25 aa, synthetic construct
  source 1..25: note = Seed: LNVIVHSATGFKQSSKALQRPVASD
LNVIVHSATGFKQHSVALSRPVASD

SEQ ID NO: 1779 - protein, 25 aa, synthetic construct
  source 1..25: note = Seed: LNVIVHSATGFKQSSKALQRPVASD
LNVIVHSATGFKQHSVALVRPVASD

SEQ ID NO: 1780 - protein, 25 aa, synthetic construct
  source 1..25: note = Seed: LNVIVHSATGFKQSSKALQRPVASD
LNVIVHSATGFKQISAALCRPVASD

SEQ ID NO: 1781 - protein, 25 aa, synthetic construct
  source 1..25: note = Seed: LNVIVHSATGFKQSSKALQRPVASD
LNVIVHSATGFKQISAALDRPVASD

SEQ ID NO: 1782 - protein, 25 aa, synthetic construct
  source 1..25: note = Seed: LNVIVHSATGFKQSSKALQRPVASD
LNVIVHSATGFKQISAALERPVASD

SEQ ID NO: 1783 - protein, 25 aa, synthetic construct
  source 1..25: note = Seed: LNVIVHSATGFKQSSKALQRPVASD
LNVIVHSATGFKQISAALFRPVASD

SEQ ID NO: 1784 - protein, 25 aa, synthetic construct
  source 1..25: note = Seed: LNVIVHSATGFKQSSKALQRPVASD
LNVIVHSATGFKQISAALGRPVASD

SEQ ID NO: 1785 - protein, 25 aa, synthetic construct
  source 1..25: note = Seed: LNVIVHSATGFKQSSKALQRPVASD
LNVIVHSATGFKQISAALHRPVASD

SEQ ID NO: 1786 - protein, 25 aa, synthetic construct
  source 1..25: note = Seed: LNVIVHSATGFKQSSKALQRPVASD
LNVIVHSATGFKQISAALIRPVASD

SEQ ID NO: 1787 - protein, 25 aa, synthetic construct
  source 1..25: note = Seed: LNVIVHSATGFKQSSKALQRPVASD
LNVIVHSATGFKQISAALKRPVASD

SEQ ID NO: 1788 - protein, 25 aa, synthetic construct
  source 1..25: note = Seed: LNVIVHSATGFKQSSKALQRPVASD
LNVIVHSATGFKQISAALLRPVASD

SEQ ID NO: 1789 - protein, 25 aa, synthetic construct
  source 1..25: note = Seed: LNVIVHSATGFKQSSKALQRPVASD
LNVIVHSATGFKQISAALMRPVASD

SEQ ID NO: 1790 - protein, 25 aa, synthetic construct
  source 1..25: note = Seed: LNVIVHSATGFKQSSKALQRPVASD
LNVIVHSATGFKQISAALNRPVASD

SEQ ID NO: 1791 - protein, 25 aa, synthetic construct
  source 1..25: note = Seed: LNVIVHSATGFKQSSKALQRPVASD
LNVIVHSATGFKQISAALPRPVASD

SEQ ID NO: 1792 - protein, 25 aa, synthetic construct
  source 1..25: note = Seed: LNVIVHSATGFKQSSKALQRPVASD
LNVIVHSATGFKQISAALQRPVASD

SEQ ID NO: 1793 - protein, 25 aa, synthetic construct
  source 1..25: note = Seed: LNVIVHSATGFKQSSKALQRPVASD
LNVIVHSATGFKQISAALRRPVASD

SEQ ID NO: 1794 - protein, 25 aa, synthetic construct
  source 1..25: note = Seed: LNVIVHSATGFKQSSKALQRPVASD
LNVIVHSATGFKQISAALSRPVASD

SEQ ID NO: 1795 - protein, 25 aa, synthetic construct
  source 1..25: note = Seed: LNVIVHSATGFKQSSKALQRPVASD
LNVIVHSATGFKQISAALTRPVASD

SEQ ID NO: 1796 - protein, 25 aa, synthetic construct
  source 1..25: note = Seed: LNVIVHSATGFKQSSKALQRPVASD
LNVIVHSATGFKQISAALVRPVASD

SEQ ID NO: 1797 - protein, 25 aa, synthetic construct
  source 1..25: note = Seed: LNVIVHSATGFKQSSKALQRPVASD
LNVIVHSATGFKQISAALWRPVASD

SEQ ID NO: 1798 - protein, 25 aa, synthetic construct
  source 1..25: note = Seed: LNVIVHSATGFKQSSKALQRPVASD
LNVIVHSATGFKQISAALYRPVASD

SEQ ID NO: 1799 - protein, 25 aa, synthetic construct
  source 1..25: note = Seed: LNVIVHSATGFKQSSKALQRPVASD
LNVIVHSATGFKQISCALARPVASD

SEQ ID NO: 1800 - protein, 25 aa, synthetic construct
  source 1..25: note = Seed: LNVIVHSATGFKQSSKALQRPVASD
LNVIVHSATGFKQISCALNRPVASD

SEQ ID NO: 1801 - protein, 25 aa, synthetic construct
  source 1..25: note = Seed: LNVIVHSATGFKQSSKALQRPVASD
LNVIVHSATGFKQISCALSRPVASD

SEQ ID NO: 1802 - protein, 25 aa, synthetic construct
  source 1..25: note = Seed: LNVIVHSATGFKQSSKALQRPVASD
LNVIVHSATGFKQISCALTRPVASD

SEQ ID NO: 1803 - protein, 25 aa, synthetic construct
  source 1..25: note = Seed: LNVIVHSATGFKQSSKALQRPVASD
LNVIVHSATGFKQISCALVRPVASD

SEQ ID NO: 1804 - protein, 25 aa, synthetic construct
  source 1..25: note = Seed: LNVIVHSATGFKQSSKALQRPVASD
LNVIVHSATGFKQISDALARPVASD

SEQ ID NO: 1805 - protein, 25 aa, synthetic construct
  source 1..25: note = Seed: LNVIVHSATGFKQSSKALQRPVASD
LNVIVHSATGFKQISDALSRPVASD

SEQ ID NO: 1806 - protein, 25 aa, synthetic construct
  source 1..25: note = Seed: LNVIVHSATGFKQSSKALQRPVASD
LNVIVHSATGFKQISDALVRPVASD

SEQ ID NO: 1807 - protein, 25 aa, synthetic construct
  source 1..25: note = Seed: LNVIVHSATGFKQSSKALQRPVASD
LNVIVHSATGFKQISEALARPVASD

SEQ ID NO: 1808 - protein, 25 aa, synthetic construct
  source 1..25: note = Seed: LNVIVHSATGFKQSSKALQRPVASD
LNVIVHSATGFKQISEALNRPVASD

SEQ ID NO: 1809 - protein, 25 aa, synthetic construct
  source 1..25: note = Seed: LNVIVHSATGFKQSSKALQRPVASD
LNVIVHSATGFKQISEALSRPVASD

SEQ ID NO: 1810 - protein, 25 aa, synthetic construct
  source 1..25: note = Seed: LNVIVHSATGFKQSSKALQRPVASD
LNVIVHSATGFKQISEALTRPVASD

SEQ ID NO: 1811 - protein, 25 aa, synthetic construct
  source 1..25: note = Seed: LNVIVHSATGFKQSSKALQRPVASD
LNVIVHSATGFKQISEALVRPVASD

SEQ ID NO: 1812 - protein, 25 aa, synthetic construct
  source 1..25: note = Seed: LNVIVHSATGFKQSSKALQRPVASD
LNVIVHSATGFKQISFALARPVASD

SEQ ID NO: 1813 - protein, 25 aa, synthetic construct
  source 1..25: note = Seed: LNVIVHSATGFKQSSKALQRPVASD
LNVIVHSATGFKQISFALDRPVASD

SEQ ID NO: 1814 - protein, 25 aa, synthetic construct
  source 1..25: note = Seed: LNVIVHSATGFKQSSKALQRPVASD
LNVIVHSATGFKQISFALERPVASD

SEQ ID NO: 1815 - protein, 25 aa, synthetic construct
  source 1..25: note = Seed: LNVIVHSATGFKQSSKALQRPVASD
LNVIVHSATGFKQISFALGRPVASD

SEQ ID NO: 1816 - protein, 25 aa, synthetic construct
  source 1..25: note = Seed: LNVIVHSATGFKQSSKALQRPVASD
LNVIVHSATGFKQISFALIRPVASD

SEQ ID NO: 1817 - protein, 25 aa, synthetic construct
  source 1..25: note = Seed: LNVIVHSATGFKQSSKALQRPVASD
LNVIVHSATGFKQISFALLRPVASD

SEQ ID NO: 1818 - protein, 25 aa, synthetic construct
  source 1..25: note = Seed: LNVIVHSATGFKQSSKALQRPVASD
LNVIVHSATGFKQISFALMRPVASD

SEQ ID NO: 1819 - protein, 25 aa, synthetic construct
  source 1..25: note = Seed: LNVIVHSATGFKQSSKALQRPVASD
LNVIVHSATGFKQISFALNRPVASD

SEQ ID NO: 1820 - protein, 25 aa, synthetic construct
  source 1..25: note = Seed: LNVIVHSATGFKQSSKALQRPVASD
LNVIVHSATGFKQISFALSRPVASD

SEQ ID NO: 1821 - protein, 25 aa, synthetic construct
  source 1..25: note = Seed: LNVIVHSATGFKQSSKALQRPVASD
LNVIVHSATGFKQISFALTRPVASD

SEQ ID NO: 1822 - protein, 25 aa, synthetic construct
  source 1..25: note = Seed: LNVIVHSATGFKQSSKALQRPVASD
LNVIVHSATGFKQISFALVRPVASD

SEQ ID NO: 1823 - protein, 25 aa, synthetic construct
  source 1..25: note = Seed: LNVIVHSATGFKQSSKALQRPVASD
LNVIVHSATGFKQISFALYRPVASD

SEQ ID NO: 1824 - protein, 25 aa, synthetic construct
  source 1..25: note = Seed: LNVIVHSATGFKQSSKALQRPVASD
LNVIVHSATGFKQISGALARPVASD

SEQ ID NO: 1825 - protein, 25 aa, synthetic construct
  source 1..25: note = Seed: LNVIVHSATGFKQSSKALQRPVASD
LNVIVHSATGFKQISGALCRPVASD

SEQ ID NO: 1826 - protein, 25 aa, synthetic construct
  source 1..25: note = Seed: LNVIVHSATGFKQSSKALQRPVASD
LNVIVHSATGFKQISGALDRPVASD

SEQ ID NO: 1827 - protein, 25 aa, synthetic construct
  source 1..25: note = Seed: LNVIVHSATGFKQSSKALQRPVASD
LNVIVHSATGFKQISGALERPVASD

SEQ ID NO: 1828 - protein, 25 aa, synthetic construct
  source 1..25: note = Seed: LNVIVHSATGFKQSSKALQRPVASD
LNVIVHSATGFKQISGALFRPVASD

SEQ ID NO: 1829 - protein, 25 aa, synthetic construct
  source 1..25: note = Seed: LNVIVHSATGFKQSSKALQRPVASD
LNVIVHSATGFKQISGALGRPVASD

SEQ ID NO: 1830 - protein, 25 aa, synthetic construct
  source 1..25: note = Seed: LNVIVHSATGFKQSSKALQRPVASD
LNVIVHSATGFKQISGALHRPVASD

SEQ ID NO: 1831 - protein, 25 aa, synthetic construct
  source 1..25: note = Seed: LNVIVHSATGFKQSSKALQRPVASD
LNVIVHSATGFKQISGALIRPVASD

SEQ ID NO: 1832 - protein, 25 aa, synthetic construct
  source 1..25: note = Seed: LNVIVHSATGFKQSSKALQRPVASD
LNVIVHSATGFKQISGALLRPVASD

SEQ ID NO: 1833 - protein, 25 aa, synthetic construct
  source 1..25: note = Seed: LNVIVHSATGFKQSSKALQRPVASD
LNVIVHSATGFKQISGALMRPVASD

SEQ ID NO: 1834 - protein, 25 aa, synthetic construct
  source 1..25: note = Seed: LNVIVHSATGFKQSSKALQRPVASD
LNVIVHSATGFKQISGALNRPVASD

SEQ ID NO: 1835 - protein, 25 aa, synthetic construct
  source 1..25: note = Seed: LNVIVHSATGFKQSSKALQRPVASD
LNVIVHSATGFKQISGALPRPVASD

SEQ ID NO: 1836 - protein, 25 aa, synthetic construct
  source 1..25: note = Seed: LNVIVHSATGFKQSSKALQRPVASD
LNVIVHSATGFKQISGALQRPVASD

SEQ ID NO: 1837 - protein, 25 aa, synthetic construct
  source 1..25: note = Seed: LNVIVHSATGFKQSSKALQRPVASD
LNVIVHSATGFKQISGALRRPVASD

SEQ ID NO: 1838 - protein, 25 aa, synthetic construct
  source 1..25: note = Seed: LNVIVHSATGFKQSSKALQRPVASD
LNVIVHSATGFKQISGALSRPVASD

SEQ ID NO: 1839 - protein, 25 aa, synthetic construct
  source 1..25: note = Seed: LNVIVHSATGFKQSSKALQRPVASD
LNVIVHSATGFKQISGALTRPVASD

SEQ ID NO: 1840 - protein, 25 aa, synthetic construct
  source 1..25: note = Seed: LNVIVHSATGFKQSSKALQRPVASD
LNVIVHSATGFKQISGALVRPVASD

SEQ ID NO: 1841 - protein, 25 aa, synthetic construct
  source 1..25: note = Seed: LNVIVHSATGFKQSSKALQRPVASD
LNVIVHSATGFKQISGALYRPVASD

SEQ ID NO: 1842 - protein, 25 aa, synthetic construct
  source 1..25: note = Seed: LNVIVHSATGFKQSSKALQRPVASD
LNVIVHSATGFKQISHALARPVASD

SEQ ID NO: 1843 - protein, 25 aa, synthetic construct
  source 1..25: note = Seed: LNVIVHSATGFKQSSKALQRPVASD
LNVIVHSATGFKQISHALGRPVASD

SEQ ID NO: 1844 - protein, 25 aa, synthetic construct
  source 1..25: note = Seed: LNVIVHSATGFKQSSKALQRPVASD
LNVIVHSATGFKQISHALHRPVASD

SEQ ID NO: 1845 - protein, 25 aa, synthetic construct
  source 1..25: note = Seed: LNVIVHSATGFKQSSKALQRPVASD
LNVIVHSATGFKQISHALIRPVASD

SEQ ID NO: 1846 - protein, 25 aa, synthetic construct
  source 1..25: note = Seed: LNVIVHSATGFKQSSKALQRPVASD
LNVIVHSATGFKQISHALKRPVASD

SEQ ID NO: 1847 - protein, 25 aa, synthetic construct
  source 1..25: note = Seed: LNVIVHSATGFKQSSKALQRPVASD
LNVIVHSATGFKQISHALLRPVASD

SEQ ID NO: 1848 - protein, 25 aa, synthetic construct
  source 1..25: note = Seed: LNVIVHSATGFKQSSKALQRPVASD
LNVIVHSATGFKQISHALMRPVASD

SEQ ID NO: 1849 - protein, 25 aa, synthetic construct
  source 1..25: note = Seed: LNVIVHSATGFKQSSKALQRPVASD
LNVIVHSATGFKQISHALNRPVASD

SEQ ID NO: 1850 - protein, 25 aa, synthetic construct
  source 1..25: note = Seed: LNVIVHSATGFKQSSKALQRPVASD
LNVIVHSATGFKQISHALQRPVASD

SEQ ID NO: 1851 - protein, 25 aa, synthetic construct
  source 1..25: note = Seed: LNVIVHSATGFKQSSKALQRPVASD
LNVIVHSATGFKQISHALRRPVASD

SEQ ID NO: 1852 - protein, 25 aa, synthetic construct
  source 1..25: note = Seed: LNVIVHSATGFKQSSKALQRPVASD
LNVIVHSATGFKQISHALSRPVASD

SEQ ID NO: 1853 - protein, 25 aa, synthetic construct
  source 1..25: note = Seed: LNVIVHSATGFKQSSKALQRPVASD
LNVIVHSATGFKQISHALTRPVASD

SEQ ID NO: 1854 - protein, 25 aa, synthetic construct
  source 1..25: note = Seed: LNVIVHSATGFKQSSKALQRPVASD
LNVIVHSATGFKQISHALVRPVASD

SEQ ID NO: 1855 - protein, 25 aa, synthetic construct
  source 1..25: note = Seed: LNVIVHSATGFKQSSKALQRPVASD
LNVIVHSATGFKQISIALARPVASD

SEQ ID NO: 1856 - protein, 25 aa, synthetic construct
  source 1..25: note = Seed: LNVIVHSATGFKQSSKALQRPVASD
LNVIVHSATGFKQISIALCRPVASD

SEQ ID NO: 1857 - protein, 25 aa, synthetic construct
  source 1..25: note = Seed: LNVIVHSATGFKQSSKALQRPVASD
LNVIVHSATGFKQISIALDRPVASD

SEQ ID NO: 1858 - protein, 25 aa, synthetic construct
  source 1..25: note = Seed: LNVIVHSATGFKQSSKALQRPVASD
LNVIVHSATGFKQISIALERPVASD

SEQ ID NO: 1859 - protein, 25 aa, synthetic construct
  source 1..25: note = Seed: LNVIVHSATGFKQSSKALQRPVASD
LNVIVHSATGFKQISIALFRPVASD

SEQ ID NO: 1860 - protein, 25 aa, synthetic construct
  source 1..25: note = Seed: LNVIVHSATGFKQSSKALQRPVASD
LNVIVHSATGFKQISIALGRPVASD

SEQ ID NO: 1861 - protein, 25 aa, synthetic construct
  source 1..25: note = Seed: LNVIVHSATGFKQSSKALQRPVASD
LNVIVHSATGFKQISIALHRPVASD

SEQ ID NO: 1862 - protein, 25 aa, synthetic construct
  source 1..25: note = Seed: LNVIVHSATGFKQSSKALQRPVASD
LNVIVHSATGFKQISIALIRPVASD

SEQ ID NO: 1863 - protein, 25 aa, synthetic construct
  source 1..25: note = Seed: LNVIVHSATGFKQSSKALQRPVASD
LNVIVHSATGFKQISIALKRPVASD

SEQ ID NO: 1864 - protein, 25 aa, synthetic construct
  source 1..25: note = Seed: LNVIVHSATGFKQSSKALQRPVASD
LNVIVHSATGFKQISIALLRPVASD

SEQ ID NO: 1865 - protein, 25 aa, synthetic construct
  source 1..25: note = Seed: LNVIVHSATGFKQSSKALQRPVASD
LNVIVHSATGFKQISIALMRPVASD

SEQ ID NO: 1866 - protein, 25 aa, synthetic construct
  source 1..25: note = Seed: LNVIVHSATGFKQSSKALQRPVASD
LNVIVHSATGFKQISIALNRPVASD

SEQ ID NO: 1867 - protein, 25 aa, synthetic construct
  source 1..25: note = Seed: LNVIVHSATGFKQSSKALQRPVASD
LNVIVHSATGFKQISIALPRPVASD

SEQ ID NO: 1868 - protein, 25 aa, synthetic construct
  source 1..25: note = Seed: LNVIVHSATGFKQSSKALQRPVASD
LNVIVHSATGFKQISIALQRPVASD

SEQ ID NO: 1869 - protein, 25 aa, synthetic construct
  source 1..25: note = Seed: LNVIVHSATGFKQSSKALQRPVASD
LNVIVHSATGFKQISIALSRPVASD

SEQ ID NO: 1870 - protein, 25 aa, synthetic construct
  source 1..25: note = Seed: LNVIVHSATGFKQSSKALQRPVASD
LNVIVHSATGFKQISIALTRPVASD

SEQ ID NO: 1871 - protein, 25 aa, synthetic construct
  source 1..25: note = Seed: LNVIVHSATGFKQSSKALQRPVASD
LNVIVHSATGFKQISIALVRPVASD

SEQ ID NO: 1872 - protein, 25 aa, synthetic construct
  source 1..25: note = Seed: LNVIVHSATGFKQSSKALQRPVASD
LNVIVHSATGFKQISIALYRPVASD

SEQ ID NO: 1873 - protein, 25 aa, synthetic construct
  source 1..25: note = Seed: LNVIVHSATGFKQSSKALQRPVASD
LNVIVHSATGFKQISKALARPVASD

SEQ ID NO: 1874 - protein, 25 aa, synthetic construct
  source 1..25: note = Seed: LNVIVHSATGFKQSSKALQRPVASD
LNVIVHSATGFKQISKALCRPVASD

SEQ ID NO: 1875 - protein, 25 aa, synthetic construct
  source 1..25: note = Seed: LNVIVHSATGFKQSSKALQRPVASD
LNVIVHSATGFKQISKALDRPVASD

SEQ ID NO: 1876 - protein, 25 aa, synthetic construct
  source 1..25: note = Seed: LNVIVHSATGFKQSSKALQRPVASD
LNVIVHSATGFKQISKALERPVASD

SEQ ID NO: 1877 - protein, 25 aa, synthetic construct
  source 1..25: note = Seed: LNVIVHSATGFKQSSKALQRPVASD
LNVIVHSATGFKQISKALFRPVASD

SEQ ID NO: 1878 - protein, 25 aa, synthetic construct
  source 1..25: note = Seed: LNVIVHSATGFKQSSKALQRPVASD
LNVIVHSATGFKQISKALGRPVASD

SEQ ID NO: 1879 - protein, 25 aa, synthetic construct
  source 1..25: note = Seed: LNVIVHSATGFKQSSKALQRPVASD
LNVIVHSATGFKQISKALHRPVASD

SEQ ID NO: 1880 - protein, 25 aa, synthetic construct
  source 1..25: note = Seed: LNVIVHSATGFKQSSKALQRPVASD
LNVIVHSATGFKQISKALIRPVASD

SEQ ID NO: 1881 - protein, 25 aa, synthetic construct
  source 1..25: note = Seed: LNVIVHSATGFKQSSKALQRPVASD
LNVIVHSATGFKQISKALKRPVASD

SEQ ID NO: 1882 - protein, 25 aa, synthetic construct
  source 1..25: note = Seed: LNVIVHSATGFKQSSKALQRPVASD
LNVIVHSATGFKQISKALLRPVASD

SEQ ID NO: 1883 - protein, 25 aa, synthetic construct
  source 1..25: note = Seed: LNVIVHSATGFKQSSKALQRPVASD
LNVIVHSATGFKQISKALMRPVASD

SEQ ID NO: 1884 - protein, 25 aa, synthetic construct
  source 1..25: note = Seed: LNVIVHSATGFKQSSKALQRPVASD
LNVIVHSATGFKQISKALNRPVASD

SEQ ID NO: 1885 - protein, 25 aa, synthetic construct
  source 1..25: note = Seed: LNVIVHSATGFKQSSKALQRPVASD
LNVIVHSATGFKQISKALPRPVASD

SEQ ID NO: 1886 - protein, 25 aa, synthetic construct
  source 1..25: note = Seed: LNVIVHSATGFKQSSKALQRPVASD
LNVIVHSATGFKQISKALQRPVASD

SEQ ID NO: 1887 - protein, 25 aa, synthetic construct
  source 1..25: note = Seed: LNVIVHSATGFKQSSKALQRPVASD
LNVIVHSATGFKQISKALRRPVASD

SEQ ID NO: 1888 - protein, 25 aa, synthetic construct
  source 1..25: note = Seed: LNVIVHSATGFKQSSKALQRPVASD
LNVIVHSATGFKQISKALSRPVASD

SEQ ID NO: 1889 - protein, 25 aa, synthetic construct
  source 1..25: note = Seed: LNVIVHSATGFKQSSKALQRPVASD
LNVIVHSATGFKQISKALTRPVASD

SEQ ID NO: 1890 - protein, 25 aa, synthetic construct
  source 1..25: note = Seed: LNVIVHSATGFKQSSKALQRPVASD
LNVIVHSATGFKQISKALVRPVASD

SEQ ID NO: 1891 - protein, 25 aa, synthetic construct
  source 1..25: note = Seed: LNVIVHSATGFKQSSKALQRPVASD
LNVIVHSATGFKQISKALWRPVASD

SEQ ID NO: 1892 - protein, 25 aa, synthetic construct
  source 1..25: note = Seed: LNVIVHSATGFKQSSKALQRPVASD
LNVIVHSATGFKQISKALYRPVASD

SEQ ID NO: 1893 - protein, 25 aa, synthetic construct
  source 1..25: note = Seed: LNVIVHSATGFKQSSKALQRPVASD
LNVIVHSATGFKQISLALARPVASD

SEQ ID NO: 1894 - protein, 25 aa, synthetic construct
  source 1..25: note = Seed: LNVIVHSATGFKQSSKALQRPVASD
LNVIVHSATGFKQISLALDRPVASD

SEQ ID NO: 1895 - protein, 25 aa, synthetic construct
  source 1..25: note = Seed: LNVIVHSATGFKQSSKALQRPVASD
LNVIVHSATGFKQISLALERPVASD

SEQ ID NO: 1896 - protein, 25 aa, synthetic construct
  source 1..25: note = Seed: LNVIVHSATGFKQSSKALQRPVASD
LNVIVHSATGFKQISLALFRPVASD

SEQ ID NO: 1897 - protein, 25 aa, synthetic construct
  source 1..25: note = Seed: LNVIVHSATGFKQSSKALQRPVASD
LNVIVHSATGFKQISLALGRPVASD

SEQ ID NO: 1898 - protein, 25 aa, synthetic construct
  source 1..25: note = Seed: LNVIVHSATGFKQSSKALQRPVASD
LNVIVHSATGFKQISLALHRPVASD

SEQ ID NO: 1899 - protein, 25 aa, synthetic construct
  source 1..25: note = Seed: LNVIVHSATGFKQSSKALQRPVASD
LNVIVHSATGFKQISLALIRPVASD

SEQ ID NO: 1900 - protein, 25 aa, synthetic construct
  source 1..25: note = Seed: LNVIVHSATGFKQSSKALQRPVASD
LNVIVHSATGFKQISLALLRPVASD

SEQ ID NO: 1901 - protein, 25 aa, synthetic construct
  source 1..25: note = Seed: LNVIVHSATGFKQSSKALQRPVASD
LNVIVHSATGFKQISLALMRPVASD

SEQ ID NO: 1902 - protein, 25 aa, synthetic construct
  source 1..25: note = Seed: LNVIVHSATGFKQSSKALQRPVASD
LNVIVHSATGFKQISLALNRPVASD

SEQ ID NO: 1903 - protein, 25 aa, synthetic construct
  source 1..25: note = Seed: LNVIVHSATGFKQSSKALQRPVASD
LNVIVHSATGFKQISLALQRPVASD

SEQ ID NO: 1904 - protein, 25 aa, synthetic construct
  source 1..25: note = Seed: LNVIVHSATGFKQSSKALQRPVASD
LNVIVHSATGFKQISLALSRPVASD

SEQ ID NO: 1905 - protein, 25 aa, synthetic construct
  source 1..25: note = Seed: LNVIVHSATGFKQSSKALQRPVASD
LNVIVHSATGFKQISLALTRPVASD

SEQ ID NO: 1906 - protein, 25 aa, synthetic construct
  source 1..25: note = Seed: LNVIVHSATGFKQSSKALQRPVASD
LNVIVHSATGFKQISLALVRPVASD

SEQ ID NO: 1907 - protein, 25 aa, synthetic construct
  source 1..25: note = Seed: LNVIVHSATGFKQSSKALQRPVASD
LNVIVHSATGFKQISMALARPVASD

SEQ ID NO: 1908 - protein, 25 aa, synthetic construct
  source 1..25: note = Seed: LNVIVHSATGFKQSSKALQRPVASD
LNVIVHSATGFKQISMALCRPVASD

SEQ ID NO: 1909 - protein, 25 aa, synthetic construct
  source 1..25: note = Seed: LNVIVHSATGFKQSSKALQRPVASD
LNVIVHSATGFKQISMALDRPVASD

SEQ ID NO: 1910 - protein, 25 aa, synthetic construct
  source 1..25: note = Seed: LNVIVHSATGFKQSSKALQRPVASD
LNVIVHSATGFKQISMALERPVASD

SEQ ID NO: 1911 - protein, 25 aa, synthetic construct
  source 1..25: note = Seed: LNVIVHSATGFKQSSKALQRPVASD
LNVIVHSATGFKQISMALFRPVASD

SEQ ID NO: 1912 - protein, 25 aa, synthetic construct
  source 1..25: note = Seed: LNVIVHSATGFKQSSKALQRPVASD
LNVIVHSATGFKQISMALGRPVASD

SEQ ID NO: 1913 - protein, 25 aa, synthetic construct
  source 1..25: note = Seed: LNVIVHSATGFKQSSKALQRPVASD
LNVIVHSATGFKQISMALHRPVASD

SEQ ID NO: 1914 - protein, 25 aa, synthetic construct
  source 1..25: note = Seed: LNVIVHSATGFKQSSKALQRPVASD
LNVIVHSATGFKQISMALIRPVASD

SEQ ID NO: 1915 - protein, 25 aa, synthetic construct
  source 1..25: note = Seed: LNVIVHSATGFKQSSKALQRPVASD
LNVIVHSATGFKQISMALLRPVASD

SEQ ID NO: 1916 - protein, 25 aa, synthetic construct
  source 1..25: note = Seed: LNVIVHSATGFKQSSKALQRPVASD
LNVIVHSATGFKQISMALMRPVASD

SEQ ID NO: 1917 - protein, 25 aa, synthetic construct
  source 1..25: note = Seed: LNVIVHSATGFKQSSKALQRPVASD
LNVIVHSATGFKQISMALNRPVASD

SEQ ID NO: 1918 - protein, 25 aa, synthetic construct
  source 1..25: note = Seed: LNVIVHSATGFKQSSKALQRPVASD
LNVIVHSATGFKQISMALQRPVASD

SEQ ID NO: 1919 - protein, 25 aa, synthetic construct
  source 1..25: note = Seed: LNVIVHSATGFKQSSKALQRPVASD
LNVIVHSATGFKQISMALSRPVASD

SEQ ID NO: 1920 - protein, 25 aa, synthetic construct
  source 1..25: note = Seed: LNVIVHSATGFKQSSKALQRPVASD
LNVIVHSATGFKQISMALTRPVASD

SEQ ID NO: 1921 - protein, 25 aa, synthetic construct
  source 1..25: note = Seed: LNVIVHSATGFKQSSKALQRPVASD
LNVIVHSATGFKQISMALVRPVASD

SEQ ID NO: 1922 - protein, 25 aa, synthetic construct
  source 1..25: note = Seed: LNVIVHSATGFKQSSKALQRPVASD
LNVIVHSATGFKQISNALARPVASD

SEQ ID NO: 1923 - protein, 25 aa, synthetic construct
  source 1..25: note = Seed: LNVIVHSATGFKQSSKALQRPVASD
LNVIVHSATGFKQISNALCRPVASD

SEQ ID NO: 1924 - protein, 25 aa, synthetic construct
  source 1..25: note = Seed: LNVIVHSATGFKQSSKALQRPVASD
LNVIVHSATGFKQISNALDRPVASD

SEQ ID NO: 1925 - protein, 25 aa, synthetic construct
  source 1..25: note = Seed: LNVIVHSATGFKQSSKALQRPVASD
LNVIVHSATGFKQISNALERPVASD

SEQ ID NO: 1926 - protein, 25 aa, synthetic construct
  source 1..25: note = Seed: LNVIVHSATGFKQSSKALQRPVASD
LNVIVHSATGFKQISNALFRPVASD

SEQ ID NO: 1927 - protein, 25 aa, synthetic construct
  source 1..25: note = Seed: LNVIVHSATGFKQSSKALQRPVASD
LNVIVHSATGFKQISNALGRPVASD

SEQ ID NO: 1928 - protein, 25 aa, synthetic construct
  source 1..25: note = Seed: LNVIVHSATGFKQSSKALQRPVASD
LNVIVHSATGFKQISNALHRPVASD

SEQ ID NO: 1929 - protein, 25 aa, synthetic construct
  source 1..25: note = Seed: LNVIVHSATGFKQSSKALQRPVASD
LNVIVHSATGFKQISNALIRPVASD

SEQ ID NO: 1930 - protein, 25 aa, synthetic construct
  source 1..25: note = Seed: LNVIVHSATGFKQSSKALQRPVASD
LNVIVHSATGFKQISNALLRPVASD

SEQ ID NO: 1931 - protein, 25 aa, synthetic construct
  source 1..25: note = Seed: LNVIVHSATGFKQSSKALQRPVASD
LNVIVHSATGFKQISNALMRPVASD

SEQ ID NO: 1932 - protein, 25 aa, synthetic construct
  source 1..25: note = Seed: LNVIVHSATGFKQSSKALQRPVASD
LNVIVHSATGFKQISNALNRPVASD

SEQ ID NO: 1933 - protein, 25 aa, synthetic construct
  source 1..25: note = Seed: LNVIVHSATGFKQSSKALQRPVASD
LNVIVHSATGFKQISNALPRPVASD

SEQ ID NO: 1934 - protein, 25 aa, synthetic construct
  source 1..25: note = Seed: LNVIVHSATGFKQSSKALQRPVASD
LNVIVHSATGFKQISNALQRPVASD

SEQ ID NO: 1935 - protein, 25 aa, synthetic construct
  source 1..25: note = Seed: LNVIVHSATGFKQSSKALQRPVASD
LNVIVHSATGFKQISNALSRPVASD

SEQ ID NO: 1936 - protein, 25 aa, synthetic construct
  source 1..25: note = Seed: LNVIVHSATGFKQSSKALQRPVASD
LNVIVHSATGFKQISNALTRPVASD

SEQ ID NO: 1937 - protein, 25 aa, synthetic construct
  source 1..25: note = Seed: LNVIVHSATGFKQSSKALQRPVASD
LNVIVHSATGFKQISNALVRPVASD

SEQ ID NO: 1938 - protein, 25 aa, synthetic construct
  source 1..25: note = Seed: LNVIVHSATGFKQSSKALQRPVASD
LNVIVHSATGFKQISPALARPVASD

SEQ ID NO: 1939 - protein, 25 aa, synthetic construct
  source 1..25: note = Seed: LNVIVHSATGFKQSSKALQRPVASD
LNVIVHSATGFKQISPALCRPVASD

SEQ ID NO: 1940 - protein, 25 aa, synthetic construct
  source 1..25: note = Seed: LNVIVHSATGFKQSSKALQRPVASD
LNVIVHSATGFKQISPALDRPVASD

SEQ ID NO: 1941 - protein, 25 aa, synthetic construct
  source 1..25: note = Seed: LNVIVHSATGFKQSSKALQRPVASD
LNVIVHSATGFKQISPALERPVASD

SEQ ID NO: 1942 - protein, 25 aa, synthetic construct
  source 1..25: note = Seed: LNVIVHSATGFKQSSKALQRPVASD
LNVIVHSATGFKQISPALFRPVASD

SEQ ID NO: 1943 - protein, 25 aa, synthetic construct
  source 1..25: note = Seed: LNVIVHSATGFKQSSKALQRPVASD
LNVIVHSATGFKQISPALGRPVASD

SEQ ID NO: 1944 - protein, 25 aa, synthetic construct
  source 1..25: note = Seed: LNVIVHSATGFKQSSKALQRPVASD
LNVIVHSATGFKQISPALHRPVASD

SEQ ID NO: 1945 - protein, 25 aa, synthetic construct
  source 1..25: note = Seed: LNVIVHSATGFKQSSKALQRPVASD
LNVIVHSATGFKQISPALIRPVASD

SEQ ID NO: 1946 - protein, 25 aa, synthetic construct
  source 1..25: note = Seed: LNVIVHSATGFKQSSKALQRPVASD
LNVIVHSATGFKQISPALKRPVASD

SEQ ID NO: 1947 - protein, 25 aa, synthetic construct
  source 1..25: note = Seed: LNVIVHSATGFKQSSKALQRPVASD
LNVIVHSATGFKQISPALLRPVASD

SEQ ID NO: 1948 - protein, 25 aa, synthetic construct
  source 1..25: note = Seed: LNVIVHSATGFKQSSKALQRPVASD
LNVIVHSATGFKQISPALMRPVASD

SEQ ID NO: 1949 - protein, 25 aa, synthetic construct
  source 1..25: note = Seed: LNVIVHSATGFKQSSKALQRPVASD
LNVIVHSATGFKQISPALNRPVASD

SEQ ID NO: 1950 - protein, 25 aa, synthetic construct
  source 1..25: note = Seed: LNVIVHSATGFKQSSKALQRPVASD
LNVIVHSATGFKQISPALPRPVASD

SEQ ID NO: 1951 - protein, 25 aa, synthetic construct
  source 1..25: note = Seed: LNVIVHSATGFKQSSKALQRPVASD
LNVIVHSATGFKQISPALQRPVASD

SEQ ID NO: 1952 - protein, 25 aa, synthetic construct
  source 1..25: note = Seed: LNVIVHSATGFKQSSKALQRPVASD
LNVIVHSATGFKQISPALRRPVASD

SEQ ID NO: 1953 - protein, 25 aa, synthetic construct
  source 1..25: note = Seed: LNVIVHSATGFKQSSKALQRPVASD
LNVIVHSATGFKQISPALSRPVASD

SEQ ID NO: 1954 - protein, 25 aa, synthetic construct
  source 1..25: note = Seed: LNVIVHSATGFKQSSKALQRPVASD
LNVIVHSATGFKQISPALTRPVASD

SEQ ID NO: 1955 - protein, 25 aa, synthetic construct
  source 1..25: note = Seed: LNVIVHSATGFKQSSKALQRPVASD
LNVIVHSATGFKQISPALVRPVASD

SEQ ID NO: 1956 - protein, 25 aa, synthetic construct
  source 1..25: note = Seed: LNVIVHSATGFKQSSKALQRPVASD
LNVIVHSATGFKQISPALWRPVASD

SEQ ID NO: 1957 - protein, 25 aa, synthetic construct
  source 1..25: note = Seed: LNVIVHSATGFKQSSKALQRPVASD
LNVIVHSATGFKQISPALYRPVASD

SEQ ID NO: 1958 - protein, 25 aa, synthetic construct
  source 1..25: note = Seed: LNVIVHSATGFKQSSKALQRPVASD
LNVIVHSATGFKQISQALARPVASD

SEQ ID NO: 1959 - protein, 25 aa, synthetic construct
  source 1..25: note = Seed: LNVIVHSATGFKQSSKALQRPVASD
LNVIVHSATGFKQISQALGRPVASD

SEQ ID NO: 1960 - protein, 25 aa, synthetic construct
  source 1..25: note = Seed: LNVIVHSATGFKQSSKALQRPVASD
LNVIVHSATGFKQISQALIRPVASD

SEQ ID NO: 1961 - protein, 25 aa, synthetic construct
  source 1..25: note = Seed: LNVIVHSATGFKQSSKALQRPVASD
LNVIVHSATGFKQISQALLRPVASD

SEQ ID NO: 1962 - protein, 25 aa, synthetic construct
  source 1..25: note = Seed: LNVIVHSATGFKQSSKALQRPVASD
LNVIVHSATGFKQISQALMRPVASD

SEQ ID NO: 1963 - protein, 25 aa, synthetic construct
  source 1..25: note = Seed: LNVIVHSATGFKQSSKALQRPVASD
LNVIVHSATGFKQISQALNRPVASD

SEQ ID NO: 1964 - protein, 25 aa, synthetic construct
  source 1..25: note = Seed: LNVIVHSATGFKQSSKALQRPVASD
LNVIVHSATGFKQISQALSRPVASD

SEQ ID NO: 1965 - protein, 25 aa, synthetic construct
  source 1..25: note = Seed: LNVIVHSATGFKQSSKALQRPVASD
LNVIVHSATGFKQISQALTRPVASD

SEQ ID NO: 1966 - protein, 25 aa, synthetic construct
  source 1..25: note = Seed: LNVIVHSATGFKQSSKALQRPVASD
LNVIVHSATGFKQISQALVRPVASD

SEQ ID NO: 1967 - protein, 25 aa, synthetic construct
  source 1..25: note = Seed: LNVIVHSATGFKQSSKALQRPVASD
LNVIVHSATGFKQISRALARPVASD

SEQ ID NO: 1968 - protein, 25 aa, synthetic construct
  source 1..25: note = Seed: LNVIVHSATGFKQSSKALQRPVASD
LNVIVHSATGFKQISRALCRPVASD

SEQ ID NO: 1969 - protein, 25 aa, synthetic construct
  source 1..25: note = Seed: LNVIVHSATGFKQSSKALQRPVASD
LNVIVHSATGFKQISRALDRPVASD

SEQ ID NO: 1970 - protein, 25 aa, synthetic construct
  source 1..25: note = Seed: LNVIVHSATGFKQSSKALQRPVASD
LNVIVHSATGFKQISRALERPVASD

SEQ ID NO: 1971 - protein, 25 aa, synthetic construct
  source 1..25: note = Seed: LNVIVHSATGFKQSSKALQRPVASD
LNVIVHSATGFKQISRALFRPVASD

SEQ ID NO: 1972 - protein, 25 aa, synthetic construct
  source 1..25: note = Seed: LNVIVHSATGFKQSSKALQRPVASD
LNVIVHSATGFKQISRALGRPVASD

SEQ ID NO: 1973 - protein, 25 aa, synthetic construct
  source 1..25: note = Seed: LNVIVHSATGFKQSSKALQRPVASD
LNVIVHSATGFKQISRALHRPVASD

SEQ ID NO: 1974 - protein, 25 aa, synthetic construct
  source 1..25: note = Seed: LNVIVHSATGFKQSSKALQRPVASD
LNVIVHSATGFKQISRALIRPVASD

SEQ ID NO: 1975 - protein, 25 aa, synthetic construct
  source 1..25: note = Seed: LNVIVHSATGFKQSSKALQRPVASD
LNVIVHSATGFKQISRALKRPVASD

SEQ ID NO: 1976 - protein, 25 aa, synthetic construct
  source 1..25: note = Seed: LNVIVHSATGFKQSSKALQRPVASD
LNVIVHSATGFKQISRALLRPVASD

SEQ ID NO: 1977 - protein, 25 aa, synthetic construct
  source 1..25: note = Seed: LNVIVHSATGFKQSSKALQRPVASD
LNVIVHSATGFKQISRALMRPVASD

SEQ ID NO: 1978 - protein, 25 aa, synthetic construct
  source 1..25: note = Seed: LNVIVHSATGFKQSSKALQRPVASD
LNVIVHSATGFKQISRALNRPVASD

SEQ ID NO: 1979 - protein, 25 aa, synthetic construct
  source 1..25: note = Seed: LNVIVHSATGFKQSSKALQRPVASD
LNVIVHSATGFKQISRALPRPVASD

SEQ ID NO: 1980 - protein, 25 aa, synthetic construct
  source 1..25: note = Seed: LNVIVHSATGFKQSSKALQRPVASD
LNVIVHSATGFKQISRALQRPVASD

SEQ ID NO: 1981 - protein, 25 aa, synthetic construct
  source 1..25: note = Seed: LNVIVHSATGFKQSSKALQRPVASD
LNVIVHSATGFKQISRALRRPVASD

SEQ ID NO: 1982 - protein, 25 aa, synthetic construct
  source 1..25: note = Seed: LNVIVHSATGFKQSSKALQRPVASD
LNVIVHSATGFKQISRALSRPVASD

SEQ ID NO: 1983 - protein, 25 aa, synthetic construct
  source 1..25: note = Seed: LNVIVHSATGFKQSSKALQRPVASD
LNVIVHSATGFKQISRALTRPVASD

SEQ ID NO: 1984 - protein, 25 aa, synthetic construct
  source 1..25: note = Seed: LNVIVHSATGFKQSSKALQRPVASD
LNVIVHSATGFKQISRALVRPVASD

SEQ ID NO: 1985 - protein, 25 aa, synthetic construct
  source 1..25: note = Seed: LNVIVHSATGFKQSSKALQRPVASD
LNVIVHSATGFKQISRALWRPVASD

SEQ ID NO: 1986 - protein, 25 aa, synthetic construct
  source 1..25: note = Seed: LNVIVHSATGFKQSSKALQRPVASD
LNVIVHSATGFKQISRALYRPVASD

SEQ ID NO: 1987 - protein, 25 aa, synthetic construct
  source 1..25: note = Seed: LNVIVHSATGFKQSSKALQRPVASD
LNVIVHSATGFKQISSALARPVASD

SEQ ID NO: 1988 - protein, 25 aa, synthetic construct
  source 1..25: note = Seed: LNVIVHSATGFKQSSKALQRPVASD
LNVIVHSATGFKQISSALCRPVASD

SEQ ID NO: 1989 - protein, 25 aa, synthetic construct
  source 1..25: note = Seed: LNVIVHSATGFKQSSKALQRPVASD
LNVIVHSATGFKQISSALDRPVASD

SEQ ID NO: 1990 - protein, 25 aa, synthetic construct
  source 1..25: note = Seed: LNVIVHSATGFKQSSKALQRPVASD
LNVIVHSATGFKQISSALERPVASD

SEQ ID NO: 1991 - protein, 25 aa, synthetic construct
  source 1..25: note = Seed: LNVIVHSATGFKQSSKALQRPVASD
LNVIVHSATGFKQISSALFRPVASD

SEQ ID NO: 1992 - protein, 25 aa, synthetic construct
  source 1..25: note = Seed: LNVIVHSATGFKQSSKALQRPVASD
LNVIVHSATGFKQISSALGRPVASD

SEQ ID NO: 1993 - protein, 25 aa, synthetic construct
  source 1..25: note = Seed: LNVIVHSATGFKQSSKALQRPVASD
LNVIVHSATGFKQISSALHRPVASD

SEQ ID NO: 1994 - protein, 25 aa, synthetic construct
  source 1..25: note = Seed: LNVIVHSATGFKQSSKALQRPVASD
LNVIVHSATGFKQISSALIRPVASD

SEQ ID NO: 1995 - protein, 25 aa, synthetic construct
  source 1..25: note = Seed: LNVIVHSATGFKQSSKALQRPVASD
LNVIVHSATGFKQISSALKRPVASD

SEQ ID NO: 1996 - protein, 25 aa, synthetic construct
  source 1..25: note = Seed: LNVIVHSATGFKQSSKALQRPVASD
LNVIVHSATGFKQISSALLRPVASD

SEQ ID NO: 1997 - protein, 25 aa, synthetic construct
  source 1..25: note = Seed: LNVIVHSATGFKQSSKALQRPVASD
LNVIVHSATGFKQISSALMRPVASD

SEQ ID NO: 1998 - protein, 25 aa, synthetic construct
  source 1..25: note = Seed: LNVIVHSATGFKQSSKALQRPVASD
LNVIVHSATGFKQISSALNRPVASD

SEQ ID NO: 1999 - protein, 25 aa, synthetic construct
  source 1..25: note = Seed: LNVIVHSATGFKQSSKALQRPVASD
LNVIVHSATGFKQISSALPRPVASD

SEQ ID NO: 2000 - protein, 25 aa, synthetic construct
  source 1..25: note = Seed: LNVIVHSATGFKQSSKALQRPVASD
LNVIVHSATGFKQISSALQRPVASD

SEQ ID NO: 2001 - protein, 25 aa, synthetic construct
  source 1..25: note = Seed: LNVIVHSATGFKQSSKALQRPVASD
LNVIVHSATGFKQISSALRRPVASD

SEQ ID NO: 2002 - protein, 25 aa, synthetic construct
  source 1..25: note = Seed: LNVIVHSATGFKQSSKALQRPVASD
LNVIVHSATGFKQISSALSRPVASD

SEQ ID NO: 2003 - protein, 25 aa, synthetic construct
  source 1..25: note = Seed: LNVIVHSATGFKQSSKALQRPVASD
LNVIVHSATGFKQISSALTRPVASD

SEQ ID NO: 2004 - protein, 25 aa, synthetic construct
  source 1..25: note = Seed: LNVIVHSATGFKQSSKALQRPVASD
LNVIVHSATGFKQISSALVRPVASD

SEQ ID NO: 2005 - protein, 25 aa, synthetic construct
  source 1..25: note = Seed: LNVIVHSATGFKQSSKALQRPVASD
LNVIVHSATGFKQISSALYRPVASD

SEQ ID NO: 2006 - protein, 25 aa, synthetic construct
  source 1..25: note = Seed: LNVIVHSATGFKQSSKALQRPVASD
LNVIVHSATGFKQISTALARPVASD

SEQ ID NO: 2007 - protein, 25 aa, synthetic construct
  source 1..25: note = Seed: LNVIVHSATGFKQSSKALQRPVASD
LNVIVHSATGFKQISTALCRPVASD

SEQ ID NO: 2008 - protein, 25 aa, synthetic construct
  source 1..25: note = Seed: LNVIVHSATGFKQSSKALQRPVASD
LNVIVHSATGFKQISTALDRPVASD

SEQ ID NO: 2009 - protein, 25 aa, synthetic construct
  source 1..25: note = Seed: LNVIVHSATGFKQSSKALQRPVASD
LNVIVHSATGFKQISTALERPVASD

SEQ ID NO: 2010 - protein, 25 aa, synthetic construct
  source 1..25: note = Seed: LNVIVHSATGFKQSSKALQRPVASD
LNVIVHSATGFKQISTALFRPVASD

SEQ ID NO: 2011 - protein, 25 aa, synthetic construct
  source 1..25: note = Seed: LNVIVHSATGFKQSSKALQRPVASD
LNVIVHSATGFKQISTALGRPVASD

SEQ ID NO: 2012 - protein, 25 aa, synthetic construct
  source 1..25: note = Seed: LNVIVHSATGFKQSSKALQRPVASD
LNVIVHSATGFKQISTALHRPVASD

SEQ ID NO: 2013 - protein, 25 aa, synthetic construct
  source 1..25: note = Seed: LNVIVHSATGFKQSSKALQRPVASD
LNVIVHSATGFKQISTALIRPVASD

SEQ ID NO: 2014 - protein, 25 aa, synthetic construct
  source 1..25: note = Seed: LNVIVHSATGFKQSSKALQRPVASD
LNVIVHSATGFKQISTALKRPVASD

SEQ ID NO: 2015 - protein, 25 aa, synthetic construct
  source 1..25: note = Seed: LNVIVHSATGFKQSSKALQRPVASD
LNVIVHSATGFKQISTALLRPVASD

SEQ ID NO: 2016 - protein, 25 aa, synthetic construct
  source 1..25: note = Seed: LNVIVHSATGFKQSSKALQRPVASD
LNVIVHSATGFKQISTALMRPVASD

SEQ ID NO: 2017 - protein, 25 aa, synthetic construct
  source 1..25: note = Seed: LNVIVHSATGFKQSSKALQRPVASD
LNVIVHSATGFKQISTALNRPVASD

SEQ ID NO: 2018 - protein, 25 aa, synthetic construct
  source 1..25: note = Seed: LNVIVHSATGFKQSSKALQRPVASD
LNVIVHSATGFKQISTALPRPVASD

SEQ ID NO: 2019 - protein, 25 aa, synthetic construct
  source 1..25: note = Seed: LNVIVHSATGFKQSSKALQRPVASD
LNVIVHSATGFKQISTALQRPVASD

SEQ ID NO: 2020 - protein, 25 aa, synthetic construct
  source 1..25: note = Seed: LNVIVHSATGFKQSSKALQRPVASD
LNVIVHSATGFKQISTALRRPVASD

SEQ ID NO: 2021 - protein, 25 aa, synthetic construct
  source 1..25: note = Seed: LNVIVHSATGFKQSSKALQRPVASD
LNVIVHSATGFKQISTALSRPVASD

SEQ ID NO: 2022 - protein, 25 aa, synthetic construct
  source 1..25: note = Seed: LNVIVHSATGFKQSSKALQRPVASD
LNVIVHSATGFKQISTALTRPVASD

SEQ ID NO: 2023 - protein, 25 aa, synthetic construct
  source 1..25: note = Seed: LNVIVHSATGFKQSSKALQRPVASD
LNVIVHSATGFKQISTALVRPVASD

SEQ ID NO: 2024 - protein, 25 aa, synthetic construct
  source 1..25: note = Seed: LNVIVHSATGFKQSSKALQRPVASD
LNVIVHSATGFKQISTALYRPVASD

SEQ ID NO: 2025 - protein, 25 aa, synthetic construct
  source 1..25: note = Seed: LNVIVHSATGFKQSSKALQRPVASD
LNVIVHSATGFKQISVALARPVASD

SEQ ID NO: 2026 - protein, 25 aa, synthetic construct
  source 1..25: note = Seed: LNVIVHSATGFKQSSKALQRPVASD
LNVIVHSATGFKQISVALCRPVASD

SEQ ID NO: 2027 - protein, 25 aa, synthetic construct
  source 1..25: note = Seed: LNVIVHSATGFKQSSKALQRPVASD
LNVIVHSATGFKQISVALDRPVASD

SEQ ID NO: 2028 - protein, 25 aa, synthetic construct
  source 1..25: note = Seed: LNVIVHSATGFKQSSKALQRPVASD
LNVIVHSATGFKQISVALERPVASD

SEQ ID NO: 2029 - protein, 25 aa, synthetic construct
  source 1..25: note = Seed: LNVIVHSATGFKQSSKALQRPVASD
LNVIVHSATGFKQISVALFRPVASD

SEQ ID NO: 2030 - protein, 25 aa, synthetic construct
  source 1..25: note = Seed: LNVIVHSATGFKQSSKALQRPVASD
LNVIVHSATGFKQISVALGRPVASD

SEQ ID NO: 2031 - protein, 25 aa, synthetic construct
  source 1..25: note = Seed: LNVIVHSATGFKQSSKALQRPVASD
LNVIVHSATGFKQISVALHRPVASD

SEQ ID NO: 2032 - protein, 25 aa, synthetic construct
  source 1..25: note = Seed: LNVIVHSATGFKQSSKALQRPVASD
LNVIVHSATGFKQISVALIRPVASD

SEQ ID NO: 2033 - protein, 25 aa, synthetic construct
  source 1..25: note = Seed: LNVIVHSATGFKQSSKALQRPVASD
LNVIVHSATGFKQISVALKRPVASD

SEQ ID NO: 2034 - protein, 25 aa, synthetic construct
  source 1..25: note = Seed: LNVIVHSATGFKQSSKALQRPVASD
LNVIVHSATGFKQISVALLRPVASD

SEQ ID NO: 2035 - protein, 25 aa, synthetic construct
  source 1..25: note = Seed: LNVIVHSATGFKQSSKALQRPVASD
LNVIVHSATGFKQISVALMRPVASD

SEQ ID NO: 2036 - protein, 25 aa, synthetic construct
  source 1..25: note = Seed: LNVIVHSATGFKQSSKALQRPVASD
LNVIVHSATGFKQISVALNRPVASD

SEQ ID NO: 2037 - protein, 25 aa, synthetic construct
  source 1..25: note = Seed: LNVIVHSATGFKQSSKALQRPVASD
LNVIVHSATGFKQISVALPRPVASD

SEQ ID NO: 2038 - protein, 25 aa, synthetic construct
  source 1..25: note = Seed: LNVIVHSATGFKQSSKALQRPVASD
LNVIVHSATGFKQISVALQRPVASD

SEQ ID NO: 2039 - protein, 25 aa, synthetic construct
  source 1..25: note = Seed: LNVIVHSATGFKQSSKALQRPVASD
LNVIVHSATGFKQISVALRRPVASD

SEQ ID NO: 2040 - protein, 25 aa, synthetic construct
  source 1..25: note = Seed: LNVIVHSATGFKQSSKALQRPVASD
LNVIVHSATGFKQISVALSRPVASD

SEQ ID NO: 2041 - protein, 25 aa, synthetic construct
  source 1..25: note = Seed: LNVIVHSATGFKQSSKALQRPVASD
LNVIVHSATGFKQISVALTRPVASD

SEQ ID NO: 2042 - protein, 25 aa, synthetic construct
  source 1..25: note = Seed: LNVIVHSATGFKQSSKALQRPVASD
LNVIVHSATGFKQISVALVRPVASD

SEQ ID NO: 2043 - protein, 25 aa, synthetic construct
  source 1..25: note = Seed: LNVIVHSATGFKQSSKALQRPVASD
LNVIVHSATGFKQISVALYRPVASD

SEQ ID NO: 2044 - protein, 25 aa, synthetic construct
  source 1..25: note = Seed: LNVIVHSATGFKQSSKALQRPVASD
LNVIVHSATGFKQISWALGRPVASD

SEQ ID NO: 2045 - protein, 25 aa, synthetic construct
  source 1..25: note = Seed: LNVIVHSATGFKQSSKALQRPVASD
LNVIVHSATGFKQISWALHRPVASD

SEQ ID NO: 2046 - protein, 25 aa, synthetic construct
  source 1..25: note = Seed: LNVIVHSATGFKQSSKALQRPVASD
LNVIVHSATGFKQISWALIRPVASD

SEQ ID NO: 2047 - protein, 25 aa, synthetic construct
  source 1..25: note = Seed: LNVIVHSATGFKQSSKALQRPVASD
LNVIVHSATGFKQISWALNRPVASD

SEQ ID NO: 2048 - protein, 25 aa, synthetic construct
  source 1..25: note = Seed: LNVIVHSATGFKQSSKALQRPVASD
LNVIVHSATGFKQISWALVRPVASD

SEQ ID NO: 2049 - protein, 25 aa, synthetic construct
  source 1..25: note = Seed: LNVIVHSATGFKQSSKALQRPVASD
LNVIVHSATGFKQISYALGRPVASD

SEQ ID NO: 2050 - protein, 25 aa, synthetic construct
  source 1..25: note = Seed: LNVIVHSATGFKQSSKALQRPVASD
LNVIVHSATGFKQISYALIRPVASD

SEQ ID NO: 2051 - protein, 25 aa, synthetic construct
  source 1..25: note = Seed: LNVIVHSATGFKQSSKALQRPVASD
LNVIVHSATGFKQISYALLRPVASD

SEQ ID NO: 2052 - protein, 25 aa, synthetic construct
  source 1..25: note = Seed: LNVIVHSATGFKQSSKALQRPVASD
LNVIVHSATGFKQISYALMRPVASD

SEQ ID NO: 2053 - protein, 25 aa, synthetic construct
  source 1..25: note = Seed: LNVIVHSATGFKQSSKALQRPVASD
LNVIVHSATGFKQISYALVRPVASD

SEQ ID NO: 2054 - protein, 25 aa, synthetic construct
  source 1..25: note = Seed: LNVIVHSATGFKQSSKALQRPVASD
LNVIVHSATGFKQKSAALARPVASD

SEQ ID NO: 2055 - protein, 25 aa, synthetic construct
  source 1..25: note = Seed: LNVIVHSATGFKQSSKALQRPVASD
LNVIVHSATGFKQKSAALIRPVASD

SEQ ID NO: 2056 - protein, 25 aa, synthetic construct
  source 1..25: note = Seed: LNVIVHSATGFKQSSKALQRPVASD
LNVIVHSATGFKQKSAALLRPVASD

SEQ ID NO: 2057 - protein, 25 aa, synthetic construct
  source 1..25: note = Seed: LNVIVHSATGFKQSSKALQRPVASD
LNVIVHSATGFKQKSAALMRPVASD

SEQ ID NO: 2058 - protein, 25 aa, synthetic construct
  source 1..25: note = Seed: LNVIVHSATGFKQSSKALQRPVASD
LNVIVHSATGFKQKSAALSRPVASD

SEQ ID NO: 2059 - protein, 25 aa, synthetic construct
  source 1..25: note = Seed: LNVIVHSATGFKQSSKALQRPVASD
LNVIVHSATGFKQKSAALVRPVASD

SEQ ID NO: 2060 - protein, 25 aa, synthetic construct
  source 1..25: note = Seed: LNVIVHSATGFKQSSKALQRPVASD
LNVIVHSATGFKQKSGALARPVASD

SEQ ID NO: 2061 - protein, 25 aa, synthetic construct
  source 1..25: note = Seed: LNVIVHSATGFKQSSKALQRPVASD
LNVIVHSATGFKQKSGALIRPVASD

SEQ ID NO: 2062 - protein, 25 aa, synthetic construct
  source 1..25: note = Seed: LNVIVHSATGFKQSSKALQRPVASD
LNVIVHSATGFKQKSGALLRPVASD

SEQ ID NO: 2063 - protein, 25 aa, synthetic construct
  source 1..25: note = Seed: LNVIVHSATGFKQSSKALQRPVASD
LNVIVHSATGFKQKSGALVRPVASD

SEQ ID NO: 2064 - protein, 25 aa, synthetic construct
  source 1..25: note = Seed: LNVIVHSATGFKQSSKALQRPVASD
LNVIVHSATGFKQKSIALARPVASD

SEQ ID NO: 2065 - protein, 25 aa, synthetic construct
  source 1..25: note = Seed: LNVIVHSATGFKQSSKALQRPVASD
LNVIVHSATGFKQKSIALRRPVASD

SEQ ID NO: 2066 - protein, 25 aa, synthetic construct
  source 1..25: note = Seed: LNVIVHSATGFKQSSKALQRPVASD
LNVIVHSATGFKQKSKALARPVASD

SEQ ID NO: 2067 - protein, 25 aa, synthetic construct
  source 1..25: note = Seed: LNVIVHSATGFKQSSKALQRPVASD
LNVIVHSATGFKQKSKALSRPVASD

SEQ ID NO: 2068 - protein, 25 aa, synthetic construct
  source 1..25: note = Seed: LNVIVHSATGFKQSSKALQRPVASD
LNVIVHSATGFKQKSPALLRPVASD

SEQ ID NO: 2069 - protein, 25 aa, synthetic construct
  source 1..25: note = Seed: LNVIVHSATGFKQSSKALQRPVASD
LNVIVHSATGFKQKSRALARPVASD

SEQ ID NO: 2070 - protein, 25 aa, synthetic construct
  source 1..25: note = Seed: LNVIVHSATGFKQSSKALQRPVASD
LNVIVHSATGFKQKSRALRRPVASD

SEQ ID NO: 2071 - protein, 25 aa, synthetic construct
  source 1..25: note = Seed: LNVIVHSATGFKQSSKALQRPVASD
LNVIVHSATGFKQKSRALSRPVASD

SEQ ID NO: 2072 - protein, 25 aa, synthetic construct
  source 1..25: note = Seed: LNVIVHSATGFKQSSKALQRPVASD
LNVIVHSATGFKQKSSALARPVASD

SEQ ID NO: 2073 - protein, 25 aa, synthetic construct
  source 1..25: note = Seed: LNVIVHSATGFKQSSKALQRPVASD
LNVIVHSATGFKQKSSALIRPVASD

SEQ ID NO: 2074 - protein, 25 aa, synthetic construct
  source 1..25: note = Seed: LNVIVHSATGFKQSSKALQRPVASD
LNVIVHSATGFKQKSSALLRPVASD

SEQ ID NO: 2075 - protein, 25 aa, synthetic construct
  source 1..25: note = Seed: LNVIVHSATGFKQSSKALQRPVASD
LNVIVHSATGFKQKSSALVRPVASD

SEQ ID NO: 2076 - protein, 25 aa, synthetic construct
  source 1..25: note = Seed: LNVIVHSATGFKQSSKALQRPVASD
LNVIVHSATGFKQKSVALARPVASD

SEQ ID NO: 2077 - protein, 25 aa, synthetic construct
  source 1..25: note = Seed: LNVIVHSATGFKQSSKALQRPVASD
LNVIVHSATGFKQKSVALIRPVASD

SEQ ID NO: 2078 - protein, 25 aa, synthetic construct
  source 1..25: note = Seed: LNVIVHSATGFKQSSKALQRPVASD
LNVIVHSATGFKQKSVALLRPVASD

SEQ ID NO: 2079 - protein, 25 aa, synthetic construct
  source 1..25: note = Seed: LNVIVHSATGFKQSSKALQRPVASD
LNVIVHSATGFKQLSAALARPVASD

SEQ ID NO: 2080 - protein, 25 aa, synthetic construct
  source 1..25: note = Seed: LNVIVHSATGFKQSSKALQRPVASD
LNVIVHSATGFKQLSAALCRPVASD

SEQ ID NO: 2081 - protein, 25 aa, synthetic construct
  source 1..25: note = Seed: LNVIVHSATGFKQSSKALQRPVASD
LNVIVHSATGFKQLSAALDRPVASD

SEQ ID NO: 2082 - protein, 25 aa, synthetic construct
  source 1..25: note = Seed: LNVIVHSATGFKQSSKALQRPVASD
LNVIVHSATGFKQLSAALERPVASD

SEQ ID NO: 2083 - protein, 25 aa, synthetic construct
  source 1..25: note = Seed: LNVIVHSATGFKQSSKALQRPVASD
LNVIVHSATGFKQLSAALFRPVASD

SEQ ID NO: 2084 - protein, 25 aa, synthetic construct
  source 1..25: note = Seed: LNVIVHSATGFKQSSKALQRPVASD
LNVIVHSATGFKQLSAALGRPVASD

SEQ ID NO: 2085 - protein, 25 aa, synthetic construct
  source 1..25: note = Seed: LNVIVHSATGFKQSSKALQRPVASD
LNVIVHSATGFKQLSAALHRPVASD

SEQ ID NO: 2086 - protein, 25 aa, synthetic construct
  source 1..25: note = Seed: LNVIVHSATGFKQSSKALQRPVASD
LNVIVHSATGFKQLSAALIRPVASD

SEQ ID NO: 2087 - protein, 25 aa, synthetic construct
  source 1..25: note = Seed: LNVIVHSATGFKQSSKALQRPVASD
LNVIVHSATGFKQLSAALKRPVASD

SEQ ID NO: 2088 - protein, 25 aa, synthetic construct
  source 1..25: note = Seed: LNVIVHSATGFKQSSKALQRPVASD
LNVIVHSATGFKQLSAALLRPVASD

SEQ ID NO: 2089 - protein, 25 aa, synthetic construct
  source 1..25: note = Seed: LNVIVHSATGFKQSSKALQRPVASD
LNVIVHSATGFKQLSAALMRPVASD

SEQ ID NO: 2090 - protein, 25 aa, synthetic construct
  source 1..25: note = Seed: LNVIVHSATGFKQSSKALQRPVASD
LNVIVHSATGFKQLSAALNRPVASD

SEQ ID NO: 2091 - protein, 25 aa, synthetic construct
  source 1..25: note = Seed: LNVIVHSATGFKQSSKALQRPVASD
LNVIVHSATGFKQLSAALPRPVASD

SEQ ID NO: 2092 - protein, 25 aa, synthetic construct
  source 1..25: note = Seed: LNVIVHSATGFKQSSKALQRPVASD
LNVIVHSATGFKQLSAALQRPVASD

SEQ ID NO: 2093 - protein, 25 aa, synthetic construct
  source 1..25: note = Seed: LNVIVHSATGFKQSSKALQRPVASD
LNVIVHSATGFKQLSAALRRPVASD

SEQ ID NO: 2094 - protein, 25 aa, synthetic construct
  source 1..25: note = Seed: LNVIVHSATGFKQSSKALQRPVASD
LNVIVHSATGFKQLSAALSRPVASD

SEQ ID NO: 2095 - protein, 25 aa, synthetic construct
  source 1..25: note = Seed: LNVIVHSATGFKQSSKALQRPVASD
LNVIVHSATGFKQLSAALTRPVASD

SEQ ID NO: 2096 - protein, 25 aa, synthetic construct
  source 1..25: note = Seed: LNVIVHSATGFKQSSKALQRPVASD
LNVIVHSATGFKQLSAALVRPVASD

SEQ ID NO: 2097 - protein, 25 aa, synthetic construct
  source 1..25: note = Seed: LNVIVHSATGFKQSSKALQRPVASD
LNVIVHSATGFKQLSAALWRPVASD

SEQ ID NO: 2098 - protein, 25 aa, synthetic construct
  source 1..25: note = Seed: LNVIVHSATGFKQSSKALQRPVASD
LNVIVHSATGFKQLSAALYRPVASD

SEQ ID NO: 2099 - protein, 25 aa, synthetic construct
  source 1..25: note = Seed: LNVIVHSATGFKQSSKALQRPVASD
LNVIVHSATGFKQLSCALARPVASD

SEQ ID NO: 2100 - protein, 25 aa, synthetic construct
  source 1..25: note = Seed: LNVIVHSATGFKQSSKALQRPVASD
LNVIVHSATGFKQLSCALGRPVASD

SEQ ID NO: 2101 - protein, 25 aa, synthetic construct
  source 1..25: note = Seed: LNVIVHSATGFKQSSKALQRPVASD
LNVIVHSATGFKQLSCALIRPVASD

SEQ ID NO: 2102 - protein, 25 aa, synthetic construct
  source 1..25: note = Seed: LNVIVHSATGFKQSSKALQRPVASD
LNVIVHSATGFKQLSCALLRPVASD

SEQ ID NO: 2103 - protein, 25 aa, synthetic construct
  source 1..25: note = Seed: LNVIVHSATGFKQSSKALQRPVASD
LNVIVHSATGFKQLSCALNRPVASD

SEQ ID NO: 2104 - protein, 25 aa, synthetic construct
  source 1..25: note = Seed: LNVIVHSATGFKQSSKALQRPVASD
LNVIVHSATGFKQLSCALSRPVASD

SEQ ID NO: 2105 - protein, 25 aa, synthetic construct
  source 1..25: note = Seed: LNVIVHSATGFKQSSKALQRPVASD
LNVIVHSATGFKQLSCALTRPVASD

SEQ ID NO: 2106 - protein, 25 aa, synthetic construct
  source 1..25: note = Seed: LNVIVHSATGFKQSSKALQRPVASD
LNVIVHSATGFKQLSCALVRPVASD

SEQ ID NO: 2107 - protein, 25 aa, synthetic construct
  source 1..25: note = Seed: LNVIVHSATGFKQSSKALQRPVASD
LNVIVHSATGFKQLSDALARPVASD

SEQ ID NO: 2108 - protein, 25 aa, synthetic construct
  source 1..25: note = Seed: LNVIVHSATGFKQSSKALQRPVASD
LNVIVHSATGFKQLSDALIRPVASD

SEQ ID NO: 2109 - protein, 25 aa, synthetic construct
  source 1..25: note = Seed: LNVIVHSATGFKQSSKALQRPVASD
LNVIVHSATGFKQLSDALLRPVASD

SEQ ID NO: 2110 - protein, 25 aa, synthetic construct
  source 1..25: note = Seed: LNVIVHSATGFKQSSKALQRPVASD
LNVIVHSATGFKQLSDALNRPVASD

SEQ ID NO: 2111 - protein, 25 aa, synthetic construct
  source 1..25: note = Seed: LNVIVHSATGFKQSSKALQRPVASD
LNVIVHSATGFKQLSDALSRPVASD

SEQ ID NO: 2112 - protein, 25 aa, synthetic construct
  source 1..25: note = Seed: LNVIVHSATGFKQSSKALQRPVASD
LNVIVHSATGFKQLSDALTRPVASD

SEQ ID NO: 2113 - protein, 25 aa, synthetic construct
  source 1..25: note = Seed: LNVIVHSATGFKQSSKALQRPVASD
LNVIVHSATGFKQLSDALVRPVASD

SEQ ID NO: 2114 - protein, 25 aa, synthetic construct
  source 1..25: note = Seed: LNVIVHSATGFKQSSKALQRPVASD
LNVIVHSATGFKQLSEALARPVASD

SEQ ID NO: 2115 - protein, 25 aa, synthetic construct
  source 1..25: note = Seed: LNVIVHSATGFKQSSKALQRPVASD
LNVIVHSATGFKQLSEALGRPVASD

SEQ ID NO: 2116 - protein, 25 aa, synthetic construct
  source 1..25: note = Seed: LNVIVHSATGFKQSSKALQRPVASD
LNVIVHSATGFKQLSEALIRPVASD

SEQ ID NO: 2117 - protein, 25 aa, synthetic construct
  source 1..25: note = Seed: LNVIVHSATGFKQSSKALQRPVASD
LNVIVHSATGFKQLSEALLRPVASD

SEQ ID NO: 2118 - protein, 25 aa, synthetic construct
  source 1..25: note = Seed: LNVIVHSATGFKQSSKALQRPVASD
LNVIVHSATGFKQLSEALMRPVASD

SEQ ID NO: 2119 - protein, 25 aa, synthetic construct
  source 1..25: note = Seed: LNVIVHSATGFKQSSKALQRPVASD
LNVIVHSATGFKQLSEALNRPVASD

SEQ ID NO: 2120 - protein, 25 aa, synthetic construct
  source 1..25: note = Seed: LNVIVHSATGFKQSSKALQRPVASD
LNVIVHSATGFKQLSEALSRPVASD

SEQ ID NO: 2121 - protein, 25 aa, synthetic construct
  source 1..25: note = Seed: LNVIVHSATGFKQSSKALQRPVASD
LNVIVHSATGFKQLSEALTRPVASD

SEQ ID NO: 2122 - protein, 25 aa, synthetic construct
  source 1..25: note = Seed: LNVIVHSATGFKQSSKALQRPVASD
LNVIVHSATGFKQLSEALVRPVASD

SEQ ID NO: 2123 - protein, 25 aa, synthetic construct
  source 1..25: note = Seed: LNVIVHSATGFKQSSKALQRPVASD
LNVIVHSATGFKQLSFALARPVASD

SEQ ID NO: 2124 - protein, 25 aa, synthetic construct
  source 1..25: note = Seed: LNVIVHSATGFKQSSKALQRPVASD
LNVIVHSATGFKQLSFALDRPVASD

SEQ ID NO: 2125 - protein, 25 aa, synthetic construct
  source 1..25: note = Seed: LNVIVHSATGFKQSSKALQRPVASD
LNVIVHSATGFKQLSFALERPVASD

SEQ ID NO: 2126 - protein, 25 aa, synthetic construct
  source 1..25: note = Seed: LNVIVHSATGFKQSSKALQRPVASD
LNVIVHSATGFKQLSFALGRPVASD

SEQ ID NO: 2127 - protein, 25 aa, synthetic construct
  source 1..25: note = Seed: LNVIVHSATGFKQSSKALQRPVASD
LNVIVHSATGFKQLSFALHRPVASD

SEQ ID NO: 2128 - protein, 25 aa, synthetic construct
  source 1..25: note = Seed: LNVIVHSATGFKQSSKALQRPVASD
LNVIVHSATGFKQLSFALIRPVASD

SEQ ID NO: 2129 - protein, 25 aa, synthetic construct
  source 1..25: note = Seed: LNVIVHSATGFKQSSKALQRPVASD
LNVIVHSATGFKQLSFALLRPVASD

SEQ ID NO: 2130 - protein, 25 aa, synthetic construct
  source 1..25: note = Seed: LNVIVHSATGFKQSSKALQRPVASD
LNVIVHSATGFKQLSFALMRPVASD

SEQ ID NO: 2131 - protein, 25 aa, synthetic construct
  source 1..25: note = Seed: LNVIVHSATGFKQSSKALQRPVASD
LNVIVHSATGFKQLSFALNRPVASD

SEQ ID NO: 2132 - protein, 25 aa, synthetic construct
  source 1..25: note = Seed: LNVIVHSATGFKQSSKALQRPVASD
LNVIVHSATGFKQLSFALVRPVASD

SEQ ID NO: 2133 - protein, 25 aa, synthetic construct
  source 1..25: note = Seed: LNVIVHSATGFKQSSKALQRPVASD
LNVIVHSATGFKQLSFALYRPVASD

SEQ ID NO: 2134 - protein, 25 aa, synthetic construct
  source 1..25: note = Seed: LNVIVHSATGFKQSSKALQRPVASD
LNVIVHSATGFKQLSGALARPVASD

SEQ ID NO: 2135 - protein, 25 aa, synthetic construct
  source 1..25: note = Seed: LNVIVHSATGFKQSSKALQRPVASD
LNVIVHSATGFKQLSGALCRPVASD

SEQ ID NO: 2136 - protein, 25 aa, synthetic construct
  source 1..25: note = Seed: LNVIVHSATGFKQSSKALQRPVASD
LNVIVHSATGFKQLSGALDRPVASD

SEQ ID NO: 2137 - protein, 25 aa, synthetic construct
  source 1..25: note = Seed: LNVIVHSATGFKQSSKALQRPVASD
LNVIVHSATGFKQLSGALERPVASD

SEQ ID NO: 2138 - protein, 25 aa, synthetic construct
  source 1..25: note = Seed: LNVIVHSATGFKQSSKALQRPVASD
LNVIVHSATGFKQLSGALFRPVASD

SEQ ID NO: 2139 - protein, 25 aa, synthetic construct
  source 1..25: note = Seed: LNVIVHSATGFKQSSKALQRPVASD
LNVIVHSATGFKQLSGALGRPVASD

SEQ ID NO: 2140 - protein, 25 aa, synthetic construct
  source 1..25: note = Seed: LNVIVHSATGFKQSSKALQRPVASD
LNVIVHSATGFKQLSGALHRPVASD

SEQ ID NO: 2141 - protein, 25 aa, synthetic construct
  source 1..25: note = Seed: LNVIVHSATGFKQSSKALQRPVASD
LNVIVHSATGFKQLSGALIRPVASD

SEQ ID NO: 2142 - protein, 25 aa, synthetic construct
  source 1..25: note = Seed: LNVIVHSATGFKQSSKALQRPVASD
LNVIVHSATGFKQLSGALKRPVASD

SEQ ID NO: 2143 - protein, 25 aa, synthetic construct
  source 1..25: note = Seed: LNVIVHSATGFKQSSKALQRPVASD
LNVIVHSATGFKQLSGALLRPVASD

SEQ ID NO: 2144 - protein, 25 aa, synthetic construct
  source 1..25: note = Seed: LNVIVHSATGFKQSSKALQRPVASD
LNVIVHSATGFKQLSGALMRPVASD

SEQ ID NO: 2145 - protein, 25 aa, synthetic construct
  source 1..25: note = Seed: LNVIVHSATGFKQSSKALQRPVASD
LNVIVHSATGFKQLSGALNRPVASD

SEQ ID NO: 2146 - protein, 25 aa, synthetic construct
  source 1..25: note = Seed: LNVIVHSATGFKQSSKALQRPVASD
LNVIVHSATGFKQLSGALPRPVASD

SEQ ID NO: 2147 - protein, 25 aa, synthetic construct
  source 1..25: note = Seed: LNVIVHSATGFKQSSKALQRPVASD
LNVIVHSATGFKQLSGALQRPVASD

SEQ ID NO: 2148 - protein, 25 aa, synthetic construct
  source 1..25: note = Seed: LNVIVHSATGFKQSSKALQRPVASD
LNVIVHSATGFKQLSGALRRPVASD

SEQ ID NO: 2149 - protein, 25 aa, synthetic construct
  source 1..25: note = Seed: LNVIVHSATGFKQSSKALQRPVASD
LNVIVHSATGFKQLSGALSRPVASD

SEQ ID NO: 2150 - protein, 25 aa, synthetic construct
  source 1..25: note = Seed: LNVIVHSATGFKQSSKALQRPVASD
LNVIVHSATGFKQLSGALTRPVASD

SEQ ID NO: 2151 - protein, 25 aa, synthetic construct
  source 1..25: note = Seed: LNVIVHSATGFKQSSKALQRPVASD
LNVIVHSATGFKQLSGALVRPVASD

SEQ ID NO: 2152 - protein, 25 aa, synthetic construct
  source 1..25: note = Seed: LNVIVHSATGFKQSSKALQRPVASD
LNVIVHSATGFKQLSGALWRPVASD

SEQ ID NO: 2153 - protein, 25 aa, synthetic construct
  source 1..25: note = Seed: LNVIVHSATGFKQSSKALQRPVASD
LNVIVHSATGFKQLSGALYRPVASD

SEQ ID NO: 2154 - protein, 25 aa, synthetic construct
  source 1..25: note = Seed: LNVIVHSATGFKQSSKALQRPVASD
LNVIVHSATGFKQLSHALARPVASD

SEQ ID NO: 2155 - protein, 25 aa, synthetic construct
  source 1..25: note = Seed: LNVIVHSATGFKQSSKALQRPVASD
LNVIVHSATGFKQLSHALGRPVASD

SEQ ID NO: 2156 - protein, 25 aa, synthetic construct
  source 1..25: note = Seed: LNVIVHSATGFKQSSKALQRPVASD
LNVIVHSATGFKQLSHALHRPVASD

SEQ ID NO: 2157 - protein, 25 aa, synthetic construct
  source 1..25: note = Seed: LNVIVHSATGFKQSSKALQRPVASD
LNVIVHSATGFKQLSHALIRPVASD

SEQ ID NO: 2158 - protein, 25 aa, synthetic construct
  source 1..25: note = Seed: LNVIVHSATGFKQSSKALQRPVASD
LNVIVHSATGFKQLSHALKRPVASD

SEQ ID NO: 2159 - protein, 25 aa, synthetic construct
  source 1..25: note = Seed: LNVIVHSATGFKQSSKALQRPVASD
LNVIVHSATGFKQLSHALLRPVASD

SEQ ID NO: 2160 - protein, 25 aa, synthetic construct
  source 1..25: note = Seed: LNVIVHSATGFKQSSKALQRPVASD
LNVIVHSATGFKQLSHALMRPVASD

SEQ ID NO: 2161 - protein, 25 aa, synthetic construct
  source 1..25: note = Seed: LNVIVHSATGFKQSSKALQRPVASD
LNVIVHSATGFKQLSHALNRPVASD

SEQ ID NO: 2162 - protein, 25 aa, synthetic construct
  source 1..25: note = Seed: LNVIVHSATGFKQSSKALQRPVASD
LNVIVHSATGFKQLSHALPRPVASD

SEQ ID NO: 2163 - protein, 25 aa, synthetic construct
  source 1..25: note = Seed: LNVIVHSATGFKQSSKALQRPVASD
LNVIVHSATGFKQLSHALRRPVASD

SEQ ID NO: 2164 - protein, 25 aa, synthetic construct
  source 1..25: note = Seed: LNVIVHSATGFKQSSKALQRPVASD
LNVIVHSATGFKQLSHALSRPVASD

SEQ ID NO: 2165 - protein, 25 aa, synthetic construct
  source 1..25: note = Seed: LNVIVHSATGFKQSSKALQRPVASD
LNVIVHSATGFKQLSHALTRPVASD

SEQ ID NO: 2166 - protein, 25 aa, synthetic construct
  source 1..25: note = Seed: LNVIVHSATGFKQSSKALQRPVASD
LNVIVHSATGFKQLSHALVRPVASD

SEQ ID NO: 2167 - protein, 25 aa, synthetic construct
  source 1..25: note = Seed: LNVIVHSATGFKQSSKALQRPVASD
LNVIVHSATGFKQLSIALARPVASD

SEQ ID NO: 2168 - protein, 25 aa, synthetic construct
  source 1..25: note = Seed: LNVIVHSATGFKQSSKALQRPVASD
LNVIVHSATGFKQLSIALCRPVASD

SEQ ID NO: 2169 - protein, 25 aa, synthetic construct
  source 1..25: note = Seed: LNVIVHSATGFKQSSKALQRPVASD
LNVIVHSATGFKQLSIALDRPVASD

SEQ ID NO: 2170 - protein, 25 aa, synthetic construct
  source 1..25: note = Seed: LNVIVHSATGFKQSSKALQRPVASD
LNVIVHSATGFKQLSIALERPVASD

SEQ ID NO: 2171 - protein, 25 aa, synthetic construct
  source 1..25: note = Seed: LNVIVHSATGFKQSSKALQRPVASD
LNVIVHSATGFKQLSIALFRPVASD

SEQ ID NO: 2172 - protein, 25 aa, synthetic construct
  source 1..25: note = Seed: LNVIVHSATGFKQSSKALQRPVASD
LNVIVHSATGFKQLSIALGRPVASD

SEQ ID NO: 2173 - protein, 25 aa, synthetic construct
  source 1..25: note = Seed: LNVIVHSATGFKQSSKALQRPVASD
LNVIVHSATGFKQLSIALHRPVASD

SEQ ID NO: 2174 - protein, 25 aa, synthetic construct
  source 1..25: note = Seed: LNVIVHSATGFKQSSKALQRPVASD
LNVIVHSATGFKQLSIALIRPVASD

SEQ ID NO: 2175 - protein, 25 aa, synthetic construct
  source 1..25: note = Seed: LNVIVHSATGFKQSSKALQRPVASD
LNVIVHSATGFKQLSIALKRPVASD

SEQ ID NO: 2176 - protein, 25 aa, synthetic construct
  source 1..25: note = Seed: LNVIVHSATGFKQSSKALQRPVASD
LNVIVHSATGFKQLSIALLRPVASD

SEQ ID NO: 2177 - protein, 25 aa, synthetic construct
  source 1..25: note = Seed: LNVIVHSATGFKQSSKALQRPVASD
LNVIVHSATGFKQLSIALMRPVASD

SEQ ID NO: 2178 - protein, 25 aa, synthetic construct
  source 1..25: note = Seed: LNVIVHSATGFKQSSKALQRPVASD
LNVIVHSATGFKQLSIALNRPVASD

SEQ ID NO: 2179 - protein, 25 aa, synthetic construct
  source 1..25: note = Seed: LNVIVHSATGFKQSSKALQRPVASD
LNVIVHSATGFKQLSIALPRPVASD

SEQ ID NO: 2180 - protein, 25 aa, synthetic construct
  source 1..25: note = Seed: LNVIVHSATGFKQSSKALQRPVASD
LNVIVHSATGFKQLSIALQRPVASD

SEQ ID NO: 2181 - protein, 25 aa, synthetic construct
  source 1..25: note = Seed: LNVIVHSATGFKQSSKALQRPVASD
LNVIVHSATGFKQLSIALRRPVASD

SEQ ID NO: 2182 - protein, 25 aa, synthetic construct
  source 1..25: note = Seed: LNVIVHSATGFKQSSKALQRPVASD
LNVIVHSATGFKQLSIALSRPVASD

SEQ ID NO: 2183 - protein, 25 aa, synthetic construct
  source 1..25: note = Seed: LNVIVHSATGFKQSSKALQRPVASD
LNVIVHSATGFKQLSIALTRPVASD

SEQ ID NO: 2184 - protein, 25 aa, synthetic construct
  source 1..25: note = Seed: LNVIVHSATGFKQSSKALQRPVASD
LNVIVHSATGFKQLSIALVRPVASD

SEQ ID NO: 2185 - protein, 25 aa, synthetic construct
  source 1..25: note = Seed: LNVIVHSATGFKQSSKALQRPVASD
LNVIVHSATGFKQLSIALYRPVASD

SEQ ID NO: 2186 - protein, 25 aa, synthetic construct
  source 1..25: note = Seed: LNVIVHSATGFKQSSKALQRPVASD
LNVIVHSATGFKQLSKALARPVASD

SEQ ID NO: 2187 - protein, 25 aa, synthetic construct
  source 1..25: note = Seed: LNVIVHSATGFKQSSKALQRPVASD
LNVIVHSATGFKQLSKALCRPVASD

SEQ ID NO: 2188 - protein, 25 aa, synthetic construct
  source 1..25: note = Seed: LNVIVHSATGFKQSSKALQRPVASD
LNVIVHSATGFKQLSKALDRPVASD

SEQ ID NO: 2189 - protein, 25 aa, synthetic construct
  source 1..25: note = Seed: LNVIVHSATGFKQSSKALQRPVASD
LNVIVHSATGFKQLSKALERPVASD

SEQ ID NO: 2190 - protein, 25 aa, synthetic construct
  source 1..25: note = Seed: LNVIVHSATGFKQSSKALQRPVASD
LNVIVHSATGFKQLSKALFRPVASD

SEQ ID NO: 2191 - protein, 25 aa, synthetic construct
  source 1..25: note = Seed: LNVIVHSATGFKQSSKALQRPVASD
LNVIVHSATGFKQLSKALGRPVASD

SEQ ID NO: 2192 - protein, 25 aa, synthetic construct
  source 1..25: note = Seed: LNVIVHSATGFKQSSKALQRPVASD
LNVIVHSATGFKQLSKALHRPVASD

SEQ ID NO: 2193 - protein, 25 aa, synthetic construct
  source 1..25: note = Seed: LNVIVHSATGFKQSSKALQRPVASD
LNVIVHSATGFKQLSKALIRPVASD

SEQ ID NO: 2194 - protein, 25 aa, synthetic construct
  source 1..25: note = Seed: LNVIVHSATGFKQSSKALQRPVASD
LNVIVHSATGFKQLSKALKRPVASD

SEQ ID NO: 2195 - protein, 25 aa, synthetic construct
  source 1..25: note = Seed: LNVIVHSATGFKQSSKALQRPVASD
LNVIVHSATGFKQLSKALLRPVASD

SEQ ID NO: 2196 - protein, 25 aa, synthetic construct
  source 1..25: note = Seed: LNVIVHSATGFKQSSKALQRPVASD
LNVIVHSATGFKQLSKALMRPVASD

SEQ ID NO: 2197 - protein, 25 aa, synthetic construct
  source 1..25: note = Seed: LNVIVHSATGFKQSSKALQRPVASD
LNVIVHSATGFKQLSKALNRPVASD

SEQ ID NO: 2198 - protein, 25 aa, synthetic construct
  source 1..25: note = Seed: LNVIVHSATGFKQSSKALQRPVASD
LNVIVHSATGFKQLSKALPRPVASD

SEQ ID NO: 2199 - protein, 25 aa, synthetic construct
  source 1..25: note = Seed: LNVIVHSATGFKQSSKALQRPVASD
LNVIVHSATGFKQLSKALQRPVASD

SEQ ID NO: 2200 - protein, 25 aa, synthetic construct
  source 1..25: note = Seed: LNVIVHSATGFKQSSKALQRPVASD
LNVIVHSATGFKQLSKALRRPVASD

SEQ ID NO: 2201 - protein, 25 aa, synthetic construct
  source 1..25: note = Seed: LNVIVHSATGFKQSSKALQRPVASD
LNVIVHSATGFKQLSKALSRPVASD

SEQ ID NO: 2202 - protein, 25 aa, synthetic construct
  source 1..25: note = Seed: LNVIVHSATGFKQSSKALQRPVASD
LNVIVHSATGFKQLSKALTRPVASD

SEQ ID NO: 2203 - protein, 25 aa, synthetic construct
  source 1..25: note = Seed: LNVIVHSATGFKQSSKALQRPVASD
LNVIVHSATGFKQLSKALVRPVASD

SEQ ID NO: 2204 - protein, 25 aa, synthetic construct
  source 1..25: note = Seed: LNVIVHSATGFKQSSKALQRPVASD
LNVIVHSATGFKQLSKALYRPVASD

SEQ ID NO: 2205 - protein, 25 aa, synthetic construct
  source 1..25: note = Seed: LNVIVHSATGFKQSSKALQRPVASD
LNVIVHSATGFKQLSLALARPVASD

SEQ ID NO: 2206 - protein, 25 aa, synthetic construct
  source 1..25: note = Seed: LNVIVHSATGFKQSSKALQRPVASD
LNVIVHSATGFKQLSLALCRPVASD

SEQ ID NO: 2207 - protein, 25 aa, synthetic construct
  source 1..25: note = Seed: LNVIVHSATGFKQSSKALQRPVASD
LNVIVHSATGFKQLSLALDRPVASD

SEQ ID NO: 2208 - protein, 25 aa, synthetic construct
  source 1..25: note = Seed: LNVIVHSATGFKQSSKALQRPVASD
LNVIVHSATGFKQLSLALERPVASD

SEQ ID NO: 2209 - protein, 25 aa, synthetic construct
  source 1..25: note = Seed: LNVIVHSATGFKQSSKALQRPVASD
LNVIVHSATGFKQLSLALFRPVASD

SEQ ID NO: 2210 - protein, 25 aa, synthetic construct
  source 1..25: note = Seed: LNVIVHSATGFKQSSKALQRPVASD
LNVIVHSATGFKQLSLALGRPVASD

SEQ ID NO: 2211 - protein, 25 aa, synthetic construct
  source 1..25: note = Seed: LNVIVHSATGFKQSSKALQRPVASD
LNVIVHSATGFKQLSLALHRPVASD

SEQ ID NO: 2212 - protein, 25 aa, synthetic construct
  source 1..25: note = Seed: LNVIVHSATGFKQSSKALQRPVASD
LNVIVHSATGFKQLSLALIRPVASD

SEQ ID NO: 2213 - protein, 25 aa, synthetic construct
  source 1..25: note = Seed: LNVIVHSATGFKQSSKALQRPVASD
LNVIVHSATGFKQLSLALLRPVASD

SEQ ID NO: 2214 - protein, 25 aa, synthetic construct
  source 1..25: note = Seed: LNVIVHSATGFKQSSKALQRPVASD
LNVIVHSATGFKQLSLALMRPVASD

SEQ ID NO: 2215 - protein, 25 aa, synthetic construct
  source 1..25: note = Seed: LNVIVHSATGFKQSSKALQRPVASD
LNVIVHSATGFKQLSLALNRPVASD

SEQ ID NO: 2216 - protein, 25 aa, synthetic construct
  source 1..25: note = Seed: LNVIVHSATGFKQSSKALQRPVASD
LNVIVHSATGFKQLSLALPRPVASD

SEQ ID NO: 2217 - protein, 25 aa, synthetic construct
  source 1..25: note = Seed: LNVIVHSATGFKQSSKALQRPVASD
LNVIVHSATGFKQLSLALQRPVASD

SEQ ID NO: 2218 - protein, 25 aa, synthetic construct
  source 1..25: note = Seed: LNVIVHSATGFKQSSKALQRPVASD
LNVIVHSATGFKQLSLALSRPVASD

SEQ ID NO: 2219 - protein, 25 aa, synthetic construct
  source 1..25: note = Seed: LNVIVHSATGFKQSSKALQRPVASD
LNVIVHSATGFKQLSLALTRPVASD

SEQ ID NO: 2220 - protein, 25 aa, synthetic construct
  source 1..25: note = Seed: LNVIVHSATGFKQSSKALQRPVASD
LNVIVHSATGFKQLSLALVRPVASD

SEQ ID NO: 2221 - protein, 25 aa, synthetic construct
  source 1..25: note = Seed: LNVIVHSATGFKQSSKALQRPVASD
LNVIVHSATGFKQLSMALARPVASD

SEQ ID NO: 2222 - protein, 25 aa, synthetic construct
  source 1..25: note = Seed: LNVIVHSATGFKQSSKALQRPVASD
LNVIVHSATGFKQLSMALCRPVASD

SEQ ID NO: 2223 - protein, 25 aa, synthetic construct
  source 1..25: note = Seed: LNVIVHSATGFKQSSKALQRPVASD
LNVIVHSATGFKQLSMALDRPVASD

SEQ ID NO: 2224 - protein, 25 aa, synthetic construct
  source 1..25: note = Seed: LNVIVHSATGFKQSSKALQRPVASD
LNVIVHSATGFKQLSMALERPVASD

SEQ ID NO: 2225 - protein, 25 aa, synthetic construct
  source 1..25: note = Seed: LNVIVHSATGFKQSSKALQRPVASD
LNVIVHSATGFKQLSMALFRPVASD

SEQ ID NO: 2226 - protein, 25 aa, synthetic construct
  source 1..25: note = Seed: LNVIVHSATGFKQSSKALQRPVASD
LNVIVHSATGFKQLSMALGRPVASD

SEQ ID NO: 2227 - protein, 25 aa, synthetic construct
  source 1..25: note = Seed: LNVIVHSATGFKQSSKALQRPVASD
LNVIVHSATGFKQLSMALHRPVASD

SEQ ID NO: 2228 - protein, 25 aa, synthetic construct
  source 1..25: note = Seed: LNVIVHSATGFKQSSKALQRPVASD
LNVIVHSATGFKQLSMALIRPVASD

SEQ ID NO: 2229 - protein, 25 aa, synthetic construct
  source 1..25: note = Seed: LNVIVHSATGFKQSSKALQRPVASD
LNVIVHSATGFKQLSMALLRPVASD

SEQ ID NO: 2230 - protein, 25 aa, synthetic construct
  source 1..25: note = Seed: LNVIVHSATGFKQSSKALQRPVASD
LNVIVHSATGFKQLSMALMRPVASD

SEQ ID NO: 2231 - protein, 25 aa, synthetic construct
  source 1..25: note = Seed: LNVIVHSATGFKQSSKALQRPVASD
LNVIVHSATGFKQLSMALNRPVASD

SEQ ID NO: 2232 - protein, 25 aa, synthetic construct
  source 1..25: note = Seed: LNVIVHSATGFKQSSKALQRPVASD
LNVIVHSATGFKQLSMALQRPVASD

SEQ ID NO: 2233 - protein, 25 aa, synthetic construct
  source 1..25: note = Seed: LNVIVHSATGFKQSSKALQRPVASD
LNVIVHSATGFKQLSMALSRPVASD

SEQ ID NO: 2234 - protein, 25 aa, synthetic construct
  source 1..25: note = Seed: LNVIVHSATGFKQSSKALQRPVASD
LNVIVHSATGFKQLSMALTRPVASD

SEQ ID NO: 2235 - protein, 25 aa, synthetic construct
  source 1..25: note = Seed: LNVIVHSATGFKQSSKALQRPVASD
LNVIVHSATGFKQLSMALVRPVASD

SEQ ID NO: 2236 - protein, 25 aa, synthetic construct
  source 1..25: note = Seed: LNVIVHSATGFKQSSKALQRPVASD
LNVIVHSATGFKQLSMALYRPVASD

SEQ ID NO: 2237 - protein, 25 aa, synthetic construct
  source 1..25: note = Seed: LNVIVHSATGFKQSSKALQRPVASD
LNVIVHSATGFKQLSNALARPVASD

SEQ ID NO: 2238 - protein, 25 aa, synthetic construct
  source 1..25: note = Seed: LNVIVHSATGFKQSSKALQRPVASD
LNVIVHSATGFKQLSNALCRPVASD

SEQ ID NO: 2239 - protein, 25 aa, synthetic construct
  source 1..25: note = Seed: LNVIVHSATGFKQSSKALQRPVASD
LNVIVHSATGFKQLSNALDRPVASD

SEQ ID NO: 2240 - protein, 25 aa, synthetic construct
  source 1..25: note = Seed: LNVIVHSATGFKQSSKALQRPVASD
LNVIVHSATGFKQLSNALERPVASD

SEQ ID NO: 2241 - protein, 25 aa, synthetic construct
  source 1..25: note = Seed: LNVIVHSATGFKQSSKALQRPVASD
LNVIVHSATGFKQLSNALFRPVASD

SEQ ID NO: 2242 - protein, 25 aa, synthetic construct
  source 1..25: note = Seed: LNVIVHSATGFKQSSKALQRPVASD
LNVIVHSATGFKQLSNALGRPVASD

SEQ ID NO: 2243 - protein, 25 aa, synthetic construct
  source 1..25: note = Seed: LNVIVHSATGFKQSSKALQRPVASD
LNVIVHSATGFKQLSNALHRPVASD

SEQ ID NO: 2244 - protein, 25 aa, synthetic construct
  source 1..25: note = Seed: LNVIVHSATGFKQSSKALQRPVASD
LNVIVHSATGFKQLSNALIRPVASD

SEQ ID NO: 2245 - protein, 25 aa, synthetic construct
  source 1..25: note = Seed: LNVIVHSATGFKQSSKALQRPVASD
LNVIVHSATGFKQLSNALLRPVASD

SEQ ID NO: 2246 - protein, 25 aa, synthetic construct
  source 1..25: note = Seed: LNVIVHSATGFKQSSKALQRPVASD
LNVIVHSATGFKQLSNALMRPVASD

SEQ ID NO: 2247 - protein, 25 aa, synthetic construct
  source 1..25: note = Seed: LNVIVHSATGFKQSSKALQRPVASD
LNVIVHSATGFKQLSNALNRPVASD

SEQ ID NO: 2248 - protein, 25 aa, synthetic construct
  source 1..25: note = Seed: LNVIVHSATGFKQSSKALQRPVASD
LNVIVHSATGFKQLSNALPRPVASD

SEQ ID NO: 2249 - protein, 25 aa, synthetic construct
  source 1..25: note = Seed: LNVIVHSATGFKQSSKALQRPVASD
LNVIVHSATGFKQLSNALQRPVASD

SEQ ID NO: 2250 - protein, 25 aa, synthetic construct
  source 1..25: note = Seed: LNVIVHSATGFKQSSKALQRPVASD
LNVIVHSATGFKQLSNALRRPVASD

SEQ ID NO: 2251 - protein, 25 aa, synthetic construct
  source 1..25: note = Seed: LNVIVHSATGFKQSSKALQRPVASD
LNVIVHSATGFKQLSNALSRPVASD

SEQ ID NO: 2252 - protein, 25 aa, synthetic construct
  source 1..25: note = Seed: LNVIVHSATGFKQSSKALQRPVASD
LNVIVHSATGFKQLSNALTRPVASD

SEQ ID NO: 2253 - protein, 25 aa, synthetic construct
  source 1..25: note = Seed: LNVIVHSATGFKQSSKALQRPVASD
LNVIVHSATGFKQLSNALVRPVASD

SEQ ID NO: 2254 - protein, 25 aa, synthetic construct
  source 1..25: note = Seed: LNVIVHSATGFKQSSKALQRPVASD
LNVIVHSATGFKQLSNALYRPVASD

SEQ ID NO: 2255 - protein, 25 aa, synthetic construct
  source 1..25: note = Seed: LNVIVHSATGFKQSSKALQRPVASD
LNVIVHSATGFKQLSPALARPVASD

SEQ ID NO: 2256 - protein, 25 aa, synthetic construct
  source 1..25: note = Seed: LNVIVHSATGFKQSSKALQRPVASD
LNVIVHSATGFKQLSPALCRPVASD

SEQ ID NO: 2257 - protein, 25 aa, synthetic construct
  source 1..25: note = Seed: LNVIVHSATGFKQSSKALQRPVASD
LNVIVHSATGFKQLSPALDRPVASD

SEQ ID NO: 2258 - protein, 25 aa, synthetic construct
  source 1..25: note = Seed: LNVIVHSATGFKQSSKALQRPVASD
LNVIVHSATGFKQLSPALERPVASD

SEQ ID NO: 2259 - protein, 25 aa, synthetic construct
  source 1..25: note = Seed: LNVIVHSATGFKQSSKALQRPVASD
LNVIVHSATGFKQLSPALFRPVASD

SEQ ID NO: 2260 - protein, 25 aa, synthetic construct
  source 1..25: note = Seed: LNVIVHSATGFKQSSKALQRPVASD
LNVIVHSATGFKQLSPALGRPVASD

SEQ ID NO: 2261 - protein, 25 aa, synthetic construct
  source 1..25: note = Seed: LNVIVHSATGFKQSSKALQRPVASD
LNVIVHSATGFKQLSPALHRPVASD

SEQ ID NO: 2262 - protein, 25 aa, synthetic construct
  source 1..25: note = Seed: LNVIVHSATGFKQSSKALQRPVASD
LNVIVHSATGFKQLSPALIRPVASD

SEQ ID NO: 2263 - protein, 25 aa, synthetic construct
  source 1..25: note = Seed: LNVIVHSATGFKQSSKALQRPVASD
LNVIVHSATGFKQLSPALKRPVASD

SEQ ID NO: 2264 - protein, 25 aa, synthetic construct
  source 1..25: note = Seed: LNVIVHSATGFKQSSKALQRPVASD
LNVIVHSATGFKQLSPALLRPVASD

SEQ ID NO: 2265 - protein, 25 aa, synthetic construct
  source 1..25: note = Seed: LNVIVHSATGFKQSSKALQRPVASD
LNVIVHSATGFKQLSPALMRPVASD

SEQ ID NO: 2266 - protein, 25 aa, synthetic construct
  source 1..25: note = Seed: LNVIVHSATGFKQSSKALQRPVASD
LNVIVHSATGFKQLSPALNRPVASD

SEQ ID NO: 2267 - protein, 25 aa, synthetic construct
  source 1..25: note = Seed: LNVIVHSATGFKQSSKALQRPVASD
LNVIVHSATGFKQLSPALPRPVASD

SEQ ID NO: 2268 - protein, 25 aa, synthetic construct
  source 1..25: note = Seed: LNVIVHSATGFKQSSKALQRPVASD
LNVIVHSATGFKQLSPALQRPVASD

SEQ ID NO: 2269 - protein, 25 aa, synthetic construct
  source 1..25: note = Seed: LNVIVHSATGFKQSSKALQRPVASD
LNVIVHSATGFKQLSPALRRPVASD

SEQ ID NO: 2270 - protein, 25 aa, synthetic construct
  source 1..25: note = Seed: LNVIVHSATGFKQSSKALQRPVASD
LNVIVHSATGFKQLSPALSRPVASD

SEQ ID NO: 2271 - protein, 25 aa, synthetic construct
  source 1..25: note = Seed: LNVIVHSATGFKQSSKALQRPVASD
LNVIVHSATGFKQLSPALTRPVASD

SEQ ID NO: 2272 - protein, 25 aa, synthetic construct
  source 1..25: note = Seed: LNVIVHSATGFKQSSKALQRPVASD
LNVIVHSATGFKQLSPALVRPVASD

SEQ ID NO: 2273 - protein, 25 aa, synthetic construct
  source 1..25: note = Seed: LNVIVHSATGFKQSSKALQRPVASD
LNVIVHSATGFKQLSPALWRPVASD

SEQ ID NO: 2274 - protein, 25 aa, synthetic construct
  source 1..25: note = Seed: LNVIVHSATGFKQSSKALQRPVASD
LNVIVHSATGFKQLSPALYRPVASD

SEQ ID NO: 2275 - protein, 25 aa, synthetic construct
  source 1..25: note = Seed: LNVIVHSATGFKQSSKALQRPVASD
LNVIVHSATGFKQLSQALARPVASD

SEQ ID NO: 2276 - protein, 25 aa, synthetic construct
  source 1..25: note = Seed: LNVIVHSATGFKQSSKALQRPVASD
LNVIVHSATGFKQLSQALGRPVASD

SEQ ID NO: 2277 - protein, 25 aa, synthetic construct
  source 1..25: note = Seed: LNVIVHSATGFKQSSKALQRPVASD
LNVIVHSATGFKQLSQALIRPVASD

SEQ ID NO: 2278 - protein, 25 aa, synthetic construct
  source 1..25: note = Seed: LNVIVHSATGFKQSSKALQRPVASD
LNVIVHSATGFKQLSQALLRPVASD

SEQ ID NO: 2279 - protein, 25 aa, synthetic construct
  source 1..25: note = Seed: LNVIVHSATGFKQSSKALQRPVASD
LNVIVHSATGFKQLSQALMRPVASD

SEQ ID NO: 2280 - protein, 25 aa, synthetic construct
  source 1..25: note = Seed: LNVIVHSATGFKQSSKALQRPVASD
LNVIVHSATGFKQLSQALNRPVASD

SEQ ID NO: 2281 - protein, 25 aa, synthetic construct
  source 1..25: note = Seed: LNVIVHSATGFKQSSKALQRPVASD
LNVIVHSATGFKQLSQALRRPVASD

SEQ ID NO: 2282 - protein, 25 aa, synthetic construct
  source 1..25: note = Seed: LNVIVHSATGFKQSSKALQRPVASD
LNVIVHSATGFKQLSQALSRPVASD

SEQ ID NO: 2283 - protein, 25 aa, synthetic construct
  source 1..25: note = Seed: LNVIVHSATGFKQSSKALQRPVASD
LNVIVHSATGFKQLSQALTRPVASD

SEQ ID NO: 2284 - protein, 25 aa, synthetic construct
  source 1..25: note = Seed: LNVIVHSATGFKQSSKALQRPVASD
LNVIVHSATGFKQLSQALVRPVASD

SEQ ID NO: 2285 - protein, 25 aa, synthetic construct
  source 1..25: note = Seed: LNVIVHSATGFKQSSKALQRPVASD
LNVIVHSATGFKQLSRALARPVASD

SEQ ID NO: 2286 - protein, 25 aa, synthetic construct
  source 1..25: note = Seed: LNVIVHSATGFKQSSKALQRPVASD
LNVIVHSATGFKQLSRALCRPVASD

SEQ ID NO: 2287 - protein, 25 aa, synthetic construct
  source 1..25: note = Seed: LNVIVHSATGFKQSSKALQRPVASD
LNVIVHSATGFKQLSRALDRPVASD

SEQ ID NO: 2288 - protein, 25 aa, synthetic construct
  source 1..25: note = Seed: LNVIVHSATGFKQSSKALQRPVASD
LNVIVHSATGFKQLSRALERPVASD

SEQ ID NO: 2289 - protein, 25 aa, synthetic construct
  source 1..25: note = Seed: LNVIVHSATGFKQSSKALQRPVASD
LNVIVHSATGFKQLSRALFRPVASD

SEQ ID NO: 2290 - protein, 25 aa, synthetic construct
  source 1..25: note = Seed: LNVIVHSATGFKQSSKALQRPVASD
LNVIVHSATGFKQLSRALGRPVASD

SEQ ID NO: 2291 - protein, 25 aa, synthetic construct
  source 1..25: note = Seed: LNVIVHSATGFKQSSKALQRPVASD
LNVIVHSATGFKQLSRALHRPVASD

SEQ ID NO: 2292 - protein, 25 aa, synthetic construct
  source 1..25: note = Seed: LNVIVHSATGFKQSSKALQRPVASD
LNVIVHSATGFKQLSRALIRPVASD

SEQ ID NO: 2293 - protein, 25 aa, synthetic construct
  source 1..25: note = Seed: LNVIVHSATGFKQSSKALQRPVASD
LNVIVHSATGFKQLSRALKRPVASD

SEQ ID NO: 2294 - protein, 25 aa, synthetic construct
  source 1..25: note = Seed: LNVIVHSATGFKQSSKALQRPVASD
LNVIVHSATGFKQLSRALLRPVASD

SEQ ID NO: 2295 - protein, 25 aa, synthetic construct
  source 1..25: note = Seed: LNVIVHSATGFKQSSKALQRPVASD
LNVIVHSATGFKQLSRALMRPVASD

SEQ ID NO: 2296 - protein, 25 aa, synthetic construct
  source 1..25: note = Seed: LNVIVHSATGFKQSSKALQRPVASD
LNVIVHSATGFKQLSRALNRPVASD

SEQ ID NO: 2297 - protein, 25 aa, synthetic construct
  source 1..25: note = Seed: LNVIVHSATGFKQSSKALQRPVASD
LNVIVHSATGFKQLSRALPRPVASD

SEQ ID NO: 2298 - protein, 25 aa, synthetic construct
  source 1..25: note = Seed: LNVIVHSATGFKQSSKALQRPVASD
LNVIVHSATGFKQLSRALQRPVASD

SEQ ID NO: 2299 - protein, 25 aa, synthetic construct
  source 1..25: note = Seed: LNVIVHSATGFKQSSKALQRPVASD
LNVIVHSATGFKQLSRALRRPVASD

SEQ ID NO: 2300 - protein, 25 aa, synthetic construct
  source 1..25: note = Seed: LNVIVHSATGFKQSSKALQRPVASD
LNVIVHSATGFKQLSRALSRPVASD

SEQ ID NO: 2301 - protein, 25 aa, synthetic construct
  source 1..25: note = Seed: LNVIVHSATGFKQSSKALQRPVASD
LNVIVHSATGFKQLSRALTRPVASD

SEQ ID NO: 2302 - protein, 25 aa, synthetic construct
  source 1..25: note = Seed: LNVIVHSATGFKQSSKALQRPVASD
LNVIVHSATGFKQLSRALVRPVASD

SEQ ID NO: 2303 - protein, 25 aa, synthetic construct
  source 1..25: note = Seed: LNVIVHSATGFKQSSKALQRPVASD
LNVIVHSATGFKQLSRALYRPVASD

SEQ ID NO: 2304 - protein, 25 aa, synthetic construct
  source 1..25: note = Seed: LNVIVHSATGFKQSSKALQRPVASD
LNVIVHSATGFKQLSSALARPVASD

SEQ ID NO: 2305 - protein, 25 aa, synthetic construct
  source 1..25: note = Seed: LNVIVHSATGFKQSSKALQRPVASD
LNVIVHSATGFKQLSSALCRPVASD

SEQ ID NO: 2306 - protein, 25 aa, synthetic construct
  source 1..25: note = Seed: LNVIVHSATGFKQSSKALQRPVASD
LNVIVHSATGFKQLSSALDRPVASD

SEQ ID NO: 2307 - protein, 25 aa, synthetic construct
  source 1..25: note = Seed: LNVIVHSATGFKQSSKALQRPVASD
LNVIVHSATGFKQLSSALERPVASD

SEQ ID NO: 2308 - protein, 25 aa, synthetic construct
  source 1..25: note = Seed: LNVIVHSATGFKQSSKALQRPVASD
LNVIVHSATGFKQLSSALFRPVASD

SEQ ID NO: 2309 - protein, 25 aa, synthetic construct
  source 1..25: note = Seed: LNVIVHSATGFKQSSKALQRPVASD
LNVIVHSATGFKQLSSALGRPVASD

SEQ ID NO: 2310 - protein, 25 aa, synthetic construct
  source 1..25: note = Seed: LNVIVHSATGFKQSSKALQRPVASD
LNVIVHSATGFKQLSSALHRPVASD

SEQ ID NO: 2311 - protein, 25 aa, synthetic construct
  source 1..25: note = Seed: LNVIVHSATGFKQSSKALQRPVASD
LNVIVHSATGFKQLSSALIRPVASD

SEQ ID NO: 2312 - protein, 25 aa, synthetic construct
  source 1..25: note = Seed: LNVIVHSATGFKQSSKALQRPVASD
LNVIVHSATGFKQLSSALKRPVASD

SEQ ID NO: 2313 - protein, 25 aa, synthetic construct
  source 1..25: note = Seed: LNVIVHSATGFKQSSKALQRPVASD
LNVIVHSATGFKQLSSALLRPVASD

SEQ ID NO: 2314 - protein, 25 aa, synthetic construct
  source 1..25: note = Seed: LNVIVHSATGFKQSSKALQRPVASD
LNVIVHSATGFKQLSSALMRPVASD

SEQ ID NO: 2315 - protein, 25 aa, synthetic construct
  source 1..25: note = Seed: LNVIVHSATGFKQSSKALQRPVASD
LNVIVHSATGFKQLSSALNRPVASD

SEQ ID NO: 2316 - protein, 25 aa, synthetic construct
  source 1..25: note = Seed: LNVIVHSATGFKQSSKALQRPVASD
LNVIVHSATGFKQLSSALPRPVASD

SEQ ID NO: 2317 - protein, 25 aa, synthetic construct
  source 1..25: note = Seed: LNVIVHSATGFKQSSKALQRPVASD
LNVIVHSATGFKQLSSALQRPVASD

SEQ ID NO: 2318 - protein, 25 aa, synthetic construct
  source 1..25: note = Seed: LNVIVHSATGFKQSSKALQRPVASD
LNVIVHSATGFKQLSSALRRPVASD

SEQ ID NO: 2319 - protein, 25 aa, synthetic construct
  source 1..25: note = Seed: LNVIVHSATGFKQSSKALQRPVASD
LNVIVHSATGFKQLSSALSRPVASD

SEQ ID NO: 2320 - protein, 25 aa, synthetic construct
  source 1..25: note = Seed: LNVIVHSATGFKQSSKALQRPVASD
LNVIVHSATGFKQLSSALTRPVASD

SEQ ID NO: 2321 - protein, 25 aa, synthetic construct
  source 1..25: note = Seed: LNVIVHSATGFKQSSKALQRPVASD
LNVIVHSATGFKQLSSALVRPVASD

SEQ ID NO: 2322 - protein, 25 aa, synthetic construct
  source 1..25: note = Seed: LNVIVHSATGFKQSSKALQRPVASD
LNVIVHSATGFKQLSSALWRPVASD

SEQ ID NO: 2323 - protein, 25 aa, synthetic construct
  source 1..25: note = Seed: LNVIVHSATGFKQSSKALQRPVASD
LNVIVHSATGFKQLSSALYRPVASD

SEQ ID NO: 2324 - protein, 25 aa, synthetic construct
  source 1..25: note = Seed: LNVIVHSATGFKQSSKALQRPVASD
LNVIVHSATGFKQLSTALARPVASD

SEQ ID NO: 2325 - protein, 25 aa, synthetic construct
  source 1..25: note = Seed: LNVIVHSATGFKQSSKALQRPVASD
LNVIVHSATGFKQLSTALCRPVASD

SEQ ID NO: 2326 - protein, 25 aa, synthetic construct
  source 1..25: note = Seed: LNVIVHSATGFKQSSKALQRPVASD
LNVIVHSATGFKQLSTALDRPVASD

SEQ ID NO: 2327 - protein, 25 aa, synthetic construct
  source 1..25: note = Seed: LNVIVHSATGFKQSSKALQRPVASD
LNVIVHSATGFKQLSTALERPVASD

SEQ ID NO: 2328 - protein, 25 aa, synthetic construct
  source 1..25: note = Seed: LNVIVHSATGFKQSSKALQRPVASD
LNVIVHSATGFKQLSTALFRPVASD

SEQ ID NO: 2329 - protein, 25 aa, synthetic construct
  source 1..25: note = Seed: LNVIVHSATGFKQSSKALQRPVASD
LNVIVHSATGFKQLSTALGRPVASD

SEQ ID NO: 2330 - protein, 25 aa, synthetic construct
  source 1..25: note = Seed: LNVIVHSATGFKQSSKALQRPVASD
LNVIVHSATGFKQLSTALHRPVASD

SEQ ID NO: 2331 - protein, 25 aa, synthetic construct
  source 1..25: note = Seed: LNVIVHSATGFKQSSKALQRPVASD
LNVIVHSATGFKQLSTALIRPVASD

SEQ ID NO: 2332 - protein, 25 aa, synthetic construct
  source 1..25: note = Seed: LNVIVHSATGFKQSSKALQRPVASD
LNVIVHSATGFKQLSTALKRPVASD

SEQ ID NO: 2333 - protein, 25 aa, synthetic construct
  source 1..25: note = Seed: LNVIVHSATGFKQSSKALQRPVASD
LNVIVHSATGFKQLSTALLRPVASD

SEQ ID NO: 2334 - protein, 25 aa, synthetic construct
  source 1..25: note = Seed: LNVIVHSATGFKQSSKALQRPVASD
LNVIVHSATGFKQLSTALMRPVASD

SEQ ID NO: 2335 - protein, 25 aa, synthetic construct
  source 1..25: note = Seed: LNVIVHSATGFKQSSKALQRPVASD
LNVIVHSATGFKQLSTALNRPVASD

SEQ ID NO: 2336 - protein, 25 aa, synthetic construct
  source 1..25: note = Seed: LNVIVHSATGFKQSSKALQRPVASD
LNVIVHSATGFKQLSTALPRPVASD

SEQ ID NO: 2337 - protein, 25 aa, synthetic construct
  source 1..25: note = Seed: LNVIVHSATGFKQSSKALQRPVASD
LNVIVHSATGFKQLSTALQRPVASD

SEQ ID NO: 2338 - protein, 25 aa, synthetic construct
  source 1..25: note = Seed: LNVIVHSATGFKQSSKALQRPVASD
LNVIVHSATGFKQLSTALRRPVASD

SEQ ID NO: 2339 - protein, 25 aa, synthetic construct
  source 1..25: note = Seed: LNVIVHSATGFKQSSKALQRPVASD
LNVIVHSATGFKQLSTALSRPVASD

SEQ ID NO: 2340 - protein, 25 aa, synthetic construct
  source 1..25: note = Seed: LNVIVHSATGFKQSSKALQRPVASD
LNVIVHSATGFKQLSTALTRPVASD

SEQ ID NO: 2341 - protein, 25 aa, synthetic construct
  source 1..25: note = Seed: LNVIVHSATGFKQSSKALQRPVASD
LNVIVHSATGFKQLSTALVRPVASD

SEQ ID NO: 2342 - protein, 25 aa, synthetic construct
  source 1..25: note = Seed: LNVIVHSATGFKQSSKALQRPVASD
LNVIVHSATGFKQLSTALYRPVASD

SEQ ID NO: 2343 - protein, 25 aa, synthetic construct
  source 1..25: note = Seed: LNVIVHSATGFKQSSKALQRPVASD
LNVIVHSATGFKQLSVALARPVASD

SEQ ID NO: 2344 - protein, 25 aa, synthetic construct
  source 1..25: note = Seed: LNVIVHSATGFKQSSKALQRPVASD
LNVIVHSATGFKQLSVALCRPVASD

SEQ ID NO: 2345 - protein, 25 aa, synthetic construct
  source 1..25: note = Seed: LNVIVHSATGFKQSSKALQRPVASD
LNVIVHSATGFKQLSVALDRPVASD

SEQ ID NO: 2346 - protein, 25 aa, synthetic construct
  source 1..25: note = Seed: LNVIVHSATGFKQSSKALQRPVASD
LNVIVHSATGFKQLSVALERPVASD

SEQ ID NO: 2347 - protein, 25 aa, synthetic construct
  source 1..25: note = Seed: LNVIVHSATGFKQSSKALQRPVASD
LNVIVHSATGFKQLSVALFRPVASD

SEQ ID NO: 2348 - protein, 25 aa, synthetic construct
  source 1..25: note = Seed: LNVIVHSATGFKQSSKALQRPVASD
LNVIVHSATGFKQLSVALGRPVASD

SEQ ID NO: 2349 - protein, 25 aa, synthetic construct
  source 1..25: note = Seed: LNVIVHSATGFKQSSKALQRPVASD
LNVIVHSATGFKQLSVALHRPVASD

SEQ ID NO: 2350 - protein, 25 aa, synthetic construct
  source 1..25: note = Seed: LNVIVHSATGFKQSSKALQRPVASD
LNVIVHSATGFKQLSVALIRPVASD

SEQ ID NO: 2351 - protein, 25 aa, synthetic construct
  source 1..25: note = Seed: LNVIVHSATGFKQSSKALQRPVASD
LNVIVHSATGFKQLSVALKRPVASD

SEQ ID NO: 2352 - protein, 25 aa, synthetic construct
  source 1..25: note = Seed: LNVIVHSATGFKQSSKALQRPVASD
LNVIVHSATGFKQLSVALLRPVASD

SEQ ID NO: 2353 - protein, 25 aa, synthetic construct
  source 1..25: note = Seed: LNVIVHSATGFKQSSKALQRPVASD
LNVIVHSATGFKQLSVALMRPVASD

SEQ ID NO: 2354 - protein, 25 aa, synthetic construct
  source 1..25: note = Seed: LNVIVHSATGFKQSSKALQRPVASD
LNVIVHSATGFKQLSVALNRPVASD

SEQ ID NO: 2355 - protein, 25 aa, synthetic construct
  source 1..25: note = Seed: LNVIVHSATGFKQSSKALQRPVASD
LNVIVHSATGFKQLSVALPRPVASD

SEQ ID NO: 2356 - protein, 25 aa, synthetic construct
  source 1..25: note = Seed: LNVIVHSATGFKQSSKALQRPVASD
LNVIVHSATGFKQLSVALQRPVASD

SEQ ID NO: 2357 - protein, 25 aa, synthetic construct
  source 1..25: note = Seed: LNVIVHSATGFKQSSKALQRPVASD
LNVIVHSATGFKQLSVALRRPVASD

SEQ ID NO: 2358 - protein, 25 aa, synthetic construct
  source 1..25: note = Seed: LNVIVHSATGFKQSSKALQRPVASD
LNVIVHSATGFKQLSVALSRPVASD

SEQ ID NO: 2359 - protein, 25 aa, synthetic construct
  source 1..25: note = Seed: LNVIVHSATGFKQSSKALQRPVASD
LNVIVHSATGFKQLSVALTRPVASD

SEQ ID NO: 2360 - protein, 25 aa, synthetic construct
  source 1..25: note = Seed: LNVIVHSATGFKQSSKALQRPVASD
LNVIVHSATGFKQLSVALVRPVASD

SEQ ID NO: 2361 - protein, 25 aa, synthetic construct
  source 1..25: note = Seed: LNVIVHSATGFKQSSKALQRPVASD
LNVIVHSATGFKQLSVALYRPVASD

SEQ ID NO: 2362 - protein, 25 aa, synthetic construct
  source 1..25: note = Seed: LNVIVHSATGFKQSSKALQRPVASD
LNVIVHSATGFKQLSWALGRPVASD

SEQ ID NO: 2363 - protein, 25 aa, synthetic construct
  source 1..25: note = Seed: LNVIVHSATGFKQSSKALQRPVASD
LNVIVHSATGFKQLSWALHRPVASD

SEQ ID NO: 2364 - protein, 25 aa, synthetic construct
  source 1..25: note = Seed: LNVIVHSATGFKQSSKALQRPVASD
LNVIVHSATGFKQLSWALIRPVASD

SEQ ID NO: 2365 - protein, 25 aa, synthetic construct
  source 1..25: note = Seed: LNVIVHSATGFKQSSKALQRPVASD
LNVIVHSATGFKQLSWALNRPVASD

SEQ ID NO: 2366 - protein, 25 aa, synthetic construct
  source 1..25: note = Seed: LNVIVHSATGFKQSSKALQRPVASD
LNVIVHSATGFKQLSWALSRPVASD

SEQ ID NO: 2367 - protein, 25 aa, synthetic construct
  source 1..25: note = Seed: LNVIVHSATGFKQSSKALQRPVASD
LNVIVHSATGFKQLSWALTRPVASD

SEQ ID NO: 2368 - protein, 25 aa, synthetic construct
  source 1..25: note = Seed: LNVIVHSATGFKQSSKALQRPVASD
LNVIVHSATGFKQLSWALVRPVASD

SEQ ID NO: 2369 - protein, 25 aa, synthetic construct
  source 1..25: note = Seed: LNVIVHSATGFKQSSKALQRPVASD
LNVIVHSATGFKQLSYALGRPVASD

SEQ ID NO: 2370 - protein, 25 aa, synthetic construct
  source 1..25: note = Seed: LNVIVHSATGFKQSSKALQRPVASD
LNVIVHSATGFKQLSYALHRPVASD

SEQ ID NO: 2371 - protein, 25 aa, synthetic construct
  source 1..25: note = Seed: LNVIVHSATGFKQSSKALQRPVASD
LNVIVHSATGFKQLSYALIRPVASD

SEQ ID NO: 2372 - protein, 25 aa, synthetic construct
  source 1..25: note = Seed: LNVIVHSATGFKQSSKALQRPVASD
LNVIVHSATGFKQLSYALMRPVASD

SEQ ID NO: 2373 - protein, 25 aa, synthetic construct
  source 1..25: note = Seed: LNVIVHSATGFKQSSKALQRPVASD
LNVIVHSATGFKQLSYALNRPVASD

SEQ ID NO: 2374 - protein, 25 aa, synthetic construct
  source 1..25: note = Seed: LNVIVHSATGFKQSSKALQRPVASD
LNVIVHSATGFKQLSYALSRPVASD

SEQ ID NO: 2375 - protein, 25 aa, synthetic construct
  source 1..25: note = Seed: LNVIVHSATGFKQSSKALQRPVASD
LNVIVHSATGFKQLSYALVRPVASD

SEQ ID NO: 2376 - protein, 25 aa, synthetic construct
  source 1..25: note = Seed: LNVIVHSATGFKQSSKALQRPVASD
LNVIVHSATGFKQMSAALARPVASD

SEQ ID NO: 2377 - protein, 25 aa, synthetic construct
  source 1..25: note = Seed: LNVIVHSATGFKQSSKALQRPVASD
LNVIVHSATGFKQMSAALCRPVASD

SEQ ID NO: 2378 - protein, 25 aa, synthetic construct
  source 1..25: note = Seed: LNVIVHSATGFKQSSKALQRPVASD
LNVIVHSATGFKQMSAALDRPVASD

SEQ ID NO: 2379 - protein, 25 aa, synthetic construct
  source 1..25: note = Seed: LNVIVHSATGFKQSSKALQRPVASD
LNVIVHSATGFKQMSAALERPVASD

SEQ ID NO: 2380 - protein, 25 aa, synthetic construct
  source 1..25: note = Seed: LNVIVHSATGFKQSSKALQRPVASD
LNVIVHSATGFKQMSAALFRPVASD

SEQ ID NO: 2381 - protein, 25 aa, synthetic construct
  source 1..25: note = Seed: LNVIVHSATGFKQSSKALQRPVASD
LNVIVHSATGFKQMSAALGRPVASD

SEQ ID NO: 2382 - protein, 25 aa, synthetic construct
  source 1..25: note = Seed: LNVIVHSATGFKQSSKALQRPVASD
LNVIVHSATGFKQMSAALHRPVASD

SEQ ID NO: 2383 - protein, 25 aa, synthetic construct
  source 1..25: note = Seed: LNVIVHSATGFKQSSKALQRPVASD
LNVIVHSATGFKQMSAALIRPVASD

SEQ ID NO: 2384 - protein, 25 aa, synthetic construct
  source 1..25: note = Seed: LNVIVHSATGFKQSSKALQRPVASD
LNVIVHSATGFKQMSAALKRPVASD

SEQ ID NO: 2385 - protein, 25 aa, synthetic construct
  source 1..25: note = Seed: LNVIVHSATGFKQSSKALQRPVASD
LNVIVHSATGFKQMSAALLRPVASD

SEQ ID NO: 2386 - protein, 25 aa, synthetic construct
  source 1..25: note = Seed: LNVIVHSATGFKQSSKALQRPVASD
LNVIVHSATGFKQMSAALMRPVASD

SEQ ID NO: 2387 - protein, 25 aa, synthetic construct
  source 1..25: note = Seed: LNVIVHSATGFKQSSKALQRPVASD
LNVIVHSATGFKQMSAALNRPVASD

SEQ ID NO: 2388 - protein, 25 aa, synthetic construct
  source 1..25: note = Seed: LNVIVHSATGFKQSSKALQRPVASD
LNVIVHSATGFKQMSAALPRPVASD

SEQ ID NO: 2389 - protein, 25 aa, synthetic construct
  source 1..25: note = Seed: LNVIVHSATGFKQSSKALQRPVASD
LNVIVHSATGFKQMSAALQRPVASD

SEQ ID NO: 2390 - protein, 25 aa, synthetic construct
  source 1..25: note = Seed: LNVIVHSATGFKQSSKALQRPVASD
LNVIVHSATGFKQMSAALRRPVASD

SEQ ID NO: 2391 - protein, 25 aa, synthetic construct
  source 1..25: note = Seed: LNVIVHSATGFKQSSKALQRPVASD
LNVIVHSATGFKQMSAALSRPVASD

SEQ ID NO: 2392 - protein, 25 aa, synthetic construct
  source 1..25: note = Seed: LNVIVHSATGFKQSSKALQRPVASD
LNVIVHSATGFKQMSAALTRPVASD

SEQ ID NO: 2393 - protein, 25 aa, synthetic construct
  source 1..25: note = Seed: LNVIVHSATGFKQSSKALQRPVASD
LNVIVHSATGFKQMSAALVRPVASD

SEQ ID NO: 2394 - protein, 25 aa, synthetic construct
  source 1..25: note = Seed: LNVIVHSATGFKQSSKALQRPVASD
LNVIVHSATGFKQMSAALWRPVASD

SEQ ID NO: 2395 - protein, 25 aa, synthetic construct
  source 1..25: note = Seed: LNVIVHSATGFKQSSKALQRPVASD
LNVIVHSATGFKQMSAALYRPVASD

SEQ ID NO: 2396 - protein, 25 aa, synthetic construct
  source 1..25: note = Seed: LNVIVHSATGFKQSSKALQRPVASD
LNVIVHSATGFKQMSCALARPVASD

SEQ ID NO: 2397 - protein, 25 aa, synthetic construct
  source 1..25: note = Seed: LNVIVHSATGFKQSSKALQRPVASD
LNVIVHSATGFKQMSCALGRPVASD

SEQ ID NO: 2398 - protein, 25 aa, synthetic construct
  source 1..25: note = Seed: LNVIVHSATGFKQSSKALQRPVASD
LNVIVHSATGFKQMSCALHRPVASD

SEQ ID NO: 2399 - protein, 25 aa, synthetic construct
  source 1..25: note = Seed: LNVIVHSATGFKQSSKALQRPVASD
LNVIVHSATGFKQMSCALIRPVASD

SEQ ID NO: 2400 - protein, 25 aa, synthetic construct
  source 1..25: note = Seed: LNVIVHSATGFKQSSKALQRPVASD
LNVIVHSATGFKQMSCALLRPVASD

SEQ ID NO: 2401 - protein, 25 aa, synthetic construct
  source 1..25: note = Seed: LNVIVHSATGFKQSSKALQRPVASD
LNVIVHSATGFKQMSCALMRPVASD

SEQ ID NO: 2402 - protein, 25 aa, synthetic construct
  source 1..25: note = Seed: LNVIVHSATGFKQSSKALQRPVASD
LNVIVHSATGFKQMSCALNRPVASD

SEQ ID NO: 2403 - protein, 25 aa, synthetic construct
  source 1..25: note = Seed: LNVIVHSATGFKQSSKALQRPVASD
LNVIVHSATGFKQMSCALSRPVASD

SEQ ID NO: 2404 - protein, 25 aa, synthetic construct
  source 1..25: note = Seed: LNVIVHSATGFKQSSKALQRPVASD
LNVIVHSATGFKQMSCALTRPVASD

SEQ ID NO: 2405 - protein, 25 aa, synthetic construct
  source 1..25: note = Seed: LNVIVHSATGFKQSSKALQRPVASD
LNVIVHSATGFKQMSCALVRPVASD

SEQ ID NO: 2406 - protein, 25 aa, synthetic construct
  source 1..25: note = Seed: LNVIVHSATGFKQSSKALQRPVASD
LNVIVHSATGFKQMSDALARPVASD

SEQ ID NO: 2407 - protein, 25 aa, synthetic construct
  source 1..25: note = Seed: LNVIVHSATGFKQSSKALQRPVASD
LNVIVHSATGFKQMSDALIRPVASD

SEQ ID NO: 2408 - protein, 25 aa, synthetic construct
  source 1..25: note = Seed: LNVIVHSATGFKQSSKALQRPVASD
LNVIVHSATGFKQMSDALLRPVASD

SEQ ID NO: 2409 - protein, 25 aa, synthetic construct
  source 1..25: note = Seed: LNVIVHSATGFKQSSKALQRPVASD
LNVIVHSATGFKQMSDALMRPVASD

SEQ ID NO: 2410 - protein, 25 aa, synthetic construct
  source 1..25: note = Seed: LNVIVHSATGFKQSSKALQRPVASD
LNVIVHSATGFKQMSDALNRPVASD

SEQ ID NO: 2411 - protein, 25 aa, synthetic construct
  source 1..25: note = Seed: LNVIVHSATGFKQSSKALQRPVASD
LNVIVHSATGFKQMSDALSRPVASD

SEQ ID NO: 2412 - protein, 25 aa, synthetic construct
  source 1..25: note = Seed: LNVIVHSATGFKQSSKALQRPVASD
LNVIVHSATGFKQMSDALTRPVASD

SEQ ID NO: 2413 - protein, 25 aa, synthetic construct
  source 1..25: note = Seed: LNVIVHSATGFKQSSKALQRPVASD
LNVIVHSATGFKQMSDALVRPVASD

SEQ ID NO: 2414 - protein, 25 aa, synthetic construct
  source 1..25: note = Seed: LNVIVHSATGFKQSSKALQRPVASD
LNVIVHSATGFKQMSEALARPVASD

SEQ ID NO: 2415 - protein, 25 aa, synthetic construct
  source 1..25: note = Seed: LNVIVHSATGFKQSSKALQRPVASD
LNVIVHSATGFKQMSEALGRPVASD

SEQ ID NO: 2416 - protein, 25 aa, synthetic construct
  source 1..25: note = Seed: LNVIVHSATGFKQSSKALQRPVASD
LNVIVHSATGFKQMSEALIRPVASD

SEQ ID NO: 2417 - protein, 25 aa, synthetic construct
  source 1..25: note = Seed: LNVIVHSATGFKQSSKALQRPVASD
LNVIVHSATGFKQMSEALLRPVASD

SEQ ID NO: 2418 - protein, 25 aa, synthetic construct
  source 1..25: note = Seed: LNVIVHSATGFKQSSKALQRPVASD
LNVIVHSATGFKQMSEALMRPVASD

SEQ ID NO: 2419 - protein, 25 aa, synthetic construct
  source 1..25: note = Seed: LNVIVHSATGFKQSSKALQRPVASD
LNVIVHSATGFKQMSEALNRPVASD

SEQ ID NO: 2420 - protein, 25 aa, synthetic construct
  source 1..25: note = Seed: LNVIVHSATGFKQSSKALQRPVASD
LNVIVHSATGFKQMSEALSRPVASD

SEQ ID NO: 2421 - protein, 25 aa, synthetic construct
  source 1..25: note = Seed: LNVIVHSATGFKQSSKALQRPVASD
LNVIVHSATGFKQMSEALTRPVASD

SEQ ID NO: 2422 - protein, 25 aa, synthetic construct
  source 1..25: note = Seed: LNVIVHSATGFKQSSKALQRPVASD
LNVIVHSATGFKQMSEALVRPVASD

SEQ ID NO: 2423 - protein, 25 aa, synthetic construct
  source 1..25: note = Seed: LNVIVHSATGFKQSSKALQRPVASD
LNVIVHSATGFKQMSFALDRPVASD

SEQ ID NO: 2424 - protein, 25 aa, synthetic construct
  source 1..25: note = Seed: LNVIVHSATGFKQSSKALQRPVASD
LNVIVHSATGFKQMSFALERPVASD

SEQ ID NO: 2425 - protein, 25 aa, synthetic construct
  source 1..25: note = Seed: LNVIVHSATGFKQSSKALQRPVASD
LNVIVHSATGFKQMSFALGRPVASD

SEQ ID NO: 2426 - protein, 25 aa, synthetic construct
  source 1..25: note = Seed: LNVIVHSATGFKQSSKALQRPVASD
LNVIVHSATGFKQMSFALHRPVASD

SEQ ID NO: 2427 - protein, 25 aa, synthetic construct
  source 1..25: note = Seed: LNVIVHSATGFKQSSKALQRPVASD
LNVIVHSATGFKQMSFALIRPVASD

SEQ ID NO: 2428 - protein, 25 aa, synthetic construct
  source 1..25: note = Seed: LNVIVHSATGFKQSSKALQRPVASD
LNVIVHSATGFKQMSFALLRPVASD

SEQ ID NO: 2429 - protein, 25 aa, synthetic construct
  source 1..25: note = Seed: LNVIVHSATGFKQSSKALQRPVASD
LNVIVHSATGFKQMSFALMRPVASD

SEQ ID NO: 2430 - protein, 25 aa, synthetic construct
  source 1..25: note = Seed: LNVIVHSATGFKQSSKALQRPVASD
LNVIVHSATGFKQMSFALNRPVASD

SEQ ID NO: 2431 - protein, 25 aa, synthetic construct
  source 1..25: note = Seed: LNVIVHSATGFKQSSKALQRPVASD
LNVIVHSATGFKQMSFALSRPVASD

SEQ ID NO: 2432 - protein, 25 aa, synthetic construct
  source 1..25: note = Seed: LNVIVHSATGFKQSSKALQRPVASD
LNVIVHSATGFKQMSFALVRPVASD

SEQ ID NO: 2433 - protein, 25 aa, synthetic construct
  source 1..25: note = Seed: LNVIVHSATGFKQSSKALQRPVASD
LNVIVHSATGFKQMSFALYRPVASD

SEQ ID NO: 2434 - protein, 25 aa, synthetic construct
  source 1..25: note = Seed: LNVIVHSATGFKQSSKALQRPVASD
LNVIVHSATGFKQMSGALARPVASD

SEQ ID NO: 2435 - protein, 25 aa, synthetic construct
  source 1..25: note = Seed: LNVIVHSATGFKQSSKALQRPVASD
LNVIVHSATGFKQMSGALCRPVASD

SEQ ID NO: 2436 - protein, 25 aa, synthetic construct
  source 1..25: note = Seed: LNVIVHSATGFKQSSKALQRPVASD
LNVIVHSATGFKQMSGALDRPVASD

SEQ ID NO: 2437 - protein, 25 aa, synthetic construct
  source 1..25: note = Seed: LNVIVHSATGFKQSSKALQRPVASD
LNVIVHSATGFKQMSGALERPVASD

SEQ ID NO: 2438 - protein, 25 aa, synthetic construct
  source 1..25: note = Seed: LNVIVHSATGFKQSSKALQRPVASD
LNVIVHSATGFKQMSGALFRPVASD

SEQ ID NO: 2439 - protein, 25 aa, synthetic construct
  source 1..25: note = Seed: LNVIVHSATGFKQSSKALQRPVASD
LNVIVHSATGFKQMSGALGRPVASD

SEQ ID NO: 2440 - protein, 25 aa, synthetic construct
  source 1..25: note = Seed: LNVIVHSATGFKQSSKALQRPVASD
LNVIVHSATGFKQMSGALHRPVASD

SEQ ID NO: 2441 - protein, 25 aa, synthetic construct
  source 1..25: note = Seed: LNVIVHSATGFKQSSKALQRPVASD
LNVIVHSATGFKQMSGALIRPVASD

SEQ ID NO: 2442 - protein, 25 aa, synthetic construct
  source 1..25: note = Seed: LNVIVHSATGFKQSSKALQRPVASD
LNVIVHSATGFKQMSGALKRPVASD

SEQ ID NO: 2443 - protein, 25 aa, synthetic construct
  source 1..25: note = Seed: LNVIVHSATGFKQSSKALQRPVASD
LNVIVHSATGFKQMSGALLRPVASD

SEQ ID NO: 2444 - protein, 25 aa, synthetic construct
  source 1..25: note = Seed: LNVIVHSATGFKQSSKALQRPVASD
LNVIVHSATGFKQMSGALMRPVASD

SEQ ID NO: 2445 - protein, 25 aa, synthetic construct
  source 1..25: note = Seed: LNVIVHSATGFKQSSKALQRPVASD
LNVIVHSATGFKQMSGALNRPVASD

SEQ ID NO: 2446 - protein, 25 aa, synthetic construct
  source 1..25: note = Seed: LNVIVHSATGFKQSSKALQRPVASD
LNVIVHSATGFKQMSGALPRPVASD

SEQ ID NO: 2447 - protein, 25 aa, synthetic construct
  source 1..25: note = Seed: LNVIVHSATGFKQSSKALQRPVASD
LNVIVHSATGFKQMSGALQRPVASD

SEQ ID NO: 2448 - protein, 25 aa, synthetic construct
  source 1..25: note = Seed: LNVIVHSATGFKQSSKALQRPVASD
LNVIVHSATGFKQMSGALRRPVASD

SEQ ID NO: 2449 - protein, 25 aa, synthetic construct
  source 1..25: note = Seed: LNVIVHSATGFKQSSKALQRPVASD
LNVIVHSATGFKQMSGALSRPVASD

SEQ ID NO: 2450 - protein, 25 aa, synthetic construct
  source 1..25: note = Seed: LNVIVHSATGFKQSSKALQRPVASD
LNVIVHSATGFKQMSGALTRPVASD

SEQ ID NO: 2451 - protein, 25 aa, synthetic construct
  source 1..25: note = Seed: LNVIVHSATGFKQSSKALQRPVASD
LNVIVHSATGFKQMSGALVRPVASD

SEQ ID NO: 2452 - protein, 25 aa, synthetic construct
  source 1..25: note = Seed: LNVIVHSATGFKQSSKALQRPVASD
LNVIVHSATGFKQMSGALWRPVASD

SEQ ID NO: 2453 - protein, 25 aa, synthetic construct
  source 1..25: note = Seed: LNVIVHSATGFKQSSKALQRPVASD
LNVIVHSATGFKQMSGALYRPVASD

SEQ ID NO: 2454 - protein, 25 aa, synthetic construct
  source 1..25: note = Seed: LNVIVHSATGFKQSSKALQRPVASD
LNVIVHSATGFKQMSHALARPVASD

SEQ ID NO: 2455 - protein, 25 aa, synthetic construct
  source 1..25: note = Seed: LNVIVHSATGFKQSSKALQRPVASD
LNVIVHSATGFKQMSHALGRPVASD

SEQ ID NO: 2456 - protein, 25 aa, synthetic construct
  source 1..25: note = Seed: LNVIVHSATGFKQSSKALQRPVASD
LNVIVHSATGFKQMSHALHRPVASD

SEQ ID NO: 2457 - protein, 25 aa, synthetic construct
  source 1..25: note = Seed: LNVIVHSATGFKQSSKALQRPVASD
LNVIVHSATGFKQMSHALIRPVASD

SEQ ID NO: 2458 - protein, 25 aa, synthetic construct
  source 1..25: note = Seed: LNVIVHSATGFKQSSKALQRPVASD
LNVIVHSATGFKQMSHALKRPVASD

SEQ ID NO: 2459 - protein, 25 aa, synthetic construct
  source 1..25: note = Seed: LNVIVHSATGFKQSSKALQRPVASD
LNVIVHSATGFKQMSHALLRPVASD

SEQ ID NO: 2460 - protein, 25 aa, synthetic construct
  source 1..25: note = Seed: LNVIVHSATGFKQSSKALQRPVASD
LNVIVHSATGFKQMSHALMRPVASD

SEQ ID NO: 2461 - protein, 25 aa, synthetic construct
  source 1..25: note = Seed: LNVIVHSATGFKQSSKALQRPVASD
LNVIVHSATGFKQMSHALNRPVASD

SEQ ID NO: 2462 - protein, 25 aa, synthetic construct
  source 1..25: note = Seed: LNVIVHSATGFKQSSKALQRPVASD
LNVIVHSATGFKQMSHALPRPVASD

SEQ ID NO: 2463 - protein, 25 aa, synthetic construct
  source 1..25: note = Seed: LNVIVHSATGFKQSSKALQRPVASD
LNVIVHSATGFKQMSHALQRPVASD

SEQ ID NO: 2464 - protein, 25 aa, synthetic construct
  source 1..25: note = Seed: LNVIVHSATGFKQSSKALQRPVASD
LNVIVHSATGFKQMSHALRRPVASD

SEQ ID NO: 2465 - protein, 25 aa, synthetic construct
  source 1..25: note = Seed: LNVIVHSATGFKQSSKALQRPVASD
LNVIVHSATGFKQMSHALSRPVASD

SEQ ID NO: 2466 - protein, 25 aa, synthetic construct
  source 1..25: note = Seed: LNVIVHSATGFKQSSKALQRPVASD
LNVIVHSATGFKQMSHALTRPVASD

SEQ ID NO: 2467 - protein, 25 aa, synthetic construct
  source 1..25: note = Seed: LNVIVHSATGFKQSSKALQRPVASD
LNVIVHSATGFKQMSHALVRPVASD

SEQ ID NO: 2468 - protein, 25 aa, synthetic construct
  source 1..25: note = Seed: LNVIVHSATGFKQSSKALQRPVASD
LNVIVHSATGFKQMSIALARPVASD

SEQ ID NO: 2469 - protein, 25 aa, synthetic construct
  source 1..25: note = Seed: LNVIVHSATGFKQSSKALQRPVASD
LNVIVHSATGFKQMSIALCRPVASD

SEQ ID NO: 2470 - protein, 25 aa, synthetic construct
  source 1..25: note = Seed: LNVIVHSATGFKQSSKALQRPVASD
LNVIVHSATGFKQMSIALDRPVASD

SEQ ID NO: 2471 - protein, 25 aa, synthetic construct
  source 1..25: note = Seed: LNVIVHSATGFKQSSKALQRPVASD
LNVIVHSATGFKQMSIALERPVASD

SEQ ID NO: 2472 - protein, 25 aa, synthetic construct
  source 1..25: note = Seed: LNVIVHSATGFKQSSKALQRPVASD
LNVIVHSATGFKQMSIALFRPVASD

SEQ ID NO: 2473 - protein, 25 aa, synthetic construct
  source 1..25: note = Seed: LNVIVHSATGFKQSSKALQRPVASD
LNVIVHSATGFKQMSIALGRPVASD

SEQ ID NO: 2474 - protein, 25 aa, synthetic construct
  source 1..25: note = Seed: LNVIVHSATGFKQSSKALQRPVASD
LNVIVHSATGFKQMSIALHRPVASD

SEQ ID NO: 2475 - protein, 25 aa, synthetic construct
  source 1..25: note = Seed: LNVIVHSATGFKQSSKALQRPVASD
LNVIVHSATGFKQMSIALIRPVASD

SEQ ID NO: 2476 - protein, 25 aa, synthetic construct
  source 1..25: note = Seed: LNVIVHSATGFKQSSKALQRPVASD
LNVIVHSATGFKQMSIALKRPVASD

SEQ ID NO: 2477 - protein, 25 aa, synthetic construct
  source 1..25: note = Seed: LNVIVHSATGFKQSSKALQRPVASD
LNVIVHSATGFKQMSIALLRPVASD

SEQ ID NO: 2478 - protein, 25 aa, synthetic construct
  source 1..25: note = Seed: LNVIVHSATGFKQSSKALQRPVASD
LNVIVHSATGFKQMSIALMRPVASD

SEQ ID NO: 2479 - protein, 25 aa, synthetic construct
  source 1..25: note = Seed: LNVIVHSATGFKQSSKALQRPVASD
LNVIVHSATGFKQMSIALNRPVASD

SEQ ID NO: 2480 - protein, 25 aa, synthetic construct
  source 1..25: note = Seed: LNVIVHSATGFKQSSKALQRPVASD
LNVIVHSATGFKQMSIALPRPVASD

SEQ ID NO: 2481 - protein, 25 aa, synthetic construct
  source 1..25: note = Seed: LNVIVHSATGFKQSSKALQRPVASD
LNVIVHSATGFKQMSIALQRPVASD

SEQ ID NO: 2482 - protein, 25 aa, synthetic construct
  source 1..25: note = Seed: LNVIVHSATGFKQSSKALQRPVASD
LNVIVHSATGFKQMSIALRRPVASD

SEQ ID NO: 2483 - protein, 25 aa, synthetic construct
  source 1..25: note = Seed: LNVIVHSATGFKQSSKALQRPVASD
LNVIVHSATGFKQMSIALSRPVASD

SEQ ID NO: 2484 - protein, 25 aa, synthetic construct
  source 1..25: note = Seed: LNVIVHSATGFKQSSKALQRPVASD
LNVIVHSATGFKQMSIALTRPVASD

SEQ ID NO: 2485 - protein, 25 aa, synthetic construct
  source 1..25: note = Seed: LNVIVHSATGFKQSSKALQRPVASD
LNVIVHSATGFKQMSIALVRPVASD

SEQ ID NO: 2486 - protein, 25 aa, synthetic construct
  source 1..25: note = Seed: LNVIVHSATGFKQSSKALQRPVASD
LNVIVHSATGFKQMSIALYRPVASD

SEQ ID NO: 2487 - protein, 25 aa, synthetic construct
  source 1..25: note = Seed: LNVIVHSATGFKQSSKALQRPVASD
LNVIVHSATGFKQMSKALARPVASD

SEQ ID NO: 2488 - protein, 25 aa, synthetic construct
  source 1..25: note = Seed: LNVIVHSATGFKQSSKALQRPVASD
LNVIVHSATGFKQMSKALCRPVASD

SEQ ID NO: 2489 - protein, 25 aa, synthetic construct
  source 1..25: note = Seed: LNVIVHSATGFKQSSKALQRPVASD
LNVIVHSATGFKQMSKALDRPVASD

SEQ ID NO: 2490 - protein, 25 aa, synthetic construct
  source 1..25: note = Seed: LNVIVHSATGFKQSSKALQRPVASD
LNVIVHSATGFKQMSKALERPVASD

SEQ ID NO: 2491 - protein, 25 aa, synthetic construct
  source 1..25: note = Seed: LNVIVHSATGFKQSSKALQRPVASD
LNVIVHSATGFKQMSKALFRPVASD

SEQ ID NO: 2492 - protein, 25 aa, synthetic construct
  source 1..25: note = Seed: LNVIVHSATGFKQSSKALQRPVASD
LNVIVHSATGFKQMSKALGRPVASD

SEQ ID NO: 2493 - protein, 25 aa, synthetic construct
  source 1..25: note = Seed: LNVIVHSATGFKQSSKALQRPVASD
LNVIVHSATGFKQMSKALHRPVASD

SEQ ID NO: 2494 - protein, 25 aa, synthetic construct
  source 1..25: note = Seed: LNVIVHSATGFKQSSKALQRPVASD
LNVIVHSATGFKQMSKALIRPVASD

SEQ ID NO: 2495 - protein, 25 aa, synthetic construct
  source 1..25: note = Seed: LNVIVHSATGFKQSSKALQRPVASD
LNVIVHSATGFKQMSKALKRPVASD

SEQ ID NO: 2496 - protein, 25 aa, synthetic construct
  source 1..25: note = Seed: LNVIVHSATGFKQSSKALQRPVASD
LNVIVHSATGFKQMSKALLRPVASD

SEQ ID NO: 2497 - protein, 25 aa, synthetic construct
  source 1..25: note = Seed: LNVIVHSATGFKQSSKALQRPVASD
LNVIVHSATGFKQMSKALMRPVASD

SEQ ID NO: 2498 - protein, 25 aa, synthetic construct
  source 1..25: note = Seed: LNVIVHSATGFKQSSKALQRPVASD
LNVIVHSATGFKQMSKALNRPVASD

SEQ ID NO: 2499 - protein, 25 aa, synthetic construct
  source 1..25: note = Seed: LNVIVHSATGFKQSSKALQRPVASD
LNVIVHSATGFKQMSKALPRPVASD

SEQ ID NO: 2500 - protein, 25 aa, synthetic construct
  source 1..25: note = Seed: LNVIVHSATGFKQSSKALQRPVASD
LNVIVHSATGFKQMSKALQRPVASD

SEQ ID NO: 2501 - protein, 25 aa, synthetic construct
  source 1..25: note = Seed: LNVIVHSATGFKQSSKALQRPVASD
LNVIVHSATGFKQMSKALRRPVASD

SEQ ID NO: 2502 - protein, 25 aa, synthetic construct
  source 1..25: note = Seed: LNVIVHSATGFKQSSKALQRPVASD
LNVIVHSATGFKQMSKALSRPVASD

SEQ ID NO: 2503 - protein, 25 aa, synthetic construct
  source 1..25: note = Seed: LNVIVHSATGFKQSSKALQRPVASD
LNVIVHSATGFKQMSKALTRPVASD

SEQ ID NO: 2504 - protein, 25 aa, synthetic construct
  source 1..25: note = Seed: LNVIVHSATGFKQSSKALQRPVASD
LNVIVHSATGFKQMSKALVRPVASD

SEQ ID NO: 2505 - protein, 25 aa, synthetic construct
  source 1..25: note = Seed: LNVIVHSATGFKQSSKALQRPVASD
LNVIVHSATGFKQMSKALWRPVASD

SEQ ID NO: 2506 - protein, 25 aa, synthetic construct
  source 1..25: note = Seed: LNVIVHSATGFKQSSKALQRPVASD
LNVIVHSATGFKQMSKALYRPVASD

SEQ ID NO: 2507 - protein, 25 aa, synthetic construct
  source 1..25: note = Seed: LNVIVHSATGFKQSSKALQRPVASD
LNVIVHSATGFKQMSLALARPVASD

SEQ ID NO: 2508 - protein, 25 aa, synthetic construct
  source 1..25: note = Seed: LNVIVHSATGFKQSSKALQRPVASD
LNVIVHSATGFKQMSLALCRPVASD

SEQ ID NO: 2509 - protein, 25 aa, synthetic construct
  source 1..25: note = Seed: LNVIVHSATGFKQSSKALQRPVASD
LNVIVHSATGFKQMSLALDRPVASD

SEQ ID NO: 2510 - protein, 25 aa, synthetic construct
  source 1..25: note = Seed: LNVIVHSATGFKQSSKALQRPVASD
LNVIVHSATGFKQMSLALERPVASD

SEQ ID NO: 2511 - protein, 25 aa, synthetic construct
  source 1..25: note = Seed: LNVIVHSATGFKQSSKALQRPVASD
LNVIVHSATGFKQMSLALFRPVASD

SEQ ID NO: 2512 - protein, 25 aa, synthetic construct
  source 1..25: note = Seed: LNVIVHSATGFKQSSKALQRPVASD
LNVIVHSATGFKQMSLALGRPVASD

SEQ ID NO: 2513 - protein, 25 aa, synthetic construct
  source 1..25: note = Seed: LNVIVHSATGFKQSSKALQRPVASD
LNVIVHSATGFKQMSLALHRPVASD

SEQ ID NO: 2514 - protein, 25 aa, synthetic construct
  source 1..25: note = Seed: LNVIVHSATGFKQSSKALQRPVASD
LNVIVHSATGFKQMSLALIRPVASD

SEQ ID NO: 2515 - protein, 25 aa, synthetic construct
  source 1..25: note = Seed: LNVIVHSATGFKQSSKALQRPVASD
LNVIVHSATGFKQMSLALKRPVASD

SEQ ID NO: 2516 - protein, 25 aa, synthetic construct
  source 1..25: note = Seed: LNVIVHSATGFKQSSKALQRPVASD
LNVIVHSATGFKQMSLALLRPVASD

SEQ ID NO: 2517 - protein, 25 aa, synthetic construct
  source 1..25: note = Seed: LNVIVHSATGFKQSSKALQRPVASD
LNVIVHSATGFKQMSLALMRPVASD

SEQ ID NO: 2518 - protein, 25 aa, synthetic construct
  source 1..25: note = Seed: LNVIVHSATGFKQSSKALQRPVASD
LNVIVHSATGFKQMSLALNRPVASD

SEQ ID NO: 2519 - protein, 25 aa, synthetic construct
  source 1..25: note = Seed: LNVIVHSATGFKQSSKALQRPVASD
LNVIVHSATGFKQMSLALPRPVASD

SEQ ID NO: 2520 - protein, 25 aa, synthetic construct
  source 1..25: note = Seed: LNVIVHSATGFKQSSKALQRPVASD
LNVIVHSATGFKQMSLALQRPVASD

SEQ ID NO: 2521 - protein, 25 aa, synthetic construct
  source 1..25: note = Seed: LNVIVHSATGFKQSSKALQRPVASD
LNVIVHSATGFKQMSLALRRPVASD

SEQ ID NO: 2522 - protein, 25 aa, synthetic construct
  source 1..25: note = Seed: LNVIVHSATGFKQSSKALQRPVASD
LNVIVHSATGFKQMSLALSRPVASD

SEQ ID NO: 2523 - protein, 25 aa, synthetic construct
  source 1..25: note = Seed: LNVIVHSATGFKQSSKALQRPVASD
LNVIVHSATGFKQMSLALTRPVASD

SEQ ID NO: 2524 - protein, 25 aa, synthetic construct
  source 1..25: note = Seed: LNVIVHSATGFKQSSKALQRPVASD
LNVIVHSATGFKQMSLALVRPVASD

SEQ ID NO: 2525 - protein, 25 aa, synthetic construct
  source 1..25: note = Seed: LNVIVHSATGFKQSSKALQRPVASD
LNVIVHSATGFKQMSLALYRPVASD

SEQ ID NO: 2526 - protein, 25 aa, synthetic construct
  source 1..25: note = Seed: LNVIVHSATGFKQSSKALQRPVASD
LNVIVHSATGFKQMSMALARPVASD

SEQ ID NO: 2527 - protein, 25 aa, synthetic construct
  source 1..25: note = Seed: LNVIVHSATGFKQSSKALQRPVASD
LNVIVHSATGFKQMSMALCRPVASD

SEQ ID NO: 2528 - protein, 25 aa, synthetic construct
  source 1..25: note = Seed: LNVIVHSATGFKQSSKALQRPVASD
LNVIVHSATGFKQMSMALDRPVASD

SEQ ID NO: 2529 - protein, 25 aa, synthetic construct
  source 1..25: note = Seed: LNVIVHSATGFKQSSKALQRPVASD
LNVIVHSATGFKQMSMALERPVASD

SEQ ID NO: 2530 - protein, 25 aa, synthetic construct
  source 1..25: note = Seed: LNVIVHSATGFKQSSKALQRPVASD
LNVIVHSATGFKQMSMALFRPVASD

SEQ ID NO: 2531 - protein, 25 aa, synthetic construct
  source 1..25: note = Seed: LNVIVHSATGFKQSSKALQRPVASD
LNVIVHSATGFKQMSMALGRPVASD

SEQ ID NO: 2532 - protein, 25 aa, synthetic construct
  source 1..25: note = Seed: LNVIVHSATGFKQSSKALQRPVASD
LNVIVHSATGFKQMSMALHRPVASD

SEQ ID NO: 2533 - protein, 25 aa, synthetic construct
  source 1..25: note = Seed: LNVIVHSATGFKQSSKALQRPVASD
LNVIVHSATGFKQMSMALIRPVASD

SEQ ID NO: 2534 - protein, 25 aa, synthetic construct
  source 1..25: note = Seed: LNVIVHSATGFKQSSKALQRPVASD
LNVIVHSATGFKQMSMALKRPVASD

SEQ ID NO: 2535 - protein, 25 aa, synthetic construct
  source 1..25: note = Seed: LNVIVHSATGFKQSSKALQRPVASD
LNVIVHSATGFKQMSMALLRPVASD

SEQ ID NO: 2536 - protein, 25 aa, synthetic construct
  source 1..25: note = Seed: LNVIVHSATGFKQSSKALQRPVASD
LNVIVHSATGFKQMSMALMRPVASD

SEQ ID NO: 2537 - protein, 25 aa, synthetic construct
  source 1..25: note = Seed: LNVIVHSATGFKQSSKALQRPVASD
LNVIVHSATGFKQMSMALNRPVASD

SEQ ID NO: 2538 - protein, 25 aa, synthetic construct
  source 1..25: note = Seed: LNVIVHSATGFKQSSKALQRPVASD
LNVIVHSATGFKQMSMALPRPVASD

SEQ ID NO: 2539 - protein, 25 aa, synthetic construct
  source 1..25: note = Seed: LNVIVHSATGFKQSSKALQRPVASD
LNVIVHSATGFKQMSMALQRPVASD

SEQ ID NO: 2540 - protein, 25 aa, synthetic construct
  source 1..25: note = Seed: LNVIVHSATGFKQSSKALQRPVASD
LNVIVHSATGFKQMSMALRRPVASD

SEQ ID NO: 2541 - protein, 25 aa, synthetic construct
  source 1..25: note = Seed: LNVIVHSATGFKQSSKALQRPVASD
LNVIVHSATGFKQMSMALSRPVASD

SEQ ID NO: 2542 - protein, 25 aa, synthetic construct
  source 1..25: note = Seed: LNVIVHSATGFKQSSKALQRPVASD
LNVIVHSATGFKQMSMALTRPVASD

SEQ ID NO: 2543 - protein, 25 aa, synthetic construct
  source 1..25: note = Seed: LNVIVHSATGFKQSSKALQRPVASD
LNVIVHSATGFKQMSMALVRPVASD

SEQ ID NO: 2544 - protein, 25 aa, synthetic construct
  source 1..25: note = Seed: LNVIVHSATGFKQSSKALQRPVASD
LNVIVHSATGFKQMSMALYRPVASD

SEQ ID NO: 2545 - protein, 25 aa, synthetic construct
  source 1..25: note = Seed: LNVIVHSATGFKQSSKALQRPVASD
LNVIVHSATGFKQMSNALARPVASD

SEQ ID NO: 2546 - protein, 25 aa, synthetic construct
  source 1..25: note = Seed: LNVIVHSATGFKQSSKALQRPVASD
LNVIVHSATGFKQMSNALCRPVASD

SEQ ID NO: 2547 - protein, 25 aa, synthetic construct
  source 1..25: note = Seed: LNVIVHSATGFKQSSKALQRPVASD
LNVIVHSATGFKQMSNALDRPVASD

SEQ ID NO: 2548 - protein, 25 aa, synthetic construct
  source 1..25: note = Seed: LNVIVHSATGFKQSSKALQRPVASD
LNVIVHSATGFKQMSNALERPVASD

SEQ ID NO: 2549 - protein, 25 aa, synthetic construct
  source 1..25: note = Seed: LNVIVHSATGFKQSSKALQRPVASD
LNVIVHSATGFKQMSNALFRPVASD

SEQ ID NO: 2550 - protein, 25 aa, synthetic construct
  source 1..25: note = Seed: LNVIVHSATGFKQSSKALQRPVASD
LNVIVHSATGFKQMSNALGRPVASD

SEQ ID NO: 2551 - protein, 25 aa, synthetic construct
  source 1..25: note = Seed: LNVIVHSATGFKQSSKALQRPVASD
LNVIVHSATGFKQMSNALHRPVASD

SEQ ID NO: 2552 - protein, 25 aa, synthetic construct
  source 1..25: note = Seed: LNVIVHSATGFKQSSKALQRPVASD
LNVIVHSATGFKQMSNALIRPVASD

SEQ ID NO: 2553 - protein, 25 aa, synthetic construct
  source 1..25: note = Seed: LNVIVHSATGFKQSSKALQRPVASD
LNVIVHSATGFKQMSNALLRPVASD

SEQ ID NO: 2554 - protein, 25 aa, synthetic construct
  source 1..25: note = Seed: LNVIVHSATGFKQSSKALQRPVASD
LNVIVHSATGFKQMSNALMRPVASD

SEQ ID NO: 2555 - protein, 25 aa, synthetic construct
  source 1..25: note = Seed: LNVIVHSATGFKQSSKALQRPVASD
LNVIVHSATGFKQMSNALNRPVASD

SEQ ID NO: 2556 - protein, 25 aa, synthetic construct
  source 1..25: note = Seed: LNVIVHSATGFKQSSKALQRPVASD
LNVIVHSATGFKQMSNALPRPVASD

SEQ ID NO: 2557 - protein, 25 aa, synthetic construct
  source 1..25: note = Seed: LNVIVHSATGFKQSSKALQRPVASD
LNVIVHSATGFKQMSNALQRPVASD

SEQ ID NO: 2558 - protein, 25 aa, synthetic construct
  source 1..25: note = Seed: LNVIVHSATGFKQSSKALQRPVASD
LNVIVHSATGFKQMSNALRRPVASD

SEQ ID NO: 2559 - protein, 25 aa, synthetic construct
  source 1..25: note = Seed: LNVIVHSATGFKQSSKALQRPVASD
LNVIVHSATGFKQMSNALSRPVASD

SEQ ID NO: 2560 - protein, 25 aa, synthetic construct
  source 1..25: note = Seed: LNVIVHSATGFKQSSKALQRPVASD
LNVIVHSATGFKQMSNALTRPVASD

SEQ ID NO: 2561 - protein, 25 aa, synthetic construct
  source 1..25: note = Seed: LNVIVHSATGFKQSSKALQRPVASD
LNVIVHSATGFKQMSNALVRPVASD

SEQ ID NO: 2562 - protein, 25 aa, synthetic construct
  source 1..25: note = Seed: LNVIVHSATGFKQSSKALQRPVASD
LNVIVHSATGFKQMSNALYRPVASD

SEQ ID NO: 2563 - protein, 25 aa, synthetic construct
  source 1..25: note = Seed: LNVIVHSATGFKQSSKALQRPVASD
LNVIVHSATGFKQMSPALARPVASD

SEQ ID NO: 2564 - protein, 25 aa, synthetic construct
  source 1..25: note = Seed: LNVIVHSATGFKQSSKALQRPVASD
LNVIVHSATGFKQMSPALCRPVASD

SEQ ID NO: 2565 - protein, 25 aa, synthetic construct
  source 1..25: note = Seed: LNVIVHSATGFKQSSKALQRPVASD
LNVIVHSATGFKQMSPALDRPVASD

SEQ ID NO: 2566 - protein, 25 aa, synthetic construct
  source 1..25: note = Seed: LNVIVHSATGFKQSSKALQRPVASD
LNVIVHSATGFKQMSPALERPVASD

SEQ ID NO: 2567 - protein, 25 aa, synthetic construct
  source 1..25: note = Seed: LNVIVHSATGFKQSSKALQRPVASD
LNVIVHSATGFKQMSPALFRPVASD

SEQ ID NO: 2568 - protein, 25 aa, synthetic construct
  source 1..25: note = Seed: LNVIVHSATGFKQSSKALQRPVASD
LNVIVHSATGFKQMSPALGRPVASD

SEQ ID NO: 2569 - protein, 25 aa, synthetic construct
  source 1..25: note = Seed: LNVIVHSATGFKQSSKALQRPVASD
LNVIVHSATGFKQMSPALHRPVASD

SEQ ID NO: 2570 - protein, 25 aa, synthetic construct
  source 1..25: note = Seed: LNVIVHSATGFKQSSKALQRPVASD
LNVIVHSATGFKQMSPALIRPVASD

SEQ ID NO: 2571 - protein, 25 aa, synthetic construct
  source 1..25: note = Seed: LNVIVHSATGFKQSSKALQRPVASD
LNVIVHSATGFKQMSPALKRPVASD

SEQ ID NO: 2572 - protein, 25 aa, synthetic construct
  source 1..25: note = Seed: LNVIVHSATGFKQSSKALQRPVASD
LNVIVHSATGFKQMSPALLRPVASD

SEQ ID NO: 2573 - protein, 25 aa, synthetic construct
  source 1..25: note = Seed: LNVIVHSATGFKQSSKALQRPVASD
LNVIVHSATGFKQMSPALMRPVASD

SEQ ID NO: 2574 - protein, 25 aa, synthetic construct
  source 1..25: note = Seed: LNVIVHSATGFKQSSKALQRPVASD
LNVIVHSATGFKQMSPALNRPVASD

SEQ ID NO: 2575 - protein, 25 aa, synthetic construct
  source 1..25: note = Seed: LNVIVHSATGFKQSSKALQRPVASD
LNVIVHSATGFKQMSPALPRPVASD

SEQ ID NO: 2576 - protein, 25 aa, synthetic construct
  source 1..25: note = Seed: LNVIVHSATGFKQSSKALQRPVASD
LNVIVHSATGFKQMSPALQRPVASD

SEQ ID NO: 2577 - protein, 25 aa, synthetic construct
  source 1..25: note = Seed: LNVIVHSATGFKQSSKALQRPVASD
LNVIVHSATGFKQMSPALRRPVASD

SEQ ID NO: 2578 - protein, 25 aa, synthetic construct
  source 1..25: note = Seed: LNVIVHSATGFKQSSKALQRPVASD
LNVIVHSATGFKQMSPALSRPVASD

SEQ ID NO: 2579 - protein, 25 aa, synthetic construct
  source 1..25: note = Seed: LNVIVHSATGFKQSSKALQRPVASD
LNVIVHSATGFKQMSPALTRPVASD

SEQ ID NO: 2580 - protein, 25 aa, synthetic construct
  source 1..25: note = Seed: LNVIVHSATGFKQSSKALQRPVASD
LNVIVHSATGFKQMSPALVRPVASD

SEQ ID NO: 2581 - protein, 25 aa, synthetic construct
  source 1..25: note = Seed: LNVIVHSATGFKQSSKALQRPVASD
LNVIVHSATGFKQMSPALWRPVASD

SEQ ID NO: 2582 - protein, 25 aa, synthetic construct
  source 1..25: note = Seed: LNVIVHSATGFKQSSKALQRPVASD
LNVIVHSATGFKQMSPALYRPVASD

SEQ ID NO: 2583 - protein, 25 aa, synthetic construct
  source 1..25: note = Seed: LNVIVHSATGFKQSSKALQRPVASD
LNVIVHSATGFKQMSQALARPVASD

SEQ ID NO: 2584 - protein, 25 aa, synthetic construct
  source 1..25: note = Seed: LNVIVHSATGFKQSSKALQRPVASD
LNVIVHSATGFKQMSQALGRPVASD

SEQ ID NO: 2585 - protein, 25 aa, synthetic construct
  source 1..25: note = Seed: LNVIVHSATGFKQSSKALQRPVASD
LNVIVHSATGFKQMSQALIRPVASD

SEQ ID NO: 2586 - protein, 25 aa, synthetic construct
  source 1..25: note = Seed: LNVIVHSATGFKQSSKALQRPVASD
LNVIVHSATGFKQMSQALLRPVASD

SEQ ID NO: 2587 - protein, 25 aa, synthetic construct
  source 1..25: note = Seed: LNVIVHSATGFKQSSKALQRPVASD
LNVIVHSATGFKQMSQALMRPVASD

SEQ ID NO: 2588 - protein, 25 aa, synthetic construct
  source 1..25: note = Seed: LNVIVHSATGFKQSSKALQRPVASD
LNVIVHSATGFKQMSQALNRPVASD

SEQ ID NO: 2589 - protein, 25 aa, synthetic construct
  source 1..25: note = Seed: LNVIVHSATGFKQSSKALQRPVASD
LNVIVHSATGFKQMSQALRRPVASD

SEQ ID NO: 2590 - protein, 25 aa, synthetic construct
  source 1..25: note = Seed: LNVIVHSATGFKQSSKALQRPVASD
LNVIVHSATGFKQMSQALSRPVASD

SEQ ID NO: 2591 - protein, 25 aa, synthetic construct
  source 1..25: note = Seed: LNVIVHSATGFKQSSKALQRPVASD
LNVIVHSATGFKQMSQALTRPVASD

SEQ ID NO: 2592 - protein, 25 aa, synthetic construct
  source 1..25: note = Seed: LNVIVHSATGFKQSSKALQRPVASD
LNVIVHSATGFKQMSQALVRPVASD

SEQ ID NO: 2593 - protein, 25 aa, synthetic construct
  source 1..25: note = Seed: LNVIVHSATGFKQSSKALQRPVASD
LNVIVHSATGFKQMSRALARPVASD

SEQ ID NO: 2594 - protein, 25 aa, synthetic construct
  source 1..25: note = Seed: LNVIVHSATGFKQSSKALQRPVASD
LNVIVHSATGFKQMSRALCRPVASD

SEQ ID NO: 2595 - protein, 25 aa, synthetic construct
  source 1..25: note = Seed: LNVIVHSATGFKQSSKALQRPVASD
LNVIVHSATGFKQMSRALDRPVASD

SEQ ID NO: 2596 - protein, 25 aa, synthetic construct
  source 1..25: note = Seed: LNVIVHSATGFKQSSKALQRPVASD
LNVIVHSATGFKQMSRALERPVASD

SEQ ID NO: 2597 - protein, 25 aa, synthetic construct
  source 1..25: note = Seed: LNVIVHSATGFKQSSKALQRPVASD
LNVIVHSATGFKQMSRALFRPVASD

SEQ ID NO: 2598 - protein, 25 aa, synthetic construct
  source 1..25: note = Seed: LNVIVHSATGFKQSSKALQRPVASD
LNVIVHSATGFKQMSRALGRPVASD

SEQ ID NO: 2599 - protein, 25 aa, synthetic construct
  source 1..25: note = Seed: LNVIVHSATGFKQSSKALQRPVASD
LNVIVHSATGFKQMSRALHRPVASD

SEQ ID NO: 2600 - protein, 25 aa, synthetic construct
  source 1..25: note = Seed: LNVIVHSATGFKQSSKALQRPVASD
LNVIVHSATGFKQMSRALIRPVASD

SEQ ID NO: 2601 - protein, 25 aa, synthetic construct
  source 1..25: note = Seed: LNVIVHSATGFKQSSKALQRPVASD
LNVIVHSATGFKQMSRALKRPVASD

SEQ ID NO: 2602 - protein, 25 aa, synthetic construct
  source 1..25: note = Seed: LNVIVHSATGFKQSSKALQRPVASD
LNVIVHSATGFKQMSRALLRPVASD

SEQ ID NO: 2603 - protein, 25 aa, synthetic construct
  source 1..25: note = Seed: LNVIVHSATGFKQSSKALQRPVASD
LNVIVHSATGFKQMSRALMRPVASD

SEQ ID NO: 2604 - protein, 25 aa, synthetic construct
  source 1..25: note = Seed: LNVIVHSATGFKQSSKALQRPVASD
LNVIVHSATGFKQMSRALNRPVASD

SEQ ID NO: 2605 - protein, 25 aa, synthetic construct
  source 1..25: note = Seed: LNVIVHSATGFKQSSKALQRPVASD
LNVIVHSATGFKQMSRALPRPVASD

SEQ ID NO: 2606 - protein, 25 aa, synthetic construct
  source 1..25: note = Seed: LNVIVHSATGFKQSSKALQRPVASD
LNVIVHSATGFKQMSRALQRPVASD

SEQ ID NO: 2607 - protein, 25 aa, synthetic construct
  source 1..25: note = Seed: LNVIVHSATGFKQSSKALQRPVASD
LNVIVHSATGFKQMSRALRRPVASD

SEQ ID NO: 2608 - protein, 25 aa, synthetic construct
  source 1..25: note = Seed: LNVIVHSATGFKQSSKALQRPVASD
LNVIVHSATGFKQMSRALSRPVASD

SEQ ID NO: 2609 - protein, 25 aa, synthetic construct
  source 1..25: note = Seed: LNVIVHSATGFKQSSKALQRPVASD
LNVIVHSATGFKQMSRALTRPVASD

SEQ ID NO: 2610 - protein, 25 aa, synthetic construct
  source 1..25: note = Seed: LNVIVHSATGFKQSSKALQRPVASD
LNVIVHSATGFKQMSRALVRPVASD

SEQ ID NO: 2611 - protein, 25 aa, synthetic construct
  source 1..25: note = Seed: LNVIVHSATGFKQSSKALQRPVASD
LNVIVHSATGFKQMSRALWRPVASD

SEQ ID NO: 2612 - protein, 25 aa, synthetic construct
  source 1..25: note = Seed: LNVIVHSATGFKQSSKALQRPVASD
LNVIVHSATGFKQMSRALYRPVASD

SEQ ID NO: 2613 - protein, 25 aa, synthetic construct
  source 1..25: note = Seed: LNVIVHSATGFKQSSKALQRPVASD
LNVIVHSATGFKQMSSALARPVASD

SEQ ID NO: 2614 - protein, 25 aa, synthetic construct
  source 1..25: note = Seed: LNVIVHSATGFKQSSKALQRPVASD
LNVIVHSATGFKQMSSALCRPVASD

SEQ ID NO: 2615 - protein, 25 aa, synthetic construct
  source 1..25: note = Seed: LNVIVHSATGFKQSSKALQRPVASD
LNVIVHSATGFKQMSSALDRPVASD

SEQ ID NO: 2616 - protein, 25 aa, synthetic construct
  source 1..25: note = Seed: LNVIVHSATGFKQSSKALQRPVASD
LNVIVHSATGFKQMSSALERPVASD

SEQ ID NO: 2617 - protein, 25 aa, synthetic construct
  source 1..25: note = Seed: LNVIVHSATGFKQSSKALQRPVASD
LNVIVHSATGFKQMSSALFRPVASD

SEQ ID NO: 2618 - protein, 25 aa, synthetic construct
  source 1..25: note = Seed: LNVIVHSATGFKQSSKALQRPVASD
LNVIVHSATGFKQMSSALGRPVASD

SEQ ID NO: 2619 - protein, 25 aa, synthetic construct
  source 1..25: note = Seed: LNVIVHSATGFKQSSKALQRPVASD
LNVIVHSATGFKQMSSALHRPVASD

SEQ ID NO: 2620 - protein, 25 aa, synthetic construct
  source 1..25: note = Seed: LNVIVHSATGFKQSSKALQRPVASD
LNVIVHSATGFKQMSSALIRPVASD

SEQ ID NO: 2621 - protein, 25 aa, synthetic construct
  source 1..25: note = Seed: LNVIVHSATGFKQSSKALQRPVASD
LNVIVHSATGFKQMSSALKRPVASD

SEQ ID NO: 2622 - protein, 25 aa, synthetic construct
  source 1..25: note = Seed: LNVIVHSATGFKQSSKALQRPVASD
LNVIVHSATGFKQMSSALLRPVASD

SEQ ID NO: 2623 - protein, 25 aa, synthetic construct
  source 1..25: note = Seed: LNVIVHSATGFKQSSKALQRPVASD
LNVIVHSATGFKQMSSALMRPVASD

SEQ ID NO: 2624 - protein, 25 aa, synthetic construct
  source 1..25: note = Seed: LNVIVHSATGFKQSSKALQRPVASD
LNVIVHSATGFKQMSSALNRPVASD

SEQ ID NO: 2625 - protein, 25 aa, synthetic construct
  source 1..25: note = Seed: LNVIVHSATGFKQSSKALQRPVASD
LNVIVHSATGFKQMSSALPRPVASD

SEQ ID NO: 2626 - protein, 25 aa, synthetic construct
  source 1..25: note = Seed: LNVIVHSATGFKQSSKALQRPVASD
LNVIVHSATGFKQMSSALQRPVASD

SEQ ID NO: 2627 - protein, 25 aa, synthetic construct
  source 1..25: note = Seed: LNVIVHSATGFKQSSKALQRPVASD
LNVIVHSATGFKQMSSALRRPVASD

SEQ ID NO: 2628 - protein, 25 aa, synthetic construct
  source 1..25: note = Seed: LNVIVHSATGFKQSSKALQRPVASD
LNVIVHSATGFKQMSSALSRPVASD

SEQ ID NO: 2629 - protein, 25 aa, synthetic construct
  source 1..25: note = Seed: LNVIVHSATGFKQSSKALQRPVASD
LNVIVHSATGFKQMSSALTRPVASD

SEQ ID NO: 2630 - protein, 25 aa, synthetic construct
  source 1..25: note = Seed: LNVIVHSATGFKQSSKALQRPVASD
LNVIVHSATGFKQMSSALVRPVASD

SEQ ID NO: 2631 - protein, 25 aa, synthetic construct
  source 1..25: note = Seed: LNVIVHSATGFKQSSKALQRPVASD
LNVIVHSATGFKQMSSALWRPVASD

SEQ ID NO: 2632 - protein, 25 aa, synthetic construct
  source 1..25: note = Seed: LNVIVHSATGFKQSSKALQRPVASD
LNVIVHSATGFKQMSSALYRPVASD

SEQ ID NO: 2633 - protein, 25 aa, synthetic construct
  source 1..25: note = Seed: LNVIVHSATGFKQSSKALQRPVASD
LNVIVHSATGFKQMSTALARPVASD

SEQ ID NO: 2634 - protein, 25 aa, synthetic construct
  source 1..25: note = Seed: LNVIVHSATGFKQSSKALQRPVASD
LNVIVHSATGFKQMSTALCRPVASD

SEQ ID NO: 2635 - protein, 25 aa, synthetic construct
  source 1..25: note = Seed: LNVIVHSATGFKQSSKALQRPVASD
LNVIVHSATGFKQMSTALDRPVASD

SEQ ID NO: 2636 - protein, 25 aa, synthetic construct
  source 1..25: note = Seed: LNVIVHSATGFKQSSKALQRPVASD
LNVIVHSATGFKQMSTALERPVASD

SEQ ID NO: 2637 - protein, 25 aa, synthetic construct
  source 1..25: note = Seed: LNVIVHSATGFKQSSKALQRPVASD
LNVIVHSATGFKQMSTALFRPVASD

SEQ ID NO: 2638 - protein, 25 aa, synthetic construct
  source 1..25: note = Seed: LNVIVHSATGFKQSSKALQRPVASD
LNVIVHSATGFKQMSTALGRPVASD

SEQ ID NO: 2639 - protein, 25 aa, synthetic construct
  source 1..25: note = Seed: LNVIVHSATGFKQSSKALQRPVASD
LNVIVHSATGFKQMSTALHRPVASD

SEQ ID NO: 2640 - protein, 25 aa, synthetic construct
  source 1..25: note = Seed: LNVIVHSATGFKQSSKALQRPVASD
LNVIVHSATGFKQMSTALIRPVASD

SEQ ID NO: 2641 - protein, 25 aa, synthetic construct
  source 1..25: note = Seed: LNVIVHSATGFKQSSKALQRPVASD
LNVIVHSATGFKQMSTALKRPVASD

SEQ ID NO: 2642 - protein, 25 aa, synthetic construct
  source 1..25: note = Seed: LNVIVHSATGFKQSSKALQRPVASD
LNVIVHSATGFKQMSTALLRPVASD

SEQ ID NO: 2643 - protein, 25 aa, synthetic construct
  source 1..25: note = Seed: LNVIVHSATGFKQSSKALQRPVASD
LNVIVHSATGFKQMSTALMRPVASD

SEQ ID NO: 2644 - protein, 25 aa, synthetic construct
  source 1..25: note = Seed: LNVIVHSATGFKQSSKALQRPVASD
LNVIVHSATGFKQMSTALNRPVASD

SEQ ID NO: 2645 - protein, 25 aa, synthetic construct
  source 1..25: note = Seed: LNVIVHSATGFKQSSKALQRPVASD
LNVIVHSATGFKQMSTALPRPVASD

SEQ ID NO: 2646 - protein, 25 aa, synthetic construct
  source 1..25: note = Seed: LNVIVHSATGFKQSSKALQRPVASD
LNVIVHSATGFKQMSTALQRPVASD

SEQ ID NO: 2647 - protein, 25 aa, synthetic construct
  source 1..25: note = Seed: LNVIVHSATGFKQSSKALQRPVASD
LNVIVHSATGFKQMSTALRRPVASD

SEQ ID NO: 2648 - protein, 25 aa, synthetic construct
  source 1..25: note = Seed: LNVIVHSATGFKQSSKALQRPVASD
LNVIVHSATGFKQMSTALSRPVASD

SEQ ID NO: 2649 - protein, 25 aa, synthetic construct
  source 1..25: note = Seed: LNVIVHSATGFKQSSKALQRPVASD
LNVIVHSATGFKQMSTALTRPVASD

SEQ ID NO: 2650 - protein, 25 aa, synthetic construct
  source 1..25: note = Seed: LNVIVHSATGFKQSSKALQRPVASD
LNVIVHSATGFKQMSTALVRPVASD

SEQ ID NO: 2651 - protein, 25 aa, synthetic construct
  source 1..25: note = Seed: LNVIVHSATGFKQSSKALQRPVASD
LNVIVHSATGFKQMSTALWRPVASD

SEQ ID NO: 2652 - protein, 25 aa, synthetic construct
  source 1..25: note = Seed: LNVIVHSATGFKQSSKALQRPVASD
LNVIVHSATGFKQMSTALYRPVASD

SEQ ID NO: 2653 - protein, 25 aa, synthetic construct
  source 1..25: note = Seed: LNVIVHSATGFKQSSKALQRPVASD
LNVIVHSATGFKQMSVALARPVASD

SEQ ID NO: 2654 - protein, 25 aa, synthetic construct
  source 1..25: note = Seed: LNVIVHSATGFKQSSKALQRPVASD
LNVIVHSATGFKQMSVALCRPVASD

SEQ ID NO: 2655 - protein, 25 aa, synthetic construct
  source 1..25: note = Seed: LNVIVHSATGFKQSSKALQRPVASD
LNVIVHSATGFKQMSVALDRPVASD

SEQ ID NO: 2656 - protein, 25 aa, synthetic construct
  source 1..25: note = Seed: LNVIVHSATGFKQSSKALQRPVASD
LNVIVHSATGFKQMSVALERPVASD

SEQ ID NO: 2657 - protein, 25 aa, synthetic construct
  source 1..25: note = Seed: LNVIVHSATGFKQSSKALQRPVASD
LNVIVHSATGFKQMSVALFRPVASD

SEQ ID NO: 2658 - protein, 25 aa, synthetic construct
  source 1..25: note = Seed: LNVIVHSATGFKQSSKALQRPVASD
LNVIVHSATGFKQMSVALGRPVASD

SEQ ID NO: 2659 - protein, 25 aa, synthetic construct
  source 1..25: note = Seed: LNVIVHSATGFKQSSKALQRPVASD
LNVIVHSATGFKQMSVALHRPVASD

SEQ ID NO: 2660 - protein, 25 aa, synthetic construct
  source 1..25: note = Seed: LNVIVHSATGFKQSSKALQRPVASD
LNVIVHSATGFKQMSVALIRPVASD

SEQ ID NO: 2661 - protein, 25 aa, synthetic construct
  source 1..25: note = Seed: LNVIVHSATGFKQSSKALQRPVASD
LNVIVHSATGFKQMSVALKRPVASD

SEQ ID NO: 2662 - protein, 25 aa, synthetic construct
  source 1..25: note = Seed: LNVIVHSATGFKQSSKALQRPVASD
LNVIVHSATGFKQMSVALLRPVASD

SEQ ID NO: 2663 - protein, 25 aa, synthetic construct
  source 1..25: note = Seed: LNVIVHSATGFKQSSKALQRPVASD
LNVIVHSATGFKQMSVALMRPVASD

SEQ ID NO: 2664 - protein, 25 aa, synthetic construct
  source 1..25: note = Seed: LNVIVHSATGFKQSSKALQRPVASD
LNVIVHSATGFKQMSVALNRPVASD

SEQ ID NO: 2665 - protein, 25 aa, synthetic construct
  source 1..25: note = Seed: LNVIVHSATGFKQSSKALQRPVASD
LNVIVHSATGFKQMSVALPRPVASD

SEQ ID NO: 2666 - protein, 25 aa, synthetic construct
  source 1..25: note = Seed: LNVIVHSATGFKQSSKALQRPVASD
LNVIVHSATGFKQMSVALQRPVASD

SEQ ID NO: 2667 - protein, 25 aa, synthetic construct
  source 1..25: note = Seed: LNVIVHSATGFKQSSKALQRPVASD
LNVIVHSATGFKQMSVALRRPVASD

SEQ ID NO: 2668 - protein, 25 aa, synthetic construct
  source 1..25: note = Seed: LNVIVHSATGFKQSSKALQRPVASD
LNVIVHSATGFKQMSVALSRPVASD

SEQ ID NO: 2669 - protein, 25 aa, synthetic construct
  source 1..25: note = Seed: LNVIVHSATGFKQSSKALQRPVASD
LNVIVHSATGFKQMSVALTRPVASD

SEQ ID NO: 2670 - protein, 25 aa, synthetic construct
  source 1..25: note = Seed: LNVIVHSATGFKQSSKALQRPVASD
LNVIVHSATGFKQMSVALVRPVASD

SEQ ID NO: 2671 - protein, 25 aa, synthetic construct
  source 1..25: note = Seed: LNVIVHSATGFKQSSKALQRPVASD
LNVIVHSATGFKQMSVALYRPVASD

SEQ ID NO: 2672 - protein, 25 aa, synthetic construct
  source 1..25: note = Seed: LNVIVHSATGFKQSSKALQRPVASD
LNVIVHSATGFKQMSWALGRPVASD

SEQ ID NO: 2673 - protein, 25 aa, synthetic construct
  source 1..25: note = Seed: LNVIVHSATGFKQSSKALQRPVASD
LNVIVHSATGFKQMSWALHRPVASD

SEQ ID NO: 2674 - protein, 25 aa, synthetic construct
  source 1..25: note = Seed: LNVIVHSATGFKQSSKALQRPVASD
LNVIVHSATGFKQMSWALIRPVASD

SEQ ID NO: 2675 - protein, 25 aa, synthetic construct
  source 1..25: note = Seed: LNVIVHSATGFKQSSKALQRPVASD
LNVIVHSATGFKQMSWALNRPVASD

SEQ ID NO: 2676 - protein, 25 aa, synthetic construct
  source 1..25: note = Seed: LNVIVHSATGFKQSSKALQRPVASD
LNVIVHSATGFKQMSWALSRPVASD

SEQ ID NO: 2677 - protein, 25 aa, synthetic construct
  source 1..25: note = Seed: LNVIVHSATGFKQSSKALQRPVASD
LNVIVHSATGFKQMSWALTRPVASD

SEQ ID NO: 2678 - protein, 25 aa, synthetic construct
  source 1..25: note = Seed: LNVIVHSATGFKQSSKALQRPVASD
LNVIVHSATGFKQMSWALVRPVASD

SEQ ID NO: 2679 - protein, 25 aa, synthetic construct
  source 1..25: note = Seed: LNVIVHSATGFKQSSKALQRPVASD
LNVIVHSATGFKQMSYALGRPVASD

SEQ ID NO: 2680 - protein, 25 aa, synthetic construct
  source 1..25: note = Seed: LNVIVHSATGFKQSSKALQRPVASD
LNVIVHSATGFKQMSYALHRPVASD

SEQ ID NO: 2681 - protein, 25 aa, synthetic construct
  source 1..25: note = Seed: LNVIVHSATGFKQSSKALQRPVASD
LNVIVHSATGFKQMSYALIRPVASD

SEQ ID NO: 2682 - protein, 25 aa, synthetic construct
  source 1..25: note = Seed: LNVIVHSATGFKQSSKALQRPVASD
LNVIVHSATGFKQMSYALLRPVASD

SEQ ID NO: 2683 - protein, 25 aa, synthetic construct
  source 1..25: note = Seed: LNVIVHSATGFKQSSKALQRPVASD
LNVIVHSATGFKQMSYALNRPVASD

SEQ ID NO: 2684 - protein, 25 aa, synthetic construct
  source 1..25: note = Seed: LNVIVHSATGFKQSSKALQRPVASD
LNVIVHSATGFKQMSYALSRPVASD

SEQ ID NO: 2685 - protein, 25 aa, synthetic construct
  source 1..25: note = Seed: LNVIVHSATGFKQSSKALQRPVASD
LNVIVHSATGFKQMSYALVRPVASD

SEQ ID NO: 2686 - protein, 25 aa, synthetic construct
  source 1..25: note = Seed: LNVIVHSATGFKQSSKALQRPVASD
LNVIVHSATGFKQNSAALARPVASD

SEQ ID NO: 2687 - protein, 25 aa, synthetic construct
  source 1..25: note = Seed: LNVIVHSATGFKQSSKALQRPVASD
LNVIVHSATGFKQNSAALCRPVASD

SEQ ID NO: 2688 - protein, 25 aa, synthetic construct
  source 1..25: note = Seed: LNVIVHSATGFKQSSKALQRPVASD
LNVIVHSATGFKQNSAALFRPVASD

SEQ ID NO: 2689 - protein, 25 aa, synthetic construct
  source 1..25: note = Seed: LNVIVHSATGFKQSSKALQRPVASD
LNVIVHSATGFKQNSAALGRPVASD

SEQ ID NO: 2690 - protein, 25 aa, synthetic construct
  source 1..25: note = Seed: LNVIVHSATGFKQSSKALQRPVASD
LNVIVHSATGFKQNSAALIRPVASD

SEQ ID NO: 2691 - protein, 25 aa, synthetic construct
  source 1..25: note = Seed: LNVIVHSATGFKQSSKALQRPVASD
LNVIVHSATGFKQNSAALLRPVASD

SEQ ID NO: 2692 - protein, 25 aa, synthetic construct
  source 1..25: note = Seed: LNVIVHSATGFKQSSKALQRPVASD
LNVIVHSATGFKQNSAALMRPVASD

SEQ ID NO: 2693 - protein, 25 aa, synthetic construct
  source 1..25: note = Seed: LNVIVHSATGFKQSSKALQRPVASD
LNVIVHSATGFKQNSAALNRPVASD

SEQ ID NO: 2694 - protein, 25 aa, synthetic construct
  source 1..25: note = Seed: LNVIVHSATGFKQSSKALQRPVASD
LNVIVHSATGFKQNSAALSRPVASD

SEQ ID NO: 2695 - protein, 25 aa, synthetic construct
  source 1..25: note = Seed: LNVIVHSATGFKQSSKALQRPVASD
LNVIVHSATGFKQNSAALTRPVASD

SEQ ID NO: 2696 - protein, 25 aa, synthetic construct
  source 1..25: note = Seed: LNVIVHSATGFKQSSKALQRPVASD
LNVIVHSATGFKQNSAALVRPVASD

SEQ ID NO: 2697 - protein, 25 aa, synthetic construct
  source 1..25: note = Seed: LNVIVHSATGFKQSSKALQRPVASD
LNVIVHSATGFKQNSAALWRPVASD

SEQ ID NO: 2698 - protein, 25 aa, synthetic construct
  source 1..25: note = Seed: LNVIVHSATGFKQSSKALQRPVASD
LNVIVHSATGFKQNSAALYRPVASD

SEQ ID NO: 2699 - protein, 25 aa, synthetic construct
  source 1..25: note = Seed: LNVIVHSATGFKQSSKALQRPVASD
LNVIVHSATGFKQNSCALIRPVASD

SEQ ID NO: 2700 - protein, 25 aa, synthetic construct
  source 1..25: note = Seed: LNVIVHSATGFKQSSKALQRPVASD
LNVIVHSATGFKQNSCALVRPVASD

SEQ ID NO: 2701 - protein, 25 aa, synthetic construct
  source 1..25: note = Seed: LNVIVHSATGFKQSSKALQRPVASD
LNVIVHSATGFKQNSFALFRPVASD

SEQ ID NO: 2702 - protein, 25 aa, synthetic construct
  source 1..25: note = Seed: LNVIVHSATGFKQSSKALQRPVASD
LNVIVHSATGFKQNSFALIRPVASD

SEQ ID NO: 2703 - protein, 25 aa, synthetic construct
  source 1..25: note = Seed: LNVIVHSATGFKQSSKALQRPVASD
LNVIVHSATGFKQNSFALLRPVASD

SEQ ID NO: 2704 - protein, 25 aa, synthetic construct
  source 1..25: note = Seed: LNVIVHSATGFKQSSKALQRPVASD
LNVIVHSATGFKQNSFALVRPVASD

SEQ ID NO: 2705 - protein, 25 aa, synthetic construct
  source 1..25: note = Seed: LNVIVHSATGFKQSSKALQRPVASD
LNVIVHSATGFKQNSGALARPVASD

SEQ ID NO: 2706 - protein, 25 aa, synthetic construct
  source 1..25: note = Seed: LNVIVHSATGFKQSSKALQRPVASD
LNVIVHSATGFKQNSGALFRPVASD

SEQ ID NO: 2707 - protein, 25 aa, synthetic construct
  source 1..25: note = Seed: LNVIVHSATGFKQSSKALQRPVASD
LNVIVHSATGFKQNSGALIRPVASD

SEQ ID NO: 2708 - protein, 25 aa, synthetic construct
  source 1..25: note = Seed: LNVIVHSATGFKQSSKALQRPVASD
LNVIVHSATGFKQNSGALLRPVASD

SEQ ID NO: 2709 - protein, 25 aa, synthetic construct
  source 1..25: note = Seed: LNVIVHSATGFKQSSKALQRPVASD
LNVIVHSATGFKQNSGALMRPVASD

SEQ ID NO: 2710 - protein, 25 aa, synthetic construct
  source 1..25: note = Seed: LNVIVHSATGFKQSSKALQRPVASD
LNVIVHSATGFKQNSGALSRPVASD

SEQ ID NO: 2711 - protein, 25 aa, synthetic construct
  source 1..25: note = Seed: LNVIVHSATGFKQSSKALQRPVASD
LNVIVHSATGFKQNSGALTRPVASD

SEQ ID NO: 2712 - protein, 25 aa, synthetic construct
  source 1..25: note = Seed: LNVIVHSATGFKQSSKALQRPVASD
LNVIVHSATGFKQNSGALVRPVASD

SEQ ID NO: 2713 - protein, 25 aa, synthetic construct
  source 1..25: note = Seed: LNVIVHSATGFKQSSKALQRPVASD
LNVIVHSATGFKQNSGALYRPVASD

SEQ ID NO: 2714 - protein, 25 aa, synthetic construct
  source 1..25: note = Seed: LNVIVHSATGFKQSSKALQRPVASD
LNVIVHSATGFKQNSHALFRPVASD

SEQ ID NO: 2715 - protein, 25 aa, synthetic construct
  source 1..25: note = Seed: LNVIVHSATGFKQSSKALQRPVASD
LNVIVHSATGFKQNSHALIRPVASD

SEQ ID NO: 2716 - protein, 25 aa, synthetic construct
  source 1..25: note = Seed: LNVIVHSATGFKQSSKALQRPVASD
LNVIVHSATGFKQNSHALLRPVASD

SEQ ID NO: 2717 - protein, 25 aa, synthetic construct
  source 1..25: note = Seed: LNVIVHSATGFKQSSKALQRPVASD
LNVIVHSATGFKQNSHALVRPVASD

SEQ ID NO: 2718 - protein, 25 aa, synthetic construct
  source 1..25: note = Seed: LNVIVHSATGFKQSSKALQRPVASD
LNVIVHSATGFKQNSIALARPVASD

SEQ ID NO: 2719 - protein, 25 aa, synthetic construct
  source 1..25: note = Seed: LNVIVHSATGFKQSSKALQRPVASD
LNVIVHSATGFKQNSIALFRPVASD

SEQ ID NO: 2720 - protein, 25 aa, synthetic construct
  source 1..25: note = Seed: LNVIVHSATGFKQSSKALQRPVASD
LNVIVHSATGFKQNSIALIRPVASD

SEQ ID NO: 2721 - protein, 25 aa, synthetic construct
  source 1..25: note = Seed: LNVIVHSATGFKQSSKALQRPVASD
LNVIVHSATGFKQNSIALLRPVASD

SEQ ID NO: 2722 - protein, 25 aa, synthetic construct
  source 1..25: note = Seed: LNVIVHSATGFKQSSKALQRPVASD
LNVIVHSATGFKQNSIALMRPVASD

SEQ ID NO: 2723 - protein, 25 aa, synthetic construct
  source 1..25: note = Seed: LNVIVHSATGFKQSSKALQRPVASD
LNVIVHSATGFKQNSIALNRPVASD

SEQ ID NO: 2724 - protein, 25 aa, synthetic construct
  source 1..25: note = Seed: LNVIVHSATGFKQSSKALQRPVASD
LNVIVHSATGFKQNSIALSRPVASD

SEQ ID NO: 2725 - protein, 25 aa, synthetic construct
  source 1..25: note = Seed: LNVIVHSATGFKQSSKALQRPVASD
LNVIVHSATGFKQNSIALVRPVASD

SEQ ID NO: 2726 - protein, 25 aa, synthetic construct
  source 1..25: note = Seed: LNVIVHSATGFKQSSKALQRPVASD
LNVIVHSATGFKQNSIALYRPVASD

SEQ ID NO: 2727 - protein, 25 aa, synthetic construct
  source 1..25: note = Seed: LNVIVHSATGFKQSSKALQRPVASD
LNVIVHSATGFKQNSKALARPVASD

SEQ ID NO: 2728 - protein, 25 aa, synthetic construct
  source 1..25: note = Seed: LNVIVHSATGFKQSSKALQRPVASD
LNVIVHSATGFKQNSKALSRPVASD

SEQ ID NO: 2729 - protein, 25 aa, synthetic construct
  source 1..25: note = Seed: LNVIVHSATGFKQSSKALQRPVASD
LNVIVHSATGFKQNSLALARPVASD

SEQ ID NO: 2730 - protein, 25 aa, synthetic construct
  source 1..25: note = Seed: LNVIVHSATGFKQSSKALQRPVASD
LNVIVHSATGFKQNSLALFRPVASD

SEQ ID NO: 2731 - protein, 25 aa, synthetic construct
  source 1..25: note = Seed: LNVIVHSATGFKQSSKALQRPVASD
LNVIVHSATGFKQNSLALIRPVASD

SEQ ID NO: 2732 - protein, 25 aa, synthetic construct
  source 1..25: note = Seed: LNVIVHSATGFKQSSKALQRPVASD
LNVIVHSATGFKQNSLALLRPVASD

SEQ ID NO: 2733 - protein, 25 aa, synthetic construct
  source 1..25: note = Seed: LNVIVHSATGFKQSSKALQRPVASD
LNVIVHSATGFKQNSLALNRPVASD

SEQ ID NO: 2734 - protein, 25 aa, synthetic construct
  source 1..25: note = Seed: LNVIVHSATGFKQSSKALQRPVASD
LNVIVHSATGFKQNSLALVRPVASD

SEQ ID NO: 2735 - protein, 25 aa, synthetic construct
  source 1..25: note = Seed: LNVIVHSATGFKQSSKALQRPVASD
LNVIVHSATGFKQNSLALYRPVASD

SEQ ID NO: 2736 - protein, 25 aa, synthetic construct
  source 1..25: note = Seed: LNVIVHSATGFKQSSKALQRPVASD
LNVIVHSATGFKQNSMALARPVASD

SEQ ID NO: 2737 - protein, 25 aa, synthetic construct
  source 1..25: note = Seed: LNVIVHSATGFKQSSKALQRPVASD
LNVIVHSATGFKQNSMALFRPVASD

SEQ ID NO: 2738 - protein, 25 aa, synthetic construct
  source 1..25: note = Seed: LNVIVHSATGFKQSSKALQRPVASD
LNVIVHSATGFKQNSMALIRPVASD

SEQ ID NO: 2739 - protein, 25 aa, synthetic construct
  source 1..25: note = Seed: LNVIVHSATGFKQSSKALQRPVASD
LNVIVHSATGFKQNSMALLRPVASD

SEQ ID NO: 2740 - protein, 25 aa, synthetic construct
  source 1..25: note = Seed: LNVIVHSATGFKQSSKALQRPVASD
LNVIVHSATGFKQNSMALMRPVASD

SEQ ID NO: 2741 - protein, 25 aa, synthetic construct
  source 1..25: note = Seed: LNVIVHSATGFKQSSKALQRPVASD
LNVIVHSATGFKQNSMALVRPVASD

SEQ ID NO: 2742 - protein, 25 aa, synthetic construct
  source 1..25: note = Seed: LNVIVHSATGFKQSSKALQRPVASD
LNVIVHSATGFKQNSMALYRPVASD

SEQ ID NO: 2743 - protein, 25 aa, synthetic construct
  source 1..25: note = Seed: LNVIVHSATGFKQSSKALQRPVASD
LNVIVHSATGFKQNSNALARPVASD

SEQ ID NO: 2744 - protein, 25 aa, synthetic construct
  source 1..25: note = Seed: LNVIVHSATGFKQSSKALQRPVASD
LNVIVHSATGFKQNSNALFRPVASD

SEQ ID NO: 2745 - protein, 25 aa, synthetic construct
  source 1..25: note = Seed: LNVIVHSATGFKQSSKALQRPVASD
LNVIVHSATGFKQNSNALIRPVASD

SEQ ID NO: 2746 - protein, 25 aa, synthetic construct
  source 1..25: note = Seed: LNVIVHSATGFKQSSKALQRPVASD
LNVIVHSATGFKQNSNALLRPVASD

SEQ ID NO: 2747 - protein, 25 aa, synthetic construct
  source 1..25: note = Seed: LNVIVHSATGFKQSSKALQRPVASD
LNVIVHSATGFKQNSNALMRPVASD

SEQ ID NO: 2748 - protein, 25 aa, synthetic construct
  source 1..25: note = Seed: LNVIVHSATGFKQSSKALQRPVASD
LNVIVHSATGFKQNSNALSRPVASD

SEQ ID NO: 2749 - protein, 25 aa, synthetic construct
  source 1..25: note = Seed: LNVIVHSATGFKQSSKALQRPVASD
LNVIVHSATGFKQNSNALTRPVASD

SEQ ID NO: 2750 - protein, 25 aa, synthetic construct
  source 1..25: note = Seed: LNVIVHSATGFKQSSKALQRPVASD
LNVIVHSATGFKQNSNALVRPVASD

SEQ ID NO: 2751 - protein, 25 aa, synthetic construct
  source 1..25: note = Seed: LNVIVHSATGFKQSSKALQRPVASD
LNVIVHSATGFKQNSNALWRPVASD

SEQ ID NO: 2752 - protein, 25 aa, synthetic construct
  source 1..25: note = Seed: LNVIVHSATGFKQSSKALQRPVASD
LNVIVHSATGFKQNSNALYRPVASD

SEQ ID NO: 2753 - protein, 25 aa, synthetic construct
  source 1..25: note = Seed: LNVIVHSATGFKQSSKALQRPVASD
LNVIVHSATGFKQNSPALARPVASD

SEQ ID NO: 2754 - protein, 25 aa, synthetic construct
  source 1..25: note = Seed: LNVIVHSATGFKQSSKALQRPVASD
LNVIVHSATGFKQNSPALFRPVASD

SEQ ID NO: 2755 - protein, 25 aa, synthetic construct
  source 1..25: note = Seed: LNVIVHSATGFKQSSKALQRPVASD
LNVIVHSATGFKQNSPALIRPVASD

SEQ ID NO: 2756 - protein, 25 aa, synthetic construct
  source 1..25: note = Seed: LNVIVHSATGFKQSSKALQRPVASD
LNVIVHSATGFKQNSPALLRPVASD

SEQ ID NO: 2757 - protein, 25 aa, synthetic construct
  source 1..25: note = Seed: LNVIVHSATGFKQSSKALQRPVASD
LNVIVHSATGFKQNSPALMRPVASD

SEQ ID NO: 2758 - protein, 25 aa, synthetic construct
  source 1..25: note = Seed: LNVIVHSATGFKQSSKALQRPVASD
LNVIVHSATGFKQNSPALNRPVASD

SEQ ID NO: 2759 - protein, 25 aa, synthetic construct
  source 1..25: note = Seed: LNVIVHSATGFKQSSKALQRPVASD
LNVIVHSATGFKQNSPALSRPVASD

SEQ ID NO: 2760 - protein, 25 aa, synthetic construct
  source 1..25: note = Seed: LNVIVHSATGFKQSSKALQRPVASD
LNVIVHSATGFKQNSPALTRPVASD

SEQ ID NO: 2761 - protein, 25 aa, synthetic construct
  source 1..25: note = Seed: LNVIVHSATGFKQSSKALQRPVASD
LNVIVHSATGFKQNSPALVRPVASD

SEQ ID NO: 2762 - protein, 25 aa, synthetic construct
  source 1..25: note = Seed: LNVIVHSATGFKQSSKALQRPVASD
LNVIVHSATGFKQNSPALWRPVASD

SEQ ID NO: 2763 - protein, 25 aa, synthetic construct
  source 1..25: note = Seed: LNVIVHSATGFKQSSKALQRPVASD
LNVIVHSATGFKQNSPALYRPVASD

SEQ ID NO: 2764 - protein, 25 aa, synthetic construct
  source 1..25: note = Seed: LNVIVHSATGFKQSSKALQRPVASD
LNVIVHSATGFKQNSQALIRPVASD

SEQ ID NO: 2765 - protein, 25 aa, synthetic construct
  source 1..25: note = Seed: LNVIVHSATGFKQSSKALQRPVASD
LNVIVHSATGFKQNSQALVRPVASD

SEQ ID NO: 2766 - protein, 25 aa, synthetic construct
  source 1..25: note = Seed: LNVIVHSATGFKQSSKALQRPVASD
LNVIVHSATGFKQNSRALARPVASD

SEQ ID NO: 2767 - protein, 25 aa, synthetic construct
  source 1..25: note = Seed: LNVIVHSATGFKQSSKALQRPVASD
LNVIVHSATGFKQNSRALSRPVASD

SEQ ID NO: 2768 - protein, 25 aa, synthetic construct
  source 1..25: note = Seed: LNVIVHSATGFKQSSKALQRPVASD
LNVIVHSATGFKQNSSALARPVASD

SEQ ID NO: 2769 - protein, 25 aa, synthetic construct
  source 1..25: note = Seed: LNVIVHSATGFKQSSKALQRPVASD
LNVIVHSATGFKQNSSALFRPVASD

SEQ ID NO: 2770 - protein, 25 aa, synthetic construct
  source 1..25: note = Seed: LNVIVHSATGFKQSSKALQRPVASD
LNVIVHSATGFKQNSSALIRPVASD

SEQ ID NO: 2771 - protein, 25 aa, synthetic construct
  source 1..25: note = Seed: LNVIVHSATGFKQSSKALQRPVASD
LNVIVHSATGFKQNSSALLRPVASD

SEQ ID NO: 2772 - protein, 25 aa, synthetic construct
  source 1..25: note = Seed: LNVIVHSATGFKQSSKALQRPVASD
LNVIVHSATGFKQNSSALMRPVASD

SEQ ID NO: 2773 - protein, 25 aa, synthetic construct
  source 1..25: note = Seed: LNVIVHSATGFKQSSKALQRPVASD
LNVIVHSATGFKQNSSALSRPVASD

SEQ ID NO: 2774 - protein, 25 aa, synthetic construct
  source 1..25: note = Seed: LNVIVHSATGFKQSSKALQRPVASD
LNVIVHSATGFKQNSSALTRPVASD

SEQ ID NO: 2775 - protein, 25 aa, synthetic construct
  source 1..25: note = Seed: LNVIVHSATGFKQSSKALQRPVASD
LNVIVHSATGFKQNSSALVRPVASD

SEQ ID NO: 2776 - protein, 25 aa, synthetic construct
  source 1..25: note = Seed: LNVIVHSATGFKQSSKALQRPVASD
LNVIVHSATGFKQNSSALWRPVASD

SEQ ID NO: 2777 - protein, 25 aa, synthetic construct
  source 1..25: note = Seed: LNVIVHSATGFKQSSKALQRPVASD
LNVIVHSATGFKQNSSALYRPVASD

SEQ ID NO: 2778 - protein, 25 aa, synthetic construct
  source 1..25: note = Seed: LNVIVHSATGFKQSSKALQRPVASD
LNVIVHSATGFKQNSTALARPVASD

SEQ ID NO: 2779 - protein, 25 aa, synthetic construct
  source 1..25: note = Seed: LNVIVHSATGFKQSSKALQRPVASD
LNVIVHSATGFKQNSTALFRPVASD

SEQ ID NO: 2780 - protein, 25 aa, synthetic construct
  source 1..25: note = Seed: LNVIVHSATGFKQSSKALQRPVASD
LNVIVHSATGFKQNSTALIRPVASD

SEQ ID NO: 2781 - protein, 25 aa, synthetic construct
  source 1..25: note = Seed: LNVIVHSATGFKQSSKALQRPVASD
LNVIVHSATGFKQNSTALLRPVASD

SEQ ID NO: 2782 - protein, 25 aa, synthetic construct
  source 1..25: note = Seed: LNVIVHSATGFKQSSKALQRPVASD
LNVIVHSATGFKQNSTALMRPVASD

SEQ ID NO: 2783 - protein, 25 aa, synthetic construct
  source 1..25: note = Seed: LNVIVHSATGFKQSSKALQRPVASD
LNVIVHSATGFKQNSTALVRPVASD

SEQ ID NO: 2784 - protein, 25 aa, synthetic construct
  source 1..25: note = Seed: LNVIVHSATGFKQSSKALQRPVASD
LNVIVHSATGFKQNSTALYRPVASD

SEQ ID NO: 2785 - protein, 25 aa, synthetic construct
  source 1..25: note = Seed: LNVIVHSATGFKQSSKALQRPVASD
LNVIVHSATGFKQNSVALARPVASD

SEQ ID NO: 2786 - protein, 25 aa, synthetic construct
  source 1..25: note = Seed: LNVIVHSATGFKQSSKALQRPVASD
LNVIVHSATGFKQNSVALFRPVASD

SEQ ID NO: 2787 - protein, 25 aa, synthetic construct
  source 1..25: note = Seed: LNVIVHSATGFKQSSKALQRPVASD
LNVIVHSATGFKQNSVALIRPVASD

SEQ ID NO: 2788 - protein, 25 aa, synthetic construct
  source 1..25: note = Seed: LNVIVHSATGFKQSSKALQRPVASD
LNVIVHSATGFKQNSVALLRPVASD

SEQ ID NO: 2789 - protein, 25 aa, synthetic construct
  source 1..25: note = Seed: LNVIVHSATGFKQSSKALQRPVASD
LNVIVHSATGFKQNSVALMRPVASD

SEQ ID NO: 2790 - protein, 25 aa, synthetic construct
  source 1..25: note = Seed: LNVIVHSATGFKQSSKALQRPVASD
LNVIVHSATGFKQNSVALNRPVASD

SEQ ID NO: 2791 - protein, 25 aa, synthetic construct
  source 1..25: note = Seed: LNVIVHSATGFKQSSKALQRPVASD
LNVIVHSATGFKQNSVALSRPVASD

SEQ ID NO: 2792 - protein, 25 aa, synthetic construct
  source 1..25: note = Seed: LNVIVHSATGFKQSSKALQRPVASD
LNVIVHSATGFKQNSVALVRPVASD

SEQ ID NO: 2793 - protein, 25 aa, synthetic construct
  source 1..25: note = Seed: LNVIVHSATGFKQSSKALQRPVASD
LNVIVHSATGFKQNSVALYRPVASD

SEQ ID NO: 2794 - protein, 25 aa, synthetic construct
  source 1..25: note = Seed: LNVIVHSATGFKQSSKALQRPVASD
LNVIVHSATGFKQQSAALARPVASD

SEQ ID NO: 2795 - protein, 25 aa, synthetic construct
  source 1..25: note = Seed: LNVIVHSATGFKQSSKALQRPVASD
LNVIVHSATGFKQQSAALCRPVASD

SEQ ID NO: 2796 - protein, 25 aa, synthetic construct
  source 1..25: note = Seed: LNVIVHSATGFKQSSKALQRPVASD
LNVIVHSATGFKQQSAALDRPVASD

SEQ ID NO: 2797 - protein, 25 aa, synthetic construct
  source 1..25: note = Seed: LNVIVHSATGFKQSSKALQRPVASD
LNVIVHSATGFKQQSAALERPVASD

SEQ ID NO: 2798 - protein, 25 aa, synthetic construct
  source 1..25: note = Seed: LNVIVHSATGFKQSSKALQRPVASD
LNVIVHSATGFKQQSAALFRPVASD

SEQ ID NO: 2799 - protein, 25 aa, synthetic construct
  source 1..25: note = Seed: LNVIVHSATGFKQSSKALQRPVASD
LNVIVHSATGFKQQSAALGRPVASD

SEQ ID NO: 2800 - protein, 25 aa, synthetic construct
  source 1..25: note = Seed: LNVIVHSATGFKQSSKALQRPVASD
LNVIVHSATGFKQQSAALHRPVASD

SEQ ID NO: 2801 - protein, 25 aa, synthetic construct
  source 1..25: note = Seed: LNVIVHSATGFKQSSKALQRPVASD
LNVIVHSATGFKQQSAALIRPVASD

SEQ ID NO: 2802 - protein, 25 aa, synthetic construct
  source 1..25: note = Seed: LNVIVHSATGFKQSSKALQRPVASD
LNVIVHSATGFKQQSAALLRPVASD

SEQ ID NO: 2803 - protein, 25 aa, synthetic construct
  source 1..25: note = Seed: LNVIVHSATGFKQSSKALQRPVASD
LNVIVHSATGFKQQSAALMRPVASD

SEQ ID NO: 2804 - protein, 25 aa, synthetic construct
  source 1..25: note = Seed: LNVIVHSATGFKQSSKALQRPVASD
LNVIVHSATGFKQQSAALNRPVASD

SEQ ID NO: 2805 - protein, 25 aa, synthetic construct
  source 1..25: note = Seed: LNVIVHSATGFKQSSKALQRPVASD
LNVIVHSATGFKQQSAALPRPVASD

SEQ ID NO: 2806 - protein, 25 aa, synthetic construct
  source 1..25: note = Seed: LNVIVHSATGFKQSSKALQRPVASD
LNVIVHSATGFKQQSAALQRPVASD

SEQ ID NO: 2807 - protein, 25 aa, synthetic construct
  source 1..25: note = Seed: LNVIVHSATGFKQSSKALQRPVASD
LNVIVHSATGFKQQSAALSRPVASD

SEQ ID NO: 2808 - protein, 25 aa, synthetic construct
  source 1..25: note = Seed: LNVIVHSATGFKQSSKALQRPVASD
LNVIVHSATGFKQQSAALTRPVASD

SEQ ID NO: 2809 - protein, 25 aa, synthetic construct
  source 1..25: note = Seed: LNVIVHSATGFKQSSKALQRPVASD
LNVIVHSATGFKQQSAALVRPVASD

SEQ ID NO: 2810 - protein, 25 aa, synthetic construct
  source 1..25: note = Seed: LNVIVHSATGFKQSSKALQRPVASD
LNVIVHSATGFKQQSAALWRPVASD

SEQ ID NO: 2811 - protein, 25 aa, synthetic construct
  source 1..25: note = Seed: LNVIVHSATGFKQSSKALQRPVASD
LNVIVHSATGFKQQSAALYRPVASD

SEQ ID NO: 2812 - protein, 25 aa, synthetic construct
  source 1..25: note = Seed: LNVIVHSATGFKQSSKALQRPVASD
LNVIVHSATGFKQQSFALFRPVASD

SEQ ID NO: 2813 - protein, 25 aa, synthetic construct
  source 1..25: note = Seed: LNVIVHSATGFKQSSKALQRPVASD
LNVIVHSATGFKQQSFALIRPVASD

SEQ ID NO: 2814 - protein, 25 aa, synthetic construct
  source 1..25: note = Seed: LNVIVHSATGFKQSSKALQRPVASD
LNVIVHSATGFKQQSFALLRPVASD

SEQ ID NO: 2815 - protein, 25 aa, synthetic construct
  source 1..25: note = Seed: LNVIVHSATGFKQSSKALQRPVASD
LNVIVHSATGFKQQSFALVRPVASD

SEQ ID NO: 2816 - protein, 25 aa, synthetic construct
  source 1..25: note = Seed: LNVIVHSATGFKQSSKALQRPVASD
LNVIVHSATGFKQQSGALARPVASD

SEQ ID NO: 2817 - protein, 25 aa, synthetic construct
  source 1..25: note = Seed: LNVIVHSATGFKQSSKALQRPVASD
LNVIVHSATGFKQQSGALCRPVASD

SEQ ID NO: 2818 - protein, 25 aa, synthetic construct
  source 1..25: note = Seed: LNVIVHSATGFKQSSKALQRPVASD
LNVIVHSATGFKQQSGALFRPVASD

SEQ ID NO: 2819 - protein, 25 aa, synthetic construct
  source 1..25: note = Seed: LNVIVHSATGFKQSSKALQRPVASD
LNVIVHSATGFKQQSGALGRPVASD

SEQ ID NO: 2820 - protein, 25 aa, synthetic construct
  source 1..25: note = Seed: LNVIVHSATGFKQSSKALQRPVASD
LNVIVHSATGFKQQSGALIRPVASD

SEQ ID NO: 2821 - protein, 25 aa, synthetic construct
  source 1..25: note = Seed: LNVIVHSATGFKQSSKALQRPVASD
LNVIVHSATGFKQQSGALLRPVASD

SEQ ID NO: 2822 - protein, 25 aa, synthetic construct
  source 1..25: note = Seed: LNVIVHSATGFKQSSKALQRPVASD
LNVIVHSATGFKQQSGALMRPVASD

SEQ ID NO: 2823 - protein, 25 aa, synthetic construct
  source 1..25: note = Seed: LNVIVHSATGFKQSSKALQRPVASD
LNVIVHSATGFKQQSGALNRPVASD

SEQ ID NO: 2824 - protein, 25 aa, synthetic construct
  source 1..25: note = Seed: LNVIVHSATGFKQSSKALQRPVASD
LNVIVHSATGFKQQSGALSRPVASD

SEQ ID NO: 2825 - protein, 25 aa, synthetic construct
  source 1..25: note = Seed: LNVIVHSATGFKQSSKALQRPVASD
LNVIVHSATGFKQQSGALTRPVASD

SEQ ID NO: 2826 - protein, 25 aa, synthetic construct
  source 1..25: note = Seed: LNVIVHSATGFKQSSKALQRPVASD
LNVIVHSATGFKQQSGALVRPVASD

SEQ ID NO: 2827 - protein, 25 aa, synthetic construct
  source 1..25: note = Seed: LNVIVHSATGFKQSSKALQRPVASD
LNVIVHSATGFKQQSIALARPVASD

SEQ ID NO: 2828 - protein, 25 aa, synthetic construct
  source 1..25: note = Seed: LNVIVHSATGFKQSSKALQRPVASD
LNVIVHSATGFKQQSIALERPVASD

SEQ ID NO: 2829 - protein, 25 aa, synthetic construct
  source 1..25: note = Seed: LNVIVHSATGFKQSSKALQRPVASD
LNVIVHSATGFKQQSIALFRPVASD

SEQ ID NO: 2830 - protein, 25 aa, synthetic construct
  source 1..25: note = Seed: LNVIVHSATGFKQSSKALQRPVASD
LNVIVHSATGFKQQSIALGRPVASD

SEQ ID NO: 2831 - protein, 25 aa, synthetic construct
  source 1..25: note = Seed: LNVIVHSATGFKQSSKALQRPVASD
LNVIVHSATGFKQQSIALHRPVASD

SEQ ID NO: 2832 - protein, 25 aa, synthetic construct
  source 1..25: note = Seed: LNVIVHSATGFKQSSKALQRPVASD
LNVIVHSATGFKQQSIALIRPVASD

SEQ ID NO: 2833 - protein, 25 aa, synthetic construct
  source 1..25: note = Seed: LNVIVHSATGFKQSSKALQRPVASD
LNVIVHSATGFKQQSIALLRPVASD

SEQ ID NO: 2834 - protein, 25 aa, synthetic construct
  source 1..25: note = Seed: LNVIVHSATGFKQSSKALQRPVASD
LNVIVHSATGFKQQSIALMRPVASD

SEQ ID NO: 2835 - protein, 25 aa, synthetic construct
  source 1..25: note = Seed: LNVIVHSATGFKQSSKALQRPVASD
LNVIVHSATGFKQQSIALNRPVASD

SEQ ID NO: 2836 - protein, 25 aa, synthetic construct
  source 1..25: note = Seed: LNVIVHSATGFKQSSKALQRPVASD
LNVIVHSATGFKQQSIALQRPVASD

SEQ ID NO: 2837 - protein, 25 aa, synthetic construct
  source 1..25: note = Seed: LNVIVHSATGFKQSSKALQRPVASD
LNVIVHSATGFKQQSIALSRPVASD

SEQ ID NO: 2838 - protein, 25 aa, synthetic construct
  source 1..25: note = Seed: LNVIVHSATGFKQSSKALQRPVASD
LNVIVHSATGFKQQSIALTRPVASD

SEQ ID NO: 2839 - protein, 25 aa, synthetic construct
  source 1..25: note = Seed: LNVIVHSATGFKQSSKALQRPVASD
LNVIVHSATGFKQQSIALVRPVASD

SEQ ID NO: 2840 - protein, 25 aa, synthetic construct
  source 1..25: note = Seed: LNVIVHSATGFKQSSKALQRPVASD
LNVIVHSATGFKQQSKALARPVASD

SEQ ID NO: 2841 - protein, 25 aa, synthetic construct
  source 1..25: note = Seed: LNVIVHSATGFKQSSKALQRPVASD
LNVIVHSATGFKQQSKALGRPVASD

SEQ ID NO: 2842 - protein, 25 aa, synthetic construct
  source 1..25: note = Seed: LNVIVHSATGFKQSSKALQRPVASD
LNVIVHSATGFKQQSKALHRPVASD

SEQ ID NO: 2843 - protein, 25 aa, synthetic construct
  source 1..25: note = Seed: LNVIVHSATGFKQSSKALQRPVASD
LNVIVHSATGFKQQSKALSRPVASD

SEQ ID NO: 2844 - protein, 25 aa, synthetic construct
  source 1..25: note = Seed: LNVIVHSATGFKQSSKALQRPVASD
LNVIVHSATGFKQQSKALTRPVASD

SEQ ID NO: 2845 - protein, 25 aa, synthetic construct
  source 1..25: note = Seed: LNVIVHSATGFKQSSKALQRPVASD
LNVIVHSATGFKQQSLALARPVASD

SEQ ID NO: 2846 - protein, 25 aa, synthetic construct
  source 1..25: note = Seed: LNVIVHSATGFKQSSKALQRPVASD
LNVIVHSATGFKQQSLALIRPVASD

SEQ ID NO: 2847 - protein, 25 aa, synthetic construct
  source 1..25: note = Seed: LNVIVHSATGFKQSSKALQRPVASD
LNVIVHSATGFKQQSLALLRPVASD

SEQ ID NO: 2848 - protein, 25 aa, synthetic construct
  source 1..25: note = Seed: LNVIVHSATGFKQSSKALQRPVASD
LNVIVHSATGFKQQSLALMRPVASD

SEQ ID NO: 2849 - protein, 25 aa, synthetic construct
  source 1..25: note = Seed: LNVIVHSATGFKQSSKALQRPVASD
LNVIVHSATGFKQQSLALNRPVASD

SEQ ID NO: 2850 - protein, 25 aa, synthetic construct
  source 1..25: note = Seed: LNVIVHSATGFKQSSKALQRPVASD
LNVIVHSATGFKQQSLALQRPVASD

SEQ ID NO: 2851 - protein, 25 aa, synthetic construct
  source 1..25: note = Seed: LNVIVHSATGFKQSSKALQRPVASD
LNVIVHSATGFKQQSLALSRPVASD

SEQ ID NO: 2852 - protein, 25 aa, synthetic construct
  source 1..25: note = Seed: LNVIVHSATGFKQSSKALQRPVASD
LNVIVHSATGFKQQSLALTRPVASD

SEQ ID NO: 2853 - protein, 25 aa, synthetic construct
  source 1..25: note = Seed: LNVIVHSATGFKQSSKALQRPVASD
LNVIVHSATGFKQQSLALVRPVASD

SEQ ID NO: 2854 - protein, 25 aa, synthetic construct
  source 1..25: note = Seed: LNVIVHSATGFKQSSKALQRPVASD
LNVIVHSATGFKQQSMALARPVASD

SEQ ID NO: 2855 - protein, 25 aa, synthetic construct
  source 1..25: note = Seed: LNVIVHSATGFKQSSKALQRPVASD
LNVIVHSATGFKQQSMALIRPVASD

SEQ ID NO: 2856 - protein, 25 aa, synthetic construct
  source 1..25: note = Seed: LNVIVHSATGFKQSSKALQRPVASD
LNVIVHSATGFKQQSMALLRPVASD

SEQ ID NO: 2857 - protein, 25 aa, synthetic construct
  source 1..25: note = Seed: LNVIVHSATGFKQSSKALQRPVASD
LNVIVHSATGFKQQSMALMRPVASD

SEQ ID NO: 2858 - protein, 25 aa, synthetic construct
  source 1..25: note = Seed: LNVIVHSATGFKQSSKALQRPVASD
LNVIVHSATGFKQQSMALNRPVASD

SEQ ID NO: 2859 - protein, 25 aa, synthetic construct
  source 1..25: note = Seed: LNVIVHSATGFKQSSKALQRPVASD
LNVIVHSATGFKQQSMALSRPVASD

SEQ ID NO: 2860 - protein, 25 aa, synthetic construct
  source 1..25: note = Seed: LNVIVHSATGFKQSSKALQRPVASD
LNVIVHSATGFKQQSMALTRPVASD

SEQ ID NO: 2861 - protein, 25 aa, synthetic construct
  source 1..25: note = Seed: LNVIVHSATGFKQSSKALQRPVASD
LNVIVHSATGFKQQSMALVRPVASD

SEQ ID NO: 2862 - protein, 25 aa, synthetic construct
  source 1..25: note = Seed: LNVIVHSATGFKQSSKALQRPVASD
LNVIVHSATGFKQQSNALARPVASD

SEQ ID NO: 2863 - protein, 25 aa, synthetic construct
  source 1..25: note = Seed: LNVIVHSATGFKQSSKALQRPVASD
LNVIVHSATGFKQQSNALGRPVASD

SEQ ID NO: 2864 - protein, 25 aa, synthetic construct
  source 1..25: note = Seed: LNVIVHSATGFKQSSKALQRPVASD
LNVIVHSATGFKQQSNALIRPVASD

SEQ ID NO: 2865 - protein, 25 aa, synthetic construct
  source 1..25: note = Seed: LNVIVHSATGFKQSSKALQRPVASD
LNVIVHSATGFKQQSNALLRPVASD

SEQ ID NO: 2866 - protein, 25 aa, synthetic construct
  source 1..25: note = Seed: LNVIVHSATGFKQSSKALQRPVASD
LNVIVHSATGFKQQSNALMRPVASD

SEQ ID NO: 2867 - protein, 25 aa, synthetic construct
  source 1..25: note = Seed: LNVIVHSATGFKQSSKALQRPVASD
LNVIVHSATGFKQQSNALNRPVASD

SEQ ID NO: 2868 - protein, 25 aa, synthetic construct
  source 1..25: note = Seed: LNVIVHSATGFKQSSKALQRPVASD
LNVIVHSATGFKQQSNALSRPVASD

SEQ ID NO: 2869 - protein, 25 aa, synthetic construct
  source 1..25: note = Seed: LNVIVHSATGFKQSSKALQRPVASD
LNVIVHSATGFKQQSNALTRPVASD

SEQ ID NO: 2870 - protein, 25 aa, synthetic construct
  source 1..25: note = Seed: LNVIVHSATGFKQSSKALQRPVASD
LNVIVHSATGFKQQSNALVRPVASD

SEQ ID NO: 2871 - protein, 25 aa, synthetic construct
  source 1..25: note = Seed: LNVIVHSATGFKQSSKALQRPVASD
LNVIVHSATGFKQQSPALARPVASD

SEQ ID NO: 2872 - protein, 25 aa, synthetic construct
  source 1..25: note = Seed: LNVIVHSATGFKQSSKALQRPVASD
LNVIVHSATGFKQQSPALCRPVASD

SEQ ID NO: 2873 - protein, 25 aa, synthetic construct
  source 1..25: note = Seed: LNVIVHSATGFKQSSKALQRPVASD
LNVIVHSATGFKQQSPALDRPVASD

SEQ ID NO: 2874 - protein, 25 aa, synthetic construct
  source 1..25: note = Seed: LNVIVHSATGFKQSSKALQRPVASD
LNVIVHSATGFKQQSPALERPVASD

SEQ ID NO: 2875 - protein, 25 aa, synthetic construct
  source 1..25: note = Seed: LNVIVHSATGFKQSSKALQRPVASD
LNVIVHSATGFKQQSPALFRPVASD

SEQ ID NO: 2876 - protein, 25 aa, synthetic construct
  source 1..25: note = Seed: LNVIVHSATGFKQSSKALQRPVASD
LNVIVHSATGFKQQSPALGRPVASD

SEQ ID NO: 2877 - protein, 25 aa, synthetic construct
  source 1..25: note = Seed: LNVIVHSATGFKQSSKALQRPVASD
LNVIVHSATGFKQQSPALHRPVASD

SEQ ID NO: 2878 - protein, 25 aa, synthetic construct
  source 1..25: note = Seed: LNVIVHSATGFKQSSKALQRPVASD
LNVIVHSATGFKQQSPALIRPVASD

SEQ ID NO: 2879 - protein, 25 aa, synthetic construct
  source 1..25: note = Seed: LNVIVHSATGFKQSSKALQRPVASD
LNVIVHSATGFKQQSPALLRPVASD

SEQ ID NO: 2880 - protein, 25 aa, synthetic construct
  source 1..25: note = Seed: LNVIVHSATGFKQSSKALQRPVASD
LNVIVHSATGFKQQSPALMRPVASD

SEQ ID NO: 2881 - protein, 25 aa, synthetic construct
  source 1..25: note = Seed: LNVIVHSATGFKQSSKALQRPVASD
LNVIVHSATGFKQQSPALNRPVASD

SEQ ID NO: 2882 - protein, 25 aa, synthetic construct
  source 1..25: note = Seed: LNVIVHSATGFKQSSKALQRPVASD
LNVIVHSATGFKQQSPALPRPVASD

SEQ ID NO: 2883 - protein, 25 aa, synthetic construct
  source 1..25: note = Seed: LNVIVHSATGFKQSSKALQRPVASD
LNVIVHSATGFKQQSPALQRPVASD

SEQ ID NO: 2884 - protein, 25 aa, synthetic construct
  source 1..25: note = Seed: LNVIVHSATGFKQSSKALQRPVASD
LNVIVHSATGFKQQSPALSRPVASD

SEQ ID NO: 2885 - protein, 25 aa, synthetic construct
  source 1..25: note = Seed: LNVIVHSATGFKQSSKALQRPVASD
LNVIVHSATGFKQQSPALTRPVASD

SEQ ID NO: 2886 - protein, 25 aa, synthetic construct
  source 1..25: note = Seed: LNVIVHSATGFKQSSKALQRPVASD
LNVIVHSATGFKQQSPALVRPVASD

SEQ ID NO: 2887 - protein, 25 aa, synthetic construct
  source 1..25: note = Seed: LNVIVHSATGFKQSSKALQRPVASD
LNVIVHSATGFKQQSRALARPVASD

SEQ ID NO: 2888 - protein, 25 aa, synthetic construct
  source 1..25: note = Seed: LNVIVHSATGFKQSSKALQRPVASD
LNVIVHSATGFKQQSRALGRPVASD

SEQ ID NO: 2889 - protein, 25 aa, synthetic construct
  source 1..25: note = Seed: LNVIVHSATGFKQSSKALQRPVASD
LNVIVHSATGFKQQSRALHRPVASD

SEQ ID NO: 2890 - protein, 25 aa, synthetic construct
  source 1..25: note = Seed: LNVIVHSATGFKQSSKALQRPVASD
LNVIVHSATGFKQQSRALQRPVASD

SEQ ID NO: 2891 - protein, 25 aa, synthetic construct
  source 1..25: note = Seed: LNVIVHSATGFKQSSKALQRPVASD
LNVIVHSATGFKQQSRALRRPVASD

SEQ ID NO: 2892 - protein, 25 aa, synthetic construct
  source 1..25: note = Seed: LNVIVHSATGFKQSSKALQRPVASD
LNVIVHSATGFKQQSRALSRPVASD

SEQ ID NO: 2893 - protein, 25 aa, synthetic construct
  source 1..25: note = Seed: LNVIVHSATGFKQSSKALQRPVASD
LNVIVHSATGFKQQSRALTRPVASD

SEQ ID NO: 2894 - protein, 25 aa, synthetic construct
  source 1..25: note = Seed: LNVIVHSATGFKQSSKALQRPVASD
LNVIVHSATGFKQQSSALARPVASD

SEQ ID NO: 2895 - protein, 25 aa, synthetic construct
  source 1..25: note = Seed: LNVIVHSATGFKQSSKALQRPVASD
LNVIVHSATGFKQQSSALCRPVASD

SEQ ID NO: 2896 - protein, 25 aa, synthetic construct
  source 1..25: note = Seed: LNVIVHSATGFKQSSKALQRPVASD
LNVIVHSATGFKQQSSALFRPVASD

SEQ ID NO: 2897 - protein, 25 aa, synthetic construct
  source 1..25: note = Seed: LNVIVHSATGFKQSSKALQRPVASD
LNVIVHSATGFKQQSSALGRPVASD

SEQ ID NO: 2898 - protein, 25 aa, synthetic construct
  source 1..25: note = Seed: LNVIVHSATGFKQSSKALQRPVASD
LNVIVHSATGFKQQSSALHRPVASD

SEQ ID NO: 2899 - protein, 25 aa, synthetic construct
  source 1..25: note = Seed: LNVIVHSATGFKQSSKALQRPVASD
LNVIVHSATGFKQQSSALIRPVASD

SEQ ID NO: 2900 - protein, 25 aa, synthetic construct
  source 1..25: note = Seed: LNVIVHSATGFKQSSKALQRPVASD
LNVIVHSATGFKQQSSALLRPVASD

SEQ ID NO: 2901 - protein, 25 aa, synthetic construct
  source 1..25: note = Seed: LNVIVHSATGFKQSSKALQRPVASD
LNVIVHSATGFKQQSSALMRPVASD

SEQ ID NO: 2902 - protein, 25 aa, synthetic construct
  source 1..25: note = Seed: LNVIVHSATGFKQSSKALQRPVASD
LNVIVHSATGFKQQSSALNRPVASD

SEQ ID NO: 2903 - protein, 25 aa, synthetic construct
  source 1..25: note = Seed: LNVIVHSATGFKQSSKALQRPVASD
LNVIVHSATGFKQQSSALQRPVASD

SEQ ID NO: 2904 - protein, 25 aa, synthetic construct
  source 1..25: note = Seed: LNVIVHSATGFKQSSKALQRPVASD
LNVIVHSATGFKQQSSALSRPVASD

SEQ ID NO: 2905 - protein, 25 aa, synthetic construct
  source 1..25: note = Seed: LNVIVHSATGFKQSSKALQRPVASD
LNVIVHSATGFKQQSSALTRPVASD

SEQ ID NO: 2906 - protein, 25 aa, synthetic construct
  source 1..25: note = Seed: LNVIVHSATGFKQSSKALQRPVASD
LNVIVHSATGFKQQSSALVRPVASD

SEQ ID NO: 2907 - protein, 25 aa, synthetic construct
  source 1..25: note = Seed: LNVIVHSATGFKQSSKALQRPVASD
LNVIVHSATGFKQQSTALARPVASD

SEQ ID NO: 2908 - protein, 25 aa, synthetic construct
  source 1..25: note = Seed: LNVIVHSATGFKQSSKALQRPVASD
LNVIVHSATGFKQQSTALGRPVASD

SEQ ID NO: 2909 - protein, 25 aa, synthetic construct
  source 1..25: note = Seed: LNVIVHSATGFKQSSKALQRPVASD
LNVIVHSATGFKQQSTALHRPVASD

SEQ ID NO: 2910 - protein, 25 aa, synthetic construct
  source 1..25: note = Seed: LNVIVHSATGFKQSSKALQRPVASD
LNVIVHSATGFKQQSTALIRPVASD

SEQ ID NO: 2911 - protein, 25 aa, synthetic construct
  source 1..25: note = Seed: LNVIVHSATGFKQSSKALQRPVASD
LNVIVHSATGFKQQSTALLRPVASD

SEQ ID NO: 2912 - protein, 25 aa, synthetic construct
  source 1..25: note = Seed: LNVIVHSATGFKQSSKALQRPVASD
LNVIVHSATGFKQQSTALMRPVASD

SEQ ID NO: 2913 - protein, 25 aa, synthetic construct
  source 1..25: note = Seed: LNVIVHSATGFKQSSKALQRPVASD
LNVIVHSATGFKQQSTALNRPVASD

SEQ ID NO: 2914 - protein, 25 aa, synthetic construct
  source 1..25: note = Seed: LNVIVHSATGFKQSSKALQRPVASD
LNVIVHSATGFKQQSTALPRPVASD

SEQ ID NO: 2915 - protein, 25 aa, synthetic construct
  source 1..25: note = Seed: LNVIVHSATGFKQSSKALQRPVASD
LNVIVHSATGFKQQSTALQRPVASD

SEQ ID NO: 2916 - protein, 25 aa, synthetic construct
  source 1..25: note = Seed: LNVIVHSATGFKQSSKALQRPVASD
LNVIVHSATGFKQQSTALSRPVASD

SEQ ID NO: 2917 - protein, 25 aa, synthetic construct
  source 1..25: note = Seed: LNVIVHSATGFKQSSKALQRPVASD
LNVIVHSATGFKQQSTALTRPVASD

SEQ ID NO: 2918 - protein, 25 aa, synthetic construct
  source 1..25: note = Seed: LNVIVHSATGFKQSSKALQRPVASD
LNVIVHSATGFKQQSTALVRPVASD

SEQ ID NO: 2919 - protein, 25 aa, synthetic construct
  source 1..25: note = Seed: LNVIVHSATGFKQSSKALQRPVASD
LNVIVHSATGFKQQSVALARPVASD

SEQ ID NO: 2920 - protein, 25 aa, synthetic construct
  source 1..25: note = Seed: LNVIVHSATGFKQSSKALQRPVASD
LNVIVHSATGFKQQSVALDRPVASD

SEQ ID NO: 2921 - protein, 25 aa, synthetic construct
  source 1..25: note = Seed: LNVIVHSATGFKQSSKALQRPVASD
LNVIVHSATGFKQQSVALERPVASD

SEQ ID NO: 2922 - protein, 25 aa, synthetic construct
  source 1..25: note = Seed: LNVIVHSATGFKQSSKALQRPVASD
LNVIVHSATGFKQQSVALGRPVASD

SEQ ID NO: 2923 - protein, 25 aa, synthetic construct
  source 1..25: note = Seed: LNVIVHSATGFKQSSKALQRPVASD
LNVIVHSATGFKQQSVALHRPVASD

SEQ ID NO: 2924 - protein, 25 aa, synthetic construct
  source 1..25: note = Seed: LNVIVHSATGFKQSSKALQRPVASD
LNVIVHSATGFKQQSVALIRPVASD

SEQ ID NO: 2925 - protein, 25 aa, synthetic construct
  source 1..25: note = Seed: LNVIVHSATGFKQSSKALQRPVASD
LNVIVHSATGFKQQSVALLRPVASD

SEQ ID NO: 2926 - protein, 25 aa, synthetic construct
  source 1..25: note = Seed: LNVIVHSATGFKQSSKALQRPVASD
LNVIVHSATGFKQQSVALMRPVASD

SEQ ID NO: 2927 - protein, 25 aa, synthetic construct
  source 1..25: note = Seed: LNVIVHSATGFKQSSKALQRPVASD
LNVIVHSATGFKQQSVALNRPVASD

SEQ ID NO: 2928 - protein, 25 aa, synthetic construct
  source 1..25: note = Seed: LNVIVHSATGFKQSSKALQRPVASD
LNVIVHSATGFKQQSVALPRPVASD

SEQ ID NO: 2929 - protein, 25 aa, synthetic construct
  source 1..25: note = Seed: LNVIVHSATGFKQSSKALQRPVASD
LNVIVHSATGFKQQSVALQRPVASD

SEQ ID NO: 2930 - protein, 25 aa, synthetic construct
  source 1..25: note = Seed: LNVIVHSATGFKQSSKALQRPVASD
LNVIVHSATGFKQQSVALSRPVASD

SEQ ID NO: 2931 - protein, 25 aa, synthetic construct
  source 1..25: note = Seed: LNVIVHSATGFKQSSKALQRPVASD
LNVIVHSATGFKQQSVALTRPVASD

SEQ ID NO: 2932 - protein, 25 aa, synthetic construct
  source 1..25: note = Seed: LNVIVHSATGFKQSSKALQRPVASD
LNVIVHSATGFKQQSVALVRPVASD

SEQ ID NO: 2933 - protein, 25 aa, synthetic construct
  source 1..25: note = Seed: LNVIVHSATGFKQSSKALQRPVASD
LNVIVHSATGFKQQSWALVRPVASD

SEQ ID NO: 2934 - protein, 25 aa, synthetic construct
  source 1..25: note = Seed: LNVIVHSATGFKQSSKALQRPVASD
LNVIVHSATGFKQRSAALARPVASD

SEQ ID NO: 2935 - protein, 25 aa, synthetic construct
  source 1..25: note = Seed: LNVIVHSATGFKQSSKALQRPVASD
LNVIVHSATGFKQRSAALIRPVASD

SEQ ID NO: 2936 - protein, 25 aa, synthetic construct
  source 1..25: note = Seed: LNVIVHSATGFKQSSKALQRPVASD
LNVIVHSATGFKQRSAALLRPVASD

SEQ ID NO: 2937 - protein, 25 aa, synthetic construct
  source 1..25: note = Seed: LNVIVHSATGFKQSSKALQRPVASD
LNVIVHSATGFKQRSAALVRPVASD

SEQ ID NO: 2938 - protein, 25 aa, synthetic construct
  source 1..25: note = Seed: LNVIVHSATGFKQSSKALQRPVASD
LNVIVHSATGFKQRSFALFRPVASD

SEQ ID NO: 2939 - protein, 25 aa, synthetic construct
  source 1..25: note = Seed: LNVIVHSATGFKQSSKALQRPVASD
LNVIVHSATGFKQRSRALRRPVASD

SEQ ID NO: 2940 - protein, 25 aa, synthetic construct
  source 1..25: note = Seed: LNVIVHSATGFKQSSKALQRPVASD
LNVIVHSATGFKQRSSALLRPVASD

SEQ ID NO: 2941 - protein, 25 aa, synthetic construct
  source 1..25: note = Seed: LNVIVHSATGFKQSSKALQRPVASD
LNVIVHSATGFKQRSVALARPVASD

SEQ ID NO: 2942 - protein, 25 aa, synthetic construct
  source 1..25: note = Seed: LNVIVHSATGFKQSSKALQRPVASD
LNVIVHSATGFKQSSAALARPVASD

SEQ ID NO: 2943 - protein, 25 aa, synthetic construct
  source 1..25: note = Seed: LNVIVHSATGFKQSSKALQRPVASD
LNVIVHSATGFKQSSAALCRPVASD

SEQ ID NO: 2944 - protein, 25 aa, synthetic construct
  source 1..25: note = Seed: LNVIVHSATGFKQSSKALQRPVASD
LNVIVHSATGFKQSSAALDRPVASD

SEQ ID NO: 2945 - protein, 25 aa, synthetic construct
  source 1..25: note = Seed: LNVIVHSATGFKQSSKALQRPVASD
LNVIVHSATGFKQSSAALERPVASD

SEQ ID NO: 2946 - protein, 25 aa, synthetic construct
  source 1..25: note = Seed: LNVIVHSATGFKQSSKALQRPVASD
LNVIVHSATGFKQSSAALFRPVASD

SEQ ID NO: 2947 - protein, 25 aa, synthetic construct
  source 1..25: note = Seed: LNVIVHSATGFKQSSKALQRPVASD
LNVIVHSATGFKQSSAALGRPVASD

SEQ ID NO: 2948 - protein, 25 aa, synthetic construct
  source 1..25: note = Seed: LNVIVHSATGFKQSSKALQRPVASD
LNVIVHSATGFKQSSAALHRPVASD

SEQ ID NO: 2949 - protein, 25 aa, synthetic construct
  source 1..25: note = Seed: LNVIVHSATGFKQSSKALQRPVASD
LNVIVHSATGFKQSSAALIRPVASD

SEQ ID NO: 2950 - protein, 25 aa, synthetic construct
  source 1..25: note = Seed: LNVIVHSATGFKQSSKALQRPVASD
LNVIVHSATGFKQSSAALLRPVASD

SEQ ID NO: 2951 - protein, 25 aa, synthetic construct
  source 1..25: note = Seed: LNVIVHSATGFKQSSKALQRPVASD
LNVIVHSATGFKQSSAALMRPVASD

SEQ ID NO: 2952 - protein, 25 aa, synthetic construct
  source 1..25: note = Seed: LNVIVHSATGFKQSSKALQRPVASD
LNVIVHSATGFKQSSAALNRPVASD

SEQ ID NO: 2953 - protein, 25 aa, synthetic construct
  source 1..25: note = Seed: LNVIVHSATGFKQSSKALQRPVASD
LNVIVHSATGFKQSSAALPRPVASD

SEQ ID NO: 2954 - protein, 25 aa, synthetic construct
  source 1..25: note = Seed: LNVIVHSATGFKQSSKALQRPVASD
LNVIVHSATGFKQSSAALQRPVASD

SEQ ID NO: 2955 - protein, 25 aa, synthetic construct
  source 1..25: note = Seed: LNVIVHSATGFKQSSKALQRPVASD
LNVIVHSATGFKQSSAALSRPVASD

SEQ ID NO: 2956 - protein, 25 aa, synthetic construct
  source 1..25: note = Seed: LNVIVHSATGFKQSSKALQRPVASD
LNVIVHSATGFKQSSAALTRPVASD

SEQ ID NO: 2957 - protein, 25 aa, synthetic construct
  source 1..25: note = Seed: LNVIVHSATGFKQSSKALQRPVASD
LNVIVHSATGFKQSSAALVRPVASD

SEQ ID NO: 2958 - protein, 25 aa, synthetic construct
  source 1..25: note = Seed: LNVIVHSATGFKQSSKALQRPVASD
LNVIVHSATGFKQSSAALWRPVASD

SEQ ID NO: 2959 - protein, 25 aa, synthetic construct
  source 1..25: note = Seed: LNVIVHSATGFKQSSKALQRPVASD
LNVIVHSATGFKQSSAALYRPVASD

SEQ ID NO: 2960 - protein, 25 aa, synthetic construct
  source 1..25: note = Seed: LNVIVHSATGFKQSSKALQRPVASD
LNVIVHSATGFKQSSFALARPVASD

SEQ ID NO: 2961 - protein, 25 aa, synthetic construct
  source 1..25: note = Seed: LNVIVHSATGFKQSSKALQRPVASD
LNVIVHSATGFKQSSFALDRPVASD

SEQ ID NO: 2962 - protein, 25 aa, synthetic construct
  source 1..25: note = Seed: LNVIVHSATGFKQSSKALQRPVASD
LNVIVHSATGFKQSSFALERPVASD

SEQ ID NO: 2963 - protein, 25 aa, synthetic construct
  source 1..25: note = Seed: LNVIVHSATGFKQSSKALQRPVASD
LNVIVHSATGFKQSSFALFRPVASD

SEQ ID NO: 2964 - protein, 25 aa, synthetic construct
  source 1..25: note = Seed: LNVIVHSATGFKQSSKALQRPVASD
LNVIVHSATGFKQSSFALIRPVASD

SEQ ID NO: 2965 - protein, 25 aa, synthetic construct
  source 1..25: note = Seed: LNVIVHSATGFKQSSKALQRPVASD
LNVIVHSATGFKQSSFALLRPVASD

SEQ ID NO: 2966 - protein, 25 aa, synthetic construct
  source 1..25: note = Seed: LNVIVHSATGFKQSSKALQRPVASD
LNVIVHSATGFKQSSFALMRPVASD

SEQ ID NO: 2967 - protein, 25 aa, synthetic construct
  source 1..25: note = Seed: LNVIVHSATGFKQSSKALQRPVASD
LNVIVHSATGFKQSSFALNRPVASD

SEQ ID NO: 2968 - protein, 25 aa, synthetic construct
  source 1..25: note = Seed: LNVIVHSATGFKQSSKALQRPVASD
LNVIVHSATGFKQSSFALSRPVASD

SEQ ID NO: 2969 - protein, 25 aa, synthetic construct
  source 1..25: note = Seed: LNVIVHSATGFKQSSKALQRPVASD
LNVIVHSATGFKQSSFALTRPVASD

SEQ ID NO: 2970 - protein, 25 aa, synthetic construct
  source 1..25: note = Seed: LNVIVHSATGFKQSSKALQRPVASD
LNVIVHSATGFKQSSFALVRPVASD

SEQ ID NO: 2971 - protein, 25 aa, synthetic construct
  source 1..25: note = Seed: LNVIVHSATGFKQSSKALQRPVASD
LNVIVHSATGFKQSSGALARPVASD

SEQ ID NO: 2972 - protein, 25 aa, synthetic construct
  source 1..25: note = Seed: LNVIVHSATGFKQSSKALQRPVASD
LNVIVHSATGFKQSSGALFRPVASD

SEQ ID NO: 2973 - protein, 25 aa, synthetic construct
  source 1..25: note = Seed: LNVIVHSATGFKQSSKALQRPVASD
LNVIVHSATGFKQSSGALGRPVASD

SEQ ID NO: 2974 - protein, 25 aa, synthetic construct
  source 1..25: note = Seed: LNVIVHSATGFKQSSKALQRPVASD
LNVIVHSATGFKQSSGALIRPVASD

SEQ ID NO: 2975 - protein, 25 aa, synthetic construct
  source 1..25: note = Seed: LNVIVHSATGFKQSSKALQRPVASD
LNVIVHSATGFKQSSGALLRPVASD

SEQ ID NO: 2976 - protein, 25 aa, synthetic construct
  source 1..25: note = Seed: LNVIVHSATGFKQSSKALQRPVASD
LNVIVHSATGFKQSSGALMRPVASD

SEQ ID NO: 2977 - protein, 25 aa, synthetic construct
  source 1..25: note = Seed: LNVIVHSATGFKQSSKALQRPVASD
LNVIVHSATGFKQSSGALNRPVASD

SEQ ID NO: 2978 - protein, 25 aa, synthetic construct
  source 1..25: note = Seed: LNVIVHSATGFKQSSKALQRPVASD
LNVIVHSATGFKQSSGALSRPVASD

SEQ ID NO: 2979 - protein, 25 aa, synthetic construct
  source 1..25: note = Seed: LNVIVHSATGFKQSSKALQRPVASD
LNVIVHSATGFKQSSGALTRPVASD

SEQ ID NO: 2980 - protein, 25 aa, synthetic construct
  source 1..25: note = Seed: LNVIVHSATGFKQSSKALQRPVASD
LNVIVHSATGFKQSSGALVRPVASD

SEQ ID NO: 2981 - protein, 25 aa, synthetic construct
  source 1..25: note = Seed: LNVIVHSATGFKQSSKALQRPVASD
LNVIVHSATGFKQSSGALYRPVASD

SEQ ID NO: 2982 - protein, 25 aa, synthetic construct
  source 1..25: note = Seed: LNVIVHSATGFKQSSKALQRPVASD
LNVIVHSATGFKQSSIALARPVASD

SEQ ID NO: 2983 - protein, 25 aa, synthetic construct
  source 1..25: note = Seed: LNVIVHSATGFKQSSKALQRPVASD
LNVIVHSATGFKQSSIALFRPVASD

SEQ ID NO: 2984 - protein, 25 aa, synthetic construct
  source 1..25: note = Seed: LNVIVHSATGFKQSSKALQRPVASD
LNVIVHSATGFKQSSIALGRPVASD

SEQ ID NO: 2985 - protein, 25 aa, synthetic construct
  source 1..25: note = Seed: LNVIVHSATGFKQSSKALQRPVASD
LNVIVHSATGFKQSSIALHRPVASD

SEQ ID NO: 2986 - protein, 25 aa, synthetic construct
  source 1..25: note = Seed: LNVIVHSATGFKQSSKALQRPVASD
LNVIVHSATGFKQSSIALIRPVASD

SEQ ID NO: 2987 - protein, 25 aa, synthetic construct
  source 1..25: note = Seed: LNVIVHSATGFKQSSKALQRPVASD
LNVIVHSATGFKQSSIALLRPVASD

SEQ ID NO: 2988 - protein, 25 aa, synthetic construct
  source 1..25: note = Seed: LNVIVHSATGFKQSSKALQRPVASD
LNVIVHSATGFKQSSIALNRPVASD

SEQ ID NO: 2989 - protein, 25 aa, synthetic construct
  source 1..25: note = Seed: LNVIVHSATGFKQSSKALQRPVASD
LNVIVHSATGFKQSSIALQRPVASD

SEQ ID NO: 2990 - protein, 25 aa, synthetic construct
  source 1..25: note = Seed: LNVIVHSATGFKQSSKALQRPVASD
LNVIVHSATGFKQSSIALSRPVASD

SEQ ID NO: 2991 - protein, 25 aa, synthetic construct
  source 1..25: note = Seed: LNVIVHSATGFKQSSKALQRPVASD
LNVIVHSATGFKQSSIALTRPVASD

SEQ ID NO: 2992 - protein, 25 aa, synthetic construct
  source 1..25: note = Seed: LNVIVHSATGFKQSSKALQRPVASD
LNVIVHSATGFKQSSIALVRPVASD

SEQ ID NO: 2993 - protein, 25 aa, synthetic construct
  source 1..25: note = Seed: LNVIVHSATGFKQSSKALQRPVASD
LNVIVHSATGFKQSSKALARPVASD

SEQ ID NO: 2994 - protein, 25 aa, synthetic construct
  source 1..25: note = Seed: LNVIVHSATGFKQSSKALQRPVASD
LNVIVHSATGFKQSSKALGRPVASD

SEQ ID NO: 2995 - protein, 25 aa, synthetic construct
  source 1..25: note = Seed: LNVIVHSATGFKQSSKALQRPVASD
LNVIVHSATGFKQSSKALHRPVASD

SEQ ID NO: 2996 - protein, 25 aa, synthetic construct
  source 1..25: note = Seed: LNVIVHSATGFKQSSKALQRPVASD
LNVIVHSATGFKQSSKALSRPVASD

SEQ ID NO: 2997 - protein, 25 aa, synthetic construct
  source 1..25: note = Seed: LNVIVHSATGFKQSSKALQRPVASD
LNVIVHSATGFKQSSKALTRPVASD

SEQ ID NO: 2998 - protein, 25 aa, synthetic construct
  source 1..25: note = Seed: LNVIVHSATGFKQSSKALQRPVASD
LNVIVHSATGFKQSSLALARPVASD

SEQ ID NO: 2999 - protein, 25 aa, synthetic construct
  source 1..25: note = Seed: LNVIVHSATGFKQSSKALQRPVASD
LNVIVHSATGFKQSSLALNRPVASD

SEQ ID NO: 3000 - protein, 25 aa, synthetic construct
  source 1..25: note = Seed: LNVIVHSATGFKQSSKALQRPVASD
LNVIVHSATGFKQSSLALSRPVASD

SEQ ID NO: 3001 - protein, 25 aa, synthetic construct
  source 1..25: note = Seed: LNVIVHSATGFKQSSKALQRPVASD
LNVIVHSATGFKQSSLALVRPVASD

SEQ ID NO: 3002 - protein, 25 aa, synthetic construct
  source 1..25: note = Seed: LNVIVHSATGFKQSSKALQRPVASD
LNVIVHSATGFKQSSMALARPVASD

SEQ ID NO: 3003 - protein, 25 aa, synthetic construct
  source 1..25: note = Seed: LNVIVHSATGFKQSSKALQRPVASD
LNVIVHSATGFKQSSMALIRPVASD

SEQ ID NO: 3004 - protein, 25 aa, synthetic construct
  source 1..25: note = Seed: LNVIVHSATGFKQSSKALQRPVASD
LNVIVHSATGFKQSSMALLRPVASD

SEQ ID NO: 3005 - protein, 25 aa, synthetic construct
  source 1..25: note = Seed: LNVIVHSATGFKQSSKALQRPVASD
LNVIVHSATGFKQSSMALMRPVASD

SEQ ID NO: 3006 - protein, 25 aa, synthetic construct
  source 1..25: note = Seed: LNVIVHSATGFKQSSKALQRPVASD
LNVIVHSATGFKQSSMALNRPVASD

SEQ ID NO: 3007 - protein, 25 aa, synthetic construct
  source 1..25: note = Seed: LNVIVHSATGFKQSSKALQRPVASD
LNVIVHSATGFKQSSMALSRPVASD

SEQ ID NO: 3008 - protein, 25 aa, synthetic construct
  source 1..25: note = Seed: LNVIVHSATGFKQSSKALQRPVASD
LNVIVHSATGFKQSSMALVRPVASD

SEQ ID NO: 3009 - protein, 25 aa, synthetic construct
  source 1..25: note = Seed: LNVIVHSATGFKQSSKALQRPVASD
LNVIVHSATGFKQSSNALARPVASD

SEQ ID NO: 3010 - protein, 25 aa, synthetic construct
  source 1..25: note = Seed: LNVIVHSATGFKQSSKALQRPVASD
LNVIVHSATGFKQSSNALFRPVASD

SEQ ID NO: 3011 - protein, 25 aa, synthetic construct
  source 1..25: note = Seed: LNVIVHSATGFKQSSKALQRPVASD
LNVIVHSATGFKQSSNALIRPVASD

SEQ ID NO: 3012 - protein, 25 aa, synthetic construct
  source 1..25: note = Seed: LNVIVHSATGFKQSSKALQRPVASD
LNVIVHSATGFKQSSNALLRPVASD

SEQ ID NO: 3013 - protein, 25 aa, synthetic construct
  source 1..25: note = Seed: LNVIVHSATGFKQSSKALQRPVASD
LNVIVHSATGFKQSSNALMRPVASD

SEQ ID NO: 3014 - protein, 25 aa, synthetic construct
  source 1..25: note = Seed: LNVIVHSATGFKQSSKALQRPVASD
LNVIVHSATGFKQSSNALNRPVASD

SEQ ID NO: 3015 - protein, 25 aa, synthetic construct
  source 1..25: note = Seed: LNVIVHSATGFKQSSKALQRPVASD
LNVIVHSATGFKQSSNALSRPVASD

SEQ ID NO: 3016 - protein, 25 aa, synthetic construct
  source 1..25: note = Seed: LNVIVHSATGFKQSSKALQRPVASD
LNVIVHSATGFKQSSNALVRPVASD

SEQ ID NO: 3017 - protein, 25 aa, synthetic construct
  source 1..25: note = Seed: LNVIVHSATGFKQSSKALQRPVASD
LNVIVHSATGFKQSSPALARPVASD

SEQ ID NO: 3018 - protein, 25 aa, synthetic construct
  source 1..25: note = Seed: LNVIVHSATGFKQSSKALQRPVASD
LNVIVHSATGFKQSSPALFRPVASD

SEQ ID NO: 3019 - protein, 25 aa, synthetic construct
  source 1..25: note = Seed: LNVIVHSATGFKQSSKALQRPVASD
LNVIVHSATGFKQSSPALGRPVASD

SEQ ID NO: 3020 - protein, 25 aa, synthetic construct
  source 1..25: note = Seed: LNVIVHSATGFKQSSKALQRPVASD
LNVIVHSATGFKQSSPALHRPVASD

SEQ ID NO: 3021 - protein, 25 aa, synthetic construct
  source 1..25: note = Seed: LNVIVHSATGFKQSSKALQRPVASD
LNVIVHSATGFKQSSPALIRPVASD

SEQ ID NO: 3022 - protein, 25 aa, synthetic construct
  source 1..25: note = Seed: LNVIVHSATGFKQSSKALQRPVASD
LNVIVHSATGFKQSSPALLRPVASD

SEQ ID NO: 3023 - protein, 25 aa, synthetic construct
  source 1..25: note = Seed: LNVIVHSATGFKQSSKALQRPVASD
LNVIVHSATGFKQSSPALMRPVASD

SEQ ID NO: 3024 - protein, 25 aa, synthetic construct
  source 1..25: note = Seed: LNVIVHSATGFKQSSKALQRPVASD
LNVIVHSATGFKQSSPALNRPVASD

SEQ ID NO: 3025 - protein, 25 aa, synthetic construct
  source 1..25: note = Seed: LNVIVHSATGFKQSSKALQRPVASD
LNVIVHSATGFKQSSPALQRPVASD

SEQ ID NO: 3026 - protein, 25 aa, synthetic construct
  source 1..25: note = Seed: LNVIVHSATGFKQSSKALQRPVASD
LNVIVHSATGFKQSSPALSRPVASD

SEQ ID NO: 3027 - protein, 25 aa, synthetic construct
  source 1..25: note = Seed: LNVIVHSATGFKQSSKALQRPVASD
LNVIVHSATGFKQSSPALTRPVASD

SEQ ID NO: 3028 - protein, 25 aa, synthetic construct
  source 1..25: note = Seed: LNVIVHSATGFKQSSKALQRPVASD
LNVIVHSATGFKQSSPALVRPVASD

SEQ ID NO: 3029 - protein, 25 aa, synthetic construct
  source 1..25: note = Seed: LNVIVHSATGFKQSSKALQRPVASD
LNVIVHSATGFKQSSPALYRPVASD

SEQ ID NO: 3030 - protein, 25 aa, synthetic construct
  source 1..25: note = Seed: LNVIVHSATGFKQSSKALQRPVASD
LNVIVHSATGFKQSSQALIRPVASD

SEQ ID NO: 3031 - protein, 25 aa, synthetic construct
  source 1..25: note = Seed: LNVIVHSATGFKQSSKALQRPVASD
LNVIVHSATGFKQSSQALLRPVASD

SEQ ID NO: 3032 - protein, 25 aa, synthetic construct
  source 1..25: note = Seed: LNVIVHSATGFKQSSKALQRPVASD
LNVIVHSATGFKQSSQALVRPVASD

SEQ ID NO: 3033 - protein, 25 aa, synthetic construct
  source 1..25: note = Seed: LNVIVHSATGFKQSSKALQRPVASD
LNVIVHSATGFKQSSRALARPVASD

SEQ ID NO: 3034 - protein, 25 aa, synthetic construct
  source 1..25: note = Seed: LNVIVHSATGFKQSSKALQRPVASD
LNVIVHSATGFKQSSRALGRPVASD

SEQ ID NO: 3035 - protein, 25 aa, synthetic construct
  source 1..25: note = Seed: LNVIVHSATGFKQSSKALQRPVASD
LNVIVHSATGFKQSSRALHRPVASD

SEQ ID NO: 3036 - protein, 25 aa, synthetic construct
  source 1..25: note = Seed: LNVIVHSATGFKQSSKALQRPVASD
LNVIVHSATGFKQSSRALMRPVASD

SEQ ID NO: 3037 - protein, 25 aa, synthetic construct
  source 1..25: note = Seed: LNVIVHSATGFKQSSKALQRPVASD
LNVIVHSATGFKQSSRALNRPVASD

SEQ ID NO: 3038 - protein, 25 aa, synthetic construct
  source 1..25: note = Seed: LNVIVHSATGFKQSSKALQRPVASD
LNVIVHSATGFKQSSRALQRPVASD

SEQ ID NO: 3039 - protein, 25 aa, synthetic construct
  source 1..25: note = Seed: LNVIVHSATGFKQSSKALQRPVASD
LNVIVHSATGFKQSSRALRRPVASD

SEQ ID NO: 3040 - protein, 25 aa, synthetic construct
  source 1..25: note = Seed: LNVIVHSATGFKQSSKALQRPVASD
LNVIVHSATGFKQSSRALSRPVASD

SEQ ID NO: 3041 - protein, 25 aa, synthetic construct
  source 1..25: note = Seed: LNVIVHSATGFKQSSKALQRPVASD
LNVIVHSATGFKQSSRALTRPVASD

SEQ ID NO: 3042 - protein, 25 aa, synthetic construct
  source 1..25: note = Seed: LNVIVHSATGFKQSSKALQRPVASD
LNVIVHSATGFKQSSSALARPVASD

SEQ ID NO: 3043 - protein, 25 aa, synthetic construct
  source 1..25: note = Seed: LNVIVHSATGFKQSSKALQRPVASD
LNVIVHSATGFKQSSSALFRPVASD

SEQ ID NO: 3044 - protein, 25 aa, synthetic construct
  source 1..25: note = Seed: LNVIVHSATGFKQSSKALQRPVASD
LNVIVHSATGFKQSSSALGRPVASD

SEQ ID NO: 3045 - protein, 25 aa, synthetic construct
  source 1..25: note = Seed: LNVIVHSATGFKQSSKALQRPVASD
LNVIVHSATGFKQSSSALIRPVASD

SEQ ID NO: 3046 - protein, 25 aa, synthetic construct
  source 1..25: note = Seed: LNVIVHSATGFKQSSKALQRPVASD
LNVIVHSATGFKQSSSALLRPVASD

SEQ ID NO: 3047 - protein, 25 aa, synthetic construct
  source 1..25: note = Seed: LNVIVHSATGFKQSSKALQRPVASD
LNVIVHSATGFKQSSSALMRPVASD

SEQ ID NO: 3048 - protein, 25 aa, synthetic construct
  source 1..25: note = Seed: LNVIVHSATGFKQSSKALQRPVASD
LNVIVHSATGFKQSSSALNRPVASD

SEQ ID NO: 3049 - protein, 25 aa, synthetic construct
  source 1..25: note = Seed: LNVIVHSATGFKQSSKALQRPVASD
LNVIVHSATGFKQSSSALQRPVASD

SEQ ID NO: 3050 - protein, 25 aa, synthetic construct
  source 1..25: note = Seed: LNVIVHSATGFKQSSKALQRPVASD
LNVIVHSATGFKQSSSALSRPVASD

SEQ ID NO: 3051 - protein, 25 aa, synthetic construct
  source 1..25: note = Seed: LNVIVHSATGFKQSSKALQRPVASD
LNVIVHSATGFKQSSSALTRPVASD

SEQ ID NO: 3052 - protein, 25 aa, synthetic construct
  source 1..25: note = Seed: LNVIVHSATGFKQSSKALQRPVASD
LNVIVHSATGFKQSSSALVRPVASD

SEQ ID NO: 3053 - protein, 25 aa, synthetic construct
  source 1..25: note = Seed: LNVIVHSATGFKQSSKALQRPVASD
LNVIVHSATGFKQSSSALWRPVASD

SEQ ID NO: 3054 - protein, 25 aa, synthetic construct
  source 1..25: note = Seed: LNVIVHSATGFKQSSKALQRPVASD
LNVIVHSATGFKQSSSALYRPVASD

SEQ ID NO: 3055 - protein, 25 aa, synthetic construct
  source 1..25: note = Seed: LNVIVHSATGFKQSSKALQRPVASD
LNVIVHSATGFKQSSTALARPVASD

SEQ ID NO: 3056 - protein, 25 aa, synthetic construct
  source 1..25: note = Seed: LNVIVHSATGFKQSSKALQRPVASD
LNVIVHSATGFKQSSTALFRPVASD

SEQ ID NO: 3057 - protein, 25 aa, synthetic construct
  source 1..25: note = Seed: LNVIVHSATGFKQSSKALQRPVASD
LNVIVHSATGFKQSSTALGRPVASD

SEQ ID NO: 3058 - protein, 25 aa, synthetic construct
  source 1..25: note = Seed: LNVIVHSATGFKQSSKALQRPVASD
LNVIVHSATGFKQSSTALHRPVASD

SEQ ID NO: 3059 - protein, 25 aa, synthetic construct
  source 1..25: note = Seed: LNVIVHSATGFKQSSKALQRPVASD
LNVIVHSATGFKQSSTALIRPVASD

SEQ ID NO: 3060 - protein, 25 aa, synthetic construct
  source 1..25: note = Seed: LNVIVHSATGFKQSSKALQRPVASD
LNVIVHSATGFKQSSTALLRPVASD

SEQ ID NO: 3061 - protein, 25 aa, synthetic construct
  source 1..25: note = Seed: LNVIVHSATGFKQSSKALQRPVASD
LNVIVHSATGFKQSSTALMRPVASD

SEQ ID NO: 3062 - protein, 25 aa, synthetic construct
  source 1..25: note = Seed: LNVIVHSATGFKQSSKALQRPVASD
LNVIVHSATGFKQSSTALNRPVASD

SEQ ID NO: 3063 - protein, 25 aa, synthetic construct
  source 1..25: note = Seed: LNVIVHSATGFKQSSKALQRPVASD
LNVIVHSATGFKQSSTALQRPVASD

SEQ ID NO: 3064 - protein, 25 aa, synthetic construct
  source 1..25: note = Seed: LNVIVHSATGFKQSSKALQRPVASD
LNVIVHSATGFKQSSTALSRPVASD

SEQ ID NO: 3065 - protein, 25 aa, synthetic construct
  source 1..25: note = Seed: LNVIVHSATGFKQSSKALQRPVASD
LNVIVHSATGFKQSSTALTRPVASD

SEQ ID NO: 3066 - protein, 25 aa, synthetic construct
  source 1..25: note = Seed: LNVIVHSATGFKQSSKALQRPVASD
LNVIVHSATGFKQSSTALVRPVASD

SEQ ID NO: 3067 - protein, 25 aa, synthetic construct
  source 1..25: note = Seed: LNVIVHSATGFKQSSKALQRPVASD
LNVIVHSATGFKQSSTALYRPVASD

SEQ ID NO: 3068 - protein, 25 aa, synthetic construct
  source 1..25: note = Seed: LNVIVHSATGFKQSSKALQRPVASD
LNVIVHSATGFKQSSVALARPVASD

SEQ ID NO: 3069 - protein, 25 aa, synthetic construct
  source 1..25: note = Seed: LNVIVHSATGFKQSSKALQRPVASD
LNVIVHSATGFKQSSVALFRPVASD

SEQ ID NO: 3070 - protein, 25 aa, synthetic construct
  source 1..25: note = Seed: LNVIVHSATGFKQSSKALQRPVASD
LNVIVHSATGFKQSSVALGRPVASD

SEQ ID NO: 3071 - protein, 25 aa, synthetic construct
  source 1..25: note = Seed: LNVIVHSATGFKQSSKALQRPVASD
LNVIVHSATGFKQSSVALHRPVASD

SEQ ID NO: 3072 - protein, 25 aa, synthetic construct
  source 1..25: note = Seed: LNVIVHSATGFKQSSKALQRPVASD
LNVIVHSATGFKQSSVALIRPVASD

SEQ ID NO: 3073 - protein, 25 aa, synthetic construct
  source 1..25: note = Seed: LNVIVHSATGFKQSSKALQRPVASD
LNVIVHSATGFKQSSVALLRPVASD

SEQ ID NO: 3074 - protein, 25 aa, synthetic construct
  source 1..25: note = Seed: LNVIVHSATGFKQSSKALQRPVASD
LNVIVHSATGFKQSSVALMRPVASD

SEQ ID NO: 3075 - protein, 25 aa, synthetic construct
  source 1..25: note = Seed: LNVIVHSATGFKQSSKALQRPVASD
LNVIVHSATGFKQSSVALNRPVASD

SEQ ID NO: 3076 - protein, 25 aa, synthetic construct
  source 1..25: note = Seed: LNVIVHSATGFKQSSKALQRPVASD
LNVIVHSATGFKQSSVALQRPVASD

SEQ ID NO: 3077 - protein, 25 aa, synthetic construct
  source 1..25: note = Seed: LNVIVHSATGFKQSSKALQRPVASD
LNVIVHSATGFKQSSVALSRPVASD

SEQ ID NO: 3078 - protein, 25 aa, synthetic construct
  source 1..25: note = Seed: LNVIVHSATGFKQSSKALQRPVASD
LNVIVHSATGFKQSSVALTRPVASD

SEQ ID NO: 3079 - protein, 25 aa, synthetic construct
  source 1..25: note = Seed: LNVIVHSATGFKQSSKALQRPVASD
LNVIVHSATGFKQSSVALVRPVASD

SEQ ID NO: 3080 - protein, 25 aa, synthetic construct
  source 1..25: note = Seed: LNVIVHSATGFKQSSKALQRPVASD
LNVIVHSATGFKQSSYALIRPVASD

SEQ ID NO: 3081 - protein, 25 aa, synthetic construct
  source 1..25: note = Seed: LNVIVHSATGFKQSSKALQRPVASD
LNVIVHSATGFKQSSYALLRPVASD

SEQ ID NO: 3082 - protein, 25 aa, synthetic construct
  source 1..25: note = Seed: LNVIVHSATGFKQSSKALQRPVASD
LNVIVHSATGFKQTSAALARPVASD

SEQ ID NO: 3083 - protein, 25 aa, synthetic construct
  source 1..25: note = Seed: LNVIVHSATGFKQSSKALQRPVASD
LNVIVHSATGFKQTSAALFRPVASD

SEQ ID NO: 3084 - protein, 25 aa, synthetic construct
  source 1..25: note = Seed: LNVIVHSATGFKQSSKALQRPVASD
LNVIVHSATGFKQTSAALGRPVASD

SEQ ID NO: 3085 - protein, 25 aa, synthetic construct
  source 1..25: note = Seed: LNVIVHSATGFKQSSKALQRPVASD
LNVIVHSATGFKQTSAALHRPVASD

SEQ ID NO: 3086 - protein, 25 aa, synthetic construct
  source 1..25: note = Seed: LNVIVHSATGFKQSSKALQRPVASD
LNVIVHSATGFKQTSAALIRPVASD

SEQ ID NO: 3087 - protein, 25 aa, synthetic construct
  source 1..25: note = Seed: LNVIVHSATGFKQSSKALQRPVASD
LNVIVHSATGFKQTSAALLRPVASD

SEQ ID NO: 3088 - protein, 25 aa, synthetic construct
  source 1..25: note = Seed: LNVIVHSATGFKQSSKALQRPVASD
LNVIVHSATGFKQTSAALMRPVASD

SEQ ID NO: 3089 - protein, 25 aa, synthetic construct
  source 1..25: note = Seed: LNVIVHSATGFKQSSKALQRPVASD
LNVIVHSATGFKQTSAALNRPVASD

SEQ ID NO: 3090 - protein, 25 aa, synthetic construct
  source 1..25: note = Seed: LNVIVHSATGFKQSSKALQRPVASD
LNVIVHSATGFKQTSAALPRPVASD

SEQ ID NO: 3091 - protein, 25 aa, synthetic construct
  source 1..25: note = Seed: LNVIVHSATGFKQSSKALQRPVASD
LNVIVHSATGFKQTSAALQRPVASD

SEQ ID NO: 3092 - protein, 25 aa, synthetic construct
  source 1..25: note = Seed: LNVIVHSATGFKQSSKALQRPVASD
LNVIVHSATGFKQTSAALSRPVASD

SEQ ID NO: 3093 - protein, 25 aa, synthetic construct
  source 1..25: note = Seed: LNVIVHSATGFKQSSKALQRPVASD
LNVIVHSATGFKQTSAALTRPVASD

SEQ ID NO: 3094 - protein, 25 aa, synthetic construct
  source 1..25: note = Seed: LNVIVHSATGFKQSSKALQRPVASD
LNVIVHSATGFKQTSAALVRPVASD

SEQ ID NO: 3095 - protein, 25 aa, synthetic construct
  source 1..25: note = Seed: LNVIVHSATGFKQSSKALQRPVASD
LNVIVHSATGFKQTSAALYRPVASD

SEQ ID NO: 3096 - protein, 25 aa, synthetic construct
  source 1..25: note = Seed: LNVIVHSATGFKQSSKALQRPVASD
LNVIVHSATGFKQTSFALARPVASD

SEQ ID NO: 3097 - protein, 25 aa, synthetic construct
  source 1..25: note = Seed: LNVIVHSATGFKQSSKALQRPVASD
LNVIVHSATGFKQTSFALDRPVASD

SEQ ID NO: 3098 - protein, 25 aa, synthetic construct
  source 1..25: note = Seed: LNVIVHSATGFKQSSKALQRPVASD
LNVIVHSATGFKQTSFALERPVASD

SEQ ID NO: 3099 - protein, 25 aa, synthetic construct
  source 1..25: note = Seed: LNVIVHSATGFKQSSKALQRPVASD
LNVIVHSATGFKQTSFALFRPVASD

SEQ ID NO: 3100 - protein, 25 aa, synthetic construct
  source 1..25: note = Seed: LNVIVHSATGFKQSSKALQRPVASD
LNVIVHSATGFKQTSFALIRPVASD

SEQ ID NO: 3101 - protein, 25 aa, synthetic construct
  source 1..25: note = Seed: LNVIVHSATGFKQSSKALQRPVASD
LNVIVHSATGFKQTSFALLRPVASD

SEQ ID NO: 3102 - protein, 25 aa, synthetic construct
  source 1..25: note = Seed: LNVIVHSATGFKQSSKALQRPVASD
LNVIVHSATGFKQTSFALMRPVASD

SEQ ID NO: 3103 - protein, 25 aa, synthetic construct
  source 1..25: note = Seed: LNVIVHSATGFKQSSKALQRPVASD
LNVIVHSATGFKQTSFALNRPVASD

SEQ ID NO: 3104 - protein, 25 aa, synthetic construct
  source 1..25: note = Seed: LNVIVHSATGFKQSSKALQRPVASD
LNVIVHSATGFKQTSFALSRPVASD

SEQ ID NO: 3105 - protein, 25 aa, synthetic construct
  source 1..25: note = Seed: LNVIVHSATGFKQSSKALQRPVASD
LNVIVHSATGFKQTSFALTRPVASD

SEQ ID NO: 3106 - protein, 25 aa, synthetic construct
  source 1..25: note = Seed: LNVIVHSATGFKQSSKALQRPVASD
LNVIVHSATGFKQTSFALVRPVASD

SEQ ID NO: 3107 - protein, 25 aa, synthetic construct
  source 1..25: note = Seed: LNVIVHSATGFKQSSKALQRPVASD
LNVIVHSATGFKQTSFALYRPVASD

SEQ ID NO: 3108 - protein, 25 aa, synthetic construct
  source 1..25: note = Seed: LNVIVHSATGFKQSSKALQRPVASD
LNVIVHSATGFKQTSGALARPVASD

SEQ ID NO: 3109 - protein, 25 aa, synthetic construct
  source 1..25: note = Seed: LNVIVHSATGFKQSSKALQRPVASD
LNVIVHSATGFKQTSGALFRPVASD

SEQ ID NO: 3110 - protein, 25 aa, synthetic construct
  source 1..25: note = Seed: LNVIVHSATGFKQSSKALQRPVASD
LNVIVHSATGFKQTSGALGRPVASD

SEQ ID NO: 3111 - protein, 25 aa, synthetic construct
  source 1..25: note = Seed: LNVIVHSATGFKQSSKALQRPVASD
LNVIVHSATGFKQTSGALIRPVASD

SEQ ID NO: 3112 - protein, 25 aa, synthetic construct
  source 1..25: note = Seed: LNVIVHSATGFKQSSKALQRPVASD
LNVIVHSATGFKQTSGALLRPVASD

SEQ ID NO: 3113 - protein, 25 aa, synthetic construct
  source 1..25: note = Seed: LNVIVHSATGFKQSSKALQRPVASD
LNVIVHSATGFKQTSGALMRPVASD

SEQ ID NO: 3114 - protein, 25 aa, synthetic construct
  source 1..25: note = Seed: LNVIVHSATGFKQSSKALQRPVASD
LNVIVHSATGFKQTSGALNRPVASD

SEQ ID NO: 3115 - protein, 25 aa, synthetic construct
  source 1..25: note = Seed: LNVIVHSATGFKQSSKALQRPVASD
LNVIVHSATGFKQTSGALSRPVASD

SEQ ID NO: 3116 - protein, 25 aa, synthetic construct
  source 1..25: note = Seed: LNVIVHSATGFKQSSKALQRPVASD
LNVIVHSATGFKQTSGALTRPVASD

SEQ ID NO: 3117 - protein, 25 aa, synthetic construct
  source 1..25: note = Seed: LNVIVHSATGFKQSSKALQRPVASD
LNVIVHSATGFKQTSGALVRPVASD

SEQ ID NO: 3118 - protein, 25 aa, synthetic construct
  source 1..25: note = Seed: LNVIVHSATGFKQSSKALQRPVASD
LNVIVHSATGFKQTSGALYRPVASD

SEQ ID NO: 3119 - protein, 25 aa, synthetic construct
  source 1..25: note = Seed: LNVIVHSATGFKQSSKALQRPVASD
LNVIVHSATGFKQTSIALARPVASD

SEQ ID NO: 3120 - protein, 25 aa, synthetic construct
  source 1..25: note = Seed: LNVIVHSATGFKQSSKALQRPVASD
LNVIVHSATGFKQTSIALFRPVASD

SEQ ID NO: 3121 - protein, 25 aa, synthetic construct
  source 1..25: note = Seed: LNVIVHSATGFKQSSKALQRPVASD
LNVIVHSATGFKQTSIALGRPVASD

SEQ ID NO: 3122 - protein, 25 aa, synthetic construct
  source 1..25: note = Seed: LNVIVHSATGFKQSSKALQRPVASD
LNVIVHSATGFKQTSIALHRPVASD

SEQ ID NO: 3123 - protein, 25 aa, synthetic construct
  source 1..25: note = Seed: LNVIVHSATGFKQSSKALQRPVASD
LNVIVHSATGFKQTSIALIRPVASD

SEQ ID NO: 3124 - protein, 25 aa, synthetic construct
  source 1..25: note = Seed: LNVIVHSATGFKQSSKALQRPVASD
LNVIVHSATGFKQTSIALLRPVASD

SEQ ID NO: 3125 - protein, 25 aa, synthetic construct
  source 1..25: note = Seed: LNVIVHSATGFKQSSKALQRPVASD
LNVIVHSATGFKQTSIALMRPVASD

SEQ ID NO: 3126 - protein, 25 aa, synthetic construct
  source 1..25: note = Seed: LNVIVHSATGFKQSSKALQRPVASD
LNVIVHSATGFKQTSIALNRPVASD

SEQ ID NO: 3127 - protein, 25 aa, synthetic construct
  source 1..25: note = Seed: LNVIVHSATGFKQSSKALQRPVASD
LNVIVHSATGFKQTSIALQRPVASD

SEQ ID NO: 3128 - protein, 25 aa, synthetic construct
  source 1..25: note = Seed: LNVIVHSATGFKQSSKALQRPVASD
LNVIVHSATGFKQTSIALSRPVASD

SEQ ID NO: 3129 - protein, 25 aa, synthetic construct
  source 1..25: note = Seed: LNVIVHSATGFKQSSKALQRPVASD
LNVIVHSATGFKQTSIALTRPVASD

SEQ ID NO: 3130 - protein, 25 aa, synthetic construct
  source 1..25: note = Seed: LNVIVHSATGFKQSSKALQRPVASD
LNVIVHSATGFKQTSIALVRPVASD

SEQ ID NO: 3131 - protein, 25 aa, synthetic construct
  source 1..25: note = Seed: LNVIVHSATGFKQSSKALQRPVASD
LNVIVHSATGFKQTSKALARPVASD

SEQ ID NO: 3132 - protein, 25 aa, synthetic construct
  source 1..25: note = Seed: LNVIVHSATGFKQSSKALQRPVASD
LNVIVHSATGFKQTSKALGRPVASD

SEQ ID NO: 3133 - protein, 25 aa, synthetic construct
  source 1..25: note = Seed: LNVIVHSATGFKQSSKALQRPVASD
LNVIVHSATGFKQTSKALHRPVASD

SEQ ID NO: 3134 - protein, 25 aa, synthetic construct
  source 1..25: note = Seed: LNVIVHSATGFKQSSKALQRPVASD
LNVIVHSATGFKQTSKALQRPVASD

SEQ ID NO: 3135 - protein, 25 aa, synthetic construct
  source 1..25: note = Seed: LNVIVHSATGFKQSSKALQRPVASD
LNVIVHSATGFKQTSKALSRPVASD

SEQ ID NO: 3136 - protein, 25 aa, synthetic construct
  source 1..25: note = Seed: LNVIVHSATGFKQSSKALQRPVASD
LNVIVHSATGFKQTSKALTRPVASD

SEQ ID NO: 3137 - protein, 25 aa, synthetic construct
  source 1..25: note = Seed: LNVIVHSATGFKQSSKALQRPVASD
LNVIVHSATGFKQTSLALARPVASD

SEQ ID NO: 3138 - protein, 25 aa, synthetic construct
  source 1..25: note = Seed: LNVIVHSATGFKQSSKALQRPVASD
LNVIVHSATGFKQTSLALIRPVASD

SEQ ID NO: 3139 - protein, 25 aa, synthetic construct
  source 1..25: note = Seed: LNVIVHSATGFKQSSKALQRPVASD
LNVIVHSATGFKQTSLALNRPVASD

SEQ ID NO: 3140 - protein, 25 aa, synthetic construct
  source 1..25: note = Seed: LNVIVHSATGFKQSSKALQRPVASD
LNVIVHSATGFKQTSLALSRPVASD

SEQ ID NO: 3141 - protein, 25 aa, synthetic construct
  source 1..25: note = Seed: LNVIVHSATGFKQSSKALQRPVASD
LNVIVHSATGFKQTSLALVRPVASD

SEQ ID NO: 3142 - protein, 25 aa, synthetic construct
  source 1..25: note = Seed: LNVIVHSATGFKQSSKALQRPVASD
LNVIVHSATGFKQTSMALARPVASD

SEQ ID NO: 3143 - protein, 25 aa, synthetic construct
  source 1..25: note = Seed: LNVIVHSATGFKQSSKALQRPVASD
LNVIVHSATGFKQTSMALIRPVASD

SEQ ID NO: 3144 - protein, 25 aa, synthetic construct
  source 1..25: note = Seed: LNVIVHSATGFKQSSKALQRPVASD
LNVIVHSATGFKQTSMALLRPVASD

SEQ ID NO: 3145 - protein, 25 aa, synthetic construct
  source 1..25: note = Seed: LNVIVHSATGFKQSSKALQRPVASD
LNVIVHSATGFKQTSMALNRPVASD

SEQ ID NO: 3146 - protein, 25 aa, synthetic construct
  source 1..25: note = Seed: LNVIVHSATGFKQSSKALQRPVASD
LNVIVHSATGFKQTSMALSRPVASD

SEQ ID NO: 3147 - protein, 25 aa, synthetic construct
  source 1..25: note = Seed: LNVIVHSATGFKQSSKALQRPVASD
LNVIVHSATGFKQTSMALVRPVASD

SEQ ID NO: 3148 - protein, 25 aa, synthetic construct
  source 1..25: note = Seed: LNVIVHSATGFKQSSKALQRPVASD
LNVIVHSATGFKQTSNALARPVASD

SEQ ID NO: 3149 - protein, 25 aa, synthetic construct
  source 1..25: note = Seed: LNVIVHSATGFKQSSKALQRPVASD
LNVIVHSATGFKQTSNALFRPVASD

SEQ ID NO: 3150 - protein, 25 aa, synthetic construct
  source 1..25: note = Seed: LNVIVHSATGFKQSSKALQRPVASD
LNVIVHSATGFKQTSNALIRPVASD

SEQ ID NO: 3151 - protein, 25 aa, synthetic construct
  source 1..25: note = Seed: LNVIVHSATGFKQSSKALQRPVASD
LNVIVHSATGFKQTSNALLRPVASD

SEQ ID NO: 3152 - protein, 25 aa, synthetic construct
  source 1..25: note = Seed: LNVIVHSATGFKQSSKALQRPVASD
LNVIVHSATGFKQTSNALMRPVASD

SEQ ID NO: 3153 - protein, 25 aa, synthetic construct
  source 1..25: note = Seed: LNVIVHSATGFKQSSKALQRPVASD
LNVIVHSATGFKQTSNALNRPVASD

SEQ ID NO: 3154 - protein, 25 aa, synthetic construct
  source 1..25: note = Seed: LNVIVHSATGFKQSSKALQRPVASD
LNVIVHSATGFKQTSNALSRPVASD

SEQ ID NO: 3155 - protein, 25 aa, synthetic construct
  source 1..25: note = Seed: LNVIVHSATGFKQSSKALQRPVASD
LNVIVHSATGFKQTSNALVRPVASD

SEQ ID NO: 3156 - protein, 25 aa, synthetic construct
  source 1..25: note = Seed: LNVIVHSATGFKQSSKALQRPVASD
LNVIVHSATGFKQTSPALARPVASD

SEQ ID NO: 3157 - protein, 25 aa, synthetic construct
  source 1..25: note = Seed: LNVIVHSATGFKQSSKALQRPVASD
LNVIVHSATGFKQTSPALFRPVASD

SEQ ID NO: 3158 - protein, 25 aa, synthetic construct
  source 1..25: note = Seed: LNVIVHSATGFKQSSKALQRPVASD
LNVIVHSATGFKQTSPALGRPVASD

SEQ ID NO: 3159 - protein, 25 aa, synthetic construct
  source 1..25: note = Seed: LNVIVHSATGFKQSSKALQRPVASD
LNVIVHSATGFKQTSPALHRPVASD

SEQ ID NO: 3160 - protein, 25 aa, synthetic construct
  source 1..25: note = Seed: LNVIVHSATGFKQSSKALQRPVASD
LNVIVHSATGFKQTSPALIRPVASD

SEQ ID NO: 3161 - protein, 25 aa, synthetic construct
  source 1..25: note = Seed: LNVIVHSATGFKQSSKALQRPVASD
LNVIVHSATGFKQTSPALLRPVASD

SEQ ID NO: 3162 - protein, 25 aa, synthetic construct
  source 1..25: note = Seed: LNVIVHSATGFKQSSKALQRPVASD
LNVIVHSATGFKQTSPALMRPVASD

SEQ ID NO: 3163 - protein, 25 aa, synthetic construct
  source 1..25: note = Seed: LNVIVHSATGFKQSSKALQRPVASD
LNVIVHSATGFKQTSPALNRPVASD

SEQ ID NO: 3164 - protein, 25 aa, synthetic construct
  source 1..25: note = Seed: LNVIVHSATGFKQSSKALQRPVASD
LNVIVHSATGFKQTSPALQRPVASD

SEQ ID NO: 3165 - protein, 25 aa, synthetic construct
  source 1..25: note = Seed: LNVIVHSATGFKQSSKALQRPVASD
LNVIVHSATGFKQTSPALSRPVASD

SEQ ID NO: 3166 - protein, 25 aa, synthetic construct
  source 1..25: note = Seed: LNVIVHSATGFKQSSKALQRPVASD
LNVIVHSATGFKQTSPALTRPVASD

SEQ ID NO: 3167 - protein, 25 aa, synthetic construct
  source 1..25: note = Seed: LNVIVHSATGFKQSSKALQRPVASD
LNVIVHSATGFKQTSPALVRPVASD

SEQ ID NO: 3168 - protein, 25 aa, synthetic construct
  source 1..25: note = Seed: LNVIVHSATGFKQSSKALQRPVASD
LNVIVHSATGFKQTSPALYRPVASD

SEQ ID NO: 3169 - protein, 25 aa, synthetic construct
  source 1..25: note = Seed: LNVIVHSATGFKQSSKALQRPVASD
LNVIVHSATGFKQTSQALIRPVASD

SEQ ID NO: 3170 - protein, 25 aa, synthetic construct
  source 1..25: note = Seed: LNVIVHSATGFKQSSKALQRPVASD
LNVIVHSATGFKQTSQALLRPVASD

SEQ ID NO: 3171 - protein, 25 aa, synthetic construct
  source 1..25: note = Seed: LNVIVHSATGFKQSSKALQRPVASD
LNVIVHSATGFKQTSQALVRPVASD

SEQ ID NO: 3172 - protein, 25 aa, synthetic construct
  source 1..25: note = Seed: LNVIVHSATGFKQSSKALQRPVASD
LNVIVHSATGFKQTSRALARPVASD

SEQ ID NO: 3173 - protein, 25 aa, synthetic construct
  source 1..25: note = Seed: LNVIVHSATGFKQSSKALQRPVASD
LNVIVHSATGFKQTSRALGRPVASD

SEQ ID NO: 3174 - protein, 25 aa, synthetic construct
  source 1..25: note = Seed: LNVIVHSATGFKQSSKALQRPVASD
LNVIVHSATGFKQTSRALHRPVASD

SEQ ID NO: 3175 - protein, 25 aa, synthetic construct
  source 1..25: note = Seed: LNVIVHSATGFKQSSKALQRPVASD
LNVIVHSATGFKQTSRALMRPVASD

SEQ ID NO: 3176 - protein, 25 aa, synthetic construct
  source 1..25: note = Seed: LNVIVHSATGFKQSSKALQRPVASD
LNVIVHSATGFKQTSRALNRPVASD

SEQ ID NO: 3177 - protein, 25 aa, synthetic construct
  source 1..25: note = Seed: LNVIVHSATGFKQSSKALQRPVASD
LNVIVHSATGFKQTSRALQRPVASD

SEQ ID NO: 3178 - protein, 25 aa, synthetic construct
  source 1..25: note = Seed: LNVIVHSATGFKQSSKALQRPVASD
LNVIVHSATGFKQTSRALSRPVASD

SEQ ID NO: 3179 - protein, 25 aa, synthetic construct
  source 1..25: note = Seed: LNVIVHSATGFKQSSKALQRPVASD
LNVIVHSATGFKQTSRALTRPVASD

SEQ ID NO: 3180 - protein, 25 aa, synthetic construct
  source 1..25: note = Seed: LNVIVHSATGFKQSSKALQRPVASD
LNVIVHSATGFKQTSSALARPVASD

SEQ ID NO: 3181 - protein, 25 aa, synthetic construct
  source 1..25: note = Seed: LNVIVHSATGFKQSSKALQRPVASD
LNVIVHSATGFKQTSSALFRPVASD

SEQ ID NO: 3182 - protein, 25 aa, synthetic construct
  source 1..25: note = Seed: LNVIVHSATGFKQSSKALQRPVASD
LNVIVHSATGFKQTSSALGRPVASD

SEQ ID NO: 3183 - protein, 25 aa, synthetic construct
  source 1..25: note = Seed: LNVIVHSATGFKQSSKALQRPVASD
LNVIVHSATGFKQTSSALIRPVASD

SEQ ID NO: 3184 - protein, 25 aa, synthetic construct
  source 1..25: note = Seed: LNVIVHSATGFKQSSKALQRPVASD
LNVIVHSATGFKQTSSALLRPVASD

SEQ ID NO: 3185 - protein, 25 aa, synthetic construct
  source 1..25: note = Seed: LNVIVHSATGFKQSSKALQRPVASD
LNVIVHSATGFKQTSSALMRPVASD

SEQ ID NO: 3186 - protein, 25 aa, synthetic construct
  source 1..25: note = Seed: LNVIVHSATGFKQSSKALQRPVASD
LNVIVHSATGFKQTSSALNRPVASD

SEQ ID NO: 3187 - protein, 25 aa, synthetic construct
  source 1..25: note = Seed: LNVIVHSATGFKQSSKALQRPVASD
LNVIVHSATGFKQTSSALPRPVASD

SEQ ID NO: 3188 - protein, 25 aa, synthetic construct
  source 1..25: note = Seed: LNVIVHSATGFKQSSKALQRPVASD
LNVIVHSATGFKQTSSALSRPVASD

SEQ ID NO: 3189 - protein, 25 aa, synthetic construct
  source 1..25: note = Seed: LNVIVHSATGFKQSSKALQRPVASD
LNVIVHSATGFKQTSSALTRPVASD

SEQ ID NO: 3190 - protein, 25 aa, synthetic construct
  source 1..25: note = Seed: LNVIVHSATGFKQSSKALQRPVASD
LNVIVHSATGFKQTSSALVRPVASD

SEQ ID NO: 3191 - protein, 25 aa, synthetic construct
  source 1..25: note = Seed: LNVIVHSATGFKQSSKALQRPVASD
LNVIVHSATGFKQTSSALWRPVASD

SEQ ID NO: 3192 - protein, 25 aa, synthetic construct
  source 1..25: note = Seed: LNVIVHSATGFKQSSKALQRPVASD
LNVIVHSATGFKQTSSALYRPVASD

SEQ ID NO: 3193 - protein, 25 aa, synthetic construct
  source 1..25: note = Seed: LNVIVHSATGFKQSSKALQRPVASD
LNVIVHSATGFKQTSTALARPVASD

SEQ ID NO: 3194 - protein, 25 aa, synthetic construct
  source 1..25: note = Seed: LNVIVHSATGFKQSSKALQRPVASD
LNVIVHSATGFKQTSTALFRPVASD

SEQ ID NO: 3195 - protein, 25 aa, synthetic construct
  source 1..25: note = Seed: LNVIVHSATGFKQSSKALQRPVASD
LNVIVHSATGFKQTSTALGRPVASD

SEQ ID NO: 3196 - protein, 25 aa, synthetic construct
  source 1..25: note = Seed: LNVIVHSATGFKQSSKALQRPVASD
LNVIVHSATGFKQTSTALHRPVASD

SEQ ID NO: 3197 - protein, 25 aa, synthetic construct
  source 1..25: note = Seed: LNVIVHSATGFKQSSKALQRPVASD
LNVIVHSATGFKQTSTALIRPVASD

SEQ ID NO: 3198 - protein, 25 aa, synthetic construct
  source 1..25: note = Seed: LNVIVHSATGFKQSSKALQRPVASD
LNVIVHSATGFKQTSTALLRPVASD

SEQ ID NO: 3199 - protein, 25 aa, synthetic construct
  source 1..25: note = Seed: LNVIVHSATGFKQSSKALQRPVASD
LNVIVHSATGFKQTSTALMRPVASD

SEQ ID NO: 3200 - protein, 25 aa, synthetic construct
  source 1..25: note = Seed: LNVIVHSATGFKQSSKALQRPVASD
LNVIVHSATGFKQTSTALNRPVASD

SEQ ID NO: 3201 - protein, 25 aa, synthetic construct
  source 1..25: note = Seed: LNVIVHSATGFKQSSKALQRPVASD
LNVIVHSATGFKQTSTALSRPVASD

SEQ ID NO: 3202 - protein, 25 aa, synthetic construct
  source 1..25: note = Seed: LNVIVHSATGFKQSSKALQRPVASD
LNVIVHSATGFKQTSTALTRPVASD

SEQ ID NO: 3203 - protein, 25 aa, synthetic construct
  source 1..25: note = Seed: LNVIVHSATGFKQSSKALQRPVASD
LNVIVHSATGFKQTSTALVRPVASD

SEQ ID NO: 3204 - protein, 25 aa, synthetic construct
  source 1..25: note = Seed: LNVIVHSATGFKQSSKALQRPVASD
LNVIVHSATGFKQTSTALYRPVASD

SEQ ID NO: 3205 - protein, 25 aa, synthetic construct
  source 1..25: note = Seed: LNVIVHSATGFKQSSKALQRPVASD
LNVIVHSATGFKQTSVALARPVASD

SEQ ID NO: 3206 - protein, 25 aa, synthetic construct
  source 1..25: note = Seed: LNVIVHSATGFKQSSKALQRPVASD
LNVIVHSATGFKQTSVALFRPVASD

SEQ ID NO: 3207 - protein, 25 aa, synthetic construct
  source 1..25: note = Seed: LNVIVHSATGFKQSSKALQRPVASD
LNVIVHSATGFKQTSVALGRPVASD

SEQ ID NO: 3208 - protein, 25 aa, synthetic construct
  source 1..25: note = Seed: LNVIVHSATGFKQSSKALQRPVASD
LNVIVHSATGFKQTSVALHRPVASD

SEQ ID NO: 3209 - protein, 25 aa, synthetic construct
  source 1..25: note = Seed: LNVIVHSATGFKQSSKALQRPVASD
LNVIVHSATGFKQTSVALIRPVASD

SEQ ID NO: 3210 - protein, 25 aa, synthetic construct
  source 1..25: note = Seed: LNVIVHSATGFKQSSKALQRPVASD
LNVIVHSATGFKQTSVALLRPVASD

SEQ ID NO: 3211 - protein, 25 aa, synthetic construct
  source 1..25: note = Seed: LNVIVHSATGFKQSSKALQRPVASD
LNVIVHSATGFKQTSVALMRPVASD

SEQ ID NO: 3212 - protein, 25 aa, synthetic construct
  source 1..25: note = Seed: LNVIVHSATGFKQSSKALQRPVASD
LNVIVHSATGFKQTSVALNRPVASD

SEQ ID NO: 3213 - protein, 25 aa, synthetic construct
  source 1..25: note = Seed: LNVIVHSATGFKQSSKALQRPVASD
LNVIVHSATGFKQTSVALQRPVASD

SEQ ID NO: 3214 - protein, 25 aa, synthetic construct
  source 1..25: note = Seed: LNVIVHSATGFKQSSKALQRPVASD
LNVIVHSATGFKQTSVALSRPVASD

SEQ ID NO: 3215 - protein, 25 aa, synthetic construct
  source 1..25: note = Seed: LNVIVHSATGFKQSSKALQRPVASD
LNVIVHSATGFKQTSVALTRPVASD

SEQ ID NO: 3216 - protein, 25 aa, synthetic construct
  source 1..25: note = Seed: LNVIVHSATGFKQSSKALQRPVASD
LNVIVHSATGFKQTSVALVRPVASD

SEQ ID NO: 3217 - protein, 25 aa, synthetic construct
  source 1..25: note = Seed: LNVIVHSATGFKQSSKALQRPVASD
LNVIVHSATGFKQTSVALYRPVASD

SEQ ID NO: 3218 - protein, 25 aa, synthetic construct
  source 1..25: note = Seed: LNVIVHSATGFKQSSKALQRPVASD
LNVIVHSATGFKQTSYALFRPVASD

SEQ ID NO: 3219 - protein, 25 aa, synthetic construct
  source 1..25: note = Seed: LNVIVHSATGFKQSSKALQRPVASD
LNVIVHSATGFKQTSYALIRPVASD

SEQ ID NO: 3220 - protein, 25 aa, synthetic construct
  source 1..25: note = Seed: LNVIVHSATGFKQSSKALQRPVASD
LNVIVHSATGFKQTSYALLRPVASD

SEQ ID NO: 3221 - protein, 25 aa, synthetic construct
  source 1..25: note = Seed: LNVIVHSATGFKQSSKALQRPVASD
LNVIVHSATGFKQTSYALVRPVASD

SEQ ID NO: 3222 - protein, 25 aa, synthetic construct
  source 1..25: note = Seed: LNVIVHSATGFKQSSKALQRPVASD
LNVIVHSATGFKQVSAALARPVASD

SEQ ID NO: 3223 - protein, 25 aa, synthetic construct
  source 1..25: note = Seed: LNVIVHSATGFKQSSKALQRPVASD
LNVIVHSATGFKQVSAALCRPVASD

SEQ ID NO: 3224 - protein, 25 aa, synthetic construct
  source 1..25: note = Seed: LNVIVHSATGFKQSSKALQRPVASD
LNVIVHSATGFKQVSAALDRPVASD

SEQ ID NO: 3225 - protein, 25 aa, synthetic construct
  source 1..25: note = Seed: LNVIVHSATGFKQSSKALQRPVASD
LNVIVHSATGFKQVSAALERPVASD

SEQ ID NO: 3226 - protein, 25 aa, synthetic construct
  source 1..25: note = Seed: LNVIVHSATGFKQSSKALQRPVASD
LNVIVHSATGFKQVSAALFRPVASD

SEQ ID NO: 3227 - protein, 25 aa, synthetic construct
  source 1..25: note = Seed: LNVIVHSATGFKQSSKALQRPVASD
LNVIVHSATGFKQVSAALGRPVASD

SEQ ID NO: 3228 - protein, 25 aa, synthetic construct
  source 1..25: note = Seed: LNVIVHSATGFKQSSKALQRPVASD
LNVIVHSATGFKQVSAALHRPVASD

SEQ ID NO: 3229 - protein, 25 aa, synthetic construct
  source 1..25: note = Seed: LNVIVHSATGFKQSSKALQRPVASD
LNVIVHSATGFKQVSAALIRPVASD

SEQ ID NO: 3230 - protein, 25 aa, synthetic construct
  source 1..25: note = Seed: LNVIVHSATGFKQSSKALQRPVASD
LNVIVHSATGFKQVSAALLRPVASD

SEQ ID NO: 3231 - protein, 25 aa, synthetic construct
  source 1..25: note = Seed: LNVIVHSATGFKQSSKALQRPVASD
LNVIVHSATGFKQVSAALMRPVASD

SEQ ID NO: 3232 - protein, 25 aa, synthetic construct
  source 1..25: note = Seed: LNVIVHSATGFKQSSKALQRPVASD
LNVIVHSATGFKQVSAALNRPVASD

SEQ ID NO: 3233 - protein, 25 aa, synthetic construct
  source 1..25: note = Seed: LNVIVHSATGFKQSSKALQRPVASD
LNVIVHSATGFKQVSAALPRPVASD

SEQ ID NO: 3234 - protein, 25 aa, synthetic construct
  source 1..25: note = Seed: LNVIVHSATGFKQSSKALQRPVASD
LNVIVHSATGFKQVSAALQRPVASD

SEQ ID NO: 3235 - protein, 25 aa, synthetic construct
  source 1..25: note = Seed: LNVIVHSATGFKQSSKALQRPVASD
LNVIVHSATGFKQVSAALRRPVASD

SEQ ID NO: 3236 - protein, 25 aa, synthetic construct
  source 1..25: note = Seed: LNVIVHSATGFKQSSKALQRPVASD
LNVIVHSATGFKQVSAALSRPVASD

SEQ ID NO: 3237 - protein, 25 aa, synthetic construct
  source 1..25: note = Seed: LNVIVHSATGFKQSSKALQRPVASD
LNVIVHSATGFKQVSAALTRPVASD

SEQ ID NO: 3238 - protein, 25 aa, synthetic construct
  source 1..25: note = Seed: LNVIVHSATGFKQSSKALQRPVASD
LNVIVHSATGFKQVSAALVRPVASD

SEQ ID NO: 3239 - protein, 25 aa, synthetic construct
  source 1..25: note = Seed: LNVIVHSATGFKQSSKALQRPVASD
LNVIVHSATGFKQVSAALYRPVASD

SEQ ID NO: 3240 - protein, 25 aa, synthetic construct
  source 1..25: note = Seed: LNVIVHSATGFKQSSKALQRPVASD
LNVIVHSATGFKQVSCALNRPVASD

SEQ ID NO: 3241 - protein, 25 aa, synthetic construct
  source 1..25: note = Seed: LNVIVHSATGFKQSSKALQRPVASD
LNVIVHSATGFKQVSEALARPVASD

SEQ ID NO: 3242 - protein, 25 aa, synthetic construct
  source 1..25: note = Seed: LNVIVHSATGFKQSSKALQRPVASD
LNVIVHSATGFKQVSFALARPVASD

SEQ ID NO: 3243 - protein, 25 aa, synthetic construct
  source 1..25: note = Seed: LNVIVHSATGFKQSSKALQRPVASD
LNVIVHSATGFKQVSFALDRPVASD

SEQ ID NO: 3244 - protein, 25 aa, synthetic construct
  source 1..25: note = Seed: LNVIVHSATGFKQSSKALQRPVASD
LNVIVHSATGFKQVSFALERPVASD

SEQ ID NO: 3245 - protein, 25 aa, synthetic construct
  source 1..25: note = Seed: LNVIVHSATGFKQSSKALQRPVASD
LNVIVHSATGFKQVSFALGRPVASD

SEQ ID NO: 3246 - protein, 25 aa, synthetic construct
  source 1..25: note = Seed: LNVIVHSATGFKQSSKALQRPVASD
LNVIVHSATGFKQVSFALIRPVASD

SEQ ID NO: 3247 - protein, 25 aa, synthetic construct
  source 1..25: note = Seed: LNVIVHSATGFKQSSKALQRPVASD
LNVIVHSATGFKQVSFALLRPVASD

SEQ ID NO: 3248 - protein, 25 aa, synthetic construct
  source 1..25: note = Seed: LNVIVHSATGFKQSSKALQRPVASD
LNVIVHSATGFKQVSFALMRPVASD

SEQ ID NO: 3249 - protein, 25 aa, synthetic construct
  source 1..25: note = Seed: LNVIVHSATGFKQSSKALQRPVASD
LNVIVHSATGFKQVSFALNRPVASD

SEQ ID NO: 3250 - protein, 25 aa, synthetic construct
  source 1..25: note = Seed: LNVIVHSATGFKQSSKALQRPVASD
LNVIVHSATGFKQVSFALSRPVASD

SEQ ID NO: 3251 - protein, 25 aa, synthetic construct
  source 1..25: note = Seed: LNVIVHSATGFKQSSKALQRPVASD
LNVIVHSATGFKQVSFALTRPVASD

SEQ ID NO: 3252 - protein, 25 aa, synthetic construct
  source 1..25: note = Seed: LNVIVHSATGFKQSSKALQRPVASD
LNVIVHSATGFKQVSFALVRPVASD

SEQ ID NO: 3253 - protein, 25 aa, synthetic construct
  source 1..25: note = Seed: LNVIVHSATGFKQSSKALQRPVASD
LNVIVHSATGFKQVSFALYRPVASD

SEQ ID NO: 3254 - protein, 25 aa, synthetic construct
  source 1..25: note = Seed: LNVIVHSATGFKQSSKALQRPVASD
LNVIVHSATGFKQVSGALARPVASD

SEQ ID NO: 3255 - protein, 25 aa, synthetic construct
  source 1..25: note = Seed: LNVIVHSATGFKQSSKALQRPVASD
LNVIVHSATGFKQVSGALCRPVASD

SEQ ID NO: 3256 - protein, 25 aa, synthetic construct
  source 1..25: note = Seed: LNVIVHSATGFKQSSKALQRPVASD
LNVIVHSATGFKQVSGALDRPVASD

SEQ ID NO: 3257 - protein, 25 aa, synthetic construct
  source 1..25: note = Seed: LNVIVHSATGFKQSSKALQRPVASD
LNVIVHSATGFKQVSGALFRPVASD

SEQ ID NO: 3258 - protein, 25 aa, synthetic construct
  source 1..25: note = Seed: LNVIVHSATGFKQSSKALQRPVASD
LNVIVHSATGFKQVSGALGRPVASD

SEQ ID NO: 3259 - protein, 25 aa, synthetic construct
  source 1..25: note = Seed: LNVIVHSATGFKQSSKALQRPVASD
LNVIVHSATGFKQVSGALHRPVASD

SEQ ID NO: 3260 - protein, 25 aa, synthetic construct
  source 1..25: note = Seed: LNVIVHSATGFKQSSKALQRPVASD
LNVIVHSATGFKQVSGALIRPVASD

SEQ ID NO: 3261 - protein, 25 aa, synthetic construct
  source 1..25: note = Seed: LNVIVHSATGFKQSSKALQRPVASD
LNVIVHSATGFKQVSGALLRPVASD

SEQ ID NO: 3262 - protein, 25 aa, synthetic construct
  source 1..25: note = Seed: LNVIVHSATGFKQSSKALQRPVASD
LNVIVHSATGFKQVSGALMRPVASD

SEQ ID NO: 3263 - protein, 25 aa, synthetic construct
  source 1..25: note = Seed: LNVIVHSATGFKQSSKALQRPVASD
LNVIVHSATGFKQVSGALNRPVASD

SEQ ID NO: 3264 - protein, 25 aa, synthetic construct
  source 1..25: note = Seed: LNVIVHSATGFKQSSKALQRPVASD
LNVIVHSATGFKQVSGALPRPVASD

SEQ ID NO: 3265 - protein, 25 aa, synthetic construct
  source 1..25: note = Seed: LNVIVHSATGFKQSSKALQRPVASD
LNVIVHSATGFKQVSGALQRPVASD

SEQ ID NO: 3266 - protein, 25 aa, synthetic construct
  source 1..25: note = Seed: LNVIVHSATGFKQSSKALQRPVASD
LNVIVHSATGFKQVSGALSRPVASD

SEQ ID NO: 3267 - protein, 25 aa, synthetic construct
  source 1..25: note = Seed: LNVIVHSATGFKQSSKALQRPVASD
LNVIVHSATGFKQVSGALTRPVASD

SEQ ID NO: 3268 - protein, 25 aa, synthetic construct
  source 1..25: note = Seed: LNVIVHSATGFKQSSKALQRPVASD
LNVIVHSATGFKQVSGALVRPVASD

SEQ ID NO: 3269 - protein, 25 aa, synthetic construct
  source 1..25: note = Seed: LNVIVHSATGFKQSSKALQRPVASD
LNVIVHSATGFKQVSHALARPVASD

SEQ ID NO: 3270 - protein, 25 aa, synthetic construct
  source 1..25: note = Seed: LNVIVHSATGFKQSSKALQRPVASD
LNVIVHSATGFKQVSHALGRPVASD

SEQ ID NO: 3271 - protein, 25 aa, synthetic construct
  source 1..25: note = Seed: LNVIVHSATGFKQSSKALQRPVASD
LNVIVHSATGFKQVSHALIRPVASD

SEQ ID NO: 3272 - protein, 25 aa, synthetic construct
  source 1..25: note = Seed: LNVIVHSATGFKQSSKALQRPVASD
LNVIVHSATGFKQVSHALLRPVASD

SEQ ID NO: 3273 - protein, 25 aa, synthetic construct
  source 1..25: note = Seed: LNVIVHSATGFKQSSKALQRPVASD
LNVIVHSATGFKQVSHALNRPVASD

SEQ ID NO: 3274 - protein, 25 aa, synthetic construct
  source 1..25: note = Seed: LNVIVHSATGFKQSSKALQRPVASD
LNVIVHSATGFKQVSHALRRPVASD

SEQ ID NO: 3275 - protein, 25 aa, synthetic construct
  source 1..25: note = Seed: LNVIVHSATGFKQSSKALQRPVASD
LNVIVHSATGFKQVSHALSRPVASD

SEQ ID NO: 3276 - protein, 25 aa, synthetic construct
  source 1..25: note = Seed: LNVIVHSATGFKQSSKALQRPVASD
LNVIVHSATGFKQVSHALTRPVASD

SEQ ID NO: 3277 - protein, 25 aa, synthetic construct
  source 1..25: note = Seed: LNVIVHSATGFKQSSKALQRPVASD
LNVIVHSATGFKQVSHALVRPVASD

SEQ ID NO: 3278 - protein, 25 aa, synthetic construct
  source 1..25: note = Seed: LNVIVHSATGFKQSSKALQRPVASD
LNVIVHSATGFKQVSIALARPVASD

SEQ ID NO: 3279 - protein, 25 aa, synthetic construct
  source 1..25: note = Seed: LNVIVHSATGFKQSSKALQRPVASD
LNVIVHSATGFKQVSIALDRPVASD

SEQ ID NO: 3280 - protein, 25 aa, synthetic construct
  source 1..25: note = Seed: LNVIVHSATGFKQSSKALQRPVASD
LNVIVHSATGFKQVSIALERPVASD

SEQ ID NO: 3281 - protein, 25 aa, synthetic construct
  source 1..25: note = Seed: LNVIVHSATGFKQSSKALQRPVASD
LNVIVHSATGFKQVSIALFRPVASD

SEQ ID NO: 3282 - protein, 25 aa, synthetic construct
  source 1..25: note = Seed: LNVIVHSATGFKQSSKALQRPVASD
LNVIVHSATGFKQVSIALGRPVASD

SEQ ID NO: 3283 - protein, 25 aa, synthetic construct
  source 1..25: note = Seed: LNVIVHSATGFKQSSKALQRPVASD
LNVIVHSATGFKQVSIALHRPVASD

SEQ ID NO: 3284 - protein, 25 aa, synthetic construct
  source 1..25: note = Seed: LNVIVHSATGFKQSSKALQRPVASD
LNVIVHSATGFKQVSIALIRPVASD

SEQ ID NO: 3285 - protein, 25 aa, synthetic construct
  source 1..25: note = Seed: LNVIVHSATGFKQSSKALQRPVASD
LNVIVHSATGFKQVSIALLRPVASD

SEQ ID NO: 3286 - protein, 25 aa, synthetic construct
  source 1..25: note = Seed: LNVIVHSATGFKQSSKALQRPVASD
LNVIVHSATGFKQVSIALMRPVASD

SEQ ID NO: 3287 - protein, 25 aa, synthetic construct
  source 1..25: note = Seed: LNVIVHSATGFKQSSKALQRPVASD
LNVIVHSATGFKQVSIALNRPVASD

SEQ ID NO: 3288 - protein, 25 aa, synthetic construct
  source 1..25: note = Seed: LNVIVHSATGFKQSSKALQRPVASD
LNVIVHSATGFKQVSIALPRPVASD

SEQ ID NO: 3289 - protein, 25 aa, synthetic construct
  source 1..25: note = Seed: LNVIVHSATGFKQSSKALQRPVASD
LNVIVHSATGFKQVSIALQRPVASD

SEQ ID NO: 3290 - protein, 25 aa, synthetic construct
  source 1..25: note = Seed: LNVIVHSATGFKQSSKALQRPVASD
LNVIVHSATGFKQVSIALSRPVASD

SEQ ID NO: 3291 - protein, 25 aa, synthetic construct
  source 1..25: note = Seed: LNVIVHSATGFKQSSKALQRPVASD
LNVIVHSATGFKQVSIALTRPVASD

SEQ ID NO: 3292 - protein, 25 aa, synthetic construct
  source 1..25: note = Seed: LNVIVHSATGFKQSSKALQRPVASD
LNVIVHSATGFKQVSIALVRPVASD

SEQ ID NO: 3293 - protein, 25 aa, synthetic construct
  source 1..25: note = Seed: LNVIVHSATGFKQSSKALQRPVASD
LNVIVHSATGFKQVSKALARPVASD

SEQ ID NO: 3294 - protein, 25 aa, synthetic construct
  source 1..25: note = Seed: LNVIVHSATGFKQSSKALQRPVASD
LNVIVHSATGFKQVSKALDRPVASD

SEQ ID NO: 3295 - protein, 25 aa, synthetic construct
  source 1..25: note = Seed: LNVIVHSATGFKQSSKALQRPVASD
LNVIVHSATGFKQVSKALGRPVASD

SEQ ID NO: 3296 - protein, 25 aa, synthetic construct
  source 1..25: note = Seed: LNVIVHSATGFKQSSKALQRPVASD
LNVIVHSATGFKQVSKALHRPVASD

SEQ ID NO: 3297 - protein, 25 aa, synthetic construct
  source 1..25: note = Seed: LNVIVHSATGFKQSSKALQRPVASD
LNVIVHSATGFKQVSKALIRPVASD

SEQ ID NO: 3298 - protein, 25 aa, synthetic construct
  source 1..25: note = Seed: LNVIVHSATGFKQSSKALQRPVASD
LNVIVHSATGFKQVSKALKRPVASD

SEQ ID NO: 3299 - protein, 25 aa, synthetic construct
  source 1..25: note = Seed: LNVIVHSATGFKQSSKALQRPVASD
LNVIVHSATGFKQVSKALLRPVASD

SEQ ID NO: 3300 - protein, 25 aa, synthetic construct
  source 1..25: note = Seed: LNVIVHSATGFKQSSKALQRPVASD
LNVIVHSATGFKQVSKALMRPVASD

SEQ ID NO: 3301 - protein, 25 aa, synthetic construct
  source 1..25: note = Seed: LNVIVHSATGFKQSSKALQRPVASD
LNVIVHSATGFKQVSKALNRPVASD

SEQ ID NO: 3302 - protein, 25 aa, synthetic construct
  source 1..25: note = Seed: LNVIVHSATGFKQSSKALQRPVASD
LNVIVHSATGFKQVSKALPRPVASD

SEQ ID NO: 3303 - protein, 25 aa, synthetic construct
  source 1..25: note = Seed: LNVIVHSATGFKQSSKALQRPVASD
LNVIVHSATGFKQVSKALQRPVASD

SEQ ID NO: 3304 - protein, 25 aa, synthetic construct
  source 1..25: note = Seed: LNVIVHSATGFKQSSKALQRPVASD
LNVIVHSATGFKQVSKALRRPVASD

SEQ ID NO: 3305 - protein, 25 aa, synthetic construct
  source 1..25: note = Seed: LNVIVHSATGFKQSSKALQRPVASD
LNVIVHSATGFKQVSKALSRPVASD

SEQ ID NO: 3306 - protein, 25 aa, synthetic construct
  source 1..25: note = Seed: LNVIVHSATGFKQSSKALQRPVASD
LNVIVHSATGFKQVSKALTRPVASD

SEQ ID NO: 3307 - protein, 25 aa, synthetic construct
  source 1..25: note = Seed: LNVIVHSATGFKQSSKALQRPVASD
LNVIVHSATGFKQVSKALVRPVASD

SEQ ID NO: 3308 - protein, 25 aa, synthetic construct
  source 1..25: note = Seed: LNVIVHSATGFKQSSKALQRPVASD
LNVIVHSATGFKQVSKALYRPVASD

SEQ ID NO: 3309 - protein, 25 aa, synthetic construct
  source 1..25: note = Seed: LNVIVHSATGFKQSSKALQRPVASD
LNVIVHSATGFKQVSLALARPVASD

SEQ ID NO: 3310 - protein, 25 aa, synthetic construct
  source 1..25: note = Seed: LNVIVHSATGFKQSSKALQRPVASD
LNVIVHSATGFKQVSLALGRPVASD

SEQ ID NO: 3311 - protein, 25 aa, synthetic construct
  source 1..25: note = Seed: LNVIVHSATGFKQSSKALQRPVASD
LNVIVHSATGFKQVSLALHRPVASD

SEQ ID NO: 3312 - protein, 25 aa, synthetic construct
  source 1..25: note = Seed: LNVIVHSATGFKQSSKALQRPVASD
LNVIVHSATGFKQVSLALIRPVASD

SEQ ID NO: 3313 - protein, 25 aa, synthetic construct
  source 1..25: note = Seed: LNVIVHSATGFKQSSKALQRPVASD
LNVIVHSATGFKQVSLALLRPVASD

SEQ ID NO: 3314 - protein, 25 aa, synthetic construct
  source 1..25: note = Seed: LNVIVHSATGFKQSSKALQRPVASD
LNVIVHSATGFKQVSLALMRPVASD

SEQ ID NO: 3315 - protein, 25 aa, synthetic construct
  source 1..25: note = Seed: LNVIVHSATGFKQSSKALQRPVASD
LNVIVHSATGFKQVSLALNRPVASD

SEQ ID NO: 3316 - protein, 25 aa, synthetic construct
  source 1..25: note = Seed: LNVIVHSATGFKQSSKALQRPVASD
LNVIVHSATGFKQVSLALQRPVASD

SEQ ID NO: 3317 - protein, 25 aa, synthetic construct
  source 1..25: note = Seed: LNVIVHSATGFKQSSKALQRPVASD
LNVIVHSATGFKQVSLALSRPVASD

SEQ ID NO: 3318 - protein, 25 aa, synthetic construct
  source 1..25: note = Seed: LNVIVHSATGFKQSSKALQRPVASD
LNVIVHSATGFKQVSLALTRPVASD

SEQ ID NO: 3319 - protein, 25 aa, synthetic construct
  source 1..25: note = Seed: LNVIVHSATGFKQSSKALQRPVASD
LNVIVHSATGFKQVSLALVRPVASD

SEQ ID NO: 3320 - protein, 25 aa, synthetic construct
  source 1..25: note = Seed: LNVIVHSATGFKQSSKALQRPVASD
LNVIVHSATGFKQVSMALARPVASD

SEQ ID NO: 3321 - protein, 25 aa, synthetic construct
  source 1..25: note = Seed: LNVIVHSATGFKQSSKALQRPVASD
LNVIVHSATGFKQVSMALGRPVASD

SEQ ID NO: 3322 - protein, 25 aa, synthetic construct
  source 1..25: note = Seed: LNVIVHSATGFKQSSKALQRPVASD
LNVIVHSATGFKQVSMALHRPVASD

SEQ ID NO: 3323 - protein, 25 aa, synthetic construct
  source 1..25: note = Seed: LNVIVHSATGFKQSSKALQRPVASD
LNVIVHSATGFKQVSMALIRPVASD

SEQ ID NO: 3324 - protein, 25 aa, synthetic construct
  source 1..25: note = Seed: LNVIVHSATGFKQSSKALQRPVASD
LNVIVHSATGFKQVSMALLRPVASD

SEQ ID NO: 3325 - protein, 25 aa, synthetic construct
  source 1..25: note = Seed: LNVIVHSATGFKQSSKALQRPVASD
LNVIVHSATGFKQVSMALMRPVASD

SEQ ID NO: 3326 - protein, 25 aa, synthetic construct
  source 1..25: note = Seed: LNVIVHSATGFKQSSKALQRPVASD
LNVIVHSATGFKQVSMALNRPVASD

SEQ ID NO: 3327 - protein, 25 aa, synthetic construct
  source 1..25: note = Seed: LNVIVHSATGFKQSSKALQRPVASD
LNVIVHSATGFKQVSMALQRPVASD

SEQ ID NO: 3328 - protein, 25 aa, synthetic construct
  source 1..25: note = Seed: LNVIVHSATGFKQSSKALQRPVASD
LNVIVHSATGFKQVSMALSRPVASD

SEQ ID NO: 3329 - protein, 25 aa, synthetic construct
  source 1..25: note = Seed: LNVIVHSATGFKQSSKALQRPVASD
LNVIVHSATGFKQVSMALTRPVASD

SEQ ID NO: 3330 - protein, 25 aa, synthetic construct
  source 1..25: note = Seed: LNVIVHSATGFKQSSKALQRPVASD
LNVIVHSATGFKQVSMALVRPVASD

SEQ ID NO: 3331 - protein, 25 aa, synthetic construct
  source 1..25: note = Seed: LNVIVHSATGFKQSSKALQRPVASD
LNVIVHSATGFKQVSNALARPVASD

SEQ ID NO: 3332 - protein, 25 aa, synthetic construct
  source 1..25: note = Seed: LNVIVHSATGFKQSSKALQRPVASD
LNVIVHSATGFKQVSNALFRPVASD

SEQ ID NO: 3333 - protein, 25 aa, synthetic construct
  source 1..25: note = Seed: LNVIVHSATGFKQSSKALQRPVASD
LNVIVHSATGFKQVSNALGRPVASD

SEQ ID NO: 3334 - protein, 25 aa, synthetic construct
  source 1..25: note = Seed: LNVIVHSATGFKQSSKALQRPVASD
LNVIVHSATGFKQVSNALHRPVASD

SEQ ID NO: 3335 - protein, 25 aa, synthetic construct
  source 1..25: note = Seed: LNVIVHSATGFKQSSKALQRPVASD
LNVIVHSATGFKQVSNALIRPVASD

SEQ ID NO: 3336 - protein, 25 aa, synthetic construct
  source 1..25: note = Seed: LNVIVHSATGFKQSSKALQRPVASD
LNVIVHSATGFKQVSNALLRPVASD

SEQ ID NO: 3337 - protein, 25 aa, synthetic construct
  source 1..25: note = Seed: LNVIVHSATGFKQSSKALQRPVASD
LNVIVHSATGFKQVSNALMRPVASD

SEQ ID NO: 3338 - protein, 25 aa, synthetic construct
  source 1..25: note = Seed: LNVIVHSATGFKQSSKALQRPVASD
LNVIVHSATGFKQVSNALNRPVASD

SEQ ID NO: 3339 - protein, 25 aa, synthetic construct
  source 1..25: note = Seed: LNVIVHSATGFKQSSKALQRPVASD
LNVIVHSATGFKQVSNALPRPVASD

SEQ ID NO: 3340 - protein, 25 aa, synthetic construct
  source 1..25: note = Seed: LNVIVHSATGFKQSSKALQRPVASD
LNVIVHSATGFKQVSNALQRPVASD

SEQ ID NO: 3341 - protein, 25 aa, synthetic construct
  source 1..25: note = Seed: LNVIVHSATGFKQSSKALQRPVASD
LNVIVHSATGFKQVSNALSRPVASD

SEQ ID NO: 3342 - protein, 25 aa, synthetic construct
  source 1..25: note = Seed: LNVIVHSATGFKQSSKALQRPVASD
LNVIVHSATGFKQVSNALTRPVASD

SEQ ID NO: 3343 - protein, 25 aa, synthetic construct
  source 1..25: note = Seed: LNVIVHSATGFKQSSKALQRPVASD
LNVIVHSATGFKQVSNALVRPVASD

SEQ ID NO: 3344 - protein, 25 aa, synthetic construct
  source 1..25: note = Seed: LNVIVHSATGFKQSSKALQRPVASD
LNVIVHSATGFKQVSPALARPVASD

SEQ ID NO: 3345 - protein, 25 aa, synthetic construct
  source 1..25: note = Seed: LNVIVHSATGFKQSSKALQRPVASD
LNVIVHSATGFKQVSPALCRPVASD

SEQ ID NO: 3346 - protein, 25 aa, synthetic construct
  source 1..25: note = Seed: LNVIVHSATGFKQSSKALQRPVASD
LNVIVHSATGFKQVSPALDRPVASD

SEQ ID NO: 3347 - protein, 25 aa, synthetic construct
  source 1..25: note = Seed: LNVIVHSATGFKQSSKALQRPVASD
LNVIVHSATGFKQVSPALERPVASD

SEQ ID NO: 3348 - protein, 25 aa, synthetic construct
  source 1..25: note = Seed: LNVIVHSATGFKQSSKALQRPVASD
LNVIVHSATGFKQVSPALFRPVASD

SEQ ID NO: 3349 - protein, 25 aa, synthetic construct
  source 1..25: note = Seed: LNVIVHSATGFKQSSKALQRPVASD
LNVIVHSATGFKQVSPALGRPVASD

SEQ ID NO: 3350 - protein, 25 aa, synthetic construct
  source 1..25: note = Seed: LNVIVHSATGFKQSSKALQRPVASD
LNVIVHSATGFKQVSPALHRPVASD

SEQ ID NO: 3351 - protein, 25 aa, synthetic construct
  source 1..25: note = Seed: LNVIVHSATGFKQSSKALQRPVASD
LNVIVHSATGFKQVSPALIRPVASD

SEQ ID NO: 3352 - protein, 25 aa, synthetic construct
  source 1..25: note = Seed: LNVIVHSATGFKQSSKALQRPVASD
LNVIVHSATGFKQVSPALLRPVASD

SEQ ID NO: 3353 - protein, 25 aa, synthetic construct
  source 1..25: note = Seed: LNVIVHSATGFKQSSKALQRPVASD
LNVIVHSATGFKQVSPALMRPVASD

SEQ ID NO: 3354 - protein, 25 aa, synthetic construct
  source 1..25: note = Seed: LNVIVHSATGFKQSSKALQRPVASD
LNVIVHSATGFKQVSPALNRPVASD

SEQ ID NO: 3355 - protein, 25 aa, synthetic construct
  source 1..25: note = Seed: LNVIVHSATGFKQSSKALQRPVASD
LNVIVHSATGFKQVSPALPRPVASD

SEQ ID NO: 3356 - protein, 25 aa, synthetic construct
  source 1..25: note = Seed: LNVIVHSATGFKQSSKALQRPVASD
LNVIVHSATGFKQVSPALQRPVASD

SEQ ID NO: 3357 - protein, 25 aa, synthetic construct
  source 1..25: note = Seed: LNVIVHSATGFKQSSKALQRPVASD
LNVIVHSATGFKQVSPALSRPVASD

SEQ ID NO: 3358 - protein, 25 aa, synthetic construct
  source 1..25: note = Seed: LNVIVHSATGFKQSSKALQRPVASD
LNVIVHSATGFKQVSPALTRPVASD

SEQ ID NO: 3359 - protein, 25 aa, synthetic construct
  source 1..25: note = Seed: LNVIVHSATGFKQSSKALQRPVASD
LNVIVHSATGFKQVSPALVRPVASD

SEQ ID NO: 3360 - protein, 25 aa, synthetic construct
  source 1..25: note = Seed: LNVIVHSATGFKQSSKALQRPVASD
LNVIVHSATGFKQVSPALWRPVASD

SEQ ID NO: 3361 - protein, 25 aa, synthetic construct
  source 1..25: note = Seed: LNVIVHSATGFKQSSKALQRPVASD
LNVIVHSATGFKQVSPALYRPVASD

SEQ ID NO: 3362 - protein, 25 aa, synthetic construct
  source 1..25: note = Seed: LNVIVHSATGFKQSSKALQRPVASD
LNVIVHSATGFKQVSQALARPVASD

SEQ ID NO: 3363 - protein, 25 aa, synthetic construct
  source 1..25: note = Seed: LNVIVHSATGFKQSSKALQRPVASD
LNVIVHSATGFKQVSQALIRPVASD

SEQ ID NO: 3364 - protein, 25 aa, synthetic construct
  source 1..25: note = Seed: LNVIVHSATGFKQSSKALQRPVASD
LNVIVHSATGFKQVSQALNRPVASD

SEQ ID NO: 3365 - protein, 25 aa, synthetic construct
  source 1..25: note = Seed: LNVIVHSATGFKQSSKALQRPVASD
LNVIVHSATGFKQVSQALSRPVASD

SEQ ID NO: 3366 - protein, 25 aa, synthetic construct
  source 1..25: note = Seed: LNVIVHSATGFKQSSKALQRPVASD
LNVIVHSATGFKQVSQALVRPVASD

SEQ ID NO: 3367 - protein, 25 aa, synthetic construct
  source 1..25: note = Seed: LNVIVHSATGFKQSSKALQRPVASD
LNVIVHSATGFKQVSRALARPVASD

SEQ ID NO: 3368 - protein, 25 aa, synthetic construct
  source 1..25: note = Seed: LNVIVHSATGFKQSSKALQRPVASD
LNVIVHSATGFKQVSRALDRPVASD

SEQ ID NO: 3369 - protein, 25 aa, synthetic construct
  source 1..25: note = Seed: LNVIVHSATGFKQSSKALQRPVASD
LNVIVHSATGFKQVSRALERPVASD

SEQ ID NO: 3370 - protein, 25 aa, synthetic construct
  source 1..25: note = Seed: LNVIVHSATGFKQSSKALQRPVASD
LNVIVHSATGFKQVSRALGRPVASD

SEQ ID NO: 3371 - protein, 25 aa, synthetic construct
  source 1..25: note = Seed: LNVIVHSATGFKQSSKALQRPVASD
LNVIVHSATGFKQVSRALHRPVASD

SEQ ID NO: 3372 - protein, 25 aa, synthetic construct
  source 1..25: note = Seed: LNVIVHSATGFKQSSKALQRPVASD
LNVIVHSATGFKQVSRALIRPVASD

SEQ ID NO: 3373 - protein, 25 aa, synthetic construct
  source 1..25: note = Seed: LNVIVHSATGFKQSSKALQRPVASD
LNVIVHSATGFKQVSRALKRPVASD

SEQ ID NO: 3374 - protein, 25 aa, synthetic construct
  source 1..25: note = Seed: LNVIVHSATGFKQSSKALQRPVASD
LNVIVHSATGFKQVSRALLRPVASD

SEQ ID NO: 3375 - protein, 25 aa, synthetic construct
  source 1..25: note = Seed: LNVIVHSATGFKQSSKALQRPVASD
LNVIVHSATGFKQVSRALMRPVASD

SEQ ID NO: 3376 - protein, 25 aa, synthetic construct
  source 1..25: note = Seed: LNVIVHSATGFKQSSKALQRPVASD
LNVIVHSATGFKQVSRALNRPVASD

SEQ ID NO: 3377 - protein, 25 aa, synthetic construct
  source 1..25: note = Seed: LNVIVHSATGFKQSSKALQRPVASD
LNVIVHSATGFKQVSRALPRPVASD

SEQ ID NO: 3378 - protein, 25 aa, synthetic construct
  source 1..25: note = Seed: LNVIVHSATGFKQSSKALQRPVASD
LNVIVHSATGFKQVSRALQRPVASD

SEQ ID NO: 3379 - protein, 25 aa, synthetic construct
  source 1..25: note = Seed: LNVIVHSATGFKQSSKALQRPVASD
LNVIVHSATGFKQVSRALRRPVASD

SEQ ID NO: 3380 - protein, 25 aa, synthetic construct
  source 1..25: note = Seed: LNVIVHSATGFKQSSKALQRPVASD
LNVIVHSATGFKQVSRALSRPVASD

SEQ ID NO: 3381 - protein, 25 aa, synthetic construct
  source 1..25: note = Seed: LNVIVHSATGFKQSSKALQRPVASD
LNVIVHSATGFKQVSRALTRPVASD

SEQ ID NO: 3382 - protein, 25 aa, synthetic construct
  source 1..25: note = Seed: LNVIVHSATGFKQSSKALQRPVASD
LNVIVHSATGFKQVSRALVRPVASD

SEQ ID NO: 3383 - protein, 25 aa, synthetic construct
  source 1..25: note = Seed: LNVIVHSATGFKQSSKALQRPVASD
LNVIVHSATGFKQVSRALYRPVASD

SEQ ID NO: 3384 - protein, 25 aa, synthetic construct
  source 1..25: note = Seed: LNVIVHSATGFKQSSKALQRPVASD
LNVIVHSATGFKQVSSALARPVASD

SEQ ID NO: 3385 - protein, 25 aa, synthetic construct
  source 1..25: note = Seed: LNVIVHSATGFKQSSKALQRPVASD
LNVIVHSATGFKQVSSALCRPVASD

SEQ ID NO: 3386 - protein, 25 aa, synthetic construct
  source 1..25: note = Seed: LNVIVHSATGFKQSSKALQRPVASD
LNVIVHSATGFKQVSSALDRPVASD

SEQ ID NO: 3387 - protein, 25 aa, synthetic construct
  source 1..25: note = Seed: LNVIVHSATGFKQSSKALQRPVASD
LNVIVHSATGFKQVSSALERPVASD

SEQ ID NO: 3388 - protein, 25 aa, synthetic construct
  source 1..25: note = Seed: LNVIVHSATGFKQSSKALQRPVASD
LNVIVHSATGFKQVSSALFRPVASD

SEQ ID NO: 3389 - protein, 25 aa, synthetic construct
  source 1..25: note = Seed: LNVIVHSATGFKQSSKALQRPVASD
LNVIVHSATGFKQVSSALGRPVASD

SEQ ID NO: 3390 - protein, 25 aa, synthetic construct
  source 1..25: note = Seed: LNVIVHSATGFKQSSKALQRPVASD
LNVIVHSATGFKQVSSALHRPVASD

SEQ ID NO: 3391 - protein, 25 aa, synthetic construct
  source 1..25: note = Seed: LNVIVHSATGFKQSSKALQRPVASD
LNVIVHSATGFKQVSSALIRPVASD

SEQ ID NO: 3392 - protein, 25 aa, synthetic construct
  source 1..25: note = Seed: LNVIVHSATGFKQSSKALQRPVASD
LNVIVHSATGFKQVSSALLRPVASD

SEQ ID NO: 3393 - protein, 25 aa, synthetic construct
  source 1..25: note = Seed: LNVIVHSATGFKQSSKALQRPVASD
LNVIVHSATGFKQVSSALMRPVASD

SEQ ID NO: 3394 - protein, 25 aa, synthetic construct
  source 1..25: note = Seed: LNVIVHSATGFKQSSKALQRPVASD
LNVIVHSATGFKQVSSALNRPVASD

SEQ ID NO: 3395 - protein, 25 aa, synthetic construct
  source 1..25: note = Seed: LNVIVHSATGFKQSSKALQRPVASD
LNVIVHSATGFKQVSSALPRPVASD

SEQ ID NO: 3396 - protein, 25 aa, synthetic construct
  source 1..25: note = Seed: LNVIVHSATGFKQSSKALQRPVASD
LNVIVHSATGFKQVSSALQRPVASD

SEQ ID NO: 3397 - protein, 25 aa, synthetic construct
  source 1..25: note = Seed: LNVIVHSATGFKQSSKALQRPVASD
LNVIVHSATGFKQVSSALSRPVASD

SEQ ID NO: 3398 - protein, 25 aa, synthetic construct
  source 1..25: note = Seed: LNVIVHSATGFKQSSKALQRPVASD
LNVIVHSATGFKQVSSALTRPVASD

SEQ ID NO: 3399 - protein, 25 aa, synthetic construct
  source 1..25: note = Seed: LNVIVHSATGFKQSSKALQRPVASD
LNVIVHSATGFKQVSSALVRPVASD

SEQ ID NO: 3400 - protein, 25 aa, synthetic construct
  source 1..25: note = Seed: LNVIVHSATGFKQSSKALQRPVASD
LNVIVHSATGFKQVSSALYRPVASD

SEQ ID NO: 3401 - protein, 25 aa, synthetic construct
  source 1..25: note = Seed: LNVIVHSATGFKQSSKALQRPVASD
LNVIVHSATGFKQVSTALARPVASD

SEQ ID NO: 3402 - protein, 25 aa, synthetic construct
  source 1..25: note = Seed: LNVIVHSATGFKQSSKALQRPVASD
LNVIVHSATGFKQVSTALCRPVASD

SEQ ID NO: 3403 - protein, 25 aa, synthetic construct
  source 1..25: note = Seed: LNVIVHSATGFKQSSKALQRPVASD
LNVIVHSATGFKQVSTALDRPVASD

SEQ ID NO: 3404 - protein, 25 aa, synthetic construct
  source 1..25: note = Seed: LNVIVHSATGFKQSSKALQRPVASD
LNVIVHSATGFKQVSTALERPVASD

SEQ ID NO: 3405 - protein, 25 aa, synthetic construct
  source 1..25: note = Seed: LNVIVHSATGFKQSSKALQRPVASD
LNVIVHSATGFKQVSTALFRPVASD

SEQ ID NO: 3406 - protein, 25 aa, synthetic construct
  source 1..25: note = Seed: LNVIVHSATGFKQSSKALQRPVASD
LNVIVHSATGFKQVSTALGRPVASD

SEQ ID NO: 3407 - protein, 25 aa, synthetic construct
  source 1..25: note = Seed: LNVIVHSATGFKQSSKALQRPVASD
LNVIVHSATGFKQVSTALHRPVASD

SEQ ID NO: 3408 - protein, 25 aa, synthetic construct
  source 1..25: note = Seed: LNVIVHSATGFKQSSKALQRPVASD
LNVIVHSATGFKQVSTALIRPVASD

SEQ ID NO: 3409 - protein, 25 aa, synthetic construct
  source 1..25: note = Seed: LNVIVHSATGFKQSSKALQRPVASD
LNVIVHSATGFKQVSTALLRPVASD

SEQ ID NO: 3410 - protein, 25 aa, synthetic construct
  source 1..25: note = Seed: LNVIVHSATGFKQSSKALQRPVASD
LNVIVHSATGFKQVSTALMRPVASD

SEQ ID NO: 3411 - protein, 25 aa, synthetic construct
  source 1..25: note = Seed: LNVIVHSATGFKQSSKALQRPVASD
LNVIVHSATGFKQVSTALNRPVASD

SEQ ID NO: 3412 - protein, 25 aa, synthetic construct
  source 1..25: note = Seed: LNVIVHSATGFKQSSKALQRPVASD
LNVIVHSATGFKQVSTALPRPVASD

SEQ ID NO: 3413 - protein, 25 aa, synthetic construct
  source 1..25: note = Seed: LNVIVHSATGFKQSSKALQRPVASD
LNVIVHSATGFKQVSTALQRPVASD

SEQ ID NO: 3414 - protein, 25 aa, synthetic construct
  source 1..25: note = Seed: LNVIVHSATGFKQSSKALQRPVASD
LNVIVHSATGFKQVSTALRRPVASD

SEQ ID NO: 3415 - protein, 25 aa, synthetic construct
  source 1..25: note = Seed: LNVIVHSATGFKQSSKALQRPVASD
LNVIVHSATGFKQVSTALSRPVASD

SEQ ID NO: 3416 - protein, 25 aa, synthetic construct
  source 1..25: note = Seed: LNVIVHSATGFKQSSKALQRPVASD
LNVIVHSATGFKQVSTALTRPVASD

SEQ ID NO: 3417 - protein, 25 aa, synthetic construct
  source 1..25: note = Seed: LNVIVHSATGFKQSSKALQRPVASD
LNVIVHSATGFKQVSTALVRPVASD

SEQ ID NO: 3418 - protein, 25 aa, synthetic construct
  source 1..25: note = Seed: LNVIVHSATGFKQSSKALQRPVASD
LNVIVHSATGFKQVSVALARPVASD

SEQ ID NO: 3419 - protein, 25 aa, synthetic construct
  source 1..25: note = Seed: LNVIVHSATGFKQSSKALQRPVASD
LNVIVHSATGFKQVSVALDRPVASD

SEQ ID NO: 3420 - protein, 25 aa, synthetic construct
  source 1..25: note = Seed: LNVIVHSATGFKQSSKALQRPVASD
LNVIVHSATGFKQVSVALERPVASD

SEQ ID NO: 3421 - protein, 25 aa, synthetic construct
  source 1..25: note = Seed: LNVIVHSATGFKQSSKALQRPVASD
LNVIVHSATGFKQVSVALGRPVASD

SEQ ID NO: 3422 - protein, 25 aa, synthetic construct
  source 1..25: note = Seed: LNVIVHSATGFKQSSKALQRPVASD
LNVIVHSATGFKQVSVALHRPVASD

SEQ ID NO: 3423 - protein, 25 aa, synthetic construct
  source 1..25: note = Seed: LNVIVHSATGFKQSSKALQRPVASD
LNVIVHSATGFKQVSVALIRPVASD

SEQ ID NO: 3424 - protein, 25 aa, synthetic construct
  source 1..25: note = Seed: LNVIVHSATGFKQSSKALQRPVASD
LNVIVHSATGFKQVSVALLRPVASD

SEQ ID NO: 3425 - protein, 25 aa, synthetic construct
  source 1..25: note = Seed: LNVIVHSATGFKQSSKALQRPVASD
LNVIVHSATGFKQVSVALMRPVASD

SEQ ID NO: 3426 - protein, 25 aa, synthetic construct
  source 1..25: note = Seed: LNVIVHSATGFKQSSKALQRPVASD
LNVIVHSATGFKQVSVALNRPVASD

SEQ ID NO: 3427 - protein, 25 aa, synthetic construct
  source 1..25: note = Seed: LNVIVHSATGFKQSSKALQRPVASD
LNVIVHSATGFKQVSVALPRPVASD

SEQ ID NO: 3428 - protein, 25 aa, synthetic construct
  source 1..25: note = Seed: LNVIVHSATGFKQSSKALQRPVASD
LNVIVHSATGFKQVSVALQRPVASD

SEQ ID NO: 3429 - protein, 25 aa, synthetic construct
  source 1..25: note = Seed: LNVIVHSATGFKQSSKALQRPVASD
LNVIVHSATGFKQVSVALSRPVASD

SEQ ID NO: 3430 - protein, 25 aa, synthetic construct
  source 1..25: note = Seed: LNVIVHSATGFKQSSKALQRPVASD
LNVIVHSATGFKQVSVALTRPVASD

SEQ ID NO: 3431 - protein, 25 aa, synthetic construct
  source 1..25: note = Seed: LNVIVHSATGFKQSSKALQRPVASD
LNVIVHSATGFKQVSVALVRPVASD

SEQ ID NO: 3432 - protein, 25 aa, synthetic construct
  source 1..25: note = Seed: LNVIVHSATGFKQSSKALQRPVASD
LNVIVHSATGFKQVSWALIRPVASD

SEQ ID NO: 3433 - protein, 25 aa, synthetic construct
  source 1..25: note = Seed: LNVIVHSATGFKQSSKALQRPVASD
LNVIVHSATGFKQVSWALVRPVASD

SEQ ID NO: 3434 - protein, 25 aa, synthetic construct
  source 1..25: note = Seed: LNVIVHSATGFKQSSKALQRPVASD
LNVIVHSATGFKQVSYALGRPVASD

SEQ ID NO: 3435 - protein, 25 aa, synthetic construct
  source 1..25: note = Seed: LNVIVHSATGFKQSSKALQRPVASD
LNVIVHSATGFKQVSYALIRPVASD

SEQ ID NO: 3436 - protein, 25 aa, synthetic construct
  source 1..25: note = Seed: LNVIVHSATGFKQSSKALQRPVASD
LNVIVHSATGFKQVSYALLRPVASD

SEQ ID NO: 3437 - protein, 25 aa, synthetic construct
  source 1..25: note = Seed: LNVIVHSATGFKQSSKALQRPVASD
LNVIVHSATGFKQVSYALVRPVASD

SEQ ID NO: 3438 - protein, 25 aa, synthetic construct
  source 1..25: note = Seed: LNVIVHSATGFKQSSKALQRPVASD
LNVIVHSATGFKQWSAALARPVASD

SEQ ID NO: 3439 - protein, 25 aa, synthetic construct
  source 1..25: note = Seed: LNVIVHSATGFKQSSKALQRPVASD
LNVIVHSATGFKQWSAALFRPVASD

SEQ ID NO: 3440 - protein, 25 aa, synthetic construct
  source 1..25: note = Seed: LNVIVHSATGFKQSSKALQRPVASD
LNVIVHSATGFKQWSAALGRPVASD

SEQ ID NO: 3441 - protein, 25 aa, synthetic construct
  source 1..25: note = Seed: LNVIVHSATGFKQSSKALQRPVASD
LNVIVHSATGFKQWSAALHRPVASD

SEQ ID NO: 3442 - protein, 25 aa, synthetic construct
  source 1..25: note = Seed: LNVIVHSATGFKQSSKALQRPVASD
LNVIVHSATGFKQWSAALIRPVASD

SEQ ID NO: 3443 - protein, 25 aa, synthetic construct
  source 1..25: note = Seed: LNVIVHSATGFKQSSKALQRPVASD
LNVIVHSATGFKQWSAALLRPVASD

SEQ ID NO: 3444 - protein, 25 aa, synthetic construct
  source 1..25: note = Seed: LNVIVHSATGFKQSSKALQRPVASD
LNVIVHSATGFKQWSAALMRPVASD

SEQ ID NO: 3445 - protein, 25 aa, synthetic construct
  source 1..25: note = Seed: LNVIVHSATGFKQSSKALQRPVASD
LNVIVHSATGFKQWSAALNRPVASD

SEQ ID NO: 3446 - protein, 25 aa, synthetic construct
  source 1..25: note = Seed: LNVIVHSATGFKQSSKALQRPVASD
LNVIVHSATGFKQWSAALQRPVASD

SEQ ID NO: 3447 - protein, 25 aa, synthetic construct
  source 1..25: note = Seed: LNVIVHSATGFKQSSKALQRPVASD
LNVIVHSATGFKQWSAALRRPVASD

SEQ ID NO: 3448 - protein, 25 aa, synthetic construct
  source 1..25: note = Seed: LNVIVHSATGFKQSSKALQRPVASD
LNVIVHSATGFKQWSAALSRPVASD

SEQ ID NO: 3449 - protein, 25 aa, synthetic construct
  source 1..25: note = Seed: LNVIVHSATGFKQSSKALQRPVASD
LNVIVHSATGFKQWSAALTRPVASD

SEQ ID NO: 3450 - protein, 25 aa, synthetic construct
  source 1..25: note = Seed: LNVIVHSATGFKQSSKALQRPVASD
LNVIVHSATGFKQWSAALVRPVASD

SEQ ID NO: 3451 - protein, 25 aa, synthetic construct
  source 1..25: note = Seed: LNVIVHSATGFKQSSKALQRPVASD
LNVIVHSATGFKQWSFALIRPVASD

SEQ ID NO: 3452 - protein, 25 aa, synthetic construct
  source 1..25: note = Seed: LNVIVHSATGFKQSSKALQRPVASD
LNVIVHSATGFKQWSFALLRPVASD

SEQ ID NO: 3453 - protein, 25 aa, synthetic construct
  source 1..25: note = Seed: LNVIVHSATGFKQSSKALQRPVASD
LNVIVHSATGFKQWSFALMRPVASD

SEQ ID NO: 3454 - protein, 25 aa, synthetic construct
  source 1..25: note = Seed: LNVIVHSATGFKQSSKALQRPVASD
LNVIVHSATGFKQWSFALVRPVASD

SEQ ID NO: 3455 - protein, 25 aa, synthetic construct
  source 1..25: note = Seed: LNVIVHSATGFKQSSKALQRPVASD
LNVIVHSATGFKQWSGALARPVASD

SEQ ID NO: 3456 - protein, 25 aa, synthetic construct
  source 1..25: note = Seed: LNVIVHSATGFKQSSKALQRPVASD
LNVIVHSATGFKQWSGALGRPVASD

SEQ ID NO: 3457 - protein, 25 aa, synthetic construct
  source 1..25: note = Seed: LNVIVHSATGFKQSSKALQRPVASD
LNVIVHSATGFKQWSGALIRPVASD

SEQ ID NO: 3458 - protein, 25 aa, synthetic construct
  source 1..25: note = Seed: LNVIVHSATGFKQSSKALQRPVASD
LNVIVHSATGFKQWSGALLRPVASD

SEQ ID NO: 3459 - protein, 25 aa, synthetic construct
  source 1..25: note = Seed: LNVIVHSATGFKQSSKALQRPVASD
LNVIVHSATGFKQWSGALNRPVASD

SEQ ID NO: 3460 - protein, 25 aa, synthetic construct
  source 1..25: note = Seed: LNVIVHSATGFKQSSKALQRPVASD
LNVIVHSATGFKQWSGALSRPVASD

SEQ ID NO: 3461 - protein, 25 aa, synthetic construct
  source 1..25: note = Seed: LNVIVHSATGFKQSSKALQRPVASD
LNVIVHSATGFKQWSGALTRPVASD

SEQ ID NO: 3462 - protein, 25 aa, synthetic construct
  source 1..25: note = Seed: LNVIVHSATGFKQSSKALQRPVASD
LNVIVHSATGFKQWSGALVRPVASD

SEQ ID NO: 3463 - protein, 25 aa, synthetic construct
  source 1..25: note = Seed: LNVIVHSATGFKQSSKALQRPVASD
LNVIVHSATGFKQWSIALERPVASD

SEQ ID NO: 3464 - protein, 25 aa, synthetic construct
  source 1..25: note = Seed: LNVIVHSATGFKQSSKALQRPVASD
LNVIVHSATGFKQWSIALFRPVASD

SEQ ID NO: 3465 - protein, 25 aa, synthetic construct
  source 1..25: note = Seed: LNVIVHSATGFKQSSKALQRPVASD
LNVIVHSATGFKQWSIALGRPVASD

SEQ ID NO: 3466 - protein, 25 aa, synthetic construct
  source 1..25: note = Seed: LNVIVHSATGFKQSSKALQRPVASD
LNVIVHSATGFKQWSIALHRPVASD

SEQ ID NO: 3467 - protein, 25 aa, synthetic construct
  source 1..25: note = Seed: LNVIVHSATGFKQSSKALQRPVASD
LNVIVHSATGFKQWSIALLRPVASD

SEQ ID NO: 3468 - protein, 25 aa, synthetic construct
  source 1..25: note = Seed: LNVIVHSATGFKQSSKALQRPVASD
LNVIVHSATGFKQWSIALNRPVASD

SEQ ID NO: 3469 - protein, 25 aa, synthetic construct
  source 1..25: note = Seed: LNVIVHSATGFKQSSKALQRPVASD
LNVIVHSATGFKQWSIALQRPVASD

SEQ ID NO: 3470 - protein, 25 aa, synthetic construct
  source 1..25: note = Seed: LNVIVHSATGFKQSSKALQRPVASD
LNVIVHSATGFKQWSIALRRPVASD

SEQ ID NO: 3471 - protein, 25 aa, synthetic construct
  source 1..25: note = Seed: LNVIVHSATGFKQSSKALQRPVASD
LNVIVHSATGFKQWSKALARPVASD

SEQ ID NO: 3472 - protein, 25 aa, synthetic construct
  source 1..25: note = Seed: LNVIVHSATGFKQSSKALQRPVASD
LNVIVHSATGFKQWSKALKRPVASD

SEQ ID NO: 3473 - protein, 25 aa, synthetic construct
  source 1..25: note = Seed: LNVIVHSATGFKQSSKALQRPVASD
LNVIVHSATGFKQWSKALRRPVASD

SEQ ID NO: 3474 - protein, 25 aa, synthetic construct
  source 1..25: note = Seed: LNVIVHSATGFKQSSKALQRPVASD
LNVIVHSATGFKQWSLALHRPVASD

SEQ ID NO: 3475 - protein, 25 aa, synthetic construct
  source 1..25: note = Seed: LNVIVHSATGFKQSSKALQRPVASD
LNVIVHSATGFKQWSLALIRPVASD

SEQ ID NO: 3476 - protein, 25 aa, synthetic construct
  source 1..25: note = Seed: LNVIVHSATGFKQSSKALQRPVASD
LNVIVHSATGFKQWSLALLRPVASD

SEQ ID NO: 3477 - protein, 25 aa, synthetic construct
  source 1..25: note = Seed: LNVIVHSATGFKQSSKALQRPVASD
LNVIVHSATGFKQWSLALMRPVASD

SEQ ID NO: 3478 - protein, 25 aa, synthetic construct
  source 1..25: note = Seed: LNVIVHSATGFKQSSKALQRPVASD
LNVIVHSATGFKQWSLALNRPVASD

SEQ ID NO: 3479 - protein, 25 aa, synthetic construct
  source 1..25: note = Seed: LNVIVHSATGFKQSSKALQRPVASD
LNVIVHSATGFKQWSLALQRPVASD

SEQ ID NO: 3480 - protein, 25 aa, synthetic construct
  source 1..25: note = Seed: LNVIVHSATGFKQSSKALQRPVASD
LNVIVHSATGFKQWSLALRRPVASD

SEQ ID NO: 3481 - protein, 25 aa, synthetic construct
  source 1..25: note = Seed: LNVIVHSATGFKQSSKALQRPVASD
LNVIVHSATGFKQWSMALIRPVASD

SEQ ID NO: 3482 - protein, 25 aa, synthetic construct
  source 1..25: note = Seed: LNVIVHSATGFKQSSKALQRPVASD
LNVIVHSATGFKQWSMALRRPVASD

SEQ ID NO: 3483 - protein, 25 aa, synthetic construct
  source 1..25: note = Seed: LNVIVHSATGFKQSSKALQRPVASD
LNVIVHSATGFKQWSNALARPVASD

SEQ ID NO: 3484 - protein, 25 aa, synthetic construct
  source 1..25: note = Seed: LNVIVHSATGFKQSSKALQRPVASD
LNVIVHSATGFKQWSNALSRPVASD

SEQ ID NO: 3485 - protein, 25 aa, synthetic construct
  source 1..25: note = Seed: LNVIVHSATGFKQSSKALQRPVASD
LNVIVHSATGFKQWSNALVRPVASD

SEQ ID NO: 3486 - protein, 25 aa, synthetic construct
  source 1..25: note = Seed: LNVIVHSATGFKQSSKALQRPVASD
LNVIVHSATGFKQWSPALARPVASD

SEQ ID NO: 3487 - protein, 25 aa, synthetic construct
  source 1..25: note = Seed: LNVIVHSATGFKQSSKALQRPVASD
LNVIVHSATGFKQWSPALGRPVASD

SEQ ID NO: 3488 - protein, 25 aa, synthetic construct
  source 1..25: note = Seed: LNVIVHSATGFKQSSKALQRPVASD
LNVIVHSATGFKQWSPALIRPVASD

SEQ ID NO: 3489 - protein, 25 aa, synthetic construct
  source 1..25: note = Seed: LNVIVHSATGFKQSSKALQRPVASD
LNVIVHSATGFKQWSPALLRPVASD

SEQ ID NO: 3490 - protein, 25 aa, synthetic construct
  source 1..25: note = Seed: LNVIVHSATGFKQSSKALQRPVASD
LNVIVHSATGFKQWSPALMRPVASD

SEQ ID NO: 3491 - protein, 25 aa, synthetic construct
  source 1..25: note = Seed: LNVIVHSATGFKQSSKALQRPVASD
LNVIVHSATGFKQWSPALNRPVASD

SEQ ID NO: 3492 - protein, 25 aa, synthetic construct
  source 1..25: note = Seed: LNVIVHSATGFKQSSKALQRPVASD
LNVIVHSATGFKQWSPALSRPVASD

SEQ ID NO: 3493 - protein, 25 aa, synthetic construct
  source 1..25: note = Seed: LNVIVHSATGFKQSSKALQRPVASD
LNVIVHSATGFKQWSPALTRPVASD

SEQ ID NO: 3494 - protein, 25 aa, synthetic construct
  source 1..25: note = Seed: LNVIVHSATGFKQSSKALQRPVASD
LNVIVHSATGFKQWSPALVRPVASD

SEQ ID NO: 3495 - protein, 25 aa, synthetic construct
  source 1..25: note = Seed: LNVIVHSATGFKQSSKALQRPVASD
LNVIVHSATGFKQWSRALARPVASD

SEQ ID NO: 3496 - protein, 25 aa, synthetic construct
  source 1..25: note = Seed: LNVIVHSATGFKQSSKALQRPVASD
LNVIVHSATGFKQWSRALHRPVASD

SEQ ID NO: 3497 - protein, 25 aa, synthetic construct
  source 1..25: note = Seed: LNVIVHSATGFKQSSKALQRPVASD
LNVIVHSATGFKQWSRALKRPVASD

SEQ ID NO: 3498 - protein, 25 aa, synthetic construct
  source 1..25: note = Seed: LNVIVHSATGFKQSSKALQRPVASD
LNVIVHSATGFKQWSRALRRPVASD

SEQ ID NO: 3499 - protein, 25 aa, synthetic construct
  source 1..25: note = Seed: LNVIVHSATGFKQSSKALQRPVASD
LNVIVHSATGFKQWSRALSRPVASD

SEQ ID NO: 3500 - protein, 25 aa, synthetic construct
  source 1..25: note = Seed: LNVIVHSATGFKQSSKALQRPVASD
LNVIVHSATGFKQWSRALYRPVASD

SEQ ID NO: 3501 - protein, 25 aa, synthetic construct
  source 1..25: note = Seed: LNVIVHSATGFKQSSKALQRPVASD
LNVIVHSATGFKQWSSALARPVASD

SEQ ID NO: 3502 - protein, 25 aa, synthetic construct
  source 1..25: note = Seed: LNVIVHSATGFKQSSKALQRPVASD
LNVIVHSATGFKQWSSALGRPVASD

SEQ ID NO: 3503 - protein, 25 aa, synthetic construct
  source 1..25: note = Seed: LNVIVHSATGFKQSSKALQRPVASD
LNVIVHSATGFKQWSSALIRPVASD

SEQ ID NO: 3504 - protein, 25 aa, synthetic construct
  source 1..25: note = Seed: LNVIVHSATGFKQSSKALQRPVASD
LNVIVHSATGFKQWSSALLRPVASD

SEQ ID NO: 3505 - protein, 25 aa, synthetic construct
  source 1..25: note = Seed: LNVIVHSATGFKQSSKALQRPVASD
LNVIVHSATGFKQWSSALMRPVASD

SEQ ID NO: 3506 - protein, 25 aa, synthetic construct
  source 1..25: note = Seed: LNVIVHSATGFKQSSKALQRPVASD
LNVIVHSATGFKQWSSALNRPVASD

SEQ ID NO: 3507 - protein, 25 aa, synthetic construct
  source 1..25: note = Seed: LNVIVHSATGFKQSSKALQRPVASD
LNVIVHSATGFKQWSSALSRPVASD

SEQ ID NO: 3508 - protein, 25 aa, synthetic construct
  source 1..25: note = Seed: LNVIVHSATGFKQSSKALQRPVASD
LNVIVHSATGFKQWSSALVRPVASD

SEQ ID NO: 3509 - protein, 25 aa, synthetic construct
  source 1..25: note = Seed: LNVIVHSATGFKQSSKALQRPVASD
LNVIVHSATGFKQWSTALARPVASD

SEQ ID NO: 3510 - protein, 25 aa, synthetic construct
  source 1..25: note = Seed: LNVIVHSATGFKQSSKALQRPVASD
LNVIVHSATGFKQWSTALGRPVASD

SEQ ID NO: 3511 - protein, 25 aa, synthetic construct
  source 1..25: note = Seed: LNVIVHSATGFKQSSKALQRPVASD
LNVIVHSATGFKQWSTALIRPVASD

SEQ ID NO: 3512 - protein, 25 aa, synthetic construct
  source 1..25: note = Seed: LNVIVHSATGFKQSSKALQRPVASD
LNVIVHSATGFKQWSTALLRPVASD

SEQ ID NO: 3513 - protein, 25 aa, synthetic construct
  source 1..25: note = Seed: LNVIVHSATGFKQSSKALQRPVASD
LNVIVHSATGFKQWSTALMRPVASD

SEQ ID NO: 3514 - protein, 25 aa, synthetic construct
  source 1..25: note = Seed: LNVIVHSATGFKQSSKALQRPVASD
LNVIVHSATGFKQWSTALNRPVASD

SEQ ID NO: 3515 - protein, 25 aa, synthetic construct
  source 1..25: note = Seed: LNVIVHSATGFKQSSKALQRPVASD
LNVIVHSATGFKQWSTALSRPVASD

SEQ ID NO: 3516 - protein, 25 aa, synthetic construct
  source 1..25: note = Seed: LNVIVHSATGFKQSSKALQRPVASD
LNVIVHSATGFKQWSTALTRPVASD

SEQ ID NO: 3517 - protein, 25 aa, synthetic construct
  source 1..25: note = Seed: LNVIVHSATGFKQSSKALQRPVASD
LNVIVHSATGFKQWSTALVRPVASD

SEQ ID NO: 3518 - protein, 25 aa, synthetic construct
  source 1..25: note = Seed: LNVIVHSATGFKQSSKALQRPVASD
LNVIVHSATGFKQWSVALARPVASD

SEQ ID NO: 3519 - protein, 25 aa, synthetic construct
  source 1..25: note = Seed: LNVIVHSATGFKQSSKALQRPVASD
LNVIVHSATGFKQWSVALGRPVASD

SEQ ID NO: 3520 - protein, 25 aa, synthetic construct
  source 1..25: note = Seed: LNVIVHSATGFKQSSKALQRPVASD
LNVIVHSATGFKQWSVALHRPVASD

SEQ ID NO: 3521 - protein, 25 aa, synthetic construct
  source 1..25: note = Seed: LNVIVHSATGFKQSSKALQRPVASD
LNVIVHSATGFKQWSVALIRPVASD

SEQ ID NO: 3522 - protein, 25 aa, synthetic construct
  source 1..25: note = Seed: LNVIVHSATGFKQSSKALQRPVASD
LNVIVHSATGFKQWSVALLRPVASD

SEQ ID NO: 3523 - protein, 25 aa, synthetic construct
  source 1..25: note = Seed: LNVIVHSATGFKQSSKALQRPVASD
LNVIVHSATGFKQWSVALMRPVASD

SEQ ID NO: 3524 - protein, 25 aa, synthetic construct
  source 1..25: note = Seed: LNVIVHSATGFKQSSKALQRPVASD
LNVIVHSATGFKQWSVALNRPVASD

SEQ ID NO: 3525 - protein, 25 aa, synthetic construct
  source 1..25: note = Seed: LNVIVHSATGFKQSSKALQRPVASD
LNVIVHSATGFKQWSVALQRPVASD

SEQ ID NO: 3526 - protein, 25 aa, synthetic construct
  source 1..25: note = Seed: LNVIVHSATGFKQSSKALQRPVASD
LNVIVHSATGFKQWSVALRRPVASD

SEQ ID NO: 3527 - protein, 25 aa, synthetic construct
  source 1..25: note = Seed: LNVIVHSATGFKQSSKALQRPVASD
LNVIVHSATGFKQWSVALSRPVASD

SEQ ID NO: 3528 - protein, 25 aa, synthetic construct
  source 1..25: note = Seed: LNVIVHSATGFKQSSKALQRPVASD
LNVIVHSATGFKQWSVALVRPVASD

SEQ ID NO: 3529 - protein, 25 aa, synthetic construct
  source 1..25: note = Seed: LNVIVHSATGFKQSSKALQRPVASD
LNVIVHSATGFKQYSAALARPVASD

SEQ ID NO: 3530 - protein, 25 aa, synthetic construct
  source 1..25: note = Seed: LNVIVHSATGFKQSSKALQRPVASD
LNVIVHSATGFKQYSAALCRPVASD

SEQ ID NO: 3531 - protein, 25 aa, synthetic construct
  source 1..25: note = Seed: LNVIVHSATGFKQSSKALQRPVASD
LNVIVHSATGFKQYSAALFRPVASD

SEQ ID NO: 3532 - protein, 25 aa, synthetic construct
  source 1..25: note = Seed: LNVIVHSATGFKQSSKALQRPVASD
LNVIVHSATGFKQYSAALGRPVASD

SEQ ID NO: 3533 - protein, 25 aa, synthetic construct
  source 1..25: note = Seed: LNVIVHSATGFKQSSKALQRPVASD
LNVIVHSATGFKQYSAALHRPVASD

SEQ ID NO: 3534 - protein, 25 aa, synthetic construct
  source 1..25: note = Seed: LNVIVHSATGFKQSSKALQRPVASD
LNVIVHSATGFKQYSAALIRPVASD

SEQ ID NO: 3535 - protein, 25 aa, synthetic construct
  source 1..25: note = Seed: LNVIVHSATGFKQSSKALQRPVASD
LNVIVHSATGFKQYSAALKRPVASD

SEQ ID NO: 3536 - protein, 25 aa, synthetic construct
  source 1..25: note = Seed: LNVIVHSATGFKQSSKALQRPVASD
LNVIVHSATGFKQYSAALLRPVASD

SEQ ID NO: 3537 - protein, 25 aa, synthetic construct
  source 1..25: note = Seed: LNVIVHSATGFKQSSKALQRPVASD
LNVIVHSATGFKQYSAALMRPVASD

SEQ ID NO: 3538 - protein, 25 aa, synthetic construct
  source 1..25: note = Seed: LNVIVHSATGFKQSSKALQRPVASD
LNVIVHSATGFKQYSAALQRPVASD

SEQ ID NO: 3539 - protein, 25 aa, synthetic construct
  source 1..25: note = Seed: LNVIVHSATGFKQSSKALQRPVASD
LNVIVHSATGFKQYSAALRRPVASD

SEQ ID NO: 3540 - protein, 25 aa, synthetic construct
  source 1..25: note = Seed: LNVIVHSATGFKQSSKALQRPVASD
LNVIVHSATGFKQYSAALTRPVASD

SEQ ID NO: 3541 - protein, 25 aa, synthetic construct
  source 1..25: note = Seed: LNVIVHSATGFKQSSKALQRPVASD
LNVIVHSATGFKQYSAALVRPVASD

SEQ ID NO: 3542 - protein, 25 aa, synthetic construct
  source 1..25: note = Seed: LNVIVHSATGFKQSSKALQRPVASD
LNVIVHSATGFKQYSFALVRPVASD

SEQ ID NO: 3543 - protein, 25 aa, synthetic construct
  source 1..25: note = Seed: LNVIVHSATGFKQSSKALQRPVASD
LNVIVHSATGFKQYSGALARPVASD

SEQ ID NO: 3544 - protein, 25 aa, synthetic construct
  source 1..25: note = Seed: LNVIVHSATGFKQSSKALQRPVASD
LNVIVHSATGFKQYSGALIRPVASD

SEQ ID NO: 3545 - protein, 25 aa, synthetic construct
  source 1..25: note = Seed: LNVIVHSATGFKQSSKALQRPVASD
LNVIVHSATGFKQYSGALLRPVASD

SEQ ID NO: 3546 - protein, 25 aa, synthetic construct
  source 1..25: note = Seed: LNVIVHSATGFKQSSKALQRPVASD
LNVIVHSATGFKQYSGALSRPVASD

SEQ ID NO: 3547 - protein, 25 aa, synthetic construct
  source 1..25: note = Seed: LNVIVHSATGFKQSSKALQRPVASD
LNVIVHSATGFKQYSGALVRPVASD

SEQ ID NO: 3548 - protein, 25 aa, synthetic construct
  source 1..25: note = Seed: LNVIVHSATGFKQSSKALQRPVASD
LNVIVHSATGFKQYSHALLRPVASD

SEQ ID NO: 3549 - protein, 25 aa, synthetic construct
  source 1..25: note = Seed: LNVIVHSATGFKQSSKALQRPVASD
LNVIVHSATGFKQYSIALRRPVASD

SEQ ID NO: 3550 - protein, 25 aa, synthetic construct
  source 1..25: note = Seed: LNVIVHSATGFKQSSKALQRPVASD
LNVIVHSATGFKQYSKALARPVASD

SEQ ID NO: 3551 - protein, 25 aa, synthetic construct
  source 1..25: note = Seed: LNVIVHSATGFKQSSKALQRPVASD
LNVIVHSATGFKQYSKALKRPVASD

SEQ ID NO: 3552 - protein, 25 aa, synthetic construct
  source 1..25: note = Seed: LNVIVHSATGFKQSSKALQRPVASD
LNVIVHSATGFKQYSKALRRPVASD

SEQ ID NO: 3553 - protein, 25 aa, synthetic construct
  source 1..25: note = Seed: LNVIVHSATGFKQSSKALQRPVASD
LNVIVHSATGFKQYSKALSRPVASD

SEQ ID NO: 3554 - protein, 25 aa, synthetic construct
  source 1..25: note = Seed: LNVIVHSATGFKQSSKALQRPVASD
LNVIVHSATGFKQYSLALMRPVASD

SEQ ID NO: 3555 - protein, 25 aa, synthetic construct
  source 1..25: note = Seed: LNVIVHSATGFKQSSKALQRPVASD
LNVIVHSATGFKQYSNALARPVASD

SEQ ID NO: 3556 - protein, 25 aa, synthetic construct
  source 1..25: note = Seed: LNVIVHSATGFKQSSKALQRPVASD
LNVIVHSATGFKQYSNALIRPVASD

SEQ ID NO: 3557 - protein, 25 aa, synthetic construct
  source 1..25: note = Seed: LNVIVHSATGFKQSSKALQRPVASD
LNVIVHSATGFKQYSNALLRPVASD

SEQ ID NO: 3558 - protein, 25 aa, synthetic construct
  source 1..25: note = Seed: LNVIVHSATGFKQSSKALQRPVASD
LNVIVHSATGFKQYSNALSRPVASD

SEQ ID NO: 3559 - protein, 25 aa, synthetic construct
  source 1..25: note = Seed: LNVIVHSATGFKQSSKALQRPVASD
LNVIVHSATGFKQYSNALVRPVASD

SEQ ID NO: 3560 - protein, 25 aa, synthetic construct
  source 1..25: note = Seed: LNVIVHSATGFKQSSKALQRPVASD
LNVIVHSATGFKQYSPALARPVASD

SEQ ID NO: 3561 - protein, 25 aa, synthetic construct
  source 1..25: note = Seed: LNVIVHSATGFKQSSKALQRPVASD
LNVIVHSATGFKQYSPALGRPVASD

SEQ ID NO: 3562 - protein, 25 aa, synthetic construct
  source 1..25: note = Seed: LNVIVHSATGFKQSSKALQRPVASD
LNVIVHSATGFKQYSPALIRPVASD

SEQ ID NO: 3563 - protein, 25 aa, synthetic construct
  source 1..25: note = Seed: LNVIVHSATGFKQSSKALQRPVASD
LNVIVHSATGFKQYSPALLRPVASD

SEQ ID NO: 3564 - protein, 25 aa, synthetic construct
  source 1..25: note = Seed: LNVIVHSATGFKQSSKALQRPVASD
LNVIVHSATGFKQYSPALMRPVASD

SEQ ID NO: 3565 - protein, 25 aa, synthetic construct
  source 1..25: note = Seed: LNVIVHSATGFKQSSKALQRPVASD
LNVIVHSATGFKQYSPALNRPVASD

SEQ ID NO: 3566 - protein, 25 aa, synthetic construct
  source 1..25: note = Seed: LNVIVHSATGFKQSSKALQRPVASD
LNVIVHSATGFKQYSRALARPVASD

SEQ ID NO: 3567 - protein, 25 aa, synthetic construct
  source 1..25: note = Seed: LNVIVHSATGFKQSSKALQRPVASD
LNVIVHSATGFKQYSRALHRPVASD

SEQ ID NO: 3568 - protein, 25 aa, synthetic construct
  source 1..25: note = Seed: LNVIVHSATGFKQSSKALQRPVASD
LNVIVHSATGFKQYSRALKRPVASD

SEQ ID NO: 3569 - protein, 25 aa, synthetic construct
  source 1..25: note = Seed: LNVIVHSATGFKQSSKALQRPVASD
LNVIVHSATGFKQYSRALRRPVASD

SEQ ID NO: 3570 - protein, 25 aa, synthetic construct
  source 1..25: note = Seed: LNVIVHSATGFKQSSKALQRPVASD
LNVIVHSATGFKQYSRALSRPVASD

SEQ ID NO: 3571 - protein, 25 aa, synthetic construct
  source 1..25: note = Seed: LNVIVHSATGFKQSSKALQRPVASD
LNVIVHSATGFKQYSSALARPVASD

SEQ ID NO: 3572 - protein, 25 aa, synthetic construct
  source 1..25: note = Seed: LNVIVHSATGFKQSSKALQRPVASD
LNVIVHSATGFKQYSSALFRPVASD

SEQ ID NO: 3573 - protein, 25 aa, synthetic construct
  source 1..25: note = Seed: LNVIVHSATGFKQSSKALQRPVASD
LNVIVHSATGFKQYSSALGRPVASD

SEQ ID NO: 3574 - protein, 25 aa, synthetic construct
  source 1..25: note = Seed: LNVIVHSATGFKQSSKALQRPVASD
LNVIVHSATGFKQYSSALIRPVASD

SEQ ID NO: 3575 - protein, 25 aa, synthetic construct
  source 1..25: note = Seed: LNVIVHSATGFKQSSKALQRPVASD
LNVIVHSATGFKQYSSALLRPVASD

SEQ ID NO: 3576 - protein, 25 aa, synthetic construct
  source 1..25: note = Seed: LNVIVHSATGFKQSSKALQRPVASD
LNVIVHSATGFKQYSSALMRPVASD

SEQ ID NO: 3577 - protein, 25 aa, synthetic construct
  source 1..25: note = Seed: LNVIVHSATGFKQSSKALQRPVASD
LNVIVHSATGFKQYSSALNRPVASD

SEQ ID NO: 3578 - protein, 25 aa, synthetic construct
  source 1..25: note = Seed: LNVIVHSATGFKQSSKALQRPVASD
LNVIVHSATGFKQYSSALRRPVASD

SEQ ID NO: 3579 - protein, 25 aa, synthetic construct
  source 1..25: note = Seed: LNVIVHSATGFKQSSKALQRPVASD
LNVIVHSATGFKQYSSALSRPVASD

SEQ ID NO: 3580 - protein, 25 aa, synthetic construct
  source 1..25: note = Seed: LNVIVHSATGFKQSSKALQRPVASD
LNVIVHSATGFKQYSSALTRPVASD

SEQ ID NO: 3581 - protein, 25 aa, synthetic construct
  source 1..25: note = Seed: LNVIVHSATGFKQSSKALQRPVASD
LNVIVHSATGFKQYSSALVRPVASD

SEQ ID NO: 3582 - protein, 25 aa, synthetic construct
  source 1..25: note = Seed: LNVIVHSATGFKQSSKALQRPVASD
LNVIVHSATGFKQYSTALARPVASD

SEQ ID NO: 3583 - protein, 25 aa, synthetic construct
  source 1..25: note = Seed: LNVIVHSATGFKQSSKALQRPVASD
LNVIVHSATGFKQYSTALGRPVASD

SEQ ID NO: 3584 - protein, 25 aa, synthetic construct
  source 1..25: note = Seed: LNVIVHSATGFKQSSKALQRPVASD
LNVIVHSATGFKQYSTALIRPVASD

SEQ ID NO: 3585 - protein, 25 aa, synthetic construct
  source 1..25: note = Seed: LNVIVHSATGFKQSSKALQRPVASD
LNVIVHSATGFKQYSTALLRPVASD

SEQ ID NO: 3586 - protein, 25 aa, synthetic construct
  source 1..25: note = Seed: LNVIVHSATGFKQSSKALQRPVASD
LNVIVHSATGFKQYSTALMRPVASD

SEQ ID NO: 3587 - protein, 25 aa, synthetic construct
  source 1..25: note = Seed: LNVIVHSATGFKQSSKALQRPVASD
LNVIVHSATGFKQYSTALNRPVASD

SEQ ID NO: 3588 - protein, 25 aa, synthetic construct
  source 1..25: note = Seed: LNVIVHSATGFKQSSKALQRPVASD
LNVIVHSATGFKQYSTALTRPVASD

SEQ ID NO: 3589 - protein, 25 aa, synthetic construct
  source 1..25: note = Seed: LNVIVHSATGFKQSSKALQRPVASD
LNVIVHSATGFKQYSTALVRPVASD

SEQ ID NO: 3590 - protein, 25 aa, synthetic construct
  source 1..25: note = Seed: LNVIVHSATGFKQSSKALQRPVASD
LNVIVHSATGFKQYSVALERPVASD

SEQ ID NO: 3591 - protein, 25 aa, synthetic construct
  source 1..25: note = Seed: LNVIVHSATGFKQSSKALQRPVASD
LNVIVHSATGFKQYSVALHRPVASD

SEQ ID NO: 3592 - protein, 25 aa, synthetic construct
  source 1..25: note = Seed: LNVIVHSATGFKQSSKALQRPVASD
LNVIVHSATGFKQYSVALLRPVASD

SEQ ID NO: 3593 - protein, 25 aa, synthetic construct
  source 1..25: note = Seed: LNVIVHSATGFKQSSKALQRPVASD
LNVIVHSATGFKQYSVALQRPVASD

SEQ ID NO: 3594 - protein, 25 aa, synthetic construct
  source 1..25: note = Seed: LNVIVHSATGFKQSSKALQRPVASD
LNVIVHSATGFKQYSVALRRPVASD

SEQ ID NO: 3595 - protein, 25 aa, synthetic construct
  source 1..25: note = Seed: LNVIVHSATGFKQSSKALQRPVASD
LNVIVHSATGHKQLSAALARPVASD

SEQ ID NO: 3596 - protein, 25 aa, synthetic construct
  source 1..25: note = Seed: LNVIVHSATGFKQSSKALQRPVASD
LNVIVHSATGHKQLSAALIRPVASD

SEQ ID NO: 3597 - protein, 25 aa, synthetic construct
  source 1..25: note = Seed: LNVIVHSATGFKQSSKALQRPVASD
LNVIVHSATGHKQLSAALLRPVASD

SEQ ID NO: 3598 - protein, 25 aa, synthetic construct
  source 1..25: note = Seed: LNVIVHSATGFKQSSKALQRPVASD
LNVIVHSATGHKQLSAALSRPVASD

SEQ ID NO: 3599 - protein, 25 aa, synthetic construct
  source 1..25: note = Seed: LNVIVHSATGFKQSSKALQRPVASD
LNVIVHSATGHKQLSAALVRPVASD

SEQ ID NO: 3600 - protein, 25 aa, synthetic construct
  source 1..25: note = Seed: LNVIVHSATGFKQSSKALQRPVASD
LNVIVHSATGHKQLSGALIRPVASD

SEQ ID NO: 3601 - protein, 25 aa, synthetic construct
  source 1..25: note = Seed: LNVIVHSATGFKQSSKALQRPVASD
LNVIVHSATGHKQLSGALVRPVASD

SEQ ID NO: 3602 - protein, 25 aa, synthetic construct
  source 1..25: note = Seed: LNVIVHSATGFKQSSKALQRPVASD
LNVIVHSATGHKQLSSALIRPVASD

SEQ ID NO: 3603 - protein, 25 aa, synthetic construct
  source 1..25: note = Seed: LNVIVHSATGFKQSSKALQRPVASD
LNVIVHSATGHKQLSSALVRPVASD

SEQ ID NO: 3604 - protein, 25 aa, synthetic construct
  source 1..25: note = Seed: LNVIVHSATGFKQSSKALQRPVASD
LNVIVHSATGHKQLSTALARPVASD

SEQ ID NO: 3605 - protein, 25 aa, synthetic construct
  source 1..25: note = Seed: LNVIVHSATGFKQSSKALQRPVASD
LNVIVHSATGHKQMSAALARPVASD

SEQ ID NO: 3606 - protein, 25 aa, synthetic construct
  source 1..25: note = Seed: LNVIVHSATGFKQSSKALQRPVASD
LNVIVHSATGHKQMSAALIRPVASD

SEQ ID NO: 3607 - protein, 25 aa, synthetic construct
  source 1..25: note = Seed: LNVIVHSATGFKQSSKALQRPVASD
LNVIVHSATGHKQMSAALLRPVASD

SEQ ID NO: 3608 - protein, 25 aa, synthetic construct
  source 1..25: note = Seed: LNVIVHSATGFKQSSKALQRPVASD
LNVIVHSATGHKQMSAALVRPVASD

SEQ ID NO: 3609 - protein, 25 aa, synthetic construct
  source 1..25: note = Seed: LNVIVHSATGFKQSSKALQRPVASD
LNVIVHSATGHKQMSGALIRPVASD

SEQ ID NO: 3610 - protein, 25 aa, synthetic construct
  source 1..25: note = Seed: LNVIVHSATGFKQSSKALQRPVASD
LNVIVHSATGHKQMSGALVRPVASD

SEQ ID NO: 3611 - protein, 25 aa, synthetic construct
  source 1..25: note = Seed: LNVIVHSATGFKQSSKALQRPVASD
LNVIVHSATGHKQMSSALVRPVASD

SEQ ID NO: 3612 - protein, 25 aa, synthetic construct
  source 1..25: note = Seed: LNVIVHSATGFKQSSKALQRPVASD
LNVIVHSATGHKQMSVALARPVASD

SEQ ID NO: 3613 - protein, 25 aa, synthetic construct
  source 1..25: note = Seed: LNVIVHSATGFKQSSKALQRPVASD
LNVIVHSATGHKQMSVALIRPVASD

SEQ ID NO: 3614 - protein, 25 aa, synthetic construct
  source 1..25: note = Seed: LNVIVHSATGFKQSSKALQRPVASD
LNVIVHSATGHKQMSVALVRPVASD

SEQ ID NO: 3615 - protein, 25 aa, synthetic construct
  source 1..25: note = Seed: LNVIVHSATGFKQSSKALQRPVASD
LNVIVHSATGIKQASAALARPVASD

SEQ ID NO: 3616 - protein, 25 aa, synthetic construct
  source 1..25: note = Seed: LNVIVHSATGFKQSSKALQRPVASD
LNVIVHSATGIKQASAALCRPVASD

SEQ ID NO: 3617 - protein, 25 aa, synthetic construct
  source 1..25: note = Seed: LNVIVHSATGFKQSSKALQRPVASD
LNVIVHSATGIKQASAALFRPVASD

SEQ ID NO: 3618 - protein, 25 aa, synthetic construct
  source 1..25: note = Seed: LNVIVHSATGFKQSSKALQRPVASD
LNVIVHSATGIKQASAALGRPVASD

SEQ ID NO: 3619 - protein, 25 aa, synthetic construct
  source 1..25: note = Seed: LNVIVHSATGFKQSSKALQRPVASD
LNVIVHSATGIKQASAALHRPVASD

SEQ ID NO: 3620 - protein, 25 aa, synthetic construct
  source 1..25: note = Seed: LNVIVHSATGFKQSSKALQRPVASD
LNVIVHSATGIKQASAALIRPVASD

SEQ ID NO: 3621 - protein, 25 aa, synthetic construct
  source 1..25: note = Seed: LNVIVHSATGFKQSSKALQRPVASD
LNVIVHSATGIKQASAALLRPVASD

SEQ ID NO: 3622 - protein, 25 aa, synthetic construct
  source 1..25: note = Seed: LNVIVHSATGFKQSSKALQRPVASD
LNVIVHSATGIKQASAALMRPVASD

SEQ ID NO: 3623 - protein, 25 aa, synthetic construct
  source 1..25: note = Seed: LNVIVHSATGFKQSSKALQRPVASD
LNVIVHSATGIKQASAALNRPVASD

SEQ ID NO: 3624 - protein, 25 aa, synthetic construct
  source 1..25: note = Seed: LNVIVHSATGFKQSSKALQRPVASD
LNVIVHSATGIKQASAALRRPVASD

SEQ ID NO: 3625 - protein, 25 aa, synthetic construct
  source 1..25: note = Seed: LNVIVHSATGFKQSSKALQRPVASD
LNVIVHSATGIKQASAALSRPVASD

SEQ ID NO: 3626 - protein, 25 aa, synthetic construct
  source 1..25: note = Seed: LNVIVHSATGFKQSSKALQRPVASD
LNVIVHSATGIKQASAALTRPVASD

SEQ ID NO: 3627 - protein, 25 aa, synthetic construct
  source 1..25: note = Seed: LNVIVHSATGFKQSSKALQRPVASD
LNVIVHSATGIKQASAALVRPVASD

SEQ ID NO: 3628 - protein, 25 aa, synthetic construct
  source 1..25: note = Seed: LNVIVHSATGFKQSSKALQRPVASD
LNVIVHSATGIKQASGALARPVASD

SEQ ID NO: 3629 - protein, 25 aa, synthetic construct
  source 1..25: note = Seed: LNVIVHSATGFKQSSKALQRPVASD
LNVIVHSATGIKQASGALGRPVASD

SEQ ID NO: 3630 - protein, 25 aa, synthetic construct
  source 1..25: note = Seed: LNVIVHSATGFKQSSKALQRPVASD
LNVIVHSATGIKQASGALIRPVASD

SEQ ID NO: 3631 - protein, 25 aa, synthetic construct
  source 1..25: note = Seed: LNVIVHSATGFKQSSKALQRPVASD
LNVIVHSATGIKQASGALLRPVASD

SEQ ID NO: 3632 - protein, 25 aa, synthetic construct
  source 1..25: note = Seed: LNVIVHSATGFKQSSKALQRPVASD
LNVIVHSATGIKQASGALMRPVASD

SEQ ID NO: 3633 - protein, 25 aa, synthetic construct
  source 1..25: note = Seed: LNVIVHSATGFKQSSKALQRPVASD
LNVIVHSATGIKQASGALSRPVASD

SEQ ID NO: 3634 - protein, 25 aa, synthetic construct
  source 1..25: note = Seed: LNVIVHSATGFKQSSKALQRPVASD
LNVIVHSATGIKQASGALTRPVASD

SEQ ID NO: 3635 - protein, 25 aa, synthetic construct
  source 1..25: note = Seed: LNVIVHSATGFKQSSKALQRPVASD
LNVIVHSATGIKQASGALVRPVASD

SEQ ID NO: 3636 - protein, 25 aa, synthetic construct
  source 1..25: note = Seed: LNVIVHSATGFKQSSKALQRPVASD
LNVIVHSATGIKQASIALARPVASD

SEQ ID NO: 3637 - protein, 25 aa, synthetic construct
  source 1..25: note = Seed: LNVIVHSATGFKQSSKALQRPVASD
LNVIVHSATGIKQASIALIRPVASD

SEQ ID NO: 3638 - protein, 25 aa, synthetic construct
  source 1..25: note = Seed: LNVIVHSATGFKQSSKALQRPVASD
LNVIVHSATGIKQASIALNRPVASD

SEQ ID NO: 3639 - protein, 25 aa, synthetic construct
  source 1..25: note = Seed: LNVIVHSATGFKQSSKALQRPVASD
LNVIVHSATGIKQASIALQRPVASD

SEQ ID NO: 3640 - protein, 25 aa, synthetic construct
  source 1..25: note = Seed: LNVIVHSATGFKQSSKALQRPVASD
LNVIVHSATGIKQASIALRRPVASD

SEQ ID NO: 3641 - protein, 25 aa, synthetic construct
  source 1..25: note = Seed: LNVIVHSATGFKQSSKALQRPVASD
LNVIVHSATGIKQASIALSRPVASD

SEQ ID NO: 3642 - protein, 25 aa, synthetic construct
  source 1..25: note = Seed: LNVIVHSATGFKQSSKALQRPVASD
LNVIVHSATGIKQASIALTRPVASD

SEQ ID NO: 3643 - protein, 25 aa, synthetic construct
  source 1..25: note = Seed: LNVIVHSATGFKQSSKALQRPVASD
LNVIVHSATGIKQASIALVRPVASD

SEQ ID NO: 3644 - protein, 25 aa, synthetic construct
  source 1..25: note = Seed: LNVIVHSATGFKQSSKALQRPVASD
LNVIVHSATGIKQASKALARPVASD

SEQ ID NO: 3645 - protein, 25 aa, synthetic construct
  source 1..25: note = Seed: LNVIVHSATGFKQSSKALQRPVASD
LNVIVHSATGIKQASKALFRPVASD

SEQ ID NO: 3646 - protein, 25 aa, synthetic construct
  source 1..25: note = Seed: LNVIVHSATGFKQSSKALQRPVASD
LNVIVHSATGIKQASKALGRPVASD

SEQ ID NO: 3647 - protein, 25 aa, synthetic construct
  source 1..25: note = Seed: LNVIVHSATGFKQSSKALQRPVASD
LNVIVHSATGIKQASKALHRPVASD

SEQ ID NO: 3648 - protein, 25 aa, synthetic construct
  source 1..25: note = Seed: LNVIVHSATGFKQSSKALQRPVASD
LNVIVHSATGIKQASKALIRPVASD

SEQ ID NO: 3649 - protein, 25 aa, synthetic construct
  source 1..25: note = Seed: LNVIVHSATGFKQSSKALQRPVASD
LNVIVHSATGIKQASKALKRPVASD

SEQ ID NO: 3650 - protein, 25 aa, synthetic construct
  source 1..25: note = Seed: LNVIVHSATGFKQSSKALQRPVASD
LNVIVHSATGIKQASKALLRPVASD

SEQ ID NO: 3651 - protein, 25 aa, synthetic construct
  source 1..25: note = Seed: LNVIVHSATGFKQSSKALQRPVASD
LNVIVHSATGIKQASKALMRPVASD

SEQ ID NO: 3652 - protein, 25 aa, synthetic construct
  source 1..25: note = Seed: LNVIVHSATGFKQSSKALQRPVASD
LNVIVHSATGIKQASKALQRPVASD

SEQ ID NO: 3653 - protein, 25 aa, synthetic construct
  source 1..25: note = Seed: LNVIVHSATGFKQSSKALQRPVASD
LNVIVHSATGIKQASKALRRPVASD

SEQ ID NO: 3654 - protein, 25 aa, synthetic construct
  source 1..25: note = Seed: LNVIVHSATGFKQSSKALQRPVASD
LNVIVHSATGIKQASKALSRPVASD

SEQ ID NO: 3655 - protein, 25 aa, synthetic construct
  source 1..25: note = Seed: LNVIVHSATGFKQSSKALQRPVASD
LNVIVHSATGIKQASKALTRPVASD

SEQ ID NO: 3656 - protein, 25 aa, synthetic construct
  source 1..25: note = Seed: LNVIVHSATGFKQSSKALQRPVASD
LNVIVHSATGIKQASKALVRPVASD

SEQ ID NO: 3657 - protein, 25 aa, synthetic construct
  source 1..25: note = Seed: LNVIVHSATGFKQSSKALQRPVASD
LNVIVHSATGIKQASKALYRPVASD

SEQ ID NO: 3658 - protein, 25 aa, synthetic construct
  source 1..25: note = Seed: LNVIVHSATGFKQSSKALQRPVASD
LNVIVHSATGIKQASLALARPVASD

SEQ ID NO: 3659 - protein, 25 aa, synthetic construct
  source 1..25: note = Seed: LNVIVHSATGFKQSSKALQRPVASD
LNVIVHSATGIKQASLALNRPVASD

SEQ ID NO: 3660 - protein, 25 aa, synthetic construct
  source 1..25: note = Seed: LNVIVHSATGFKQSSKALQRPVASD
LNVIVHSATGIKQASLALSRPVASD

SEQ ID NO: 3661 - protein, 25 aa, synthetic construct
  source 1..25: note = Seed: LNVIVHSATGFKQSSKALQRPVASD
LNVIVHSATGIKQASLALVRPVASD

SEQ ID NO: 3662 - protein, 25 aa, synthetic construct
  source 1..25: note = Seed: LNVIVHSATGFKQSSKALQRPVASD
LNVIVHSATGIKQASMALARPVASD

SEQ ID NO: 3663 - protein, 25 aa, synthetic construct
  source 1..25: note = Seed: LNVIVHSATGFKQSSKALQRPVASD
LNVIVHSATGIKQASMALSRPVASD

SEQ ID NO: 3664 - protein, 25 aa, synthetic construct
  source 1..25: note = Seed: LNVIVHSATGFKQSSKALQRPVASD
LNVIVHSATGIKQASNALARPVASD

SEQ ID NO: 3665 - protein, 25 aa, synthetic construct
  source 1..25: note = Seed: LNVIVHSATGFKQSSKALQRPVASD
LNVIVHSATGIKQASNALFRPVASD

SEQ ID NO: 3666 - protein, 25 aa, synthetic construct
  source 1..25: note = Seed: LNVIVHSATGFKQSSKALQRPVASD
LNVIVHSATGIKQASNALIRPVASD

SEQ ID NO: 3667 - protein, 25 aa, synthetic construct
  source 1..25: note = Seed: LNVIVHSATGFKQSSKALQRPVASD
LNVIVHSATGIKQASNALLRPVASD

SEQ ID NO: 3668 - protein, 25 aa, synthetic construct
  source 1..25: note = Seed: LNVIVHSATGFKQSSKALQRPVASD
LNVIVHSATGIKQASNALSRPVASD

SEQ ID NO: 3669 - protein, 25 aa, synthetic construct
  source 1..25: note = Seed: LNVIVHSATGFKQSSKALQRPVASD
LNVIVHSATGIKQASNALTRPVASD

SEQ ID NO: 3670 - protein, 25 aa, synthetic construct
  source 1..25: note = Seed: LNVIVHSATGFKQSSKALQRPVASD
LNVIVHSATGIKQASNALVRPVASD

SEQ ID NO: 3671 - protein, 25 aa, synthetic construct
  source 1..25: note = Seed: LNVIVHSATGFKQSSKALQRPVASD
LNVIVHSATGIKQASNALYRPVASD

SEQ ID NO: 3672 - protein, 25 aa, synthetic construct
  source 1..25: note = Seed: LNVIVHSATGFKQSSKALQRPVASD
LNVIVHSATGIKQASPALARPVASD

SEQ ID NO: 3673 - protein, 25 aa, synthetic construct
  source 1..25: note = Seed: LNVIVHSATGFKQSSKALQRPVASD
LNVIVHSATGIKQASPALIRPVASD

SEQ ID NO: 3674 - protein, 25 aa, synthetic construct
  source 1..25: note = Seed: LNVIVHSATGFKQSSKALQRPVASD
LNVIVHSATGIKQASPALLRPVASD

SEQ ID NO: 3675 - protein, 25 aa, synthetic construct
  source 1..25: note = Seed: LNVIVHSATGFKQSSKALQRPVASD
LNVIVHSATGIKQASPALMRPVASD

SEQ ID NO: 3676 - protein, 25 aa, synthetic construct
  source 1..25: note = Seed: LNVIVHSATGFKQSSKALQRPVASD
LNVIVHSATGIKQASPALNRPVASD

SEQ ID NO: 3677 - protein, 25 aa, synthetic construct
  source 1..25: note = Seed: LNVIVHSATGFKQSSKALQRPVASD
LNVIVHSATGIKQASPALSRPVASD

SEQ ID NO: 3678 - protein, 25 aa, synthetic construct
  source 1..25: note = Seed: LNVIVHSATGFKQSSKALQRPVASD
LNVIVHSATGIKQASPALTRPVASD

SEQ ID NO: 3679 - protein, 25 aa, synthetic construct
  source 1..25: note = Seed: LNVIVHSATGFKQSSKALQRPVASD
LNVIVHSATGIKQASPALVRPVASD

SEQ ID NO: 3680 - protein, 25 aa, synthetic construct
  source 1..25: note = Seed: LNVIVHSATGFKQSSKALQRPVASD
LNVIVHSATGIKQASRALARPVASD

SEQ ID NO: 3681 - protein, 25 aa, synthetic construct
  source 1..25: note = Seed: LNVIVHSATGFKQSSKALQRPVASD
LNVIVHSATGIKQASRALFRPVASD

SEQ ID NO: 3682 - protein, 25 aa, synthetic construct
  source 1..25: note = Seed: LNVIVHSATGFKQSSKALQRPVASD
LNVIVHSATGIKQASRALGRPVASD

SEQ ID NO: 3683 - protein, 25 aa, synthetic construct
  source 1..25: note = Seed: LNVIVHSATGFKQSSKALQRPVASD
LNVIVHSATGIKQASRALHRPVASD

SEQ ID NO: 3684 - protein, 25 aa, synthetic construct
  source 1..25: note = Seed: LNVIVHSATGFKQSSKALQRPVASD
LNVIVHSATGIKQASRALIRPVASD

SEQ ID NO: 3685 - protein, 25 aa, synthetic construct
  source 1..25: note = Seed: LNVIVHSATGFKQSSKALQRPVASD
LNVIVHSATGIKQASRALKRPVASD

SEQ ID NO: 3686 - protein, 25 aa, synthetic construct
  source 1..25: note = Seed: LNVIVHSATGFKQSSKALQRPVASD
LNVIVHSATGIKQASRALLRPVASD

SEQ ID NO: 3687 - protein, 25 aa, synthetic construct
  source 1..25: note = Seed: LNVIVHSATGFKQSSKALQRPVASD
LNVIVHSATGIKQASRALMRPVASD

SEQ ID NO: 3688 - protein, 25 aa, synthetic construct
  source 1..25: note = Seed: LNVIVHSATGFKQSSKALQRPVASD
LNVIVHSATGIKQASRALNRPVASD

SEQ ID NO: 3689 - protein, 25 aa, synthetic construct
  source 1..25: note = Seed: LNVIVHSATGFKQSSKALQRPVASD
LNVIVHSATGIKQASRALQRPVASD

SEQ ID NO: 3690 - protein, 25 aa, synthetic construct
  source 1..25: note = Seed: LNVIVHSATGFKQSSKALQRPVASD
LNVIVHSATGIKQASRALRRPVASD

SEQ ID NO: 3691 - protein, 25 aa, synthetic construct
  source 1..25: note = Seed: LNVIVHSATGFKQSSKALQRPVASD
LNVIVHSATGIKQASRALSRPVASD

SEQ ID NO: 3692 - protein, 25 aa, synthetic construct
  source 1..25: note = Seed: LNVIVHSATGFKQSSKALQRPVASD
LNVIVHSATGIKQASRALTRPVASD

SEQ ID NO: 3693 - protein, 25 aa, synthetic construct
  source 1..25: note = Seed: LNVIVHSATGFKQSSKALQRPVASD
LNVIVHSATGIKQASRALVRPVASD

SEQ ID NO: 3694 - protein, 25 aa, synthetic construct
  source 1..25: note = Seed: LNVIVHSATGFKQSSKALQRPVASD
LNVIVHSATGIKQASRALYRPVASD

SEQ ID NO: 3695 - protein, 25 aa, synthetic construct
  source 1..25: note = Seed: LNVIVHSATGFKQSSKALQRPVASD
LNVIVHSATGIKQASSALARPVASD

SEQ ID NO: 3696 - protein, 25 aa, synthetic construct
  source 1..25: note = Seed: LNVIVHSATGFKQSSKALQRPVASD
LNVIVHSATGIKQASSALFRPVASD

SEQ ID NO: 3697 - protein, 25 aa, synthetic construct
  source 1..25: note = Seed: LNVIVHSATGFKQSSKALQRPVASD
LNVIVHSATGIKQASSALGRPVASD

SEQ ID NO: 3698 - protein, 25 aa, synthetic construct
  source 1..25: note = Seed: LNVIVHSATGFKQSSKALQRPVASD
LNVIVHSATGIKQASSALIRPVASD

SEQ ID NO: 3699 - protein, 25 aa, synthetic construct
  source 1..25: note = Seed: LNVIVHSATGFKQSSKALQRPVASD
LNVIVHSATGIKQASSALLRPVASD

SEQ ID NO: 3700 - protein, 25 aa, synthetic construct
  source 1..25: note = Seed: LNVIVHSATGFKQSSKALQRPVASD
LNVIVHSATGIKQASSALMRPVASD

SEQ ID NO: 3701 - protein, 25 aa, synthetic construct
  source 1..25: note = Seed: LNVIVHSATGFKQSSKALQRPVASD
LNVIVHSATGIKQASSALNRPVASD

SEQ ID NO: 3702 - protein, 25 aa, synthetic construct
  source 1..25: note = Seed: LNVIVHSATGFKQSSKALQRPVASD
LNVIVHSATGIKQASSALSRPVASD

SEQ ID NO: 3703 - protein, 25 aa, synthetic construct
  source 1..25: note = Seed: LNVIVHSATGFKQSSKALQRPVASD
LNVIVHSATGIKQASSALTRPVASD

SEQ ID NO: 3704 - protein, 25 aa, synthetic construct
  source 1..25: note = Seed: LNVIVHSATGFKQSSKALQRPVASD
LNVIVHSATGIKQASSALVRPVASD

SEQ ID NO: 3705 - protein, 25 aa, synthetic construct
  source 1..25: note = Seed: LNVIVHSATGFKQSSKALQRPVASD
LNVIVHSATGIKQASTALARPVASD

SEQ ID NO: 3706 - protein, 25 aa, synthetic construct
  source 1..25: note = Seed: LNVIVHSATGFKQSSKALQRPVASD
LNVIVHSATGIKQASTALIRPVASD

SEQ ID NO: 3707 - protein, 25 aa, synthetic construct
  source 1..25: note = Seed: LNVIVHSATGFKQSSKALQRPVASD
LNVIVHSATGIKQASTALLRPVASD

SEQ ID NO: 3708 - protein, 25 aa, synthetic construct
  source 1..25: note = Seed: LNVIVHSATGFKQSSKALQRPVASD
LNVIVHSATGIKQASTALNRPVASD

SEQ ID NO: 3709 - protein, 25 aa, synthetic construct
  source 1..25: note = Seed: LNVIVHSATGFKQSSKALQRPVASD
LNVIVHSATGIKQASTALSRPVASD

SEQ ID NO: 3710 - protein, 25 aa, synthetic construct
  source 1..25: note = Seed: LNVIVHSATGFKQSSKALQRPVASD
LNVIVHSATGIKQASTALVRPVASD

SEQ ID NO: 3711 - protein, 25 aa, synthetic construct
  source 1..25: note = Seed: LNVIVHSATGFKQSSKALQRPVASD
LNVIVHSATGIKQASVALARPVASD

SEQ ID NO: 3712 - protein, 25 aa, synthetic construct
  source 1..25: note = Seed: LNVIVHSATGFKQSSKALQRPVASD
LNVIVHSATGIKQASVALIRPVASD

SEQ ID NO: 3713 - protein, 25 aa, synthetic construct
  source 1..25: note = Seed: LNVIVHSATGFKQSSKALQRPVASD
LNVIVHSATGIKQASVALLRPVASD

SEQ ID NO: 3714 - protein, 25 aa, synthetic construct
  source 1..25: note = Seed: LNVIVHSATGFKQSSKALQRPVASD
LNVIVHSATGIKQASVALMRPVASD

SEQ ID NO: 3715 - protein, 25 aa, synthetic construct
  source 1..25: note = Seed: LNVIVHSATGFKQSSKALQRPVASD
LNVIVHSATGIKQASVALNRPVASD

SEQ ID NO: 3716 - protein, 25 aa, synthetic construct
  source 1..25: note = Seed: LNVIVHSATGFKQSSKALQRPVASD
LNVIVHSATGIKQASVALRRPVASD

SEQ ID NO: 3717 - protein, 25 aa, synthetic construct
  source 1..25: note = Seed: LNVIVHSATGFKQSSKALQRPVASD
LNVIVHSATGIKQASVALSRPVASD

SEQ ID NO: 3718 - protein, 25 aa, synthetic construct
  source 1..25: note = Seed: LNVIVHSATGFKQSSKALQRPVASD
LNVIVHSATGIKQASVALTRPVASD

SEQ ID NO: 3719 - protein, 25 aa, synthetic construct
  source 1..25: note = Seed: LNVIVHSATGFKQSSKALQRPVASD
LNVIVHSATGIKQASVALVRPVASD

SEQ ID NO: 3720 - protein, 25 aa, synthetic construct
  source 1..25: note = Seed: LNVIVHSATGFKQSSKALQRPVASD
LNVIVHSATGIKQCSAALARPVASD

SEQ ID NO: 3721 - protein, 25 aa, synthetic construct
  source 1..25: note = Seed: LNVIVHSATGFKQSSKALQRPVASD
LNVIVHSATGIKQCSAALIRPVASD

SEQ ID NO: 3722 - protein, 25 aa, synthetic construct
  source 1..25: note = Seed: LNVIVHSATGFKQSSKALQRPVASD
LNVIVHSATGIKQCSAALLRPVASD

SEQ ID NO: 3723 - protein, 25 aa, synthetic construct
  source 1..25: note = Seed: LNVIVHSATGFKQSSKALQRPVASD
LNVIVHSATGIKQCSAALSRPVASD

SEQ ID NO: 3724 - protein, 25 aa, synthetic construct
  source 1..25: note = Seed: LNVIVHSATGFKQSSKALQRPVASD
LNVIVHSATGIKQCSAALVRPVASD

SEQ ID NO: 3725 - protein, 25 aa, synthetic construct
  source 1..25: note = Seed: LNVIVHSATGFKQSSKALQRPVASD
LNVIVHSATGIKQCSFALFRPVASD

SEQ ID NO: 3726 - protein, 25 aa, synthetic construct
  source 1..25: note = Seed: LNVIVHSATGFKQSSKALQRPVASD
LNVIVHSATGIKQCSIALARPVASD

SEQ ID NO: 3727 - protein, 25 aa, synthetic construct
  source 1..25: note = Seed: LNVIVHSATGFKQSSKALQRPVASD
LNVIVHSATGIKQCSIALSRPVASD

SEQ ID NO: 3728 - protein, 25 aa, synthetic construct
  source 1..25: note = Seed: LNVIVHSATGFKQSSKALQRPVASD
LNVIVHSATGIKQCSKALARPVASD

SEQ ID NO: 3729 - protein, 25 aa, synthetic construct
  source 1..25: note = Seed: LNVIVHSATGFKQSSKALQRPVASD
LNVIVHSATGIKQCSKALSRPVASD

SEQ ID NO: 3730 - protein, 25 aa, synthetic construct
  source 1..25: note = Seed: LNVIVHSATGFKQSSKALQRPVASD
LNVIVHSATGIKQCSRALARPVASD

SEQ ID NO: 3731 - protein, 25 aa, synthetic construct
  source 1..25: note = Seed: LNVIVHSATGFKQSSKALQRPVASD
LNVIVHSATGIKQCSRALGRPVASD

SEQ ID NO: 3732 - protein, 25 aa, synthetic construct
  source 1..25: note = Seed: LNVIVHSATGFKQSSKALQRPVASD
LNVIVHSATGIKQCSRALHRPVASD

SEQ ID NO: 3733 - protein, 25 aa, synthetic construct
  source 1..25: note = Seed: LNVIVHSATGFKQSSKALQRPVASD
LNVIVHSATGIKQCSRALKRPVASD

SEQ ID NO: 3734 - protein, 25 aa, synthetic construct
  source 1..25: note = Seed: LNVIVHSATGFKQSSKALQRPVASD
LNVIVHSATGIKQCSRALQRPVASD

SEQ ID NO: 3735 - protein, 25 aa, synthetic construct
  source 1..25: note = Seed: LNVIVHSATGFKQSSKALQRPVASD
LNVIVHSATGIKQCSRALRRPVASD

SEQ ID NO: 3736 - protein, 25 aa, synthetic construct
  source 1..25: note = Seed: LNVIVHSATGFKQSSKALQRPVASD
LNVIVHSATGIKQCSRALSRPVASD

SEQ ID NO: 3737 - protein, 25 aa, synthetic construct
  source 1..25: note = Seed: LNVIVHSATGFKQSSKALQRPVASD
LNVIVHSATGIKQCSSALARPVASD

SEQ ID NO: 3738 - protein, 25 aa, synthetic construct
  source 1..25: note = Seed: LNVIVHSATGFKQSSKALQRPVASD
LNVIVHSATGIKQCSVALARPVASD

SEQ ID NO: 3739 - protein, 25 aa, synthetic construct
  source 1..25: note = Seed: LNVIVHSATGFKQSSKALQRPVASD
LNVIVHSATGIKQDSAALFRPVASD

SEQ ID NO: 3740 - protein, 25 aa, synthetic construct
  source 1..25: note = Seed: LNVIVHSATGFKQSSKALQRPVASD
LNVIVHSATGIKQDSAALIRPVASD

SEQ ID NO: 3741 - protein, 25 aa, synthetic construct
  source 1..25: note = Seed: LNVIVHSATGFKQSSKALQRPVASD
LNVIVHSATGIKQDSAALLRPVASD

SEQ ID NO: 3742 - protein, 25 aa, synthetic construct
  source 1..25: note = Seed: LNVIVHSATGFKQSSKALQRPVASD
LNVIVHSATGIKQDSAALVRPVASD

SEQ ID NO: 3743 - protein, 25 aa, synthetic construct
  source 1..25: note = Seed: LNVIVHSATGFKQSSKALQRPVASD
LNVIVHSATGIKQDSAALYRPVASD

SEQ ID NO: 3744 - protein, 25 aa, synthetic construct
  source 1..25: note = Seed: LNVIVHSATGFKQSSKALQRPVASD
LNVIVHSATGIKQDSIALIRPVASD

SEQ ID NO: 3745 - protein, 25 aa, synthetic construct
  source 1..25: note = Seed: LNVIVHSATGFKQSSKALQRPVASD
LNVIVHSATGIKQDSNALIRPVASD

SEQ ID NO: 3746 - protein, 25 aa, synthetic construct
  source 1..25: note = Seed: LNVIVHSATGFKQSSKALQRPVASD
LNVIVHSATGIKQDSNALVRPVASD

SEQ ID NO: 3747 - protein, 25 aa, synthetic construct
  source 1..25: note = Seed: LNVIVHSATGFKQSSKALQRPVASD
LNVIVHSATGIKQDSPALIRPVASD

SEQ ID NO: 3748 - protein, 25 aa, synthetic construct
  source 1..25: note = Seed: LNVIVHSATGFKQSSKALQRPVASD
LNVIVHSATGIKQDSPALVRPVASD

SEQ ID NO: 3749 - protein, 25 aa, synthetic construct
  source 1..25: note = Seed: LNVIVHSATGFKQSSKALQRPVASD
LNVIVHSATGIKQDSSALIRPVASD

SEQ ID NO: 3750 - protein, 25 aa, synthetic construct
  source 1..25: note = Seed: LNVIVHSATGFKQSSKALQRPVASD
LNVIVHSATGIKQDSSALVRPVASD

SEQ ID NO: 3751 - protein, 25 aa, synthetic construct
  source 1..25: note = Seed: LNVIVHSATGFKQSSKALQRPVASD
LNVIVHSATGIKQDSTALIRPVASD

SEQ ID NO: 3752 - protein, 25 aa, synthetic construct
  source 1..25: note = Seed: LNVIVHSATGFKQSSKALQRPVASD
LNVIVHSATGIKQDSVALIRPVASD

SEQ ID NO: 3753 - protein, 25 aa, synthetic construct
  source 1..25: note = Seed: LNVIVHSATGFKQSSKALQRPVASD
LNVIVHSATGIKQDSVALVRPVASD

SEQ ID NO: 3754 - protein, 25 aa, synthetic construct
  source 1..25: note = Seed: LNVIVHSATGFKQSSKALQRPVASD
LNVIVHSATGIKQESAALARPVASD

SEQ ID NO: 3755 - protein, 25 aa, synthetic construct
  source 1..25: note = Seed: LNVIVHSATGFKQSSKALQRPVASD
LNVIVHSATGIKQESAALIRPVASD

SEQ ID NO: 3756 - protein, 25 aa, synthetic construct
  source 1..25: note = Seed: LNVIVHSATGFKQSSKALQRPVASD
LNVIVHSATGIKQESAALLRPVASD

SEQ ID NO: 3757 - protein, 25 aa, synthetic construct
  source 1..25: note = Seed: LNVIVHSATGFKQSSKALQRPVASD
LNVIVHSATGIKQESAALMRPVASD

SEQ ID NO: 3758 - protein, 25 aa, synthetic construct
  source 1..25: note = Seed: LNVIVHSATGFKQSSKALQRPVASD
LNVIVHSATGIKQESAALSRPVASD

SEQ ID NO: 3759 - protein, 25 aa, synthetic construct
  source 1..25: note = Seed: LNVIVHSATGFKQSSKALQRPVASD
LNVIVHSATGIKQESAALTRPVASD

SEQ ID NO: 3760 - protein, 25 aa, synthetic construct
  source 1..25: note = Seed: LNVIVHSATGFKQSSKALQRPVASD
LNVIVHSATGIKQESAALVRPVASD

SEQ ID NO: 3761 - protein, 25 aa, synthetic construct
  source 1..25: note = Seed: LNVIVHSATGFKQSSKALQRPVASD
LNVIVHSATGIKQESGALARPVASD

SEQ ID NO: 3762 - protein, 25 aa, synthetic construct
  source 1..25: note = Seed: LNVIVHSATGFKQSSKALQRPVASD
LNVIVHSATGIKQESGALIRPVASD

SEQ ID NO: 3763 - protein, 25 aa, synthetic construct
  source 1..25: note = Seed: LNVIVHSATGFKQSSKALQRPVASD
LNVIVHSATGIKQESGALLRPVASD

SEQ ID NO: 3764 - protein, 25 aa, synthetic construct
  source 1..25: note = Seed: LNVIVHSATGFKQSSKALQRPVASD
LNVIVHSATGIKQESGALVRPVASD

SEQ ID NO: 3765 - protein, 25 aa, synthetic construct
  source 1..25: note = Seed: LNVIVHSATGFKQSSKALQRPVASD
LNVIVHSATGIKQESIALARPVASD

SEQ ID NO: 3766 - protein, 25 aa, synthetic construct
  source 1..25: note = Seed: LNVIVHSATGFKQSSKALQRPVASD
LNVIVHSATGIKQESIALIRPVASD

SEQ ID NO: 3767 - protein, 25 aa, synthetic construct
  source 1..25: note = Seed: LNVIVHSATGFKQSSKALQRPVASD
LNVIVHSATGIKQESLALARPVASD

SEQ ID NO: 3768 - protein, 25 aa, synthetic construct
  source 1..25: note = Seed: LNVIVHSATGFKQSSKALQRPVASD
LNVIVHSATGIKQESPALLRPVASD

SEQ ID NO: 3769 - protein, 25 aa, synthetic construct
  source 1..25: note = Seed: LNVIVHSATGFKQSSKALQRPVASD
LNVIVHSATGIKQESPALVRPVASD

SEQ ID NO: 3770 - protein, 25 aa, synthetic construct
  source 1..25: note = Seed: LNVIVHSATGFKQSSKALQRPVASD
LNVIVHSATGIKQESSALARPVASD

SEQ ID NO: 3771 - protein, 25 aa, synthetic construct
  source 1..25: note = Seed: LNVIVHSATGFKQSSKALQRPVASD
LNVIVHSATGIKQESSALIRPVASD

SEQ ID NO: 3772 - protein, 25 aa, synthetic construct
  source 1..25: note = Seed: LNVIVHSATGFKQSSKALQRPVASD
LNVIVHSATGIKQESSALLRPVASD

SEQ ID NO: 3773 - protein, 25 aa, synthetic construct
  source 1..25: note = Seed: LNVIVHSATGFKQSSKALQRPVASD
LNVIVHSATGIKQESSALVRPVASD

SEQ ID NO: 3774 - protein, 25 aa, synthetic construct
  source 1..25: note = Seed: LNVIVHSATGFKQSSKALQRPVASD
LNVIVHSATGIKQESVALARPVASD

SEQ ID NO: 3775 - protein, 25 aa, synthetic construct
  source 1..25: note = Seed: LNVIVHSATGFKQSSKALQRPVASD
LNVIVHSATGIKQESVALMRPVASD

SEQ ID NO: 3776 - protein, 25 aa, synthetic construct
  source 1..25: note = Seed: LNVIVHSATGFKQSSKALQRPVASD
LNVIVHSATGIKQFSAALARPVASD

SEQ ID NO: 3777 - protein, 25 aa, synthetic construct
  source 1..25: note = Seed: LNVIVHSATGFKQSSKALQRPVASD
LNVIVHSATGIKQFSAALCRPVASD

SEQ ID NO: 3778 - protein, 25 aa, synthetic construct
  source 1..25: note = Seed: LNVIVHSATGFKQSSKALQRPVASD
LNVIVHSATGIKQFSAALFRPVASD

SEQ ID NO: 3779 - protein, 25 aa, synthetic construct
  source 1..25: note = Seed: LNVIVHSATGFKQSSKALQRPVASD
LNVIVHSATGIKQFSAALGRPVASD

SEQ ID NO: 3780 - protein, 25 aa, synthetic construct
  source 1..25: note = Seed: LNVIVHSATGFKQSSKALQRPVASD
LNVIVHSATGIKQFSAALHRPVASD

SEQ ID NO: 3781 - protein, 25 aa, synthetic construct
  source 1..25: note = Seed: LNVIVHSATGFKQSSKALQRPVASD
LNVIVHSATGIKQFSAALIRPVASD

SEQ ID NO: 3782 - protein, 25 aa, synthetic construct
  source 1..25: note = Seed: LNVIVHSATGFKQSSKALQRPVASD
LNVIVHSATGIKQFSAALKRPVASD

SEQ ID NO: 3783 - protein, 25 aa, synthetic construct
  source 1..25: note = Seed: LNVIVHSATGFKQSSKALQRPVASD
LNVIVHSATGIKQFSAALLRPVASD

SEQ ID NO: 3784 - protein, 25 aa, synthetic construct
  source 1..25: note = Seed: LNVIVHSATGFKQSSKALQRPVASD
LNVIVHSATGIKQFSAALMRPVASD

SEQ ID NO: 3785 - protein, 25 aa, synthetic construct
  source 1..25: note = Seed: LNVIVHSATGFKQSSKALQRPVASD
LNVIVHSATGIKQFSAALNRPVASD

SEQ ID NO: 3786 - protein, 25 aa, synthetic construct
  source 1..25: note = Seed: LNVIVHSATGFKQSSKALQRPVASD
LNVIVHSATGIKQFSAALQRPVASD

SEQ ID NO: 3787 - protein, 25 aa, synthetic construct
  source 1..25: note = Seed: LNVIVHSATGFKQSSKALQRPVASD
LNVIVHSATGIKQFSAALRRPVASD

SEQ ID NO: 3788 - protein, 25 aa, synthetic construct
  source 1..25: note = Seed: LNVIVHSATGFKQSSKALQRPVASD
LNVIVHSATGIKQFSAALTRPVASD

SEQ ID NO: 3789 - protein, 25 aa, synthetic construct
  source 1..25: note = Seed: LNVIVHSATGFKQSSKALQRPVASD
LNVIVHSATGIKQFSAALVRPVASD

SEQ ID NO: 3790 - protein, 25 aa, synthetic construct
  source 1..25: note = Seed: LNVIVHSATGFKQSSKALQRPVASD
LNVIVHSATGIKQFSAALYRPVASD

SEQ ID NO: 3791 - protein, 25 aa, synthetic construct
  source 1..25: note = Seed: LNVIVHSATGFKQSSKALQRPVASD
LNVIVHSATGIKQFSFALVRPVASD

SEQ ID NO: 3792 - protein, 25 aa, synthetic construct
  source 1..25: note = Seed: LNVIVHSATGFKQSSKALQRPVASD
LNVIVHSATGIKQFSGALARPVASD

SEQ ID NO: 3793 - protein, 25 aa, synthetic construct
  source 1..25: note = Seed: LNVIVHSATGFKQSSKALQRPVASD
LNVIVHSATGIKQFSGALIRPVASD

SEQ ID NO: 3794 - protein, 25 aa, synthetic construct
  source 1..25: note = Seed: LNVIVHSATGFKQSSKALQRPVASD
LNVIVHSATGIKQFSGALLRPVASD

SEQ ID NO: 3795 - protein, 25 aa, synthetic construct
  source 1..25: note = Seed: LNVIVHSATGFKQSSKALQRPVASD
LNVIVHSATGIKQFSGALMRPVASD

SEQ ID NO: 3796 - protein, 25 aa, synthetic construct
  source 1..25: note = Seed: LNVIVHSATGFKQSSKALQRPVASD
LNVIVHSATGIKQFSGALNRPVASD

SEQ ID NO: 3797 - protein, 25 aa, synthetic construct
  source 1..25: note = Seed: LNVIVHSATGFKQSSKALQRPVASD
LNVIVHSATGIKQFSGALRRPVASD

SEQ ID NO: 3798 - protein, 25 aa, synthetic construct
  source 1..25: note = Seed: LNVIVHSATGFKQSSKALQRPVASD
LNVIVHSATGIKQFSGALSRPVASD

SEQ ID NO: 3799 - protein, 25 aa, synthetic construct
  source 1..25: note = Seed: LNVIVHSATGFKQSSKALQRPVASD
LNVIVHSATGIKQFSGALVRPVASD

SEQ ID NO: 3800 - protein, 25 aa, synthetic construct
  source 1..25: note = Seed: LNVIVHSATGFKQSSKALQRPVASD
LNVIVHSATGIKQFSHALKRPVASD

SEQ ID NO: 3801 - protein, 25 aa, synthetic construct
  source 1..25: note = Seed: LNVIVHSATGFKQSSKALQRPVASD
LNVIVHSATGIKQFSHALLRPVASD

SEQ ID NO: 3802 - protein, 25 aa, synthetic construct
  source 1..25: note = Seed: LNVIVHSATGFKQSSKALQRPVASD
LNVIVHSATGIKQFSHALRRPVASD

SEQ ID NO: 3803 - protein, 25 aa, synthetic construct
  source 1..25: note = Seed: LNVIVHSATGFKQSSKALQRPVASD
LNVIVHSATGIKQFSIALHRPVASD

SEQ ID NO: 3804 - protein, 25 aa, synthetic construct
  source 1..25: note = Seed: LNVIVHSATGFKQSSKALQRPVASD
LNVIVHSATGIKQFSIALQRPVASD

SEQ ID NO: 3805 - protein, 25 aa, synthetic construct
  source 1..25: note = Seed: LNVIVHSATGFKQSSKALQRPVASD
LNVIVHSATGIKQFSIALRRPVASD

SEQ ID NO: 3806 - protein, 25 aa, synthetic construct
  source 1..25: note = Seed: LNVIVHSATGFKQSSKALQRPVASD
LNVIVHSATGIKQFSKALARPVASD

SEQ ID NO: 3807 - protein, 25 aa, synthetic construct
  source 1..25: note = Seed: LNVIVHSATGFKQSSKALQRPVASD
LNVIVHSATGIKQFSKALFRPVASD

SEQ ID NO: 3808 - protein, 25 aa, synthetic construct
  source 1..25: note = Seed: LNVIVHSATGFKQSSKALQRPVASD
LNVIVHSATGIKQFSKALGRPVASD

SEQ ID NO: 3809 - protein, 25 aa, synthetic construct
  source 1..25: note = Seed: LNVIVHSATGFKQSSKALQRPVASD
LNVIVHSATGIKQFSKALHRPVASD

SEQ ID NO: 3810 - protein, 25 aa, synthetic construct
  source 1..25: note = Seed: LNVIVHSATGFKQSSKALQRPVASD
LNVIVHSATGIKQFSKALIRPVASD

SEQ ID NO: 3811 - protein, 25 aa, synthetic construct
  source 1..25: note = Seed: LNVIVHSATGFKQSSKALQRPVASD
LNVIVHSATGIKQFSKALKRPVASD

SEQ ID NO: 3812 - protein, 25 aa, synthetic construct
  source 1..25: note = Seed: LNVIVHSATGFKQSSKALQRPVASD
LNVIVHSATGIKQFSKALLRPVASD

SEQ ID NO: 3813 - protein, 25 aa, synthetic construct
  source 1..25: note = Seed: LNVIVHSATGFKQSSKALQRPVASD
LNVIVHSATGIKQFSKALMRPVASD

SEQ ID NO: 3814 - protein, 25 aa, synthetic construct
  source 1..25: note = Seed: LNVIVHSATGFKQSSKALQRPVASD
LNVIVHSATGIKQFSKALNRPVASD

SEQ ID NO: 3815 - protein, 25 aa, synthetic construct
  source 1..25: note = Seed: LNVIVHSATGFKQSSKALQRPVASD
LNVIVHSATGIKQFSKALQRPVASD

SEQ ID NO: 3816 - protein, 25 aa, synthetic construct
  source 1..25: note = Seed: LNVIVHSATGFKQSSKALQRPVASD
LNVIVHSATGIKQFSKALRRPVASD

SEQ ID NO: 3817 - protein, 25 aa, synthetic construct
  source 1..25: note = Seed: LNVIVHSATGFKQSSKALQRPVASD
LNVIVHSATGIKQFSKALSRPVASD

SEQ ID NO: 3818 - protein, 25 aa, synthetic construct
  source 1..25: note = Seed: LNVIVHSATGFKQSSKALQRPVASD
LNVIVHSATGIKQFSKALTRPVASD

SEQ ID NO: 3819 - protein, 25 aa, synthetic construct
  source 1..25: note = Seed: LNVIVHSATGFKQSSKALQRPVASD
LNVIVHSATGIKQFSKALVRPVASD

SEQ ID NO: 3820 - protein, 25 aa, synthetic construct
  source 1..25: note = Seed: LNVIVHSATGFKQSSKALQRPVASD
LNVIVHSATGIKQFSKALYRPVASD

SEQ ID NO: 3821 - protein, 25 aa, synthetic construct
  source 1..25: note = Seed: LNVIVHSATGFKQSSKALQRPVASD
LNVIVHSATGIKQFSLALMRPVASD

SEQ ID NO: 3822 - protein, 25 aa, synthetic construct
  source 1..25: note = Seed: LNVIVHSATGFKQSSKALQRPVASD
LNVIVHSATGIKQFSLALRRPVASD

SEQ ID NO: 3823 - protein, 25 aa, synthetic construct
  source 1..25: note = Seed: LNVIVHSATGFKQSSKALQRPVASD
LNVIVHSATGIKQFSLALVRPVASD

SEQ ID NO: 3824 - protein, 25 aa, synthetic construct
  source 1..25: note = Seed: LNVIVHSATGFKQSSKALQRPVASD
LNVIVHSATGIKQFSLALYRPVASD

SEQ ID NO: 3825 - protein, 25 aa, synthetic construct
  source 1..25: note = Seed: LNVIVHSATGFKQSSKALQRPVASD
LNVIVHSATGIKQFSMALRRPVASD

SEQ ID NO: 3826 - protein, 25 aa, synthetic construct
  source 1..25: note = Seed: LNVIVHSATGFKQSSKALQRPVASD
LNVIVHSATGIKQFSNALARPVASD

SEQ ID NO: 3827 - protein, 25 aa, synthetic construct
  source 1..25: note = Seed: LNVIVHSATGFKQSSKALQRPVASD
LNVIVHSATGIKQFSNALGRPVASD

SEQ ID NO: 3828 - protein, 25 aa, synthetic construct
  source 1..25: note = Seed: LNVIVHSATGFKQSSKALQRPVASD
LNVIVHSATGIKQFSNALIRPVASD

SEQ ID NO: 3829 - protein, 25 aa, synthetic construct
  source 1..25: note = Seed: LNVIVHSATGFKQSSKALQRPVASD
LNVIVHSATGIKQFSNALLRPVASD

SEQ ID NO: 3830 - protein, 25 aa, synthetic construct
  source 1..25: note = Seed: LNVIVHSATGFKQSSKALQRPVASD
LNVIVHSATGIKQFSNALNRPVASD

SEQ ID NO: 3831 - protein, 25 aa, synthetic construct
  source 1..25: note = Seed: LNVIVHSATGFKQSSKALQRPVASD
LNVIVHSATGIKQFSNALRRPVASD

SEQ ID NO: 3832 - protein, 25 aa, synthetic construct
  source 1..25: note = Seed: LNVIVHSATGFKQSSKALQRPVASD
LNVIVHSATGIKQFSNALSRPVASD

SEQ ID NO: 3833 - protein, 25 aa, synthetic construct
  source 1..25: note = Seed: LNVIVHSATGFKQSSKALQRPVASD
LNVIVHSATGIKQFSNALVRPVASD

SEQ ID NO: 3834 - protein, 25 aa, synthetic construct
  source 1..25: note = Seed: LNVIVHSATGFKQSSKALQRPVASD
LNVIVHSATGIKQFSPALGRPVASD

SEQ ID NO: 3835 - protein, 25 aa, synthetic construct
  source 1..25: note = Seed: LNVIVHSATGFKQSSKALQRPVASD
LNVIVHSATGIKQFSPALIRPVASD

SEQ ID NO: 3836 - protein, 25 aa, synthetic construct
  source 1..25: note = Seed: LNVIVHSATGFKQSSKALQRPVASD
LNVIVHSATGIKQFSPALKRPVASD

SEQ ID NO: 3837 - protein, 25 aa, synthetic construct
  source 1..25: note = Seed: LNVIVHSATGFKQSSKALQRPVASD
LNVIVHSATGIKQFSPALLRPVASD

SEQ ID NO: 3838 - protein, 25 aa, synthetic construct
  source 1..25: note = Seed: LNVIVHSATGFKQSSKALQRPVASD
LNVIVHSATGIKQFSPALMRPVASD

SEQ ID NO: 3839 - protein, 25 aa, synthetic construct
  source 1..25: note = Seed: LNVIVHSATGFKQSSKALQRPVASD
LNVIVHSATGIKQFSPALNRPVASD

SEQ ID NO: 3840 - protein, 25 aa, synthetic construct
  source 1..25: note = Seed: LNVIVHSATGFKQSSKALQRPVASD
LNVIVHSATGIKQFSPALRRPVASD

SEQ ID NO: 3841 - protein, 25 aa, synthetic construct
  source 1..25: note = Seed: LNVIVHSATGFKQSSKALQRPVASD
LNVIVHSATGIKQFSPALVRPVASD

SEQ ID NO: 3842 - protein, 25 aa, synthetic construct
  source 1..25: note = Seed: LNVIVHSATGFKQSSKALQRPVASD
LNVIVHSATGIKQFSQALRRPVASD

SEQ ID NO: 3843 - protein, 25 aa, synthetic construct
  source 1..25: note = Seed: LNVIVHSATGFKQSSKALQRPVASD
LNVIVHSATGIKQFSRALARPVASD

SEQ ID NO: 3844 - protein, 25 aa, synthetic construct
  source 1..25: note = Seed: LNVIVHSATGFKQSSKALQRPVASD
LNVIVHSATGIKQFSRALERPVASD

SEQ ID NO: 3845 - protein, 25 aa, synthetic construct
  source 1..25: note = Seed: LNVIVHSATGFKQSSKALQRPVASD
LNVIVHSATGIKQFSRALFRPVASD

SEQ ID NO: 3846 - protein, 25 aa, synthetic construct
  source 1..25: note = Seed: LNVIVHSATGFKQSSKALQRPVASD
LNVIVHSATGIKQFSRALGRPVASD

SEQ ID NO: 3847 - protein, 25 aa, synthetic construct
  source 1..25: note = Seed: LNVIVHSATGFKQSSKALQRPVASD
LNVIVHSATGIKQFSRALHRPVASD

SEQ ID NO: 3848 - protein, 25 aa, synthetic construct
  source 1..25: note = Seed: LNVIVHSATGFKQSSKALQRPVASD
LNVIVHSATGIKQFSRALIRPVASD

SEQ ID NO: 3849 - protein, 25 aa, synthetic construct
  source 1..25: note = Seed: LNVIVHSATGFKQSSKALQRPVASD
LNVIVHSATGIKQFSRALKRPVASD

SEQ ID NO: 3850 - protein, 25 aa, synthetic construct
  source 1..25: note = Seed: LNVIVHSATGFKQSSKALQRPVASD
LNVIVHSATGIKQFSRALLRPVASD

SEQ ID NO: 3851 - protein, 25 aa, synthetic construct
  source 1..25: note = Seed: LNVIVHSATGFKQSSKALQRPVASD
LNVIVHSATGIKQFSRALMRPVASD

SEQ ID NO: 3852 - protein, 25 aa, synthetic construct
  source 1..25: note = Seed: LNVIVHSATGFKQSSKALQRPVASD
LNVIVHSATGIKQFSRALNRPVASD

SEQ ID NO: 3853 - protein, 25 aa, synthetic construct
  source 1..25: note = Seed: LNVIVHSATGFKQSSKALQRPVASD
LNVIVHSATGIKQFSRALPRPVASD

SEQ ID NO: 3854 - protein, 25 aa, synthetic construct
  source 1..25: note = Seed: LNVIVHSATGFKQSSKALQRPVASD
LNVIVHSATGIKQFSRALQRPVASD

SEQ ID NO: 3855 - protein, 25 aa, synthetic construct
  source 1..25: note = Seed: LNVIVHSATGFKQSSKALQRPVASD
LNVIVHSATGIKQFSRALRRPVASD

SEQ ID NO: 3856 - protein, 25 aa, synthetic construct
  source 1..25: note = Seed: LNVIVHSATGFKQSSKALQRPVASD
LNVIVHSATGIKQFSRALSRPVASD

SEQ ID NO: 3857 - protein, 25 aa, synthetic construct
  source 1..25: note = Seed: LNVIVHSATGFKQSSKALQRPVASD
LNVIVHSATGIKQFSRALTRPVASD

SEQ ID NO: 3858 - protein, 25 aa, synthetic construct
  source 1..25: note = Seed: LNVIVHSATGFKQSSKALQRPVASD
LNVIVHSATGIKQFSRALVRPVASD

SEQ ID NO: 3859 - protein, 25 aa, synthetic construct
  source 1..25: note = Seed: LNVIVHSATGFKQSSKALQRPVASD
LNVIVHSATGIKQFSRALYRPVASD

SEQ ID NO: 3860 - protein, 25 aa, synthetic construct
  source 1..25: note = Seed: LNVIVHSATGFKQSSKALQRPVASD
LNVIVHSATGIKQFSSALARPVASD

SEQ ID NO: 3861 - protein, 25 aa, synthetic construct
  source 1..25: note = Seed: LNVIVHSATGFKQSSKALQRPVASD
LNVIVHSATGIKQFSSALCRPVASD

SEQ ID NO: 3862 - protein, 25 aa, synthetic construct
  source 1..25: note = Seed: LNVIVHSATGFKQSSKALQRPVASD
LNVIVHSATGIKQFSSALFRPVASD

SEQ ID NO: 3863 - protein, 25 aa, synthetic construct
  source 1..25: note = Seed: LNVIVHSATGFKQSSKALQRPVASD
LNVIVHSATGIKQFSSALGRPVASD

SEQ ID NO: 3864 - protein, 25 aa, synthetic construct
  source 1..25: note = Seed: LNVIVHSATGFKQSSKALQRPVASD
LNVIVHSATGIKQFSSALIRPVASD

SEQ ID NO: 3865 - protein, 25 aa, synthetic construct
  source 1..25: note = Seed: LNVIVHSATGFKQSSKALQRPVASD
LNVIVHSATGIKQFSSALKRPVASD

SEQ ID NO: 3866 - protein, 25 aa, synthetic construct
  source 1..25: note = Seed: LNVIVHSATGFKQSSKALQRPVASD
LNVIVHSATGIKQFSSALLRPVASD

SEQ ID NO: 3867 - protein, 25 aa, synthetic construct
  source 1..25: note = Seed: LNVIVHSATGFKQSSKALQRPVASD
LNVIVHSATGIKQFSSALMRPVASD

SEQ ID NO: 3868 - protein, 25 aa, synthetic construct
  source 1..25: note = Seed: LNVIVHSATGFKQSSKALQRPVASD
LNVIVHSATGIKQFSSALRRPVASD

SEQ ID NO: 3869 - protein, 25 aa, synthetic construct
  source 1..25: note = Seed: LNVIVHSATGFKQSSKALQRPVASD
LNVIVHSATGIKQFSSALSRPVASD

SEQ ID NO: 3870 - protein, 25 aa, synthetic construct
  source 1..25: note = Seed: LNVIVHSATGFKQSSKALQRPVASD
LNVIVHSATGIKQFSSALTRPVASD

SEQ ID NO: 3871 - protein, 25 aa, synthetic construct
  source 1..25: note = Seed: LNVIVHSATGFKQSSKALQRPVASD
LNVIVHSATGIKQFSSALVRPVASD

SEQ ID NO: 3872 - protein, 25 aa, synthetic construct
  source 1..25: note = Seed: LNVIVHSATGFKQSSKALQRPVASD
LNVIVHSATGIKQFSTALARPVASD

SEQ ID NO: 3873 - protein, 25 aa, synthetic construct
  source 1..25: note = Seed: LNVIVHSATGFKQSSKALQRPVASD
LNVIVHSATGIKQFSTALGRPVASD

SEQ ID NO: 3874 - protein, 25 aa, synthetic construct
  source 1..25: note = Seed: LNVIVHSATGFKQSSKALQRPVASD
LNVIVHSATGIKQFSTALIRPVASD

SEQ ID NO: 3875 - protein, 25 aa, synthetic construct
  source 1..25: note = Seed: LNVIVHSATGFKQSSKALQRPVASD
LNVIVHSATGIKQFSTALKRPVASD

SEQ ID NO: 3876 - protein, 25 aa, synthetic construct
  source 1..25: note = Seed: LNVIVHSATGFKQSSKALQRPVASD
LNVIVHSATGIKQFSTALLRPVASD

SEQ ID NO: 3877 - protein, 25 aa, synthetic construct
  source 1..25: note = Seed: LNVIVHSATGFKQSSKALQRPVASD
LNVIVHSATGIKQFSTALMRPVASD

SEQ ID NO: 3878 - protein, 25 aa, synthetic construct
  source 1..25: note = Seed: LNVIVHSATGFKQSSKALQRPVASD
LNVIVHSATGIKQFSTALNRPVASD

SEQ ID NO: 3879 - protein, 25 aa, synthetic construct
  source 1..25: note = Seed: LNVIVHSATGFKQSSKALQRPVASD
LNVIVHSATGIKQFSTALRRPVASD

SEQ ID NO: 3880 - protein, 25 aa, synthetic construct
  source 1..25: note = Seed: LNVIVHSATGFKQSSKALQRPVASD
LNVIVHSATGIKQFSTALTRPVASD

SEQ ID NO: 3881 - protein, 25 aa, synthetic construct
  source 1..25: note = Seed: LNVIVHSATGFKQSSKALQRPVASD
LNVIVHSATGIKQFSTALVRPVASD

SEQ ID NO: 3882 - protein, 25 aa, synthetic construct
  source 1..25: note = Seed: LNVIVHSATGFKQSSKALQRPVASD
LNVIVHSATGIKQFSVALHRPVASD

SEQ ID NO: 3883 - protein, 25 aa, synthetic construct
  source 1..25: note = Seed: LNVIVHSATGFKQSSKALQRPVASD
LNVIVHSATGIKQFSVALKRPVASD

SEQ ID NO: 3884 - protein, 25 aa, synthetic construct
  source 1..25: note = Seed: LNVIVHSATGFKQSSKALQRPVASD
LNVIVHSATGIKQFSVALLRPVASD

SEQ ID NO: 3885 - protein, 25 aa, synthetic construct
  source 1..25: note = Seed: LNVIVHSATGFKQSSKALQRPVASD
LNVIVHSATGIKQFSVALNRPVASD

SEQ ID NO: 3886 - protein, 25 aa, synthetic construct
  source 1..25: note = Seed: LNVIVHSATGFKQSSKALQRPVASD
LNVIVHSATGIKQFSVALQRPVASD

SEQ ID NO: 3887 - protein, 25 aa, synthetic construct
  source 1..25: note = Seed: LNVIVHSATGFKQSSKALQRPVASD
LNVIVHSATGIKQFSVALRRPVASD

SEQ ID NO: 3888 - protein, 25 aa, synthetic construct
  source 1..25: note = Seed: LNVIVHSATGFKQSSKALQRPVASD
LNVIVHSATGIKQFSYALRRPVASD

SEQ ID NO: 3889 - protein, 25 aa, synthetic construct
  source 1..25: note = Seed: LNVIVHSATGFKQSSKALQRPVASD
LNVIVHSATGIKQGSAALARPVASD

SEQ ID NO: 3890 - protein, 25 aa, synthetic construct
  source 1..25: note = Seed: LNVIVHSATGFKQSSKALQRPVASD
LNVIVHSATGIKQGSAALIRPVASD

SEQ ID NO: 3891 - protein, 25 aa, synthetic construct
  source 1..25: note = Seed: LNVIVHSATGFKQSSKALQRPVASD
LNVIVHSATGIKQGSAALLRPVASD

SEQ ID NO: 3892 - protein, 25 aa, synthetic construct
  source 1..25: note = Seed: LNVIVHSATGFKQSSKALQRPVASD
LNVIVHSATGIKQGSAALMRPVASD

SEQ ID NO: 3893 - protein, 25 aa, synthetic construct
  source 1..25: note = Seed: LNVIVHSATGFKQSSKALQRPVASD
LNVIVHSATGIKQGSAALVRPVASD

SEQ ID NO: 3894 - protein, 25 aa, synthetic construct
  source 1..25: note = Seed: LNVIVHSATGFKQSSKALQRPVASD
LNVIVHSATGIKQGSGALIRPVASD

SEQ ID NO: 3895 - protein, 25 aa, synthetic construct
  source 1..25: note = Seed: LNVIVHSATGFKQSSKALQRPVASD
LNVIVHSATGIKQGSGALLRPVASD

SEQ ID NO: 3896 - protein, 25 aa, synthetic construct
  source 1..25: note = Seed: LNVIVHSATGFKQSSKALQRPVASD
LNVIVHSATGIKQGSGALVRPVASD

SEQ ID NO: 3897 - protein, 25 aa, synthetic construct
  source 1..25: note = Seed: LNVIVHSATGFKQSSKALQRPVASD
LNVIVHSATGIKQGSPALLRPVASD

SEQ ID NO: 3898 - protein, 25 aa, synthetic construct
  source 1..25: note = Seed: LNVIVHSATGFKQSSKALQRPVASD
LNVIVHSATGIKQGSSALARPVASD

SEQ ID NO: 3899 - protein, 25 aa, synthetic construct
  source 1..25: note = Seed: LNVIVHSATGFKQSSKALQRPVASD
LNVIVHSATGIKQGSSALIRPVASD

SEQ ID NO: 3900 - protein, 25 aa, synthetic construct
  source 1..25: note = Seed: LNVIVHSATGFKQSSKALQRPVASD
LNVIVHSATGIKQGSSALLRPVASD

SEQ ID NO: 3901 - protein, 25 aa, synthetic construct
  source 1..25: note = Seed: LNVIVHSATGFKQSSKALQRPVASD
LNVIVHSATGIKQGSSALVRPVASD

SEQ ID NO: 3902 - protein, 25 aa, synthetic construct
  source 1..25: note = Seed: LNVIVHSATGFKQSSKALQRPVASD
LNVIVHSATGIKQHSAALARPVASD

SEQ ID NO: 3903 - protein, 25 aa, synthetic construct
  source 1..25: note = Seed: LNVIVHSATGFKQSSKALQRPVASD
LNVIVHSATGIKQHSAALFRPVASD

SEQ ID NO: 3904 - protein, 25 aa, synthetic construct
  source 1..25: note = Seed: LNVIVHSATGFKQSSKALQRPVASD
LNVIVHSATGIKQHSAALIRPVASD

SEQ ID NO: 3905 - protein, 25 aa, synthetic construct
  source 1..25: note = Seed: LNVIVHSATGFKQSSKALQRPVASD
LNVIVHSATGIKQHSAALKRPVASD

SEQ ID NO: 3906 - protein, 25 aa, synthetic construct
  source 1..25: note = Seed: LNVIVHSATGFKQSSKALQRPVASD
LNVIVHSATGIKQHSAALLRPVASD

SEQ ID NO: 3907 - protein, 25 aa, synthetic construct
  source 1..25: note = Seed: LNVIVHSATGFKQSSKALQRPVASD
LNVIVHSATGIKQHSAALRRPVASD

SEQ ID NO: 3908 - protein, 25 aa, synthetic construct
  source 1..25: note = Seed: LNVIVHSATGFKQSSKALQRPVASD
LNVIVHSATGIKQHSAALVRPVASD

SEQ ID NO: 3909 - protein, 25 aa, synthetic construct
  source 1..25: note = Seed: LNVIVHSATGFKQSSKALQRPVASD
LNVIVHSATGIKQHSAALYRPVASD

SEQ ID NO: 3910 - protein, 25 aa, synthetic construct
  source 1..25: note = Seed: LNVIVHSATGFKQSSKALQRPVASD
LNVIVHSATGIKQHSGALRRPVASD

SEQ ID NO: 3911 - protein, 25 aa, synthetic construct
  source 1..25: note = Seed: LNVIVHSATGFKQSSKALQRPVASD
LNVIVHSATGIKQHSHALRRPVASD

SEQ ID NO: 3912 - protein, 25 aa, synthetic construct
  source 1..25: note = Seed: LNVIVHSATGFKQSSKALQRPVASD
LNVIVHSATGIKQHSIALKRPVASD

SEQ ID NO: 3913 - protein, 25 aa, synthetic construct
  source 1..25: note = Seed: LNVIVHSATGFKQSSKALQRPVASD
LNVIVHSATGIKQHSIALRRPVASD

SEQ ID NO: 3914 - protein, 25 aa, synthetic construct
  source 1..25: note = Seed: LNVIVHSATGFKQSSKALQRPVASD
LNVIVHSATGIKQHSIALYRPVASD

SEQ ID NO: 3915 - protein, 25 aa, synthetic construct
  source 1..25: note = Seed: LNVIVHSATGFKQSSKALQRPVASD
LNVIVHSATGIKQHSKALARPVASD

SEQ ID NO: 3916 - protein, 25 aa, synthetic construct
  source 1..25: note = Seed: LNVIVHSATGFKQSSKALQRPVASD
LNVIVHSATGIKQHSKALFRPVASD

SEQ ID NO: 3917 - protein, 25 aa, synthetic construct
  source 1..25: note = Seed: LNVIVHSATGFKQSSKALQRPVASD
LNVIVHSATGIKQHSKALHRPVASD

SEQ ID NO: 3918 - protein, 25 aa, synthetic construct
  source 1..25: note = Seed: LNVIVHSATGFKQSSKALQRPVASD
LNVIVHSATGIKQHSKALIRPVASD

SEQ ID NO: 3919 - protein, 25 aa, synthetic construct
  source 1..25: note = Seed: LNVIVHSATGFKQSSKALQRPVASD
LNVIVHSATGIKQHSKALKRPVASD

SEQ ID NO: 3920 - protein, 25 aa, synthetic construct
  source 1..25: note = Seed: LNVIVHSATGFKQSSKALQRPVASD
LNVIVHSATGIKQHSKALLRPVASD

SEQ ID NO: 3921 - protein, 25 aa, synthetic construct
  source 1..25: note = Seed: LNVIVHSATGFKQSSKALQRPVASD
LNVIVHSATGIKQHSKALMRPVASD

SEQ ID NO: 3922 - protein, 25 aa, synthetic construct
  source 1..25: note = Seed: LNVIVHSATGFKQSSKALQRPVASD
LNVIVHSATGIKQHSKALRRPVASD

SEQ ID NO: 3923 - protein, 25 aa, synthetic construct
  source 1..25: note = Seed: LNVIVHSATGFKQSSKALQRPVASD
LNVIVHSATGIKQHSKALSRPVASD

SEQ ID NO: 3924 - protein, 25 aa, synthetic construct
  source 1..25: note = Seed: LNVIVHSATGFKQSSKALQRPVASD
LNVIVHSATGIKQHSKALVRPVASD

SEQ ID NO: 3925 - protein, 25 aa, synthetic construct
  source 1..25: note = Seed: LNVIVHSATGFKQSSKALQRPVASD
LNVIVHSATGIKQHSKALWRPVASD

SEQ ID NO: 3926 - protein, 25 aa, synthetic construct
  source 1..25: note = Seed: LNVIVHSATGFKQSSKALQRPVASD
LNVIVHSATGIKQHSKALYRPVASD

SEQ ID NO: 3927 - protein, 25 aa, synthetic construct
  source 1..25: note = Seed: LNVIVHSATGFKQSSKALQRPVASD
LNVIVHSATGIKQHSLALRRPVASD

SEQ ID NO: 3928 - protein, 25 aa, synthetic construct
  source 1..25: note = Seed: LNVIVHSATGFKQSSKALQRPVASD
LNVIVHSATGIKQHSMALRRPVASD

SEQ ID NO: 3929 - protein, 25 aa, synthetic construct
  source 1..25: note = Seed: LNVIVHSATGFKQSSKALQRPVASD
LNVIVHSATGIKQHSNALFRPVASD

SEQ ID NO: 3930 - protein, 25 aa, synthetic construct
  source 1..25: note = Seed: LNVIVHSATGFKQSSKALQRPVASD
LNVIVHSATGIKQHSNALIRPVASD

SEQ ID NO: 3931 - protein, 25 aa, synthetic construct
  source 1..25: note = Seed: LNVIVHSATGFKQSSKALQRPVASD
LNVIVHSATGIKQHSNALRRPVASD

SEQ ID NO: 3932 - protein, 25 aa, synthetic construct
  source 1..25: note = Seed: LNVIVHSATGFKQSSKALQRPVASD
LNVIVHSATGIKQHSNALVRPVASD

SEQ ID NO: 3933 - protein, 25 aa, synthetic construct
  source 1..25: note = Seed: LNVIVHSATGFKQSSKALQRPVASD
LNVIVHSATGIKQHSNALYRPVASD

SEQ ID NO: 3934 - protein, 25 aa, synthetic construct
  source 1..25: note = Seed: LNVIVHSATGFKQSSKALQRPVASD
LNVIVHSATGIKQHSPALIRPVASD

SEQ ID NO: 3935 - protein, 25 aa, synthetic construct
  source 1..25: note = Seed: LNVIVHSATGFKQSSKALQRPVASD
LNVIVHSATGIKQHSPALRRPVASD

SEQ ID NO: 3936 - protein, 25 aa, synthetic construct
  source 1..25: note = Seed: LNVIVHSATGFKQSSKALQRPVASD
LNVIVHSATGIKQHSPALVRPVASD

SEQ ID NO: 3937 - protein, 25 aa, synthetic construct
  source 1..25: note = Seed: LNVIVHSATGFKQSSKALQRPVASD
LNVIVHSATGIKQHSPALYRPVASD

SEQ ID NO: 3938 - protein, 25 aa, synthetic construct
  source 1..25: note = Seed: LNVIVHSATGFKQSSKALQRPVASD
LNVIVHSATGIKQHSRALARPVASD

SEQ ID NO: 3939 - protein, 25 aa, synthetic construct
  source 1..25: note = Seed: LNVIVHSATGFKQSSKALQRPVASD
LNVIVHSATGIKQHSRALFRPVASD

SEQ ID NO: 3940 - protein, 25 aa, synthetic construct
  source 1..25: note = Seed: LNVIVHSATGFKQSSKALQRPVASD
LNVIVHSATGIKQHSRALHRPVASD

SEQ ID NO: 3941 - protein, 25 aa, synthetic construct
  source 1..25: note = Seed: LNVIVHSATGFKQSSKALQRPVASD
LNVIVHSATGIKQHSRALIRPVASD

SEQ ID NO: 3942 - protein, 25 aa, synthetic construct
  source 1..25: note = Seed: LNVIVHSATGFKQSSKALQRPVASD
LNVIVHSATGIKQHSRALKRPVASD

SEQ ID NO: 3943 - protein, 25 aa, synthetic construct
  source 1..25: note = Seed: LNVIVHSATGFKQSSKALQRPVASD
LNVIVHSATGIKQHSRALLRPVASD

SEQ ID NO: 3944 - protein, 25 aa, synthetic construct
  source 1..25: note = Seed: LNVIVHSATGFKQSSKALQRPVASD
LNVIVHSATGIKQHSRALMRPVASD

SEQ ID NO: 3945 - protein, 25 aa, synthetic construct
  source 1..25: note = Seed: LNVIVHSATGFKQSSKALQRPVASD
LNVIVHSATGIKQHSRALRRPVASD

SEQ ID NO: 3946 - protein, 25 aa, synthetic construct
  source 1..25: note = Seed: LNVIVHSATGFKQSSKALQRPVASD
LNVIVHSATGIKQHSRALSRPVASD

SEQ ID NO: 3947 - protein, 25 aa, synthetic construct
  source 1..25: note = Seed: LNVIVHSATGFKQSSKALQRPVASD
LNVIVHSATGIKQHSRALTRPVASD

SEQ ID NO: 3948 - protein, 25 aa, synthetic construct
  source 1..25: note = Seed: LNVIVHSATGFKQSSKALQRPVASD
LNVIVHSATGIKQHSRALVRPVASD

SEQ ID NO: 3949 - protein, 25 aa, synthetic construct
  source 1..25: note = Seed: LNVIVHSATGFKQSSKALQRPVASD
LNVIVHSATGIKQHSRALWRPVASD

SEQ ID NO: 3950 - protein, 25 aa, synthetic construct
  source 1..25: note = Seed: LNVIVHSATGFKQSSKALQRPVASD
LNVIVHSATGIKQHSRALYRPVASD

SEQ ID NO: 3951 - protein, 25 aa, synthetic construct
  source 1..25: note = Seed: LNVIVHSATGFKQSSKALQRPVASD
LNVIVHSATGIKQHSSALIRPVASD

SEQ ID NO: 3952 - protein, 25 aa, synthetic construct
  source 1..25: note = Seed: LNVIVHSATGFKQSSKALQRPVASD
LNVIVHSATGIKQHSSALRRPVASD

SEQ ID NO: 3953 - protein, 25 aa, synthetic construct
  source 1..25: note = Seed: LNVIVHSATGFKQSSKALQRPVASD
LNVIVHSATGIKQHSSALVRPVASD

SEQ ID NO: 3954 - protein, 25 aa, synthetic construct
  source 1..25: note = Seed: LNVIVHSATGFKQSSKALQRPVASD
LNVIVHSATGIKQHSSALYRPVASD

SEQ ID NO: 3955 - protein, 25 aa, synthetic construct
  source 1..25: note = Seed: LNVIVHSATGFKQSSKALQRPVASD
LNVIVHSATGIKQHSTALRRPVASD

SEQ ID NO: 3956 - protein, 25 aa, synthetic construct
  source 1..25: note = Seed: LNVIVHSATGFKQSSKALQRPVASD
LNVIVHSATGIKQHSTALYRPVASD

SEQ ID NO: 3957 - protein, 25 aa, synthetic construct
  source 1..25: note = Seed: LNVIVHSATGFKQSSKALQRPVASD
LNVIVHSATGIKQHSVALKRPVASD

SEQ ID NO: 3958 - protein, 25 aa, synthetic construct
  source 1..25: note = Seed: LNVIVHSATGFKQSSKALQRPVASD
LNVIVHSATGIKQHSVALRRPVASD

SEQ ID NO: 3959 - protein, 25 aa, synthetic construct
  source 1..25: note = Seed: LNVIVHSATGFKQSSKALQRPVASD
LNVIVHSATGIKQHSVALYRPVASD

SEQ ID NO: 3960 - protein, 25 aa, synthetic construct
  source 1..25: note = Seed: LNVIVHSATGFKQSSKALQRPVASD
LNVIVHSATGIKQISAALARPVASD

SEQ ID NO: 3961 - protein, 25 aa, synthetic construct
  source 1..25: note = Seed: LNVIVHSATGFKQSSKALQRPVASD
LNVIVHSATGIKQISAALCRPVASD

SEQ ID NO: 3962 - protein, 25 aa, synthetic construct
  source 1..25: note = Seed: LNVIVHSATGFKQSSKALQRPVASD
LNVIVHSATGIKQISAALGRPVASD

SEQ ID NO: 3963 - protein, 25 aa, synthetic construct
  source 1..25: note = Seed: LNVIVHSATGFKQSSKALQRPVASD
LNVIVHSATGIKQISAALHRPVASD

SEQ ID NO: 3964 - protein, 25 aa, synthetic construct
  source 1..25: note = Seed: LNVIVHSATGFKQSSKALQRPVASD
LNVIVHSATGIKQISAALKRPVASD

SEQ ID NO: 3965 - protein, 25 aa, synthetic construct
  source 1..25: note = Seed: LNVIVHSATGFKQSSKALQRPVASD
LNVIVHSATGIKQISAALLRPVASD

SEQ ID NO: 3966 - protein, 25 aa, synthetic construct
  source 1..25: note = Seed: LNVIVHSATGFKQSSKALQRPVASD
LNVIVHSATGIKQISAALMRPVASD

SEQ ID NO: 3967 - protein, 25 aa, synthetic construct
  source 1..25: note = Seed: LNVIVHSATGFKQSSKALQRPVASD
LNVIVHSATGIKQISAALNRPVASD

SEQ ID NO: 3968 - protein, 25 aa, synthetic construct
  source 1..25: note = Seed: LNVIVHSATGFKQSSKALQRPVASD
LNVIVHSATGIKQISAALPRPVASD

SEQ ID NO: 3969 - protein, 25 aa, synthetic construct
  source 1..25: note = Seed: LNVIVHSATGFKQSSKALQRPVASD
LNVIVHSATGIKQISAALQRPVASD

SEQ ID NO: 3970 - protein, 25 aa, synthetic construct
  source 1..25: note = Seed: LNVIVHSATGFKQSSKALQRPVASD
LNVIVHSATGIKQISAALRRPVASD

SEQ ID NO: 3971 - protein, 25 aa, synthetic construct
  source 1..25: note = Seed: LNVIVHSATGFKQSSKALQRPVASD
LNVIVHSATGIKQISAALSRPVASD

SEQ ID NO: 3972 - protein, 25 aa, synthetic construct
  source 1..25: note = Seed: LNVIVHSATGFKQSSKALQRPVASD
LNVIVHSATGIKQISAALTRPVASD

SEQ ID NO: 3973 - protein, 25 aa, synthetic construct
  source 1..25: note = Seed: LNVIVHSATGFKQSSKALQRPVASD
LNVIVHSATGIKQISAALVRPVASD

SEQ ID NO: 3974 - protein, 25 aa, synthetic construct
  source 1..25: note = Seed: LNVIVHSATGFKQSSKALQRPVASD
LNVIVHSATGIKQISAALYRPVASD

SEQ ID NO: 3975 - protein, 25 aa, synthetic construct
  source 1..25: note = Seed: LNVIVHSATGFKQSSKALQRPVASD
LNVIVHSATGIKQISFALMRPVASD

SEQ ID NO: 3976 - protein, 25 aa, synthetic construct
  source 1..25: note = Seed: LNVIVHSATGFKQSSKALQRPVASD
LNVIVHSATGIKQISFALVRPVASD

SEQ ID NO: 3977 - protein, 25 aa, synthetic construct
  source 1..25: note = Seed: LNVIVHSATGFKQSSKALQRPVASD
LNVIVHSATGIKQISGALARPVASD

SEQ ID NO: 3978 - protein, 25 aa, synthetic construct
  source 1..25: note = Seed: LNVIVHSATGFKQSSKALQRPVASD
LNVIVHSATGIKQISGALCRPVASD

SEQ ID NO: 3979 - protein, 25 aa, synthetic construct
  source 1..25: note = Seed: LNVIVHSATGFKQSSKALQRPVASD
LNVIVHSATGIKQISGALGRPVASD

SEQ ID NO: 3980 - protein, 25 aa, synthetic construct
  source 1..25: note = Seed: LNVIVHSATGFKQSSKALQRPVASD
LNVIVHSATGIKQISGALIRPVASD

SEQ ID NO: 3981 - protein, 25 aa, synthetic construct
  source 1..25: note = Seed: LNVIVHSATGFKQSSKALQRPVASD
LNVIVHSATGIKQISGALLRPVASD

SEQ ID NO: 3982 - protein, 25 aa, synthetic construct
  source 1..25: note = Seed: LNVIVHSATGFKQSSKALQRPVASD
LNVIVHSATGIKQISGALMRPVASD

SEQ ID NO: 3983 - protein, 25 aa, synthetic construct
  source 1..25: note = Seed: LNVIVHSATGFKQSSKALQRPVASD
LNVIVHSATGIKQISGALNRPVASD

SEQ ID NO: 3984 - protein, 25 aa, synthetic construct
  source 1..25: note = Seed: LNVIVHSATGFKQSSKALQRPVASD
LNVIVHSATGIKQISGALRRPVASD

SEQ ID NO: 3985 - protein, 25 aa, synthetic construct
  source 1..25: note = Seed: LNVIVHSATGFKQSSKALQRPVASD
LNVIVHSATGIKQISGALSRPVASD

SEQ ID NO: 3986 - protein, 25 aa, synthetic construct
  source 1..25: note = Seed: LNVIVHSATGFKQSSKALQRPVASD
LNVIVHSATGIKQISGALTRPVASD

SEQ ID NO: 3987 - protein, 25 aa, synthetic construct
  source 1..25: note = Seed: LNVIVHSATGFKQSSKALQRPVASD
LNVIVHSATGIKQISGALVRPVASD

SEQ ID NO: 3988 - protein, 25 aa, synthetic construct
  source 1..25: note = Seed: LNVIVHSATGFKQSSKALQRPVASD
LNVIVHSATGIKQISHALARPVASD

SEQ ID NO: 3989 - protein, 25 aa, synthetic construct
  source 1..25: note = Seed: LNVIVHSATGFKQSSKALQRPVASD
LNVIVHSATGIKQISHALGRPVASD

SEQ ID NO: 3990 - protein, 25 aa, synthetic construct
  source 1..25: note = Seed: LNVIVHSATGFKQSSKALQRPVASD
LNVIVHSATGIKQISHALHRPVASD

SEQ ID NO: 3991 - protein, 25 aa, synthetic construct
  source 1..25: note = Seed: LNVIVHSATGFKQSSKALQRPVASD
LNVIVHSATGIKQISHALIRPVASD

SEQ ID NO: 3992 - protein, 25 aa, synthetic construct
  source 1..25: note = Seed: LNVIVHSATGFKQSSKALQRPVASD
LNVIVHSATGIKQISHALKRPVASD

SEQ ID NO: 3993 - protein, 25 aa, synthetic construct
  source 1..25: note = Seed: LNVIVHSATGFKQSSKALQRPVASD
LNVIVHSATGIKQISHALNRPVASD

SEQ ID NO: 3994 - protein, 25 aa, synthetic construct
  source 1..25: note = Seed: LNVIVHSATGFKQSSKALQRPVASD
LNVIVHSATGIKQISHALRRPVASD

SEQ ID NO: 3995 - protein, 25 aa, synthetic construct
  source 1..25: note = Seed: LNVIVHSATGFKQSSKALQRPVASD
LNVIVHSATGIKQISHALSRPVASD

SEQ ID NO: 3996 - protein, 25 aa, synthetic construct
  source 1..25: note = Seed: LNVIVHSATGFKQSSKALQRPVASD
LNVIVHSATGIKQISHALTRPVASD

SEQ ID NO: 3997 - protein, 25 aa, synthetic construct
  source 1..25: note = Seed: LNVIVHSATGFKQSSKALQRPVASD
LNVIVHSATGIKQISHALVRPVASD

SEQ ID NO: 3998 - protein, 25 aa, synthetic construct
  source 1..25: note = Seed: LNVIVHSATGFKQSSKALQRPVASD
LNVIVHSATGIKQISHALYRPVASD

SEQ ID NO: 3999 - protein, 25 aa, synthetic construct
  source 1..25: note = Seed: LNVIVHSATGFKQSSKALQRPVASD
LNVIVHSATGIKQISIALARPVASD

SEQ ID NO: 4000 - protein, 25 aa, synthetic construct
  source 1..25: note = Seed: LNVIVHSATGFKQSSKALQRPVASD
LNVIVHSATGIKQISIALGRPVASD

SEQ ID NO: 4001 - protein, 25 aa, synthetic construct
  source 1..25: note = Seed: LNVIVHSATGFKQSSKALQRPVASD
LNVIVHSATGIKQISIALHRPVASD

SEQ ID NO: 4002 - protein, 25 aa, synthetic construct
  source 1..25: note = Seed: LNVIVHSATGFKQSSKALQRPVASD
LNVIVHSATGIKQISIALIRPVASD

SEQ ID NO: 4003 - protein, 25 aa, synthetic construct
  source 1..25: note = Seed: LNVIVHSATGFKQSSKALQRPVASD
LNVIVHSATGIKQISIALNRPVASD

SEQ ID NO: 4004 - protein, 25 aa, synthetic construct
  source 1..25: note = Seed: LNVIVHSATGFKQSSKALQRPVASD
LNVIVHSATGIKQISIALQRPVASD

SEQ ID NO: 4005 - protein, 25 aa, synthetic construct
  source 1..25: note = Seed: LNVIVHSATGFKQSSKALQRPVASD
LNVIVHSATGIKQISIALRRPVASD

SEQ ID NO: 4006 - protein, 25 aa, synthetic construct
  source 1..25: note = Seed: LNVIVHSATGFKQSSKALQRPVASD
LNVIVHSATGIKQISIALSRPVASD

SEQ ID NO: 4007 - protein, 25 aa, synthetic construct
  source 1..25: note = Seed: LNVIVHSATGFKQSSKALQRPVASD
LNVIVHSATGIKQISIALTRPVASD

SEQ ID NO: 4008 - protein, 25 aa, synthetic construct
  source 1..25: note = Seed: LNVIVHSATGFKQSSKALQRPVASD
LNVIVHSATGIKQISIALVRPVASD

SEQ ID NO: 4009 - protein, 25 aa, synthetic construct
  source 1..25: note = Seed: LNVIVHSATGFKQSSKALQRPVASD
LNVIVHSATGIKQISKALARPVASD

SEQ ID NO: 4010 - protein, 25 aa, synthetic construct
  source 1..25: note = Seed: LNVIVHSATGFKQSSKALQRPVASD
LNVIVHSATGIKQISKALCRPVASD

SEQ ID NO: 4011 - protein, 25 aa, synthetic construct
  source 1..25: note = Seed: LNVIVHSATGFKQSSKALQRPVASD
LNVIVHSATGIKQISKALFRPVASD

SEQ ID NO: 4012 - protein, 25 aa, synthetic construct
  source 1..25: note = Seed: LNVIVHSATGFKQSSKALQRPVASD
LNVIVHSATGIKQISKALGRPVASD

SEQ ID NO: 4013 - protein, 25 aa, synthetic construct
  source 1..25: note = Seed: LNVIVHSATGFKQSSKALQRPVASD
LNVIVHSATGIKQISKALHRPVASD

SEQ ID NO: 4014 - protein, 25 aa, synthetic construct
  source 1..25: note = Seed: LNVIVHSATGFKQSSKALQRPVASD
LNVIVHSATGIKQISKALIRPVASD

SEQ ID NO: 4015 - protein, 25 aa, synthetic construct
  source 1..25: note = Seed: LNVIVHSATGFKQSSKALQRPVASD
LNVIVHSATGIKQISKALKRPVASD

SEQ ID NO: 4016 - protein, 25 aa, synthetic construct
  source 1..25: note = Seed: LNVIVHSATGFKQSSKALQRPVASD
LNVIVHSATGIKQISKALLRPVASD

SEQ ID NO: 4017 - protein, 25 aa, synthetic construct
  source 1..25: note = Seed: LNVIVHSATGFKQSSKALQRPVASD
LNVIVHSATGIKQISKALMRPVASD

SEQ ID NO: 4018 - protein, 25 aa, synthetic construct
  source 1..25: note = Seed: LNVIVHSATGFKQSSKALQRPVASD
LNVIVHSATGIKQISKALNRPVASD

SEQ ID NO: 4019 - protein, 25 aa, synthetic construct
  source 1..25: note = Seed: LNVIVHSATGFKQSSKALQRPVASD
LNVIVHSATGIKQISKALPRPVASD

SEQ ID NO: 4020 - protein, 25 aa, synthetic construct
  source 1..25: note = Seed: LNVIVHSATGFKQSSKALQRPVASD
LNVIVHSATGIKQISKALQRPVASD

SEQ ID NO: 4021 - protein, 25 aa, synthetic construct
  source 1..25: note = Seed: LNVIVHSATGFKQSSKALQRPVASD
LNVIVHSATGIKQISKALRRPVASD

SEQ ID NO: 4022 - protein, 25 aa, synthetic construct
  source 1..25: note = Seed: LNVIVHSATGFKQSSKALQRPVASD
LNVIVHSATGIKQISKALSRPVASD

SEQ ID NO: 4023 - protein, 25 aa, synthetic construct
  source 1..25: note = Seed: LNVIVHSATGFKQSSKALQRPVASD
LNVIVHSATGIKQISKALTRPVASD

SEQ ID NO: 4024 - protein, 25 aa, synthetic construct
  source 1..25: note = Seed: LNVIVHSATGFKQSSKALQRPVASD
LNVIVHSATGIKQISKALVRPVASD

SEQ ID NO: 4025 - protein, 25 aa, synthetic construct
  source 1..25: note = Seed: LNVIVHSATGFKQSSKALQRPVASD
LNVIVHSATGIKQISKALWRPVASD

SEQ ID NO: 4026 - protein, 25 aa, synthetic construct
  source 1..25: note = Seed: LNVIVHSATGFKQSSKALQRPVASD
LNVIVHSATGIKQISKALYRPVASD

SEQ ID NO: 4027 - protein, 25 aa, synthetic construct
  source 1..25: note = Seed: LNVIVHSATGFKQSSKALQRPVASD
LNVIVHSATGIKQISLALGRPVASD

SEQ ID NO: 4028 - protein, 25 aa, synthetic construct
  source 1..25: note = Seed: LNVIVHSATGFKQSSKALQRPVASD
LNVIVHSATGIKQISLALIRPVASD

SEQ ID NO: 4029 - protein, 25 aa, synthetic construct
  source 1..25: note = Seed: LNVIVHSATGFKQSSKALQRPVASD
LNVIVHSATGIKQISLALLRPVASD

SEQ ID NO: 4030 - protein, 25 aa, synthetic construct
  source 1..25: note = Seed: LNVIVHSATGFKQSSKALQRPVASD
LNVIVHSATGIKQISLALMRPVASD

SEQ ID NO: 4031 - protein, 25 aa, synthetic construct
  source 1..25: note = Seed: LNVIVHSATGFKQSSKALQRPVASD
LNVIVHSATGIKQISLALNRPVASD

SEQ ID NO: 4032 - protein, 25 aa, synthetic construct
  source 1..25: note = Seed: LNVIVHSATGFKQSSKALQRPVASD
LNVIVHSATGIKQISLALRRPVASD

SEQ ID NO: 4033 - protein, 25 aa, synthetic construct
  source 1..25: note = Seed: LNVIVHSATGFKQSSKALQRPVASD
LNVIVHSATGIKQISLALSRPVASD

SEQ ID NO: 4034 - protein, 25 aa, synthetic construct
  source 1..25: note = Seed: LNVIVHSATGFKQSSKALQRPVASD
LNVIVHSATGIKQISMALGRPVASD

SEQ ID NO: 4035 - protein, 25 aa, synthetic construct
  source 1..25: note = Seed: LNVIVHSATGFKQSSKALQRPVASD
LNVIVHSATGIKQISMALNRPVASD

SEQ ID NO: 4036 - protein, 25 aa, synthetic construct
  source 1..25: note = Seed: LNVIVHSATGFKQSSKALQRPVASD
LNVIVHSATGIKQISNALARPVASD

SEQ ID NO: 4037 - protein, 25 aa, synthetic construct
  source 1..25: note = Seed: LNVIVHSATGFKQSSKALQRPVASD
LNVIVHSATGIKQISNALFRPVASD

SEQ ID NO: 4038 - protein, 25 aa, synthetic construct
  source 1..25: note = Seed: LNVIVHSATGFKQSSKALQRPVASD
LNVIVHSATGIKQISNALGRPVASD

SEQ ID NO: 4039 - protein, 25 aa, synthetic construct
  source 1..25: note = Seed: LNVIVHSATGFKQSSKALQRPVASD
LNVIVHSATGIKQISNALIRPVASD

SEQ ID NO: 4040 - protein, 25 aa, synthetic construct
  source 1..25: note = Seed: LNVIVHSATGFKQSSKALQRPVASD
LNVIVHSATGIKQISNALLRPVASD

SEQ ID NO: 4041 - protein, 25 aa, synthetic construct
  source 1..25: note = Seed: LNVIVHSATGFKQSSKALQRPVASD
LNVIVHSATGIKQISNALMRPVASD

SEQ ID NO: 4042 - protein, 25 aa, synthetic construct
  source 1..25: note = Seed: LNVIVHSATGFKQSSKALQRPVASD
LNVIVHSATGIKQISNALNRPVASD

SEQ ID NO: 4043 - protein, 25 aa, synthetic construct
  source 1..25: note = Seed: LNVIVHSATGFKQSSKALQRPVASD
LNVIVHSATGIKQISNALRRPVASD

SEQ ID NO: 4044 - protein, 25 aa, synthetic construct
  source 1..25: note = Seed: LNVIVHSATGFKQSSKALQRPVASD
LNVIVHSATGIKQISNALSRPVASD

SEQ ID NO: 4045 - protein, 25 aa, synthetic construct
  source 1..25: note = Seed: LNVIVHSATGFKQSSKALQRPVASD
LNVIVHSATGIKQISNALTRPVASD

SEQ ID NO: 4046 - protein, 25 aa, synthetic construct
  source 1..25: note = Seed: LNVIVHSATGFKQSSKALQRPVASD
LNVIVHSATGIKQISNALVRPVASD

SEQ ID NO: 4047 - protein, 25 aa, synthetic construct
  source 1..25: note = Seed: LNVIVHSATGFKQSSKALQRPVASD
LNVIVHSATGIKQISNALYRPVASD

SEQ ID NO: 4048 - protein, 25 aa, synthetic construct
  source 1..25: note = Seed: LNVIVHSATGFKQSSKALQRPVASD
LNVIVHSATGIKQISPALARPVASD

SEQ ID NO: 4049 - protein, 25 aa, synthetic construct
  source 1..25: note = Seed: LNVIVHSATGFKQSSKALQRPVASD
LNVIVHSATGIKQISPALCRPVASD

SEQ ID NO: 4050 - protein, 25 aa, synthetic construct
  source 1..25: note = Seed: LNVIVHSATGFKQSSKALQRPVASD
LNVIVHSATGIKQISPALGRPVASD

SEQ ID NO: 4051 - protein, 25 aa, synthetic construct
  source 1..25: note = Seed: LNVIVHSATGFKQSSKALQRPVASD
LNVIVHSATGIKQISPALHRPVASD

SEQ ID NO: 4052 - protein, 25 aa, synthetic construct
  source 1..25: note = Seed: LNVIVHSATGFKQSSKALQRPVASD
LNVIVHSATGIKQISPALIRPVASD

SEQ ID NO: 4053 - protein, 25 aa, synthetic construct
  source 1..25: note = Seed: LNVIVHSATGFKQSSKALQRPVASD
LNVIVHSATGIKQISPALLRPVASD

SEQ ID NO: 4054 - protein, 25 aa, synthetic construct
  source 1..25: note = Seed: LNVIVHSATGFKQSSKALQRPVASD
LNVIVHSATGIKQISPALMRPVASD

SEQ ID NO: 4055 - protein, 25 aa, synthetic construct
  source 1..25: note = Seed: LNVIVHSATGFKQSSKALQRPVASD
LNVIVHSATGIKQISPALNRPVASD

SEQ ID NO: 4056 - protein, 25 aa, synthetic construct
  source 1..25: note = Seed: LNVIVHSATGFKQSSKALQRPVASD
LNVIVHSATGIKQISPALQRPVASD

SEQ ID NO: 4057 - protein, 25 aa, synthetic construct
  source 1..25: note = Seed: LNVIVHSATGFKQSSKALQRPVASD
LNVIVHSATGIKQISPALRRPVASD

SEQ ID NO: 4058 - protein, 25 aa, synthetic construct
  source 1..25: note = Seed: LNVIVHSATGFKQSSKALQRPVASD
LNVIVHSATGIKQISPALSRPVASD

SEQ ID NO: 4059 - protein, 25 aa, synthetic construct
  source 1..25: note = Seed: LNVIVHSATGFKQSSKALQRPVASD
LNVIVHSATGIKQISPALTRPVASD

SEQ ID NO: 4060 - protein, 25 aa, synthetic construct
  source 1..25: note = Seed: LNVIVHSATGFKQSSKALQRPVASD
LNVIVHSATGIKQISPALVRPVASD

SEQ ID NO: 4061 - protein, 25 aa, synthetic construct
  source 1..25: note = Seed: LNVIVHSATGFKQSSKALQRPVASD
LNVIVHSATGIKQISPALYRPVASD

SEQ ID NO: 4062 - protein, 25 aa, synthetic construct
  source 1..25: note = Seed: LNVIVHSATGFKQSSKALQRPVASD
LNVIVHSATGIKQISQALRRPVASD

SEQ ID NO: 4063 - protein, 25 aa, synthetic construct
  source 1..25: note = Seed: LNVIVHSATGFKQSSKALQRPVASD
LNVIVHSATGIKQISRALCRPVASD

SEQ ID NO: 4064 - protein, 25 aa, synthetic construct
  source 1..25: note = Seed: LNVIVHSATGFKQSSKALQRPVASD
LNVIVHSATGIKQISRALERPVASD

SEQ ID NO: 4065 - protein, 25 aa, synthetic construct
  source 1..25: note = Seed: LNVIVHSATGFKQSSKALQRPVASD
LNVIVHSATGIKQISRALFRPVASD

SEQ ID NO: 4066 - protein, 25 aa, synthetic construct
  source 1..25: note = Seed: LNVIVHSATGFKQSSKALQRPVASD
LNVIVHSATGIKQISRALGRPVASD

SEQ ID NO: 4067 - protein, 25 aa, synthetic construct
  source 1..25: note = Seed: LNVIVHSATGFKQSSKALQRPVASD
LNVIVHSATGIKQISRALHRPVASD

SEQ ID NO: 4068 - protein, 25 aa, synthetic construct
  source 1..25: note = Seed: LNVIVHSATGFKQSSKALQRPVASD
LNVIVHSATGIKQISRALIRPVASD

SEQ ID NO: 4069 - protein, 25 aa, synthetic construct
  source 1..25: note = Seed: LNVIVHSATGFKQSSKALQRPVASD
LNVIVHSATGIKQISRALKRPVASD

SEQ ID NO: 4070 - protein, 25 aa, synthetic construct
  source 1..25: note = Seed: LNVIVHSATGFKQSSKALQRPVASD
LNVIVHSATGIKQISRALLRPVASD

SEQ ID NO: 4071 - protein, 25 aa, synthetic construct
  source 1..25: note = Seed: LNVIVHSATGFKQSSKALQRPVASD
LNVIVHSATGIKQISRALMRPVASD

SEQ ID NO: 4072 - protein, 25 aa, synthetic construct
  source 1..25: note = Seed: LNVIVHSATGFKQSSKALQRPVASD
LNVIVHSATGIKQISRALNRPVASD

SEQ ID NO: 4073 - protein, 25 aa, synthetic construct
  source 1..25: note = Seed: LNVIVHSATGFKQSSKALQRPVASD
LNVIVHSATGIKQISRALPRPVASD

SEQ ID NO: 4074 - protein, 25 aa, synthetic construct
  source 1..25: note = Seed: LNVIVHSATGFKQSSKALQRPVASD
LNVIVHSATGIKQISRALQRPVASD

SEQ ID NO: 4075 - protein, 25 aa, synthetic construct
  source 1..25: note = Seed: LNVIVHSATGFKQSSKALQRPVASD
LNVIVHSATGIKQISRALRRPVASD

SEQ ID NO: 4076 - protein, 25 aa, synthetic construct
  source 1..25: note = Seed: LNVIVHSATGFKQSSKALQRPVASD
LNVIVHSATGIKQISRALSRPVASD

SEQ ID NO: 4077 - protein, 25 aa, synthetic construct
  source 1..25: note = Seed: LNVIVHSATGFKQSSKALQRPVASD
LNVIVHSATGIKQISRALTRPVASD

SEQ ID NO: 4078 - protein, 25 aa, synthetic construct
  source 1..25: note = Seed: LNVIVHSATGFKQSSKALQRPVASD
LNVIVHSATGIKQISRALVRPVASD

SEQ ID NO: 4079 - protein, 25 aa, synthetic construct
  source 1..25: note = Seed: LNVIVHSATGFKQSSKALQRPVASD
LNVIVHSATGIKQISRALWRPVASD

SEQ ID NO: 4080 - protein, 25 aa, synthetic construct
  source 1..25: note = Seed: LNVIVHSATGFKQSSKALQRPVASD
LNVIVHSATGIKQISRALYRPVASD

SEQ ID NO: 4081 - protein, 25 aa, synthetic construct
  source 1..25: note = Seed: LNVIVHSATGFKQSSKALQRPVASD
LNVIVHSATGIKQISSALARPVASD

SEQ ID NO: 4082 - protein, 25 aa, synthetic construct
  source 1..25: note = Seed: LNVIVHSATGFKQSSKALQRPVASD
LNVIVHSATGIKQISSALCRPVASD

SEQ ID NO: 4083 - protein, 25 aa, synthetic construct
  source 1..25: note = Seed: LNVIVHSATGFKQSSKALQRPVASD
LNVIVHSATGIKQISSALFRPVASD

SEQ ID NO: 4084 - protein, 25 aa, synthetic construct
  source 1..25: note = Seed: LNVIVHSATGFKQSSKALQRPVASD
LNVIVHSATGIKQISSALGRPVASD

SEQ ID NO: 4085 - protein, 25 aa, synthetic construct
  source 1..25: note = Seed: LNVIVHSATGFKQSSKALQRPVASD
LNVIVHSATGIKQISSALLRPVASD

SEQ ID NO: 4086 - protein, 25 aa, synthetic construct
  source 1..25: note = Seed: LNVIVHSATGFKQSSKALQRPVASD
LNVIVHSATGIKQISSALMRPVASD

SEQ ID NO: 4087 - protein, 25 aa, synthetic construct
  source 1..25: note = Seed: LNVIVHSATGFKQSSKALQRPVASD
LNVIVHSATGIKQISSALNRPVASD

SEQ ID NO: 4088 - protein, 25 aa, synthetic construct
  source 1..25: note = Seed: LNVIVHSATGFKQSSKALQRPVASD
LNVIVHSATGIKQISSALRRPVASD

SEQ ID NO: 4089 - protein, 25 aa, synthetic construct
  source 1..25: note = Seed: LNVIVHSATGFKQSSKALQRPVASD
LNVIVHSATGIKQISSALSRPVASD

SEQ ID NO: 4090 - protein, 25 aa, synthetic construct
  source 1..25: note = Seed: LNVIVHSATGFKQSSKALQRPVASD
LNVIVHSATGIKQISSALTRPVASD

SEQ ID NO: 4091 - protein, 25 aa, synthetic construct
  source 1..25: note = Seed: LNVIVHSATGFKQSSKALQRPVASD
LNVIVHSATGIKQISSALVRPVASD

SEQ ID NO: 4092 - protein, 25 aa, synthetic construct
  source 1..25: note = Seed: LNVIVHSATGFKQSSKALQRPVASD
LNVIVHSATGIKQISSALYRPVASD

SEQ ID NO: 4093 - protein, 25 aa, synthetic construct
  source 1..25: note = Seed: LNVIVHSATGFKQSSKALQRPVASD
LNVIVHSATGIKQISTALARPVASD

SEQ ID NO: 4094 - protein, 25 aa, synthetic construct
  source 1..25: note = Seed: LNVIVHSATGFKQSSKALQRPVASD
LNVIVHSATGIKQISTALGRPVASD

SEQ ID NO: 4095 - protein, 25 aa, synthetic construct
  source 1..25: note = Seed: LNVIVHSATGFKQSSKALQRPVASD
LNVIVHSATGIKQISTALIRPVASD

SEQ ID NO: 4096 - protein, 25 aa, synthetic construct
  source 1..25: note = Seed: LNVIVHSATGFKQSSKALQRPVASD
LNVIVHSATGIKQISTALLRPVASD

SEQ ID NO: 4097 - protein, 25 aa, synthetic construct
  source 1..25: note = Seed: LNVIVHSATGFKQSSKALQRPVASD
LNVIVHSATGIKQISTALMRPVASD

SEQ ID NO: 4098 - protein, 25 aa, synthetic construct
  source 1..25: note = Seed: LNVIVHSATGFKQSSKALQRPVASD
LNVIVHSATGIKQISTALNRPVASD

SEQ ID NO: 4099 - protein, 25 aa, synthetic construct
  source 1..25: note = Seed: LNVIVHSATGFKQSSKALQRPVASD
LNVIVHSATGIKQISTALRRPVASD

SEQ ID NO: 4100 - protein, 25 aa, synthetic construct
  source 1..25: note = Seed: LNVIVHSATGFKQSSKALQRPVASD
LNVIVHSATGIKQISTALSRPVASD

SEQ ID NO: 4101 - protein, 25 aa, synthetic construct
  source 1..25: note = Seed: LNVIVHSATGFKQSSKALQRPVASD
LNVIVHSATGIKQISTALTRPVASD

SEQ ID NO: 4102 - protein, 25 aa, synthetic construct
  source 1..25: note = Seed: LNVIVHSATGFKQSSKALQRPVASD
LNVIVHSATGIKQISTALVRPVASD

SEQ ID NO: 4103 - protein, 25 aa, synthetic construct
  source 1..25: note = Seed: LNVIVHSATGFKQSSKALQRPVASD
LNVIVHSATGIKQISVALARPVASD

SEQ ID NO: 4104 - protein, 25 aa, synthetic construct
  source 1..25: note = Seed: LNVIVHSATGFKQSSKALQRPVASD
LNVIVHSATGIKQISVALGRPVASD

SEQ ID NO: 4105 - protein, 25 aa, synthetic construct
  source 1..25: note = Seed: LNVIVHSATGFKQSSKALQRPVASD
LNVIVHSATGIKQISVALHRPVASD

SEQ ID NO: 4106 - protein, 25 aa, synthetic construct
  source 1..25: note = Seed: LNVIVHSATGFKQSSKALQRPVASD
LNVIVHSATGIKQISVALIRPVASD

SEQ ID NO: 4107 - protein, 25 aa, synthetic construct
  source 1..25: note = Seed: LNVIVHSATGFKQSSKALQRPVASD
LNVIVHSATGIKQISVALLRPVASD

SEQ ID NO: 4108 - protein, 25 aa, synthetic construct
  source 1..25: note = Seed: LNVIVHSATGFKQSSKALQRPVASD
LNVIVHSATGIKQISVALMRPVASD

SEQ ID NO: 4109 - protein, 25 aa, synthetic construct
  source 1..25: note = Seed: LNVIVHSATGFKQSSKALQRPVASD
LNVIVHSATGIKQISVALNRPVASD

SEQ ID NO: 4110 - protein, 25 aa, synthetic construct
  source 1..25: note = Seed: LNVIVHSATGFKQSSKALQRPVASD
LNVIVHSATGIKQISVALQRPVASD

SEQ ID NO: 4111 - protein, 25 aa, synthetic construct
  source 1..25: note = Seed: LNVIVHSATGFKQSSKALQRPVASD
LNVIVHSATGIKQISVALRRPVASD

SEQ ID NO: 4112 - protein, 25 aa, synthetic construct
  source 1..25: note = Seed: LNVIVHSATGFKQSSKALQRPVASD
LNVIVHSATGIKQISVALSRPVASD

SEQ ID NO: 4113 - protein, 25 aa, synthetic construct
  source 1..25: note = Seed: LNVIVHSATGFKQSSKALQRPVASD
LNVIVHSATGIKQISVALTRPVASD

SEQ ID NO: 4114 - protein, 25 aa, synthetic construct
  source 1..25: note = Seed: LNVIVHSATGFKQSSKALQRPVASD
LNVIVHSATGIKQISVALVRPVASD

SEQ ID NO: 4115 - protein, 25 aa, synthetic construct
  source 1..25: note = Seed: LNVIVHSATGFKQSSKALQRPVASD
LNVIVHSATGIKQKSAALRRPVASD

SEQ ID NO: 4116 - protein, 25 aa, synthetic construct
  source 1..25: note = Seed: LNVIVHSATGFKQSSKALQRPVASD
LNVIVHSATGIKQKSIALRRPVASD

SEQ ID NO: 4117 - protein, 25 aa, synthetic construct
  source 1..25: note = Seed: LNVIVHSATGFKQSSKALQRPVASD
LNVIVHSATGIKQKSKALARPVASD

SEQ ID NO: 4118 - protein, 25 aa, synthetic construct
  source 1..25: note = Seed: LNVIVHSATGFKQSSKALQRPVASD
LNVIVHSATGIKQKSKALFRPVASD

SEQ ID NO: 4119 - protein, 25 aa, synthetic construct
  source 1..25: note = Seed: LNVIVHSATGFKQSSKALQRPVASD
LNVIVHSATGIKQKSKALKRPVASD

SEQ ID NO: 4120 - protein, 25 aa, synthetic construct
  source 1..25: note = Seed: LNVIVHSATGFKQSSKALQRPVASD
LNVIVHSATGIKQKSKALRRPVASD

SEQ ID NO: 4121 - protein, 25 aa, synthetic construct
  source 1..25: note = Seed: LNVIVHSATGFKQSSKALQRPVASD
LNVIVHSATGIKQKSKALSRPVASD

SEQ ID NO: 4122 - protein, 25 aa, synthetic construct
  source 1..25: note = Seed: LNVIVHSATGFKQSSKALQRPVASD
LNVIVHSATGIKQKSKALYRPVASD

SEQ ID NO: 4123 - protein, 25 aa, synthetic construct
  source 1..25: note = Seed: LNVIVHSATGFKQSSKALQRPVASD
LNVIVHSATGIKQKSRALARPVASD

SEQ ID NO: 4124 - protein, 25 aa, synthetic construct
  source 1..25: note = Seed: LNVIVHSATGFKQSSKALQRPVASD
LNVIVHSATGIKQKSRALFRPVASD

SEQ ID NO: 4125 - protein, 25 aa, synthetic construct
  source 1..25: note = Seed: LNVIVHSATGFKQSSKALQRPVASD
LNVIVHSATGIKQKSRALGRPVASD

SEQ ID NO: 4126 - protein, 25 aa, synthetic construct
  source 1..25: note = Seed: LNVIVHSATGFKQSSKALQRPVASD
LNVIVHSATGIKQKSRALHRPVASD

SEQ ID NO: 4127 - protein, 25 aa, synthetic construct
  source 1..25: note = Seed: LNVIVHSATGFKQSSKALQRPVASD
LNVIVHSATGIKQKSRALIRPVASD

SEQ ID NO: 4128 - protein, 25 aa, synthetic construct
  source 1..25: note = Seed: LNVIVHSATGFKQSSKALQRPVASD
LNVIVHSATGIKQKSRALKRPVASD

SEQ ID NO: 4129 - protein, 25 aa, synthetic construct
  source 1..25: note = Seed: LNVIVHSATGFKQSSKALQRPVASD
LNVIVHSATGIKQKSRALLRPVASD

SEQ ID NO: 4130 - protein, 25 aa, synthetic construct
  source 1..25: note = Seed: LNVIVHSATGFKQSSKALQRPVASD
LNVIVHSATGIKQKSRALMRPVASD

SEQ ID NO: 4131 - protein, 25 aa, synthetic construct
  source 1..25: note = Seed: LNVIVHSATGFKQSSKALQRPVASD
LNVIVHSATGIKQKSRALQRPVASD

SEQ ID NO: 4132 - protein, 25 aa, synthetic construct
  source 1..25: note = Seed: LNVIVHSATGFKQSSKALQRPVASD
LNVIVHSATGIKQKSRALRRPVASD

SEQ ID NO: 4133 - protein, 25 aa, synthetic construct
  source 1..25: note = Seed: LNVIVHSATGFKQSSKALQRPVASD
LNVIVHSATGIKQKSRALSRPVASD

SEQ ID NO: 4134 - protein, 25 aa, synthetic construct
  source 1..25: note = Seed: LNVIVHSATGFKQSSKALQRPVASD
LNVIVHSATGIKQKSRALVRPVASD

SEQ ID NO: 4135 - protein, 25 aa, synthetic construct
  source 1..25: note = Seed: LNVIVHSATGFKQSSKALQRPVASD
LNVIVHSATGIKQKSRALYRPVASD

SEQ ID NO: 4136 - protein, 25 aa, synthetic construct
  source 1..25: note = Seed: LNVIVHSATGFKQSSKALQRPVASD
LNVIVHSATGIKQKSSALYRPVASD

SEQ ID NO: 4137 - protein, 25 aa, synthetic construct
  source 1..25: note = Seed: LNVIVHSATGFKQSSKALQRPVASD
LNVIVHSATGIKQKSVALRRPVASD

SEQ ID NO: 4138 - protein, 25 aa, synthetic construct
  source 1..25: note = Seed: LNVIVHSATGFKQSSKALQRPVASD
LNVIVHSATGIKQLSAALARPVASD

SEQ ID NO: 4139 - protein, 25 aa, synthetic construct
  source 1..25: note = Seed: LNVIVHSATGFKQSSKALQRPVASD
LNVIVHSATGIKQLSAALCRPVASD

SEQ ID NO: 4140 - protein, 25 aa, synthetic construct
  source 1..25: note = Seed: LNVIVHSATGFKQSSKALQRPVASD
LNVIVHSATGIKQLSAALDRPVASD

SEQ ID NO: 4141 - protein, 25 aa, synthetic construct
  source 1..25: note = Seed: LNVIVHSATGFKQSSKALQRPVASD
LNVIVHSATGIKQLSAALERPVASD

SEQ ID NO: 4142 - protein, 25 aa, synthetic construct
  source 1..25: note = Seed: LNVIVHSATGFKQSSKALQRPVASD
LNVIVHSATGIKQLSAALFRPVASD

SEQ ID NO: 4143 - protein, 25 aa, synthetic construct
  source 1..25: note = Seed: LNVIVHSATGFKQSSKALQRPVASD
LNVIVHSATGIKQLSAALGRPVASD

SEQ ID NO: 4144 - protein, 25 aa, synthetic construct
  source 1..25: note = Seed: LNVIVHSATGFKQSSKALQRPVASD
LNVIVHSATGIKQLSAALHRPVASD

SEQ ID NO: 4145 - protein, 25 aa, synthetic construct
  source 1..25: note = Seed: LNVIVHSATGFKQSSKALQRPVASD
LNVIVHSATGIKQLSAALIRPVASD

SEQ ID NO: 4146 - protein, 25 aa, synthetic construct
  source 1..25: note = Seed: LNVIVHSATGFKQSSKALQRPVASD
LNVIVHSATGIKQLSAALLRPVASD

SEQ ID NO: 4147 - protein, 25 aa, synthetic construct
  source 1..25: note = Seed: LNVIVHSATGFKQSSKALQRPVASD
LNVIVHSATGIKQLSAALMRPVASD

SEQ ID NO: 4148 - protein, 25 aa, synthetic construct
  source 1..25: note = Seed: LNVIVHSATGFKQSSKALQRPVASD
LNVIVHSATGIKQLSAALNRPVASD

SEQ ID NO: 4149 - protein, 25 aa, synthetic construct
  source 1..25: note = Seed: LNVIVHSATGFKQSSKALQRPVASD
LNVIVHSATGIKQLSAALPRPVASD

SEQ ID NO: 4150 - protein, 25 aa, synthetic construct
  source 1..25: note = Seed: LNVIVHSATGFKQSSKALQRPVASD
LNVIVHSATGIKQLSAALQRPVASD

SEQ ID NO: 4151 - protein, 25 aa, synthetic construct
  source 1..25: note = Seed: LNVIVHSATGFKQSSKALQRPVASD
LNVIVHSATGIKQLSAALRRPVASD

SEQ ID NO: 4152 - protein, 25 aa, synthetic construct
  source 1..25: note = Seed: LNVIVHSATGFKQSSKALQRPVASD
LNVIVHSATGIKQLSAALSRPVASD

SEQ ID NO: 4153 - protein, 25 aa, synthetic construct
  source 1..25: note = Seed: LNVIVHSATGFKQSSKALQRPVASD
LNVIVHSATGIKQLSAALTRPVASD

SEQ ID NO: 4154 - protein, 25 aa, synthetic construct
  source 1..25: note = Seed: LNVIVHSATGFKQSSKALQRPVASD
LNVIVHSATGIKQLSAALVRPVASD

SEQ ID NO: 4155 - protein, 25 aa, synthetic construct
  source 1..25: note = Seed: LNVIVHSATGFKQSSKALQRPVASD
LNVIVHSATGIKQLSAALYRPVASD

SEQ ID NO: 4156 - protein, 25 aa, synthetic construct
  source 1..25: note = Seed: LNVIVHSATGFKQSSKALQRPVASD
LNVIVHSATGIKQLSCALSRPVASD

SEQ ID NO: 4157 - protein, 25 aa, synthetic construct
  source 1..25: note = Seed: LNVIVHSATGFKQSSKALQRPVASD
LNVIVHSATGIKQLSEALARPVASD

SEQ ID NO: 4158 - protein, 25 aa, synthetic construct
  source 1..25: note = Seed: LNVIVHSATGFKQSSKALQRPVASD
LNVIVHSATGIKQLSFALMRPVASD

SEQ ID NO: 4159 - protein, 25 aa, synthetic construct
  source 1..25: note = Seed: LNVIVHSATGFKQSSKALQRPVASD
LNVIVHSATGIKQLSFALVRPVASD

SEQ ID NO: 4160 - protein, 25 aa, synthetic construct
  source 1..25: note = Seed: LNVIVHSATGFKQSSKALQRPVASD
LNVIVHSATGIKQLSGALARPVASD

SEQ ID NO: 4161 - protein, 25 aa, synthetic construct
  source 1..25: note = Seed: LNVIVHSATGFKQSSKALQRPVASD
LNVIVHSATGIKQLSGALCRPVASD

SEQ ID NO: 4162 - protein, 25 aa, synthetic construct
  source 1..25: note = Seed: LNVIVHSATGFKQSSKALQRPVASD
LNVIVHSATGIKQLSGALFRPVASD

SEQ ID NO: 4163 - protein, 25 aa, synthetic construct
  source 1..25: note = Seed: LNVIVHSATGFKQSSKALQRPVASD
LNVIVHSATGIKQLSGALGRPVASD

SEQ ID NO: 4164 - protein, 25 aa, synthetic construct
  source 1..25: note = Seed: LNVIVHSATGFKQSSKALQRPVASD
LNVIVHSATGIKQLSGALHRPVASD

SEQ ID NO: 4165 - protein, 25 aa, synthetic construct
  source 1..25: note = Seed: LNVIVHSATGFKQSSKALQRPVASD
LNVIVHSATGIKQLSGALIRPVASD

SEQ ID NO: 4166 - protein, 25 aa, synthetic construct
  source 1..25: note = Seed: LNVIVHSATGFKQSSKALQRPVASD
LNVIVHSATGIKQLSGALLRPVASD

SEQ ID NO: 4167 - protein, 25 aa, synthetic construct
  source 1..25: note = Seed: LNVIVHSATGFKQSSKALQRPVASD
LNVIVHSATGIKQLSGALMRPVASD

SEQ ID NO: 4168 - protein, 25 aa, synthetic construct
  source 1..25: note = Seed: LNVIVHSATGFKQSSKALQRPVASD
LNVIVHSATGIKQLSGALNRPVASD

SEQ ID NO: 4169 - protein, 25 aa, synthetic construct
  source 1..25: note = Seed: LNVIVHSATGFKQSSKALQRPVASD
LNVIVHSATGIKQLSGALPRPVASD

SEQ ID NO: 4170 - protein, 25 aa, synthetic construct
  source 1..25: note = Seed: LNVIVHSATGFKQSSKALQRPVASD
LNVIVHSATGIKQLSGALQRPVASD

SEQ ID NO: 4171 - protein, 25 aa, synthetic construct
  source 1..25: note = Seed: LNVIVHSATGFKQSSKALQRPVASD
LNVIVHSATGIKQLSGALRRPVASD

SEQ ID NO: 4172 - protein, 25 aa, synthetic construct
  source 1..25: note = Seed: LNVIVHSATGFKQSSKALQRPVASD
LNVIVHSATGIKQLSGALSRPVASD

SEQ ID NO: 4173 - protein, 25 aa, synthetic construct
  source 1..25: note = Seed: LNVIVHSATGFKQSSKALQRPVASD
LNVIVHSATGIKQLSGALTRPVASD

SEQ ID NO: 4174 - protein, 25 aa, synthetic construct
  source 1..25: note = Seed: LNVIVHSATGFKQSSKALQRPVASD
LNVIVHSATGIKQLSGALVRPVASD

SEQ ID NO: 4175 - protein, 25 aa, synthetic construct
  source 1..25: note = Seed: LNVIVHSATGFKQSSKALQRPVASD
LNVIVHSATGIKQLSHALARPVASD

SEQ ID NO: 4176 - protein, 25 aa, synthetic construct
  source 1..25: note = Seed: LNVIVHSATGFKQSSKALQRPVASD
LNVIVHSATGIKQLSHALGRPVASD

SEQ ID NO: 4177 - protein, 25 aa, synthetic construct
  source 1..25: note = Seed: LNVIVHSATGFKQSSKALQRPVASD
LNVIVHSATGIKQLSHALHRPVASD

SEQ ID NO: 4178 - protein, 25 aa, synthetic construct
  source 1..25: note = Seed: LNVIVHSATGFKQSSKALQRPVASD
LNVIVHSATGIKQLSHALIRPVASD

SEQ ID NO: 4179 - protein, 25 aa, synthetic construct
  source 1..25: note = Seed: LNVIVHSATGFKQSSKALQRPVASD
LNVIVHSATGIKQLSHALKRPVASD

SEQ ID NO: 4180 - protein, 25 aa, synthetic construct
  source 1..25: note = Seed: LNVIVHSATGFKQSSKALQRPVASD
LNVIVHSATGIKQLSHALLRPVASD

SEQ ID NO: 4181 - protein, 25 aa, synthetic construct
  source 1..25: note = Seed: LNVIVHSATGFKQSSKALQRPVASD
LNVIVHSATGIKQLSHALRRPVASD

SEQ ID NO: 4182 - protein, 25 aa, synthetic construct
  source 1..25: note = Seed: LNVIVHSATGFKQSSKALQRPVASD
LNVIVHSATGIKQLSHALSRPVASD

SEQ ID NO: 4183 - protein, 25 aa, synthetic construct
  source 1..25: note = Seed: LNVIVHSATGFKQSSKALQRPVASD
LNVIVHSATGIKQLSHALTRPVASD

SEQ ID NO: 4184 - protein, 25 aa, synthetic construct
  source 1..25: note = Seed: LNVIVHSATGFKQSSKALQRPVASD
LNVIVHSATGIKQLSHALVRPVASD

SEQ ID NO: 4185 - protein, 25 aa, synthetic construct
  source 1..25: note = Seed: LNVIVHSATGFKQSSKALQRPVASD
LNVIVHSATGIKQLSIALARPVASD

SEQ ID NO: 4186 - protein, 25 aa, synthetic construct
  source 1..25: note = Seed: LNVIVHSATGFKQSSKALQRPVASD
LNVIVHSATGIKQLSIALGRPVASD

SEQ ID NO: 4187 - protein, 25 aa, synthetic construct
  source 1..25: note = Seed: LNVIVHSATGFKQSSKALQRPVASD
LNVIVHSATGIKQLSIALHRPVASD

SEQ ID NO: 4188 - protein, 25 aa, synthetic construct
  source 1..25: note = Seed: LNVIVHSATGFKQSSKALQRPVASD
LNVIVHSATGIKQLSIALIRPVASD

SEQ ID NO: 4189 - protein, 25 aa, synthetic construct
  source 1..25: note = Seed: LNVIVHSATGFKQSSKALQRPVASD
LNVIVHSATGIKQLSIALLRPVASD

SEQ ID NO: 4190 - protein, 25 aa, synthetic construct
  source 1..25: note = Seed: LNVIVHSATGFKQSSKALQRPVASD
LNVIVHSATGIKQLSIALMRPVASD

SEQ ID NO: 4191 - protein, 25 aa, synthetic construct
  source 1..25: note = Seed: LNVIVHSATGFKQSSKALQRPVASD
LNVIVHSATGIKQLSIALNRPVASD

SEQ ID NO: 4192 - protein, 25 aa, synthetic construct
  source 1..25: note = Seed: LNVIVHSATGFKQSSKALQRPVASD
LNVIVHSATGIKQLSIALPRPVASD

SEQ ID NO: 4193 - protein, 25 aa, synthetic construct
  source 1..25: note = Seed: LNVIVHSATGFKQSSKALQRPVASD
LNVIVHSATGIKQLSIALQRPVASD

SEQ ID NO: 4194 - protein, 25 aa, synthetic construct
  source 1..25: note = Seed: LNVIVHSATGFKQSSKALQRPVASD
LNVIVHSATGIKQLSIALRRPVASD

SEQ ID NO: 4195 - protein, 25 aa, synthetic construct
  source 1..25: note = Seed: LNVIVHSATGFKQSSKALQRPVASD
LNVIVHSATGIKQLSIALSRPVASD

SEQ ID NO: 4196 - protein, 25 aa, synthetic construct
  source 1..25: note = Seed: LNVIVHSATGFKQSSKALQRPVASD
LNVIVHSATGIKQLSIALTRPVASD

SEQ ID NO: 4197 - protein, 25 aa, synthetic construct
  source 1..25: note = Seed: LNVIVHSATGFKQSSKALQRPVASD
LNVIVHSATGIKQLSIALVRPVASD

SEQ ID NO: 4198 - protein, 25 aa, synthetic construct
  source 1..25: note = Seed: LNVIVHSATGFKQSSKALQRPVASD
LNVIVHSATGIKQLSKALARPVASD

SEQ ID NO: 4199 - protein, 25 aa, synthetic construct
  source 1..25: note = Seed: LNVIVHSATGFKQSSKALQRPVASD
LNVIVHSATGIKQLSKALCRPVASD

SEQ ID NO: 4200 - protein, 25 aa, synthetic construct
  source 1..25: note = Seed: LNVIVHSATGFKQSSKALQRPVASD
LNVIVHSATGIKQLSKALFRPVASD

SEQ ID NO: 4201 - protein, 25 aa, synthetic construct
  source 1..25: note = Seed: LNVIVHSATGFKQSSKALQRPVASD
LNVIVHSATGIKQLSKALGRPVASD

SEQ ID NO: 4202 - protein, 25 aa, synthetic construct
  source 1..25: note = Seed: LNVIVHSATGFKQSSKALQRPVASD
LNVIVHSATGIKQLSKALHRPVASD

SEQ ID NO: 4203 - protein, 25 aa, synthetic construct
  source 1..25: note = Seed: LNVIVHSATGFKQSSKALQRPVASD
LNVIVHSATGIKQLSKALIRPVASD

SEQ ID NO: 4204 - protein, 25 aa, synthetic construct
  source 1..25: note = Seed: LNVIVHSATGFKQSSKALQRPVASD
LNVIVHSATGIKQLSKALKRPVASD

SEQ ID NO: 4205 - protein, 25 aa, synthetic construct
  source 1..25: note = Seed: LNVIVHSATGFKQSSKALQRPVASD
LNVIVHSATGIKQLSKALLRPVASD

SEQ ID NO: 4206 - protein, 25 aa, synthetic construct
  source 1..25: note = Seed: LNVIVHSATGFKQSSKALQRPVASD
LNVIVHSATGIKQLSKALMRPVASD

SEQ ID NO: 4207 - protein, 25 aa, synthetic construct
  source 1..25: note = Seed: LNVIVHSATGFKQSSKALQRPVASD
LNVIVHSATGIKQLSKALNRPVASD

SEQ ID NO: 4208 - protein, 25 aa, synthetic construct
  source 1..25: note = Seed: LNVIVHSATGFKQSSKALQRPVASD
LNVIVHSATGIKQLSKALPRPVASD

SEQ ID NO: 4209 - protein, 25 aa, synthetic construct
  source 1..25: note = Seed: LNVIVHSATGFKQSSKALQRPVASD
LNVIVHSATGIKQLSKALQRPVASD

SEQ ID NO: 4210 - protein, 25 aa, synthetic construct
  source 1..25: note = Seed: LNVIVHSATGFKQSSKALQRPVASD
LNVIVHSATGIKQLSKALRRPVASD

SEQ ID NO: 4211 - protein, 25 aa, synthetic construct
  source 1..25: note = Seed: LNVIVHSATGFKQSSKALQRPVASD
LNVIVHSATGIKQLSKALSRPVASD

SEQ ID NO: 4212 - protein, 25 aa, synthetic construct
  source 1..25: note = Seed: LNVIVHSATGFKQSSKALQRPVASD
LNVIVHSATGIKQLSKALTRPVASD

SEQ ID NO: 4213 - protein, 25 aa, synthetic construct
  source 1..25: note = Seed: LNVIVHSATGFKQSSKALQRPVASD
LNVIVHSATGIKQLSKALVRPVASD

SEQ ID NO: 4214 - protein, 25 aa, synthetic construct
  source 1..25: note = Seed: LNVIVHSATGFKQSSKALQRPVASD
LNVIVHSATGIKQLSKALYRPVASD

SEQ ID NO: 4215 - protein, 25 aa, synthetic construct
  source 1..25: note = Seed: LNVIVHSATGFKQSSKALQRPVASD
LNVIVHSATGIKQLSLALARPVASD

SEQ ID NO: 4216 - protein, 25 aa, synthetic construct
  source 1..25: note = Seed: LNVIVHSATGFKQSSKALQRPVASD
LNVIVHSATGIKQLSLALGRPVASD

SEQ ID NO: 4217 - protein, 25 aa, synthetic construct
  source 1..25: note = Seed: LNVIVHSATGFKQSSKALQRPVASD
LNVIVHSATGIKQLSLALHRPVASD

SEQ ID NO: 4218 - protein, 25 aa, synthetic construct
  source 1..25: note = Seed: LNVIVHSATGFKQSSKALQRPVASD
LNVIVHSATGIKQLSLALIRPVASD

SEQ ID NO: 4219 - protein, 25 aa, synthetic construct
  source 1..25: note = Seed: LNVIVHSATGFKQSSKALQRPVASD
LNVIVHSATGIKQLSLALLRPVASD

SEQ ID NO: 4220 - protein, 25 aa, synthetic construct
  source 1..25: note = Seed: LNVIVHSATGFKQSSKALQRPVASD
LNVIVHSATGIKQLSLALMRPVASD

SEQ ID NO: 4221 - protein, 25 aa, synthetic construct
  source 1..25: note = Seed: LNVIVHSATGFKQSSKALQRPVASD
LNVIVHSATGIKQLSLALNRPVASD

SEQ ID NO: 4222 - protein, 25 aa, synthetic construct
  source 1..25: note = Seed: LNVIVHSATGFKQSSKALQRPVASD
LNVIVHSATGIKQLSLALQRPVASD

SEQ ID NO: 4223 - protein, 25 aa, synthetic construct
  source 1..25: note = Seed: LNVIVHSATGFKQSSKALQRPVASD
LNVIVHSATGIKQLSLALRRPVASD

SEQ ID NO: 4224 - protein, 25 aa, synthetic construct
  source 1..25: note = Seed: LNVIVHSATGFKQSSKALQRPVASD
LNVIVHSATGIKQLSLALSRPVASD

SEQ ID NO: 4225 - protein, 25 aa, synthetic construct
  source 1..25: note = Seed: LNVIVHSATGFKQSSKALQRPVASD
LNVIVHSATGIKQLSLALTRPVASD

SEQ ID NO: 4226 - protein, 25 aa, synthetic construct
  source 1..25: note = Seed: LNVIVHSATGFKQSSKALQRPVASD
LNVIVHSATGIKQLSLALVRPVASD

SEQ ID NO: 4227 - protein, 25 aa, synthetic construct
  source 1..25: note = Seed: LNVIVHSATGFKQSSKALQRPVASD
LNVIVHSATGIKQLSMALARPVASD

SEQ ID NO: 4228 - protein, 25 aa, synthetic construct
  source 1..25: note = Seed: LNVIVHSATGFKQSSKALQRPVASD
LNVIVHSATGIKQLSMALGRPVASD

SEQ ID NO: 4229 - protein, 25 aa, synthetic construct
  source 1..25: note = Seed: LNVIVHSATGFKQSSKALQRPVASD
LNVIVHSATGIKQLSMALHRPVASD

SEQ ID NO: 4230 - protein, 25 aa, synthetic construct
  source 1..25: note = Seed: LNVIVHSATGFKQSSKALQRPVASD
LNVIVHSATGIKQLSMALIRPVASD

SEQ ID NO: 4231 - protein, 25 aa, synthetic construct
  source 1..25: note = Seed: LNVIVHSATGFKQSSKALQRPVASD
LNVIVHSATGIKQLSMALLRPVASD

SEQ ID NO: 4232 - protein, 25 aa, synthetic construct
  source 1..25: note = Seed: LNVIVHSATGFKQSSKALQRPVASD
LNVIVHSATGIKQLSMALMRPVASD

SEQ ID NO: 4233 - protein, 25 aa, synthetic construct
  source 1..25: note = Seed: LNVIVHSATGFKQSSKALQRPVASD
LNVIVHSATGIKQLSMALNRPVASD

SEQ ID NO: 4234 - protein, 25 aa, synthetic construct
  source 1..25: note = Seed: LNVIVHSATGFKQSSKALQRPVASD
LNVIVHSATGIKQLSMALRRPVASD

SEQ ID NO: 4235 - protein, 25 aa, synthetic construct
  source 1..25: note = Seed: LNVIVHSATGFKQSSKALQRPVASD
LNVIVHSATGIKQLSMALSRPVASD

SEQ ID NO: 4236 - protein, 25 aa, synthetic construct
  source 1..25: note = Seed: LNVIVHSATGFKQSSKALQRPVASD
LNVIVHSATGIKQLSMALVRPVASD

SEQ ID NO: 4237 - protein, 25 aa, synthetic construct
  source 1..25: note = Seed: LNVIVHSATGFKQSSKALQRPVASD
LNVIVHSATGIKQLSNALARPVASD

SEQ ID NO: 4238 - protein, 25 aa, synthetic construct
  source 1..25: note = Seed: LNVIVHSATGFKQSSKALQRPVASD
LNVIVHSATGIKQLSNALCRPVASD

SEQ ID NO: 4239 - protein, 25 aa, synthetic construct
  source 1..25: note = Seed: LNVIVHSATGFKQSSKALQRPVASD
LNVIVHSATGIKQLSNALGRPVASD

SEQ ID NO: 4240 - protein, 25 aa, synthetic construct
  source 1..25: note = Seed: LNVIVHSATGFKQSSKALQRPVASD
LNVIVHSATGIKQLSNALIRPVASD

SEQ ID NO: 4241 - protein, 25 aa, synthetic construct
  source 1..25: note = Seed: LNVIVHSATGFKQSSKALQRPVASD
LNVIVHSATGIKQLSNALKRPVASD

SEQ ID NO: 4242 - protein, 25 aa, synthetic construct
  source 1..25: note = Seed: LNVIVHSATGFKQSSKALQRPVASD
LNVIVHSATGIKQLSNALLRPVASD

SEQ ID NO: 4243 - protein, 25 aa, synthetic construct
  source 1..25: note = Seed: LNVIVHSATGFKQSSKALQRPVASD
LNVIVHSATGIKQLSNALMRPVASD

SEQ ID NO: 4244 - protein, 25 aa, synthetic construct
  source 1..25: note = Seed: LNVIVHSATGFKQSSKALQRPVASD
LNVIVHSATGIKQLSNALNRPVASD

SEQ ID NO: 4245 - protein, 25 aa, synthetic construct
  source 1..25: note = Seed: LNVIVHSATGFKQSSKALQRPVASD
LNVIVHSATGIKQLSNALPRPVASD

SEQ ID NO: 4246 - protein, 25 aa, synthetic construct
  source 1..25: note = Seed: LNVIVHSATGFKQSSKALQRPVASD
LNVIVHSATGIKQLSNALRRPVASD

SEQ ID NO: 4247 - protein, 25 aa, synthetic construct
  source 1..25: note = Seed: LNVIVHSATGFKQSSKALQRPVASD
LNVIVHSATGIKQLSNALSRPVASD

SEQ ID NO: 4248 - protein, 25 aa, synthetic construct
  source 1..25: note = Seed: LNVIVHSATGFKQSSKALQRPVASD
LNVIVHSATGIKQLSNALTRPVASD

SEQ ID NO: 4249 - protein, 25 aa, synthetic construct
  source 1..25: note = Seed: LNVIVHSATGFKQSSKALQRPVASD
LNVIVHSATGIKQLSNALVRPVASD

SEQ ID NO: 4250 - protein, 25 aa, synthetic construct
  source 1..25: note = Seed: LNVIVHSATGFKQSSKALQRPVASD
LNVIVHSATGIKQLSPALARPVASD

SEQ ID NO: 4251 - protein, 25 aa, synthetic construct
  source 1..25: note = Seed: LNVIVHSATGFKQSSKALQRPVASD
LNVIVHSATGIKQLSPALCRPVASD

SEQ ID NO: 4252 - protein, 25 aa, synthetic construct
  source 1..25: note = Seed: LNVIVHSATGFKQSSKALQRPVASD
LNVIVHSATGIKQLSPALFRPVASD

SEQ ID NO: 4253 - protein, 25 aa, synthetic construct
  source 1..25: note = Seed: LNVIVHSATGFKQSSKALQRPVASD
LNVIVHSATGIKQLSPALGRPVASD

SEQ ID NO: 4254 - protein, 25 aa, synthetic construct
  source 1..25: note = Seed: LNVIVHSATGFKQSSKALQRPVASD
LNVIVHSATGIKQLSPALHRPVASD

SEQ ID NO: 4255 - protein, 25 aa, synthetic construct
  source 1..25: note = Seed: LNVIVHSATGFKQSSKALQRPVASD
LNVIVHSATGIKQLSPALIRPVASD

SEQ ID NO: 4256 - protein, 25 aa, synthetic construct
  source 1..25: note = Seed: LNVIVHSATGFKQSSKALQRPVASD
LNVIVHSATGIKQLSPALLRPVASD

SEQ ID NO: 4257 - protein, 25 aa, synthetic construct
  source 1..25: note = Seed: LNVIVHSATGFKQSSKALQRPVASD
LNVIVHSATGIKQLSPALMRPVASD

SEQ ID NO: 4258 - protein, 25 aa, synthetic construct
  source 1..25: note = Seed: LNVIVHSATGFKQSSKALQRPVASD
LNVIVHSATGIKQLSPALNRPVASD

SEQ ID NO: 4259 - protein, 25 aa, synthetic construct
  source 1..25: note = Seed: LNVIVHSATGFKQSSKALQRPVASD
LNVIVHSATGIKQLSPALPRPVASD

SEQ ID NO: 4260 - protein, 25 aa, synthetic construct
  source 1..25: note = Seed: LNVIVHSATGFKQSSKALQRPVASD
LNVIVHSATGIKQLSPALQRPVASD

SEQ ID NO: 4261 - protein, 25 aa, synthetic construct
  source 1..25: note = Seed: LNVIVHSATGFKQSSKALQRPVASD
LNVIVHSATGIKQLSPALRRPVASD

SEQ ID NO: 4262 - protein, 25 aa, synthetic construct
  source 1..25: note = Seed: LNVIVHSATGFKQSSKALQRPVASD
LNVIVHSATGIKQLSPALSRPVASD

SEQ ID NO: 4263 - protein, 25 aa, synthetic construct
  source 1..25: note = Seed: LNVIVHSATGFKQSSKALQRPVASD
LNVIVHSATGIKQLSPALTRPVASD

SEQ ID NO: 4264 - protein, 25 aa, synthetic construct
  source 1..25: note = Seed: LNVIVHSATGFKQSSKALQRPVASD
LNVIVHSATGIKQLSPALVRPVASD

SEQ ID NO: 4265 - protein, 25 aa, synthetic construct
  source 1..25: note = Seed: LNVIVHSATGFKQSSKALQRPVASD
LNVIVHSATGIKQLSQALKRPVASD

SEQ ID NO: 4266 - protein, 25 aa, synthetic construct
  source 1..25: note = Seed: LNVIVHSATGFKQSSKALQRPVASD
LNVIVHSATGIKQLSQALRRPVASD

SEQ ID NO: 4267 - protein, 25 aa, synthetic construct
  source 1..25: note = Seed: LNVIVHSATGFKQSSKALQRPVASD
LNVIVHSATGIKQLSQALVRPVASD

SEQ ID NO: 4268 - protein, 25 aa, synthetic construct
  source 1..25: note = Seed: LNVIVHSATGFKQSSKALQRPVASD
LNVIVHSATGIKQLSRALARPVASD

SEQ ID NO: 4269 - protein, 25 aa, synthetic construct
  source 1..25: note = Seed: LNVIVHSATGFKQSSKALQRPVASD
LNVIVHSATGIKQLSRALCRPVASD

SEQ ID NO: 4270 - protein, 25 aa, synthetic construct
  source 1..25: note = Seed: LNVIVHSATGFKQSSKALQRPVASD
LNVIVHSATGIKQLSRALDRPVASD

SEQ ID NO: 4271 - protein, 25 aa, synthetic construct
  source 1..25: note = Seed: LNVIVHSATGFKQSSKALQRPVASD
LNVIVHSATGIKQLSRALERPVASD

SEQ ID NO: 4272 - protein, 25 aa, synthetic construct
  source 1..25: note = Seed: LNVIVHSATGFKQSSKALQRPVASD
LNVIVHSATGIKQLSRALFRPVASD

SEQ ID NO: 4273 - protein, 25 aa, synthetic construct
  source 1..25: note = Seed: LNVIVHSATGFKQSSKALQRPVASD
LNVIVHSATGIKQLSRALGRPVASD

SEQ ID NO: 4274 - protein, 25 aa, synthetic construct
  source 1..25: note = Seed: LNVIVHSATGFKQSSKALQRPVASD
LNVIVHSATGIKQLSRALHRPVASD

SEQ ID NO: 4275 - protein, 25 aa, synthetic construct
  source 1..25: note = Seed: LNVIVHSATGFKQSSKALQRPVASD
LNVIVHSATGIKQLSRALIRPVASD

SEQ ID NO: 4276 - protein, 25 aa, synthetic construct
  source 1..25: note = Seed: LNVIVHSATGFKQSSKALQRPVASD
LNVIVHSATGIKQLSRALKRPVASD

SEQ ID NO: 4277 - protein, 25 aa, synthetic construct
  source 1..25: note = Seed: LNVIVHSATGFKQSSKALQRPVASD
LNVIVHSATGIKQLSRALLRPVASD

SEQ ID NO: 4278 - protein, 25 aa, synthetic construct
  source 1..25: note = Seed: LNVIVHSATGFKQSSKALQRPVASD
LNVIVHSATGIKQLSRALMRPVASD

SEQ ID NO: 4279 - protein, 25 aa, synthetic construct
  source 1..25: note = Seed: LNVIVHSATGFKQSSKALQRPVASD
LNVIVHSATGIKQLSRALNRPVASD

SEQ ID NO: 4280 - protein, 25 aa, synthetic construct
  source 1..25: note = Seed: LNVIVHSATGFKQSSKALQRPVASD
LNVIVHSATGIKQLSRALPRPVASD

SEQ ID NO: 4281 - protein, 25 aa, synthetic construct
  source 1..25: note = Seed: LNVIVHSATGFKQSSKALQRPVASD
LNVIVHSATGIKQLSRALQRPVASD

SEQ ID NO: 4282 - protein, 25 aa, synthetic construct
  source 1..25: note = Seed: LNVIVHSATGFKQSSKALQRPVASD
LNVIVHSATGIKQLSRALRRPVASD

SEQ ID NO: 4283 - protein, 25 aa, synthetic construct
  source 1..25: note = Seed: LNVIVHSATGFKQSSKALQRPVASD
LNVIVHSATGIKQLSRALSRPVASD

SEQ ID NO: 4284 - protein, 25 aa, synthetic construct
  source 1..25: note = Seed: LNVIVHSATGFKQSSKALQRPVASD
LNVIVHSATGIKQLSRALTRPVASD

SEQ ID NO: 4285 - protein, 25 aa, synthetic construct
  source 1..25: note = Seed: LNVIVHSATGFKQSSKALQRPVASD
LNVIVHSATGIKQLSRALVRPVASD

SEQ ID NO: 4286 - protein, 25 aa, synthetic construct
  source 1..25: note = Seed: LNVIVHSATGFKQSSKALQRPVASD
LNVIVHSATGIKQLSRALWRPVASD

SEQ ID NO: 4287 - protein, 25 aa, synthetic construct
  source 1..25: note = Seed: LNVIVHSATGFKQSSKALQRPVASD
LNVIVHSATGIKQLSRALYRPVASD

SEQ ID NO: 4288 - protein, 25 aa, synthetic construct
  source 1..25: note = Seed: LNVIVHSATGFKQSSKALQRPVASD
LNVIVHSATGIKQLSSALARPVASD

SEQ ID NO: 4289 - protein, 25 aa, synthetic construct
  source 1..25: note = Seed: LNVIVHSATGFKQSSKALQRPVASD
LNVIVHSATGIKQLSSALCRPVASD

SEQ ID NO: 4290 - protein, 25 aa, synthetic construct
  source 1..25: note = Seed: LNVIVHSATGFKQSSKALQRPVASD
LNVIVHSATGIKQLSSALFRPVASD

SEQ ID NO: 4291 - protein, 25 aa, synthetic construct
  source 1..25: note = Seed: LNVIVHSATGFKQSSKALQRPVASD
LNVIVHSATGIKQLSSALGRPVASD

SEQ ID NO: 4292 - protein, 25 aa, synthetic construct
  source 1..25: note = Seed: LNVIVHSATGFKQSSKALQRPVASD
LNVIVHSATGIKQLSSALHRPVASD

SEQ ID NO: 4293 - protein, 25 aa, synthetic construct
  source 1..25: note = Seed: LNVIVHSATGFKQSSKALQRPVASD
LNVIVHSATGIKQLSSALIRPVASD

SEQ ID NO: 4294 - protein, 25 aa, synthetic construct
  source 1..25: note = Seed: LNVIVHSATGFKQSSKALQRPVASD
LNVIVHSATGIKQLSSALKRPVASD

SEQ ID NO: 4295 - protein, 25 aa, synthetic construct
  source 1..25: note = Seed: LNVIVHSATGFKQSSKALQRPVASD
LNVIVHSATGIKQLSSALLRPVASD

SEQ ID NO: 4296 - protein, 25 aa, synthetic construct
  source 1..25: note = Seed: LNVIVHSATGFKQSSKALQRPVASD
LNVIVHSATGIKQLSSALMRPVASD

SEQ ID NO: 4297 - protein, 25 aa, synthetic construct
  source 1..25: note = Seed: LNVIVHSATGFKQSSKALQRPVASD
LNVIVHSATGIKQLSSALNRPVASD

SEQ ID NO: 4298 - protein, 25 aa, synthetic construct
  source 1..25: note = Seed: LNVIVHSATGFKQSSKALQRPVASD
LNVIVHSATGIKQLSSALPRPVASD

SEQ ID NO: 4299 - protein, 25 aa, synthetic construct
  source 1..25: note = Seed: LNVIVHSATGFKQSSKALQRPVASD
LNVIVHSATGIKQLSSALRRPVASD

SEQ ID NO: 4300 - protein, 25 aa, synthetic construct
  source 1..25: note = Seed: LNVIVHSATGFKQSSKALQRPVASD
LNVIVHSATGIKQLSSALSRPVASD

SEQ ID NO: 4301 - protein, 25 aa, synthetic construct
  source 1..25: note = Seed: LNVIVHSATGFKQSSKALQRPVASD
LNVIVHSATGIKQLSSALTRPVASD

SEQ ID NO: 4302 - protein, 25 aa, synthetic construct
  source 1..25: note = Seed: LNVIVHSATGFKQSSKALQRPVASD
LNVIVHSATGIKQLSSALVRPVASD

SEQ ID NO: 4303 - protein, 25 aa, synthetic construct
  source 1..25: note = Seed: LNVIVHSATGFKQSSKALQRPVASD
LNVIVHSATGIKQLSTALARPVASD

SEQ ID NO: 4304 - protein, 25 aa, synthetic construct
  source 1..25: note = Seed: LNVIVHSATGFKQSSKALQRPVASD
LNVIVHSATGIKQLSTALCRPVASD

SEQ ID NO: 4305 - protein, 25 aa, synthetic construct
  source 1..25: note = Seed: LNVIVHSATGFKQSSKALQRPVASD
LNVIVHSATGIKQLSTALGRPVASD

SEQ ID NO: 4306 - protein, 25 aa, synthetic construct
  source 1..25: note = Seed: LNVIVHSATGFKQSSKALQRPVASD
LNVIVHSATGIKQLSTALHRPVASD

SEQ ID NO: 4307 - protein, 25 aa, synthetic construct
  source 1..25: note = Seed: LNVIVHSATGFKQSSKALQRPVASD
LNVIVHSATGIKQLSTALIRPVASD

SEQ ID NO: 4308 - protein, 25 aa, synthetic construct
  source 1..25: note = Seed: LNVIVHSATGFKQSSKALQRPVASD
LNVIVHSATGIKQLSTALKRPVASD

SEQ ID NO: 4309 - protein, 25 aa, synthetic construct
  source 1..25: note = Seed: LNVIVHSATGFKQSSKALQRPVASD
LNVIVHSATGIKQLSTALLRPVASD

SEQ ID NO: 4310 - protein, 25 aa, synthetic construct
  source 1..25: note = Seed: LNVIVHSATGFKQSSKALQRPVASD
LNVIVHSATGIKQLSTALMRPVASD

SEQ ID NO: 4311 - protein, 25 aa, synthetic construct
  source 1..25: note = Seed: LNVIVHSATGFKQSSKALQRPVASD
LNVIVHSATGIKQLSTALNRPVASD

SEQ ID NO: 4312 - protein, 25 aa, synthetic construct
  source 1..25: note = Seed: LNVIVHSATGFKQSSKALQRPVASD
LNVIVHSATGIKQLSTALPRPVASD

SEQ ID NO: 4313 - protein, 25 aa, synthetic construct
  source 1..25: note = Seed: LNVIVHSATGFKQSSKALQRPVASD
LNVIVHSATGIKQLSTALQRPVASD

SEQ ID NO: 4314 - protein, 25 aa, synthetic construct
  source 1..25: note = Seed: LNVIVHSATGFKQSSKALQRPVASD
LNVIVHSATGIKQLSTALRRPVASD

SEQ ID NO: 4315 - protein, 25 aa, synthetic construct
  source 1..25: note = Seed: LNVIVHSATGFKQSSKALQRPVASD
LNVIVHSATGIKQLSTALSRPVASD

SEQ ID NO: 4316 - protein, 25 aa, synthetic construct
  source 1..25: note = Seed: LNVIVHSATGFKQSSKALQRPVASD
LNVIVHSATGIKQLSTALTRPVASD

SEQ ID NO: 4317 - protein, 25 aa, synthetic construct
  source 1..25: note = Seed: LNVIVHSATGFKQSSKALQRPVASD
LNVIVHSATGIKQLSTALVRPVASD

SEQ ID NO: 4318 - protein, 25 aa, synthetic construct
  source 1..25: note = Seed: LNVIVHSATGFKQSSKALQRPVASD
LNVIVHSATGIKQLSVALARPVASD

SEQ ID NO: 4319 - protein, 25 aa, synthetic construct
  source 1..25: note = Seed: LNVIVHSATGFKQSSKALQRPVASD
LNVIVHSATGIKQLSVALGRPVASD

SEQ ID NO: 4320 - protein, 25 aa, synthetic construct
  source 1..25: note = Seed: LNVIVHSATGFKQSSKALQRPVASD
LNVIVHSATGIKQLSVALHRPVASD

SEQ ID NO: 4321 - protein, 25 aa, synthetic construct
  source 1..25: note = Seed: LNVIVHSATGFKQSSKALQRPVASD
LNVIVHSATGIKQLSVALIRPVASD

SEQ ID NO: 4322 - protein, 25 aa, synthetic construct
  source 1..25: note = Seed: LNVIVHSATGFKQSSKALQRPVASD
LNVIVHSATGIKQLSVALLRPVASD

SEQ ID NO: 4323 - protein, 25 aa, synthetic construct
  source 1..25: note = Seed: LNVIVHSATGFKQSSKALQRPVASD
LNVIVHSATGIKQLSVALMRPVASD

SEQ ID NO: 4324 - protein, 25 aa, synthetic construct
  source 1..25: note = Seed: LNVIVHSATGFKQSSKALQRPVASD
LNVIVHSATGIKQLSVALNRPVASD

SEQ ID NO: 4325 - protein, 25 aa, synthetic construct
  source 1..25: note = Seed: LNVIVHSATGFKQSSKALQRPVASD
LNVIVHSATGIKQLSVALPRPVASD

SEQ ID NO: 4326 - protein, 25 aa, synthetic construct
  source 1..25: note = Seed: LNVIVHSATGFKQSSKALQRPVASD
LNVIVHSATGIKQLSVALQRPVASD

SEQ ID NO: 4327 - protein, 25 aa, synthetic construct
  source 1..25: note = Seed: LNVIVHSATGFKQSSKALQRPVASD
LNVIVHSATGIKQLSVALRRPVASD

SEQ ID NO: 4328 - protein, 25 aa, synthetic construct
  source 1..25: note = Seed: LNVIVHSATGFKQSSKALQRPVASD
LNVIVHSATGIKQLSVALSRPVASD

SEQ ID NO: 4329 - protein, 25 aa, synthetic construct
  source 1..25: note = Seed: LNVIVHSATGFKQSSKALQRPVASD
LNVIVHSATGIKQLSVALTRPVASD

SEQ ID NO: 4330 - protein, 25 aa, synthetic construct
  source 1..25: note = Seed: LNVIVHSATGFKQSSKALQRPVASD
LNVIVHSATGIKQLSVALVRPVASD

SEQ ID NO: 4331 - protein, 25 aa, synthetic construct
  source 1..25: note = Seed: LNVIVHSATGFKQSSKALQRPVASD
LNVIVHSATGIKQMSAALARPVASD

SEQ ID NO: 4332 - protein, 25 aa, synthetic construct
  source 1..25: note = Seed: LNVIVHSATGFKQSSKALQRPVASD
LNVIVHSATGIKQMSAALCRPVASD

SEQ ID NO: 4333 - protein, 25 aa, synthetic construct
  source 1..25: note = Seed: LNVIVHSATGFKQSSKALQRPVASD
LNVIVHSATGIKQMSAALDRPVASD

SEQ ID NO: 4334 - protein, 25 aa, synthetic construct
  source 1..25: note = Seed: LNVIVHSATGFKQSSKALQRPVASD
LNVIVHSATGIKQMSAALERPVASD

SEQ ID NO: 4335 - protein, 25 aa, synthetic construct
  source 1..25: note = Seed: LNVIVHSATGFKQSSKALQRPVASD
LNVIVHSATGIKQMSAALFRPVASD

SEQ ID NO: 4336 - protein, 25 aa, synthetic construct
  source 1..25: note = Seed: LNVIVHSATGFKQSSKALQRPVASD
LNVIVHSATGIKQMSAALGRPVASD

SEQ ID NO: 4337 - protein, 25 aa, synthetic construct
  source 1..25: note = Seed: LNVIVHSATGFKQSSKALQRPVASD
LNVIVHSATGIKQMSAALHRPVASD

SEQ ID NO: 4338 - protein, 25 aa, synthetic construct
  source 1..25: note = Seed: LNVIVHSATGFKQSSKALQRPVASD
LNVIVHSATGIKQMSAALIRPVASD

SEQ ID NO: 4339 - protein, 25 aa, synthetic construct
  source 1..25: note = Seed: LNVIVHSATGFKQSSKALQRPVASD
LNVIVHSATGIKQMSAALKRPVASD

SEQ ID NO: 4340 - protein, 25 aa, synthetic construct
  source 1..25: note = Seed: LNVIVHSATGFKQSSKALQRPVASD
LNVIVHSATGIKQMSAALLRPVASD

SEQ ID NO: 4341 - protein, 25 aa, synthetic construct
  source 1..25: note = Seed: LNVIVHSATGFKQSSKALQRPVASD
LNVIVHSATGIKQMSAALMRPVASD

SEQ ID NO: 4342 - protein, 25 aa, synthetic construct
  source 1..25: note = Seed: LNVIVHSATGFKQSSKALQRPVASD
LNVIVHSATGIKQMSAALNRPVASD

SEQ ID NO: 4343 - protein, 25 aa, synthetic construct
  source 1..25: note = Seed: LNVIVHSATGFKQSSKALQRPVASD
LNVIVHSATGIKQMSAALPRPVASD

SEQ ID NO: 4344 - protein, 25 aa, synthetic construct
  source 1..25: note = Seed: LNVIVHSATGFKQSSKALQRPVASD
LNVIVHSATGIKQMSAALQRPVASD

SEQ ID NO: 4345 - protein, 25 aa, synthetic construct
  source 1..25: note = Seed: LNVIVHSATGFKQSSKALQRPVASD
LNVIVHSATGIKQMSAALRRPVASD

SEQ ID NO: 4346 - protein, 25 aa, synthetic construct
  source 1..25: note = Seed: LNVIVHSATGFKQSSKALQRPVASD
LNVIVHSATGIKQMSAALSRPVASD

SEQ ID NO: 4347 - protein, 25 aa, synthetic construct
  source 1..25: note = Seed: LNVIVHSATGFKQSSKALQRPVASD
LNVIVHSATGIKQMSAALTRPVASD

SEQ ID NO: 4348 - protein, 25 aa, synthetic construct
  source 1..25: note = Seed: LNVIVHSATGFKQSSKALQRPVASD
LNVIVHSATGIKQMSAALVRPVASD

SEQ ID NO: 4349 - protein, 25 aa, synthetic construct
  source 1..25: note = Seed: LNVIVHSATGFKQSSKALQRPVASD
LNVIVHSATGIKQMSAALYRPVASD

SEQ ID NO: 4350 - protein, 25 aa, synthetic construct
  source 1..25: note = Seed: LNVIVHSATGFKQSSKALQRPVASD
LNVIVHSATGIKQMSCALARPVASD

SEQ ID NO: 4351 - protein, 25 aa, synthetic construct
  source 1..25: note = Seed: LNVIVHSATGFKQSSKALQRPVASD
LNVIVHSATGIKQMSFALIRPVASD

SEQ ID NO: 4352 - protein, 25 aa, synthetic construct
  source 1..25: note = Seed: LNVIVHSATGFKQSSKALQRPVASD
LNVIVHSATGIKQMSFALMRPVASD

SEQ ID NO: 4353 - protein, 25 aa, synthetic construct
  source 1..25: note = Seed: LNVIVHSATGFKQSSKALQRPVASD
LNVIVHSATGIKQMSFALVRPVASD

SEQ ID NO: 4354 - protein, 25 aa, synthetic construct
  source 1..25: note = Seed: LNVIVHSATGFKQSSKALQRPVASD
LNVIVHSATGIKQMSGALARPVASD

SEQ ID NO: 4355 - protein, 25 aa, synthetic construct
  source 1..25: note = Seed: LNVIVHSATGFKQSSKALQRPVASD
LNVIVHSATGIKQMSGALCRPVASD

SEQ ID NO: 4356 - protein, 25 aa, synthetic construct
  source 1..25: note = Seed: LNVIVHSATGFKQSSKALQRPVASD
LNVIVHSATGIKQMSGALFRPVASD

SEQ ID NO: 4357 - protein, 25 aa, synthetic construct
  source 1..25: note = Seed: LNVIVHSATGFKQSSKALQRPVASD
LNVIVHSATGIKQMSGALGRPVASD

SEQ ID NO: 4358 - protein, 25 aa, synthetic construct
  source 1..25: note = Seed: LNVIVHSATGFKQSSKALQRPVASD
LNVIVHSATGIKQMSGALHRPVASD

SEQ ID NO: 4359 - protein, 25 aa, synthetic construct
  source 1..25: note = Seed: LNVIVHSATGFKQSSKALQRPVASD
LNVIVHSATGIKQMSGALIRPVASD

SEQ ID NO: 4360 - protein, 25 aa, synthetic construct
  source 1..25: note = Seed: LNVIVHSATGFKQSSKALQRPVASD
LNVIVHSATGIKQMSGALLRPVASD

SEQ ID NO: 4361 - protein, 25 aa, synthetic construct
  source 1..25: note = Seed: LNVIVHSATGFKQSSKALQRPVASD
LNVIVHSATGIKQMSGALMRPVASD

SEQ ID NO: 4362 - protein, 25 aa, synthetic construct
  source 1..25: note = Seed: LNVIVHSATGFKQSSKALQRPVASD
LNVIVHSATGIKQMSGALNRPVASD

SEQ ID NO: 4363 - protein, 25 aa, synthetic construct
  source 1..25: note = Seed: LNVIVHSATGFKQSSKALQRPVASD
LNVIVHSATGIKQMSGALPRPVASD

SEQ ID NO: 4364 - protein, 25 aa, synthetic construct
  source 1..25: note = Seed: LNVIVHSATGFKQSSKALQRPVASD
LNVIVHSATGIKQMSGALQRPVASD

SEQ ID NO: 4365 - protein, 25 aa, synthetic construct
  source 1..25: note = Seed: LNVIVHSATGFKQSSKALQRPVASD
LNVIVHSATGIKQMSGALRRPVASD

SEQ ID NO: 4366 - protein, 25 aa, synthetic construct
  source 1..25: note = Seed: LNVIVHSATGFKQSSKALQRPVASD
LNVIVHSATGIKQMSGALSRPVASD

SEQ ID NO: 4367 - protein, 25 aa, synthetic construct
  source 1..25: note = Seed: LNVIVHSATGFKQSSKALQRPVASD
LNVIVHSATGIKQMSGALTRPVASD

SEQ ID NO: 4368 - protein, 25 aa, synthetic construct
  source 1..25: note = Seed: LNVIVHSATGFKQSSKALQRPVASD
LNVIVHSATGIKQMSGALVRPVASD

SEQ ID NO: 4369 - protein, 25 aa, synthetic construct
  source 1..25: note = Seed: LNVIVHSATGFKQSSKALQRPVASD
LNVIVHSATGIKQMSGALYRPVASD

SEQ ID NO: 4370 - protein, 25 aa, synthetic construct
  source 1..25: note = Seed: LNVIVHSATGFKQSSKALQRPVASD
LNVIVHSATGIKQMSHALARPVASD

SEQ ID NO: 4371 - protein, 25 aa, synthetic construct
  source 1..25: note = Seed: LNVIVHSATGFKQSSKALQRPVASD
LNVIVHSATGIKQMSHALGRPVASD

SEQ ID NO: 4372 - protein, 25 aa, synthetic construct
  source 1..25: note = Seed: LNVIVHSATGFKQSSKALQRPVASD
LNVIVHSATGIKQMSHALHRPVASD

SEQ ID NO: 4373 - protein, 25 aa, synthetic construct
  source 1..25: note = Seed: LNVIVHSATGFKQSSKALQRPVASD
LNVIVHSATGIKQMSHALIRPVASD

SEQ ID NO: 4374 - protein, 25 aa, synthetic construct
  source 1..25: note = Seed: LNVIVHSATGFKQSSKALQRPVASD
LNVIVHSATGIKQMSHALKRPVASD

SEQ ID NO: 4375 - protein, 25 aa, synthetic construct
  source 1..25: note = Seed: LNVIVHSATGFKQSSKALQRPVASD
LNVIVHSATGIKQMSHALLRPVASD

SEQ ID NO: 4376 - protein, 25 aa, synthetic construct
  source 1..25: note = Seed: LNVIVHSATGFKQSSKALQRPVASD
LNVIVHSATGIKQMSHALQRPVASD

SEQ ID NO: 4377 - protein, 25 aa, synthetic construct
  source 1..25: note = Seed: LNVIVHSATGFKQSSKALQRPVASD
LNVIVHSATGIKQMSHALRRPVASD

SEQ ID NO: 4378 - protein, 25 aa, synthetic construct
  source 1..25: note = Seed: LNVIVHSATGFKQSSKALQRPVASD
LNVIVHSATGIKQMSHALSRPVASD

SEQ ID NO: 4379 - protein, 25 aa, synthetic construct
  source 1..25: note = Seed: LNVIVHSATGFKQSSKALQRPVASD
LNVIVHSATGIKQMSHALTRPVASD

SEQ ID NO: 4380 - protein, 25 aa, synthetic construct
  source 1..25: note = Seed: LNVIVHSATGFKQSSKALQRPVASD
LNVIVHSATGIKQMSHALVRPVASD

SEQ ID NO: 4381 - protein, 25 aa, synthetic construct
  source 1..25: note = Seed: LNVIVHSATGFKQSSKALQRPVASD
LNVIVHSATGIKQMSIALARPVASD

SEQ ID NO: 4382 - protein, 25 aa, synthetic construct
  source 1..25: note = Seed: LNVIVHSATGFKQSSKALQRPVASD
LNVIVHSATGIKQMSIALERPVASD

SEQ ID NO: 4383 - protein, 25 aa, synthetic construct
  source 1..25: note = Seed: LNVIVHSATGFKQSSKALQRPVASD
LNVIVHSATGIKQMSIALFRPVASD

SEQ ID NO: 4384 - protein, 25 aa, synthetic construct
  source 1..25: note = Seed: LNVIVHSATGFKQSSKALQRPVASD
LNVIVHSATGIKQMSIALGRPVASD

SEQ ID NO: 4385 - protein, 25 aa, synthetic construct
  source 1..25: note = Seed: LNVIVHSATGFKQSSKALQRPVASD
LNVIVHSATGIKQMSIALHRPVASD

SEQ ID NO: 4386 - protein, 25 aa, synthetic construct
  source 1..25: note = Seed: LNVIVHSATGFKQSSKALQRPVASD
LNVIVHSATGIKQMSIALIRPVASD

SEQ ID NO: 4387 - protein, 25 aa, synthetic construct
  source 1..25: note = Seed: LNVIVHSATGFKQSSKALQRPVASD
LNVIVHSATGIKQMSIALKRPVASD

SEQ ID NO: 4388 - protein, 25 aa, synthetic construct
  source 1..25: note = Seed: LNVIVHSATGFKQSSKALQRPVASD
LNVIVHSATGIKQMSIALLRPVASD

SEQ ID NO: 4389 - protein, 25 aa, synthetic construct
  source 1..25: note = Seed: LNVIVHSATGFKQSSKALQRPVASD
LNVIVHSATGIKQMSIALMRPVASD

SEQ ID NO: 4390 - protein, 25 aa, synthetic construct
  source 1..25: note = Seed: LNVIVHSATGFKQSSKALQRPVASD
LNVIVHSATGIKQMSIALNRPVASD

SEQ ID NO: 4391 - protein, 25 aa, synthetic construct
  source 1..25: note = Seed: LNVIVHSATGFKQSSKALQRPVASD
LNVIVHSATGIKQMSIALPRPVASD

SEQ ID NO: 4392 - protein, 25 aa, synthetic construct
  source 1..25: note = Seed: LNVIVHSATGFKQSSKALQRPVASD
LNVIVHSATGIKQMSIALQRPVASD

SEQ ID NO: 4393 - protein, 25 aa, synthetic construct
  source 1..25: note = Seed: LNVIVHSATGFKQSSKALQRPVASD
LNVIVHSATGIKQMSIALRRPVASD

SEQ ID NO: 4394 - protein, 25 aa, synthetic construct
  source 1..25: note = Seed: LNVIVHSATGFKQSSKALQRPVASD
LNVIVHSATGIKQMSIALSRPVASD

SEQ ID NO: 4395 - protein, 25 aa, synthetic construct
  source 1..25: note = Seed: LNVIVHSATGFKQSSKALQRPVASD
LNVIVHSATGIKQMSIALTRPVASD

SEQ ID NO: 4396 - protein, 25 aa, synthetic construct
  source 1..25: note = Seed: LNVIVHSATGFKQSSKALQRPVASD
LNVIVHSATGIKQMSIALVRPVASD

SEQ ID NO: 4397 - protein, 25 aa, synthetic construct
  source 1..25: note = Seed: LNVIVHSATGFKQSSKALQRPVASD
LNVIVHSATGIKQMSKALARPVASD

SEQ ID NO: 4398 - protein, 25 aa, synthetic construct
  source 1..25: note = Seed: LNVIVHSATGFKQSSKALQRPVASD
LNVIVHSATGIKQMSKALCRPVASD

SEQ ID NO: 4399 - protein, 25 aa, synthetic construct
  source 1..25: note = Seed: LNVIVHSATGFKQSSKALQRPVASD
LNVIVHSATGIKQMSKALERPVASD

SEQ ID NO: 4400 - protein, 25 aa, synthetic construct
  source 1..25: note = Seed: LNVIVHSATGFKQSSKALQRPVASD
LNVIVHSATGIKQMSKALFRPVASD

SEQ ID NO: 4401 - protein, 25 aa, synthetic construct
  source 1..25: note = Seed: LNVIVHSATGFKQSSKALQRPVASD
LNVIVHSATGIKQMSKALGRPVASD

SEQ ID NO: 4402 - protein, 25 aa, synthetic construct
  source 1..25: note = Seed: LNVIVHSATGFKQSSKALQRPVASD
LNVIVHSATGIKQMSKALHRPVASD

SEQ ID NO: 4403 - protein, 25 aa, synthetic construct
  source 1..25: note = Seed: LNVIVHSATGFKQSSKALQRPVASD
LNVIVHSATGIKQMSKALIRPVASD

SEQ ID NO: 4404 - protein, 25 aa, synthetic construct
  source 1..25: note = Seed: LNVIVHSATGFKQSSKALQRPVASD
LNVIVHSATGIKQMSKALKRPVASD

SEQ ID NO: 4405 - protein, 25 aa, synthetic construct
  source 1..25: note = Seed: LNVIVHSATGFKQSSKALQRPVASD
LNVIVHSATGIKQMSKALLRPVASD

SEQ ID NO: 4406 - protein, 25 aa, synthetic construct
  source 1..25: note = Seed: LNVIVHSATGFKQSSKALQRPVASD
LNVIVHSATGIKQMSKALMRPVASD

SEQ ID NO: 4407 - protein, 25 aa, synthetic construct
  source 1..25: note = Seed: LNVIVHSATGFKQSSKALQRPVASD
LNVIVHSATGIKQMSKALNRPVASD

SEQ ID NO: 4408 - protein, 25 aa, synthetic construct
  source 1..25: note = Seed: LNVIVHSATGFKQSSKALQRPVASD
LNVIVHSATGIKQMSKALPRPVASD

SEQ ID NO: 4409 - protein, 25 aa, synthetic construct
  source 1..25: note = Seed: LNVIVHSATGFKQSSKALQRPVASD
LNVIVHSATGIKQMSKALQRPVASD

SEQ ID NO: 4410 - protein, 25 aa, synthetic construct
  source 1..25: note = Seed: LNVIVHSATGFKQSSKALQRPVASD
LNVIVHSATGIKQMSKALRRPVASD

SEQ ID NO: 4411 - protein, 25 aa, synthetic construct
  source 1..25: note = Seed: LNVIVHSATGFKQSSKALQRPVASD
LNVIVHSATGIKQMSKALSRPVASD

SEQ ID NO: 4412 - protein, 25 aa, synthetic construct
  source 1..25: note = Seed: LNVIVHSATGFKQSSKALQRPVASD
LNVIVHSATGIKQMSKALTRPVASD

SEQ ID NO: 4413 - protein, 25 aa, synthetic construct
  source 1..25: note = Seed: LNVIVHSATGFKQSSKALQRPVASD
LNVIVHSATGIKQMSKALVRPVASD

SEQ ID NO: 4414 - protein, 25 aa, synthetic construct
  source 1..25: note = Seed: LNVIVHSATGFKQSSKALQRPVASD
LNVIVHSATGIKQMSKALWRPVASD

SEQ ID NO: 4415 - protein, 25 aa, synthetic construct
  source 1..25: note = Seed: LNVIVHSATGFKQSSKALQRPVASD
LNVIVHSATGIKQMSKALYRPVASD

SEQ ID NO: 4416 - protein, 25 aa, synthetic construct
  source 1..25: note = Seed: LNVIVHSATGFKQSSKALQRPVASD
LNVIVHSATGIKQMSLALARPVASD

SEQ ID NO: 4417 - protein, 25 aa, synthetic construct
  source 1..25: note = Seed: LNVIVHSATGFKQSSKALQRPVASD
LNVIVHSATGIKQMSLALGRPVASD

SEQ ID NO: 4418 - protein, 25 aa, synthetic construct
  source 1..25: note = Seed: LNVIVHSATGFKQSSKALQRPVASD
LNVIVHSATGIKQMSLALHRPVASD

SEQ ID NO: 4419 - protein, 25 aa, synthetic construct
  source 1..25: note = Seed: LNVIVHSATGFKQSSKALQRPVASD
LNVIVHSATGIKQMSLALIRPVASD

SEQ ID NO: 4420 - protein, 25 aa, synthetic construct
  source 1..25: note = Seed: LNVIVHSATGFKQSSKALQRPVASD
LNVIVHSATGIKQMSLALKRPVASD

SEQ ID NO: 4421 - protein, 25 aa, synthetic construct
  source 1..25: note = Seed: LNVIVHSATGFKQSSKALQRPVASD
LNVIVHSATGIKQMSLALLRPVASD

SEQ ID NO: 4422 - protein, 25 aa, synthetic construct
  source 1..25: note = Seed: LNVIVHSATGFKQSSKALQRPVASD
LNVIVHSATGIKQMSLALMRPVASD

SEQ ID NO: 4423 - protein, 25 aa, synthetic construct
  source 1..25: note = Seed: LNVIVHSATGFKQSSKALQRPVASD
LNVIVHSATGIKQMSLALNRPVASD

SEQ ID NO: 4424 - protein, 25 aa, synthetic construct
  source 1..25: note = Seed: LNVIVHSATGFKQSSKALQRPVASD
LNVIVHSATGIKQMSLALQRPVASD

SEQ ID NO: 4425 - protein, 25 aa, synthetic construct
  source 1..25: note = Seed: LNVIVHSATGFKQSSKALQRPVASD
LNVIVHSATGIKQMSLALRRPVASD

SEQ ID NO: 4426 - protein, 25 aa, synthetic construct
  source 1..25: note = Seed: LNVIVHSATGFKQSSKALQRPVASD
LNVIVHSATGIKQMSLALSRPVASD

SEQ ID NO: 4427 - protein, 25 aa, synthetic construct
  source 1..25: note = Seed: LNVIVHSATGFKQSSKALQRPVASD
LNVIVHSATGIKQMSLALTRPVASD

SEQ ID NO: 4428 - protein, 25 aa, synthetic construct
  source 1..25: note = Seed: LNVIVHSATGFKQSSKALQRPVASD
LNVIVHSATGIKQMSLALVRPVASD

SEQ ID NO: 4429 - protein, 25 aa, synthetic construct
  source 1..25: note = Seed: LNVIVHSATGFKQSSKALQRPVASD
LNVIVHSATGIKQMSMALARPVASD

SEQ ID NO: 4430 - protein, 25 aa, synthetic construct
  source 1..25: note = Seed: LNVIVHSATGFKQSSKALQRPVASD
LNVIVHSATGIKQMSMALGRPVASD

SEQ ID NO: 4431 - protein, 25 aa, synthetic construct
  source 1..25: note = Seed: LNVIVHSATGFKQSSKALQRPVASD
LNVIVHSATGIKQMSMALHRPVASD

SEQ ID NO: 4432 - protein, 25 aa, synthetic construct
  source 1..25: note = Seed: LNVIVHSATGFKQSSKALQRPVASD
LNVIVHSATGIKQMSMALIRPVASD

SEQ ID NO: 4433 - protein, 25 aa, synthetic construct
  source 1..25: note = Seed: LNVIVHSATGFKQSSKALQRPVASD
LNVIVHSATGIKQMSMALLRPVASD

SEQ ID NO: 4434 - protein, 25 aa, synthetic construct
  source 1..25: note = Seed: LNVIVHSATGFKQSSKALQRPVASD
LNVIVHSATGIKQMSMALMRPVASD

SEQ ID NO: 4435 - protein, 25 aa, synthetic construct
  source 1..25: note = Seed: LNVIVHSATGFKQSSKALQRPVASD
LNVIVHSATGIKQMSMALNRPVASD

SEQ ID NO: 4436 - protein, 25 aa, synthetic construct
  source 1..25: note = Seed: LNVIVHSATGFKQSSKALQRPVASD
LNVIVHSATGIKQMSMALRRPVASD

SEQ ID NO: 4437 - protein, 25 aa, synthetic construct
  source 1..25: note = Seed: LNVIVHSATGFKQSSKALQRPVASD
LNVIVHSATGIKQMSMALSRPVASD

SEQ ID NO: 4438 - protein, 25 aa, synthetic construct
  source 1..25: note = Seed: LNVIVHSATGFKQSSKALQRPVASD
LNVIVHSATGIKQMSMALTRPVASD

SEQ ID NO: 4439 - protein, 25 aa, synthetic construct
  source 1..25: note = Seed: LNVIVHSATGFKQSSKALQRPVASD
LNVIVHSATGIKQMSMALVRPVASD

SEQ ID NO: 4440 - protein, 25 aa, synthetic construct
  source 1..25: note = Seed: LNVIVHSATGFKQSSKALQRPVASD
LNVIVHSATGIKQMSNALARPVASD

SEQ ID NO: 4441 - protein, 25 aa, synthetic construct
  source 1..25: note = Seed: LNVIVHSATGFKQSSKALQRPVASD
LNVIVHSATGIKQMSNALCRPVASD

SEQ ID NO: 4442 - protein, 25 aa, synthetic construct
  source 1..25: note = Seed: LNVIVHSATGFKQSSKALQRPVASD
LNVIVHSATGIKQMSNALGRPVASD

SEQ ID NO: 4443 - protein, 25 aa, synthetic construct
  source 1..25: note = Seed: LNVIVHSATGFKQSSKALQRPVASD
LNVIVHSATGIKQMSNALIRPVASD

SEQ ID NO: 4444 - protein, 25 aa, synthetic construct
  source 1..25: note = Seed: LNVIVHSATGFKQSSKALQRPVASD
LNVIVHSATGIKQMSNALLRPVASD

SEQ ID NO: 4445 - protein, 25 aa, synthetic construct
  source 1..25: note = Seed: LNVIVHSATGFKQSSKALQRPVASD
LNVIVHSATGIKQMSNALMRPVASD

SEQ ID NO: 4446 - protein, 25 aa, synthetic construct
  source 1..25: note = Seed: LNVIVHSATGFKQSSKALQRPVASD
LNVIVHSATGIKQMSNALNRPVASD

SEQ ID NO: 4447 - protein, 25 aa, synthetic construct
  source 1..25: note = Seed: LNVIVHSATGFKQSSKALQRPVASD
LNVIVHSATGIKQMSNALRRPVASD

SEQ ID NO: 4448 - protein, 25 aa, synthetic construct
  source 1..25: note = Seed: LNVIVHSATGFKQSSKALQRPVASD
LNVIVHSATGIKQMSNALSRPVASD

SEQ ID NO: 4449 - protein, 25 aa, synthetic construct
  source 1..25: note = Seed: LNVIVHSATGFKQSSKALQRPVASD
LNVIVHSATGIKQMSNALTRPVASD

SEQ ID NO: 4450 - protein, 25 aa, synthetic construct
  source 1..25: note = Seed: LNVIVHSATGFKQSSKALQRPVASD
LNVIVHSATGIKQMSNALVRPVASD

SEQ ID NO: 4451 - protein, 25 aa, synthetic construct
  source 1..25: note = Seed: LNVIVHSATGFKQSSKALQRPVASD
LNVIVHSATGIKQMSPALARPVASD

SEQ ID NO: 4452 - protein, 25 aa, synthetic construct
  source 1..25: note = Seed: LNVIVHSATGFKQSSKALQRPVASD
LNVIVHSATGIKQMSPALCRPVASD

SEQ ID NO: 4453 - protein, 25 aa, synthetic construct
  source 1..25: note = Seed: LNVIVHSATGFKQSSKALQRPVASD
LNVIVHSATGIKQMSPALDRPVASD

SEQ ID NO: 4454 - protein, 25 aa, synthetic construct
  source 1..25: note = Seed: LNVIVHSATGFKQSSKALQRPVASD
LNVIVHSATGIKQMSPALERPVASD

SEQ ID NO: 4455 - protein, 25 aa, synthetic construct
  source 1..25: note = Seed: LNVIVHSATGFKQSSKALQRPVASD
LNVIVHSATGIKQMSPALFRPVASD

SEQ ID NO: 4456 - protein, 25 aa, synthetic construct
  source 1..25: note = Seed: LNVIVHSATGFKQSSKALQRPVASD
LNVIVHSATGIKQMSPALGRPVASD

SEQ ID NO: 4457 - protein, 25 aa, synthetic construct
  source 1..25: note = Seed: LNVIVHSATGFKQSSKALQRPVASD
LNVIVHSATGIKQMSPALHRPVASD

SEQ ID NO: 4458 - protein, 25 aa, synthetic construct
  source 1..25: note = Seed: LNVIVHSATGFKQSSKALQRPVASD
LNVIVHSATGIKQMSPALIRPVASD

SEQ ID NO: 4459 - protein, 25 aa, synthetic construct
  source 1..25: note = Seed: LNVIVHSATGFKQSSKALQRPVASD
LNVIVHSATGIKQMSPALKRPVASD

SEQ ID NO: 4460 - protein, 25 aa, synthetic construct
  source 1..25: note = Seed: LNVIVHSATGFKQSSKALQRPVASD
LNVIVHSATGIKQMSPALLRPVASD

SEQ ID NO: 4461 - protein, 25 aa, synthetic construct
  source 1..25: note = Seed: LNVIVHSATGFKQSSKALQRPVASD
LNVIVHSATGIKQMSPALMRPVASD

SEQ ID NO: 4462 - protein, 25 aa, synthetic construct
  source 1..25: note = Seed: LNVIVHSATGFKQSSKALQRPVASD
LNVIVHSATGIKQMSPALNRPVASD

SEQ ID NO: 4463 - protein, 25 aa, synthetic construct
  source 1..25: note = Seed: LNVIVHSATGFKQSSKALQRPVASD
LNVIVHSATGIKQMSPALPRPVASD

SEQ ID NO: 4464 - protein, 25 aa, synthetic construct
  source 1..25: note = Seed: LNVIVHSATGFKQSSKALQRPVASD
LNVIVHSATGIKQMSPALQRPVASD

SEQ ID NO: 4465 - protein, 25 aa, synthetic construct
  source 1..25: note = Seed: LNVIVHSATGFKQSSKALQRPVASD
LNVIVHSATGIKQMSPALRRPVASD

SEQ ID NO: 4466 - protein, 25 aa, synthetic construct
  source 1..25: note = Seed: LNVIVHSATGFKQSSKALQRPVASD
LNVIVHSATGIKQMSPALSRPVASD

SEQ ID NO: 4467 - protein, 25 aa, synthetic construct
  source 1..25: note = Seed: LNVIVHSATGFKQSSKALQRPVASD
LNVIVHSATGIKQMSPALTRPVASD

SEQ ID NO: 4468 - protein, 25 aa, synthetic construct
  source 1..25: note = Seed: LNVIVHSATGFKQSSKALQRPVASD
LNVIVHSATGIKQMSPALVRPVASD

SEQ ID NO: 4469 - protein, 25 aa, synthetic construct
  source 1..25: note = Seed: LNVIVHSATGFKQSSKALQRPVASD
LNVIVHSATGIKQMSQALARPVASD

SEQ ID NO: 4470 - protein, 25 aa, synthetic construct
  source 1..25: note = Seed: LNVIVHSATGFKQSSKALQRPVASD
LNVIVHSATGIKQMSQALKRPVASD

SEQ ID NO: 4471 - protein, 25 aa, synthetic construct
  source 1..25: note = Seed: LNVIVHSATGFKQSSKALQRPVASD
LNVIVHSATGIKQMSQALRRPVASD

SEQ ID NO: 4472 - protein, 25 aa, synthetic construct
  source 1..25: note = Seed: LNVIVHSATGFKQSSKALQRPVASD
LNVIVHSATGIKQMSQALVRPVASD

SEQ ID NO: 4473 - protein, 25 aa, synthetic construct
  source 1..25: note = Seed: LNVIVHSATGFKQSSKALQRPVASD
LNVIVHSATGIKQMSRALARPVASD

SEQ ID NO: 4474 - protein, 25 aa, synthetic construct
  source 1..25: note = Seed: LNVIVHSATGFKQSSKALQRPVASD
LNVIVHSATGIKQMSRALCRPVASD

SEQ ID NO: 4475 - protein, 25 aa, synthetic construct
  source 1..25: note = Seed: LNVIVHSATGFKQSSKALQRPVASD
LNVIVHSATGIKQMSRALDRPVASD

SEQ ID NO: 4476 - protein, 25 aa, synthetic construct
  source 1..25: note = Seed: LNVIVHSATGFKQSSKALQRPVASD
LNVIVHSATGIKQMSRALERPVASD

SEQ ID NO: 4477 - protein, 25 aa, synthetic construct
  source 1..25: note = Seed: LNVIVHSATGFKQSSKALQRPVASD
LNVIVHSATGIKQMSRALFRPVASD

SEQ ID NO: 4478 - protein, 25 aa, synthetic construct
  source 1..25: note = Seed: LNVIVHSATGFKQSSKALQRPVASD
LNVIVHSATGIKQMSRALGRPVASD

SEQ ID NO: 4479 - protein, 25 aa, synthetic construct
  source 1..25: note = Seed: LNVIVHSATGFKQSSKALQRPVASD
LNVIVHSATGIKQMSRALHRPVASD

SEQ ID NO: 4480 - protein, 25 aa, synthetic construct
  source 1..25: note = Seed: LNVIVHSATGFKQSSKALQRPVASD
LNVIVHSATGIKQMSRALIRPVASD

SEQ ID NO: 4481 - protein, 25 aa, synthetic construct
  source 1..25: note = Seed: LNVIVHSATGFKQSSKALQRPVASD
LNVIVHSATGIKQMSRALKRPVASD

SEQ ID NO: 4482 - protein, 25 aa, synthetic construct
  source 1..25: note = Seed: LNVIVHSATGFKQSSKALQRPVASD
LNVIVHSATGIKQMSRALLRPVASD

SEQ ID NO: 4483 - protein, 25 aa, synthetic construct
  source 1..25: note = Seed: LNVIVHSATGFKQSSKALQRPVASD
LNVIVHSATGIKQMSRALMRPVASD

SEQ ID NO: 4484 - protein, 25 aa, synthetic construct
  source 1..25: note = Seed: LNVIVHSATGFKQSSKALQRPVASD
LNVIVHSATGIKQMSRALNRPVASD

SEQ ID NO: 4485 - protein, 25 aa, synthetic construct
  source 1..25: note = Seed: LNVIVHSATGFKQSSKALQRPVASD
LNVIVHSATGIKQMSRALPRPVASD

SEQ ID NO: 4486 - protein, 25 aa, synthetic construct
  source 1..25: note = Seed: LNVIVHSATGFKQSSKALQRPVASD
LNVIVHSATGIKQMSRALQRPVASD

SEQ ID NO: 4487 - protein, 25 aa, synthetic construct
  source 1..25: note = Seed: LNVIVHSATGFKQSSKALQRPVASD
LNVIVHSATGIKQMSRALRRPVASD

SEQ ID NO: 4488 - protein, 25 aa, synthetic construct
  source 1..25: note = Seed: LNVIVHSATGFKQSSKALQRPVASD
LNVIVHSATGIKQMSRALSRPVASD

SEQ ID NO: 4489 - protein, 25 aa, synthetic construct
  source 1..25: note = Seed: LNVIVHSATGFKQSSKALQRPVASD
LNVIVHSATGIKQMSRALTRPVASD

SEQ ID NO: 4490 - protein, 25 aa, synthetic construct
  source 1..25: note = Seed: LNVIVHSATGFKQSSKALQRPVASD
LNVIVHSATGIKQMSRALVRPVASD

SEQ ID NO: 4491 - protein, 25 aa, synthetic construct
  source 1..25: note = Seed: LNVIVHSATGFKQSSKALQRPVASD
LNVIVHSATGIKQMSRALWRPVASD

SEQ ID NO: 4492 - protein, 25 aa, synthetic construct
  source 1..25: note = Seed: LNVIVHSATGFKQSSKALQRPVASD
LNVIVHSATGIKQMSRALYRPVASD

SEQ ID NO: 4493 - protein, 25 aa, synthetic construct
  source 1..25: note = Seed: LNVIVHSATGFKQSSKALQRPVASD
LNVIVHSATGIKQMSSALARPVASD

SEQ ID NO: 4494 - protein, 25 aa, synthetic construct
  source 1..25: note = Seed: LNVIVHSATGFKQSSKALQRPVASD
LNVIVHSATGIKQMSSALCRPVASD

SEQ ID NO: 4495 - protein, 25 aa, synthetic construct
  source 1..25: note = Seed: LNVIVHSATGFKQSSKALQRPVASD
LNVIVHSATGIKQMSSALFRPVASD

SEQ ID NO: 4496 - protein, 25 aa, synthetic construct
  source 1..25: note = Seed: LNVIVHSATGFKQSSKALQRPVASD
LNVIVHSATGIKQMSSALGRPVASD

SEQ ID NO: 4497 - protein, 25 aa, synthetic construct
  source 1..25: note = Seed: LNVIVHSATGFKQSSKALQRPVASD
LNVIVHSATGIKQMSSALHRPVASD

SEQ ID NO: 4498 - protein, 25 aa, synthetic construct
  source 1..25: note = Seed: LNVIVHSATGFKQSSKALQRPVASD
LNVIVHSATGIKQMSSALIRPVASD

SEQ ID NO: 4499 - protein, 25 aa, synthetic construct
  source 1..25: note = Seed: LNVIVHSATGFKQSSKALQRPVASD
LNVIVHSATGIKQMSSALKRPVASD

SEQ ID NO: 4500 - protein, 25 aa, synthetic construct
  source 1..25: note = Seed: LNVIVHSATGFKQSSKALQRPVASD
LNVIVHSATGIKQMSSALLRPVASD

SEQ ID NO: 4501 - protein, 25 aa, synthetic construct
  source 1..25: note = Seed: LNVIVHSATGFKQSSKALQRPVASD
LNVIVHSATGIKQMSSALMRPVASD

SEQ ID NO: 4502 - protein, 25 aa, synthetic construct
  source 1..25: note = Seed: LNVIVHSATGFKQSSKALQRPVASD
LNVIVHSATGIKQMSSALNRPVASD

SEQ ID NO: 4503 - protein, 25 aa, synthetic construct
  source 1..25: note = Seed: LNVIVHSATGFKQSSKALQRPVASD
LNVIVHSATGIKQMSSALPRPVASD

SEQ ID NO: 4504 - protein, 25 aa, synthetic construct
  source 1..25: note = Seed: LNVIVHSATGFKQSSKALQRPVASD
LNVIVHSATGIKQMSSALQRPVASD

SEQ ID NO: 4505 - protein, 25 aa, synthetic construct
  source 1..25: note = Seed: LNVIVHSATGFKQSSKALQRPVASD
LNVIVHSATGIKQMSSALRRPVASD

SEQ ID NO: 4506 - protein, 25 aa, synthetic construct
  source 1..25: note = Seed: LNVIVHSATGFKQSSKALQRPVASD
LNVIVHSATGIKQMSSALSRPVASD

SEQ ID NO: 4507 - protein, 25 aa, synthetic construct
  source 1..25: note = Seed: LNVIVHSATGFKQSSKALQRPVASD
LNVIVHSATGIKQMSSALTRPVASD

SEQ ID NO: 4508 - protein, 25 aa, synthetic construct
  source 1..25: note = Seed: LNVIVHSATGFKQSSKALQRPVASD
LNVIVHSATGIKQMSSALVRPVASD

SEQ ID NO: 4509 - protein, 25 aa, synthetic construct
  source 1..25: note = Seed: LNVIVHSATGFKQSSKALQRPVASD
LNVIVHSATGIKQMSTALARPVASD

SEQ ID NO: 4510 - protein, 25 aa, synthetic construct
  source 1..25: note = Seed: LNVIVHSATGFKQSSKALQRPVASD
LNVIVHSATGIKQMSTALCRPVASD

SEQ ID NO: 4511 - protein, 25 aa, synthetic construct
  source 1..25: note = Seed: LNVIVHSATGFKQSSKALQRPVASD
LNVIVHSATGIKQMSTALGRPVASD

SEQ ID NO: 4512 - protein, 25 aa, synthetic construct
  source 1..25: note = Seed: LNVIVHSATGFKQSSKALQRPVASD
LNVIVHSATGIKQMSTALHRPVASD

SEQ ID NO: 4513 - protein, 25 aa, synthetic construct
  source 1..25: note = Seed: LNVIVHSATGFKQSSKALQRPVASD
LNVIVHSATGIKQMSTALIRPVASD

SEQ ID NO: 4514 - protein, 25 aa, synthetic construct
  source 1..25: note = Seed: LNVIVHSATGFKQSSKALQRPVASD
LNVIVHSATGIKQMSTALKRPVASD

SEQ ID NO: 4515 - protein, 25 aa, synthetic construct
  source 1..25: note = Seed: LNVIVHSATGFKQSSKALQRPVASD
LNVIVHSATGIKQMSTALLRPVASD

SEQ ID NO: 4516 - protein, 25 aa, synthetic construct
  source 1..25: note = Seed: LNVIVHSATGFKQSSKALQRPVASD
LNVIVHSATGIKQMSTALMRPVASD

SEQ ID NO: 4517 - protein, 25 aa, synthetic construct
  source 1..25: note = Seed: LNVIVHSATGFKQSSKALQRPVASD
LNVIVHSATGIKQMSTALNRPVASD

SEQ ID NO: 4518 - protein, 25 aa, synthetic construct
  source 1..25: note = Seed: LNVIVHSATGFKQSSKALQRPVASD
LNVIVHSATGIKQMSTALQRPVASD

SEQ ID NO: 4519 - protein, 25 aa, synthetic construct
  source 1..25: note = Seed: LNVIVHSATGFKQSSKALQRPVASD
LNVIVHSATGIKQMSTALRRPVASD

SEQ ID NO: 4520 - protein, 25 aa, synthetic construct
  source 1..25: note = Seed: LNVIVHSATGFKQSSKALQRPVASD
LNVIVHSATGIKQMSTALSRPVASD

SEQ ID NO: 4521 - protein, 25 aa, synthetic construct
  source 1..25: note = Seed: LNVIVHSATGFKQSSKALQRPVASD
LNVIVHSATGIKQMSTALTRPVASD

SEQ ID NO: 4522 - protein, 25 aa, synthetic construct
  source 1..25: note = Seed: LNVIVHSATGFKQSSKALQRPVASD
LNVIVHSATGIKQMSTALVRPVASD

SEQ ID NO: 4523 - protein, 25 aa, synthetic construct
  source 1..25: note = Seed: LNVIVHSATGFKQSSKALQRPVASD
LNVIVHSATGIKQMSVALARPVASD

SEQ ID NO: 4524 - protein, 25 aa, synthetic construct
  source 1..25: note = Seed: LNVIVHSATGFKQSSKALQRPVASD
LNVIVHSATGIKQMSVALDRPVASD

SEQ ID NO: 4525 - protein, 25 aa, synthetic construct
  source 1..25: note = Seed: LNVIVHSATGFKQSSKALQRPVASD
LNVIVHSATGIKQMSVALERPVASD

SEQ ID NO: 4526 - protein, 25 aa, synthetic construct
  source 1..25: note = Seed: LNVIVHSATGFKQSSKALQRPVASD
LNVIVHSATGIKQMSVALGRPVASD

SEQ ID NO: 4527 - protein, 25 aa, synthetic construct
  source 1..25: note = Seed: LNVIVHSATGFKQSSKALQRPVASD
LNVIVHSATGIKQMSVALHRPVASD

SEQ ID NO: 4528 - protein, 25 aa, synthetic construct
  source 1..25: note = Seed: LNVIVHSATGFKQSSKALQRPVASD
LNVIVHSATGIKQMSVALIRPVASD

SEQ ID NO: 4529 - protein, 25 aa, synthetic construct
  source 1..25: note = Seed: LNVIVHSATGFKQSSKALQRPVASD
LNVIVHSATGIKQMSVALKRPVASD

SEQ ID NO: 4530 - protein, 25 aa, synthetic construct
  source 1..25: note = Seed: LNVIVHSATGFKQSSKALQRPVASD
LNVIVHSATGIKQMSVALLRPVASD

SEQ ID NO: 4531 - protein, 25 aa, synthetic construct
  source 1..25: note = Seed: LNVIVHSATGFKQSSKALQRPVASD
LNVIVHSATGIKQMSVALMRPVASD

SEQ ID NO: 4532 - protein, 25 aa, synthetic construct
  source 1..25: note = Seed: LNVIVHSATGFKQSSKALQRPVASD
LNVIVHSATGIKQMSVALNRPVASD

SEQ ID NO: 4533 - protein, 25 aa, synthetic construct
  source 1..25: note = Seed: LNVIVHSATGFKQSSKALQRPVASD
LNVIVHSATGIKQMSVALPRPVASD

SEQ ID NO: 4534 - protein, 25 aa, synthetic construct
  source 1..25: note = Seed: LNVIVHSATGFKQSSKALQRPVASD
LNVIVHSATGIKQMSVALQRPVASD

SEQ ID NO: 4535 - protein, 25 aa, synthetic construct
  source 1..25: note = Seed: LNVIVHSATGFKQSSKALQRPVASD
LNVIVHSATGIKQMSVALRRPVASD

SEQ ID NO: 4536 - protein, 25 aa, synthetic construct
  source 1..25: note = Seed: LNVIVHSATGFKQSSKALQRPVASD
LNVIVHSATGIKQMSVALSRPVASD

SEQ ID NO: 4537 - protein, 25 aa, synthetic construct
  source 1..25: note = Seed: LNVIVHSATGFKQSSKALQRPVASD
LNVIVHSATGIKQMSVALTRPVASD

SEQ ID NO: 4538 - protein, 25 aa, synthetic construct
  source 1..25: note = Seed: LNVIVHSATGFKQSSKALQRPVASD
LNVIVHSATGIKQMSVALVRPVASD

SEQ ID NO: 4539 - protein, 25 aa, synthetic construct
  source 1..25: note = Seed: LNVIVHSATGFKQSSKALQRPVASD
LNVIVHSATGIKQMSWALVRPVASD

SEQ ID NO: 4540 - protein, 25 aa, synthetic construct
  source 1..25: note = Seed: LNVIVHSATGFKQSSKALQRPVASD
LNVIVHSATGIKQMSYALGRPVASD

SEQ ID NO: 4541 - protein, 25 aa, synthetic construct
  source 1..25: note = Seed: LNVIVHSATGFKQSSKALQRPVASD
LNVIVHSATGIKQNSAALARPVASD

SEQ ID NO: 4542 - protein, 25 aa, synthetic construct
  source 1..25: note = Seed: LNVIVHSATGFKQSSKALQRPVASD
LNVIVHSATGIKQNSAALCRPVASD

SEQ ID NO: 4543 - protein, 25 aa, synthetic construct
  source 1..25: note = Seed: LNVIVHSATGFKQSSKALQRPVASD
LNVIVHSATGIKQNSAALDRPVASD

SEQ ID NO: 4544 - protein, 25 aa, synthetic construct
  source 1..25: note = Seed: LNVIVHSATGFKQSSKALQRPVASD
LNVIVHSATGIKQNSAALERPVASD

SEQ ID NO: 4545 - protein, 25 aa, synthetic construct
  source 1..25: note = Seed: LNVIVHSATGFKQSSKALQRPVASD
LNVIVHSATGIKQNSAALFRPVASD

SEQ ID NO: 4546 - protein, 25 aa, synthetic construct
  source 1..25: note = Seed: LNVIVHSATGFKQSSKALQRPVASD
LNVIVHSATGIKQNSAALGRPVASD

SEQ ID NO: 4547 - protein, 25 aa, synthetic construct
  source 1..25: note = Seed: LNVIVHSATGFKQSSKALQRPVASD
LNVIVHSATGIKQNSAALHRPVASD

SEQ ID NO: 4548 - protein, 25 aa, synthetic construct
  source 1..25: note = Seed: LNVIVHSATGFKQSSKALQRPVASD
LNVIVHSATGIKQNSAALIRPVASD

SEQ ID NO: 4549 - protein, 25 aa, synthetic construct
  source 1..25: note = Seed: LNVIVHSATGFKQSSKALQRPVASD
LNVIVHSATGIKQNSAALLRPVASD

SEQ ID NO: 4550 - protein, 25 aa, synthetic construct
  source 1..25: note = Seed: LNVIVHSATGFKQSSKALQRPVASD
LNVIVHSATGIKQNSAALMRPVASD

SEQ ID NO: 4551 - protein, 25 aa, synthetic construct
  source 1..25: note = Seed: LNVIVHSATGFKQSSKALQRPVASD
LNVIVHSATGIKQNSAALNRPVASD

SEQ ID NO: 4552 - protein, 25 aa, synthetic construct
  source 1..25: note = Seed: LNVIVHSATGFKQSSKALQRPVASD
LNVIVHSATGIKQNSAALPRPVASD

SEQ ID NO: 4553 - protein, 25 aa, synthetic construct
  source 1..25: note = Seed: LNVIVHSATGFKQSSKALQRPVASD
LNVIVHSATGIKQNSAALQRPVASD

SEQ ID NO: 4554 - protein, 25 aa, synthetic construct
  source 1..25: note = Seed: LNVIVHSATGFKQSSKALQRPVASD
LNVIVHSATGIKQNSAALRRPVASD

SEQ ID NO: 4555 - protein, 25 aa, synthetic construct
  source 1..25: note = Seed: LNVIVHSATGFKQSSKALQRPVASD
LNVIVHSATGIKQNSAALSRPVASD

SEQ ID NO: 4556 - protein, 25 aa, synthetic construct
  source 1..25: note = Seed: LNVIVHSATGFKQSSKALQRPVASD
LNVIVHSATGIKQNSAALTRPVASD

SEQ ID NO: 4557 - protein, 25 aa, synthetic construct
  source 1..25: note = Seed: LNVIVHSATGFKQSSKALQRPVASD
LNVIVHSATGIKQNSAALVRPVASD

SEQ ID NO: 4558 - protein, 25 aa, synthetic construct
  source 1..25: note = Seed: LNVIVHSATGFKQSSKALQRPVASD
LNVIVHSATGIKQNSAALWRPVASD

SEQ ID NO: 4559 - protein, 25 aa, synthetic construct
  source 1..25: note = Seed: LNVIVHSATGFKQSSKALQRPVASD
LNVIVHSATGIKQNSAALYRPVASD

SEQ ID NO: 4560 - protein, 25 aa, synthetic construct
  source 1..25: note = Seed: LNVIVHSATGFKQSSKALQRPVASD
LNVIVHSATGIKQNSCALFRPVASD

SEQ ID NO: 4561 - protein, 25 aa, synthetic construct
  source 1..25: note = Seed: LNVIVHSATGFKQSSKALQRPVASD
LNVIVHSATGIKQNSCALIRPVASD

SEQ ID NO: 4562 - protein, 25 aa, synthetic construct
  source 1..25: note = Seed: LNVIVHSATGFKQSSKALQRPVASD
LNVIVHSATGIKQNSCALLRPVASD

SEQ ID NO: 4563 - protein, 25 aa, synthetic construct
  source 1..25: note = Seed: LNVIVHSATGFKQSSKALQRPVASD
LNVIVHSATGIKQNSCALVRPVASD

SEQ ID NO: 4564 - protein, 25 aa, synthetic construct
  source 1..25: note = Seed: LNVIVHSATGFKQSSKALQRPVASD
LNVIVHSATGIKQNSCALYRPVASD

SEQ ID NO: 4565 - protein, 25 aa, synthetic construct
  source 1..25: note = Seed: LNVIVHSATGFKQSSKALQRPVASD
LNVIVHSATGIKQNSDALFRPVASD

SEQ ID NO: 4566 - protein, 25 aa, synthetic construct
  source 1..25: note = Seed: LNVIVHSATGFKQSSKALQRPVASD
LNVIVHSATGIKQNSDALIRPVASD

SEQ ID NO: 4567 - protein, 25 aa, synthetic construct
  source 1..25: note = Seed: LNVIVHSATGFKQSSKALQRPVASD
LNVIVHSATGIKQNSDALLRPVASD

SEQ ID NO: 4568 - protein, 25 aa, synthetic construct
  source 1..25: note = Seed: LNVIVHSATGFKQSSKALQRPVASD
LNVIVHSATGIKQNSDALVRPVASD

SEQ ID NO: 4569 - protein, 25 aa, synthetic construct
  source 1..25: note = Seed: LNVIVHSATGFKQSSKALQRPVASD
LNVIVHSATGIKQNSDALYRPVASD

SEQ ID NO: 4570 - protein, 25 aa, synthetic construct
  source 1..25: note = Seed: LNVIVHSATGFKQSSKALQRPVASD
LNVIVHSATGIKQNSEALIRPVASD

SEQ ID NO: 4571 - protein, 25 aa, synthetic construct
  source 1..25: note = Seed: LNVIVHSATGFKQSSKALQRPVASD
LNVIVHSATGIKQNSEALLRPVASD

SEQ ID NO: 4572 - protein, 25 aa, synthetic construct
  source 1..25: note = Seed: LNVIVHSATGFKQSSKALQRPVASD
LNVIVHSATGIKQNSEALVRPVASD

SEQ ID NO: 4573 - protein, 25 aa, synthetic construct
  source 1..25: note = Seed: LNVIVHSATGFKQSSKALQRPVASD
LNVIVHSATGIKQNSFALFRPVASD

SEQ ID NO: 4574 - protein, 25 aa, synthetic construct
  source 1..25: note = Seed: LNVIVHSATGFKQSSKALQRPVASD
LNVIVHSATGIKQNSFALIRPVASD

SEQ ID NO: 4575 - protein, 25 aa, synthetic construct
  source 1..25: note = Seed: LNVIVHSATGFKQSSKALQRPVASD
LNVIVHSATGIKQNSFALNRPVASD

SEQ ID NO: 4576 - protein, 25 aa, synthetic construct
  source 1..25: note = Seed: LNVIVHSATGFKQSSKALQRPVASD
LNVIVHSATGIKQNSFALVRPVASD

SEQ ID NO: 4577 - protein, 25 aa, synthetic construct
  source 1..25: note = Seed: LNVIVHSATGFKQSSKALQRPVASD
LNVIVHSATGIKQNSFALYRPVASD

SEQ ID NO: 4578 - protein, 25 aa, synthetic construct
  source 1..25: note = Seed: LNVIVHSATGFKQSSKALQRPVASD
LNVIVHSATGIKQNSGALARPVASD

SEQ ID NO: 4579 - protein, 25 aa, synthetic construct
  source 1..25: note = Seed: LNVIVHSATGFKQSSKALQRPVASD
LNVIVHSATGIKQNSGALFRPVASD

SEQ ID NO: 4580 - protein, 25 aa, synthetic construct
  source 1..25: note = Seed: LNVIVHSATGFKQSSKALQRPVASD
LNVIVHSATGIKQNSGALIRPVASD

SEQ ID NO: 4581 - protein, 25 aa, synthetic construct
  source 1..25: note = Seed: LNVIVHSATGFKQSSKALQRPVASD
LNVIVHSATGIKQNSGALLRPVASD

SEQ ID NO: 4582 - protein, 25 aa, synthetic construct
  source 1..25: note = Seed: LNVIVHSATGFKQSSKALQRPVASD
LNVIVHSATGIKQNSGALMRPVASD

SEQ ID NO: 4583 - protein, 25 aa, synthetic construct
  source 1..25: note = Seed: LNVIVHSATGFKQSSKALQRPVASD
LNVIVHSATGIKQNSGALNRPVASD

SEQ ID NO: 4584 - protein, 25 aa, synthetic construct
  source 1..25: note = Seed: LNVIVHSATGFKQSSKALQRPVASD
LNVIVHSATGIKQNSGALQRPVASD

SEQ ID NO: 4585 - protein, 25 aa, synthetic construct
  source 1..25: note = Seed: LNVIVHSATGFKQSSKALQRPVASD
LNVIVHSATGIKQNSGALSRPVASD

SEQ ID NO: 4586 - protein, 25 aa, synthetic construct
  source 1..25: note = Seed: LNVIVHSATGFKQSSKALQRPVASD
LNVIVHSATGIKQNSGALTRPVASD

SEQ ID NO: 4587 - protein, 25 aa, synthetic construct
  source 1..25: note = Seed: LNVIVHSATGFKQSSKALQRPVASD
LNVIVHSATGIKQNSGALVRPVASD

SEQ ID NO: 4588 - protein, 25 aa, synthetic construct
  source 1..25: note = Seed: LNVIVHSATGFKQSSKALQRPVASD
LNVIVHSATGIKQNSGALWRPVASD

SEQ ID NO: 4589 - protein, 25 aa, synthetic construct
  source 1..25: note = Seed: LNVIVHSATGFKQSSKALQRPVASD
LNVIVHSATGIKQNSGALYRPVASD

SEQ ID NO: 4590 - protein, 25 aa, synthetic construct
  source 1..25: note = Seed: LNVIVHSATGFKQSSKALQRPVASD
LNVIVHSATGIKQNSHALARPVASD

SEQ ID NO: 4591 - protein, 25 aa, synthetic construct
  source 1..25: note = Seed: LNVIVHSATGFKQSSKALQRPVASD
LNVIVHSATGIKQNSHALFRPVASD

SEQ ID NO: 4592 - protein, 25 aa, synthetic construct
  source 1..25: note = Seed: LNVIVHSATGFKQSSKALQRPVASD
LNVIVHSATGIKQNSHALIRPVASD

SEQ ID NO: 4593 - protein, 25 aa, synthetic construct
  source 1..25: note = Seed: LNVIVHSATGFKQSSKALQRPVASD
LNVIVHSATGIKQNSHALLRPVASD

SEQ ID NO: 4594 - protein, 25 aa, synthetic construct
  source 1..25: note = Seed: LNVIVHSATGFKQSSKALQRPVASD
LNVIVHSATGIKQNSHALMRPVASD

SEQ ID NO: 4595 - protein, 25 aa, synthetic construct
  source 1..25: note = Seed: LNVIVHSATGFKQSSKALQRPVASD
LNVIVHSATGIKQNSHALVRPVASD

SEQ ID NO: 4596 - protein, 25 aa, synthetic construct
  source 1..25: note = Seed: LNVIVHSATGFKQSSKALQRPVASD
LNVIVHSATGIKQNSHALYRPVASD

SEQ ID NO: 4597 - protein, 25 aa, synthetic construct
  source 1..25: note = Seed: LNVIVHSATGFKQSSKALQRPVASD
LNVIVHSATGIKQNSIALARPVASD

SEQ ID NO: 4598 - protein, 25 aa, synthetic construct
  source 1..25: note = Seed: LNVIVHSATGFKQSSKALQRPVASD
LNVIVHSATGIKQNSIALFRPVASD

SEQ ID NO: 4599 - protein, 25 aa, synthetic construct
  source 1..25: note = Seed: LNVIVHSATGFKQSSKALQRPVASD
LNVIVHSATGIKQNSIALHRPVASD

SEQ ID NO: 4600 - protein, 25 aa, synthetic construct
  source 1..25: note = Seed: LNVIVHSATGFKQSSKALQRPVASD
LNVIVHSATGIKQNSIALIRPVASD

SEQ ID NO: 4601 - protein, 25 aa, synthetic construct
  source 1..25: note = Seed: LNVIVHSATGFKQSSKALQRPVASD
LNVIVHSATGIKQNSIALLRPVASD

SEQ ID NO: 4602 - protein, 25 aa, synthetic construct
  source 1..25: note = Seed: LNVIVHSATGFKQSSKALQRPVASD
LNVIVHSATGIKQNSIALMRPVASD

SEQ ID NO: 4603 - protein, 25 aa, synthetic construct
  source 1..25: note = Seed: LNVIVHSATGFKQSSKALQRPVASD
LNVIVHSATGIKQNSIALNRPVASD

SEQ ID NO: 4604 - protein, 25 aa, synthetic construct
  source 1..25: note = Seed: LNVIVHSATGFKQSSKALQRPVASD
LNVIVHSATGIKQNSIALQRPVASD

SEQ ID NO: 4605 - protein, 25 aa, synthetic construct
  source 1..25: note = Seed: LNVIVHSATGFKQSSKALQRPVASD
LNVIVHSATGIKQNSIALSRPVASD

SEQ ID NO: 4606 - protein, 25 aa, synthetic construct
  source 1..25: note = Seed: LNVIVHSATGFKQSSKALQRPVASD
LNVIVHSATGIKQNSIALTRPVASD

SEQ ID NO: 4607 - protein, 25 aa, synthetic construct
  source 1..25: note = Seed: LNVIVHSATGFKQSSKALQRPVASD
LNVIVHSATGIKQNSIALVRPVASD

SEQ ID NO: 4608 - protein, 25 aa, synthetic construct
  source 1..25: note = Seed: LNVIVHSATGFKQSSKALQRPVASD
LNVIVHSATGIKQNSIALWRPVASD

SEQ ID NO: 4609 - protein, 25 aa, synthetic construct
  source 1..25: note = Seed: LNVIVHSATGFKQSSKALQRPVASD
LNVIVHSATGIKQNSIALYRPVASD

SEQ ID NO: 4610 - protein, 25 aa, synthetic construct
  source 1..25: note = Seed: LNVIVHSATGFKQSSKALQRPVASD
LNVIVHSATGIKQNSKALFRPVASD

SEQ ID NO: 4611 - protein, 25 aa, synthetic construct
  source 1..25: note = Seed: LNVIVHSATGFKQSSKALQRPVASD
LNVIVHSATGIKQNSKALIRPVASD

SEQ ID NO: 4612 - protein, 25 aa, synthetic construct
  source 1..25: note = Seed: LNVIVHSATGFKQSSKALQRPVASD
LNVIVHSATGIKQNSKALLRPVASD

SEQ ID NO: 4613 - protein, 25 aa, synthetic construct
  source 1..25: note = Seed: LNVIVHSATGFKQSSKALQRPVASD
LNVIVHSATGIKQNSKALVRPVASD

SEQ ID NO: 4614 - protein, 25 aa, synthetic construct
  source 1..25: note = Seed: LNVIVHSATGFKQSSKALQRPVASD
LNVIVHSATGIKQNSLALARPVASD

SEQ ID NO: 4615 - protein, 25 aa, synthetic construct
  source 1..25: note = Seed: LNVIVHSATGFKQSSKALQRPVASD
LNVIVHSATGIKQNSLALFRPVASD

SEQ ID NO: 4616 - protein, 25 aa, synthetic construct
  source 1..25: note = Seed: LNVIVHSATGFKQSSKALQRPVASD
LNVIVHSATGIKQNSLALIRPVASD

SEQ ID NO: 4617 - protein, 25 aa, synthetic construct
  source 1..25: note = Seed: LNVIVHSATGFKQSSKALQRPVASD
LNVIVHSATGIKQNSLALLRPVASD

SEQ ID NO: 4618 - protein, 25 aa, synthetic construct
  source 1..25: note = Seed: LNVIVHSATGFKQSSKALQRPVASD
LNVIVHSATGIKQNSLALMRPVASD

SEQ ID NO: 4619 - protein, 25 aa, synthetic construct
  source 1..25: note = Seed: LNVIVHSATGFKQSSKALQRPVASD
LNVIVHSATGIKQNSLALNRPVASD

SEQ ID NO: 4620 - protein, 25 aa, synthetic construct
  source 1..25: note = Seed: LNVIVHSATGFKQSSKALQRPVASD
LNVIVHSATGIKQNSLALSRPVASD

SEQ ID NO: 4621 - protein, 25 aa, synthetic construct
  source 1..25: note = Seed: LNVIVHSATGFKQSSKALQRPVASD
LNVIVHSATGIKQNSLALTRPVASD

SEQ ID NO: 4622 - protein, 25 aa, synthetic construct
  source 1..25: note = Seed: LNVIVHSATGFKQSSKALQRPVASD
LNVIVHSATGIKQNSLALVRPVASD

SEQ ID NO: 4623 - protein, 25 aa, synthetic construct
  source 1..25: note = Seed: LNVIVHSATGFKQSSKALQRPVASD
LNVIVHSATGIKQNSLALYRPVASD

SEQ ID NO: 4624 - protein, 25 aa, synthetic construct
  source 1..25: note = Seed: LNVIVHSATGFKQSSKALQRPVASD
LNVIVHSATGIKQNSMALARPVASD

SEQ ID NO: 4625 - protein, 25 aa, synthetic construct
  source 1..25: note = Seed: LNVIVHSATGFKQSSKALQRPVASD
LNVIVHSATGIKQNSMALFRPVASD

SEQ ID NO: 4626 - protein, 25 aa, synthetic construct
  source 1..25: note = Seed: LNVIVHSATGFKQSSKALQRPVASD
LNVIVHSATGIKQNSMALIRPVASD

SEQ ID NO: 4627 - protein, 25 aa, synthetic construct
  source 1..25: note = Seed: LNVIVHSATGFKQSSKALQRPVASD
LNVIVHSATGIKQNSMALLRPVASD

SEQ ID NO: 4628 - protein, 25 aa, synthetic construct
  source 1..25: note = Seed: LNVIVHSATGFKQSSKALQRPVASD
LNVIVHSATGIKQNSMALMRPVASD

SEQ ID NO: 4629 - protein, 25 aa, synthetic construct
  source 1..25: note = Seed: LNVIVHSATGFKQSSKALQRPVASD
LNVIVHSATGIKQNSMALNRPVASD

SEQ ID NO: 4630 - protein, 25 aa, synthetic construct
  source 1..25: note = Seed: LNVIVHSATGFKQSSKALQRPVASD
LNVIVHSATGIKQNSMALSRPVASD

SEQ ID NO: 4631 - protein, 25 aa, synthetic construct
  source 1..25: note = Seed: LNVIVHSATGFKQSSKALQRPVASD
LNVIVHSATGIKQNSMALTRPVASD

SEQ ID NO: 4632 - protein, 25 aa, synthetic construct
  source 1..25: note = Seed: LNVIVHSATGFKQSSKALQRPVASD
LNVIVHSATGIKQNSMALVRPVASD

SEQ ID NO: 4633 - protein, 25 aa, synthetic construct
  source 1..25: note = Seed: LNVIVHSATGFKQSSKALQRPVASD
LNVIVHSATGIKQNSMALYRPVASD

SEQ ID NO: 4634 - protein, 25 aa, synthetic construct
  source 1..25: note = Seed: LNVIVHSATGFKQSSKALQRPVASD
LNVIVHSATGIKQNSNALARPVASD

SEQ ID NO: 4635 - protein, 25 aa, synthetic construct
  source 1..25: note = Seed: LNVIVHSATGFKQSSKALQRPVASD
LNVIVHSATGIKQNSNALFRPVASD

SEQ ID NO: 4636 - protein, 25 aa, synthetic construct
  source 1..25: note = Seed: LNVIVHSATGFKQSSKALQRPVASD
LNVIVHSATGIKQNSNALGRPVASD

SEQ ID NO: 4637 - protein, 25 aa, synthetic construct
  source 1..25: note = Seed: LNVIVHSATGFKQSSKALQRPVASD
LNVIVHSATGIKQNSNALHRPVASD

SEQ ID NO: 4638 - protein, 25 aa, synthetic construct
  source 1..25: note = Seed: LNVIVHSATGFKQSSKALQRPVASD
LNVIVHSATGIKQNSNALIRPVASD

SEQ ID NO: 4639 - protein, 25 aa, synthetic construct
  source 1..25: note = Seed: LNVIVHSATGFKQSSKALQRPVASD
LNVIVHSATGIKQNSNALLRPVASD

SEQ ID NO: 4640 - protein, 25 aa, synthetic construct
  source 1..25: note = Seed: LNVIVHSATGFKQSSKALQRPVASD
LNVIVHSATGIKQNSNALMRPVASD

SEQ ID NO: 4641 - protein, 25 aa, synthetic construct
  source 1..25: note = Seed: LNVIVHSATGFKQSSKALQRPVASD
LNVIVHSATGIKQNSNALNRPVASD

SEQ ID NO: 4642 - protein, 25 aa, synthetic construct
  source 1..25: note = Seed: LNVIVHSATGFKQSSKALQRPVASD
LNVIVHSATGIKQNSNALPRPVASD

SEQ ID NO: 4643 - protein, 25 aa, synthetic construct
  source 1..25: note = Seed: LNVIVHSATGFKQSSKALQRPVASD
LNVIVHSATGIKQNSNALQRPVASD

SEQ ID NO: 4644 - protein, 25 aa, synthetic construct
  source 1..25: note = Seed: LNVIVHSATGFKQSSKALQRPVASD
LNVIVHSATGIKQNSNALSRPVASD

SEQ ID NO: 4645 - protein, 25 aa, synthetic construct
  source 1..25: note = Seed: LNVIVHSATGFKQSSKALQRPVASD
LNVIVHSATGIKQNSNALTRPVASD

SEQ ID NO: 4646 - protein, 25 aa, synthetic construct
  source 1..25: note = Seed: LNVIVHSATGFKQSSKALQRPVASD
LNVIVHSATGIKQNSNALVRPVASD

SEQ ID NO: 4647 - protein, 25 aa, synthetic construct
  source 1..25: note = Seed: LNVIVHSATGFKQSSKALQRPVASD
LNVIVHSATGIKQNSNALWRPVASD

SEQ ID NO: 4648 - protein, 25 aa, synthetic construct
  source 1..25: note = Seed: LNVIVHSATGFKQSSKALQRPVASD
LNVIVHSATGIKQNSNALYRPVASD

SEQ ID NO: 4649 - protein, 25 aa, synthetic construct
  source 1..25: note = Seed: LNVIVHSATGFKQSSKALQRPVASD
LNVIVHSATGIKQNSPALARPVASD

SEQ ID NO: 4650 - protein, 25 aa, synthetic construct
  source 1..25: note = Seed: LNVIVHSATGFKQSSKALQRPVASD
LNVIVHSATGIKQNSPALFRPVASD

SEQ ID NO: 4651 - protein, 25 aa, synthetic construct
  source 1..25: note = Seed: LNVIVHSATGFKQSSKALQRPVASD
LNVIVHSATGIKQNSPALIRPVASD

SEQ ID NO: 4652 - protein, 25 aa, synthetic construct
  source 1..25: note = Seed: LNVIVHSATGFKQSSKALQRPVASD
LNVIVHSATGIKQNSPALLRPVASD

SEQ ID NO: 4653 - protein, 25 aa, synthetic construct
  source 1..25: note = Seed: LNVIVHSATGFKQSSKALQRPVASD
LNVIVHSATGIKQNSPALMRPVASD

SEQ ID NO: 4654 - protein, 25 aa, synthetic construct
  source 1..25: note = Seed: LNVIVHSATGFKQSSKALQRPVASD
LNVIVHSATGIKQNSPALNRPVASD

SEQ ID NO: 4655 - protein, 25 aa, synthetic construct
  source 1..25: note = Seed: LNVIVHSATGFKQSSKALQRPVASD
LNVIVHSATGIKQNSPALQRPVASD

SEQ ID NO: 4656 - protein, 25 aa, synthetic construct
  source 1..25: note = Seed: LNVIVHSATGFKQSSKALQRPVASD
LNVIVHSATGIKQNSPALSRPVASD

SEQ ID NO: 4657 - protein, 25 aa, synthetic construct
  source 1..25: note = Seed: LNVIVHSATGFKQSSKALQRPVASD
LNVIVHSATGIKQNSPALTRPVASD

SEQ ID NO: 4658 - protein, 25 aa, synthetic construct
  source 1..25: note = Seed: LNVIVHSATGFKQSSKALQRPVASD
LNVIVHSATGIKQNSPALVRPVASD

SEQ ID NO: 4659 - protein, 25 aa, synthetic construct
  source 1..25: note = Seed: LNVIVHSATGFKQSSKALQRPVASD
LNVIVHSATGIKQNSPALWRPVASD

SEQ ID NO: 4660 - protein, 25 aa, synthetic construct
  source 1..25: note = Seed: LNVIVHSATGFKQSSKALQRPVASD
LNVIVHSATGIKQNSPALYRPVASD

SEQ ID NO: 4661 - protein, 25 aa, synthetic construct
  source 1..25: note = Seed: LNVIVHSATGFKQSSKALQRPVASD
LNVIVHSATGIKQNSQALFRPVASD

SEQ ID NO: 4662 - protein, 25 aa, synthetic construct
  source 1..25: note = Seed: LNVIVHSATGFKQSSKALQRPVASD
LNVIVHSATGIKQNSQALIRPVASD

SEQ ID NO: 4663 - protein, 25 aa, synthetic construct
  source 1..25: note = Seed: LNVIVHSATGFKQSSKALQRPVASD
LNVIVHSATGIKQNSQALLRPVASD

SEQ ID NO: 4664 - protein, 25 aa, synthetic construct
  source 1..25: note = Seed: LNVIVHSATGFKQSSKALQRPVASD
LNVIVHSATGIKQNSQALMRPVASD

SEQ ID NO: 4665 - protein, 25 aa, synthetic construct
  source 1..25: note = Seed: LNVIVHSATGFKQSSKALQRPVASD
LNVIVHSATGIKQNSQALVRPVASD

SEQ ID NO: 4666 - protein, 25 aa, synthetic construct
  source 1..25: note = Seed: LNVIVHSATGFKQSSKALQRPVASD
LNVIVHSATGIKQNSQALYRPVASD

SEQ ID NO: 4667 - protein, 25 aa, synthetic construct
  source 1..25: note = Seed: LNVIVHSATGFKQSSKALQRPVASD
LNVIVHSATGIKQNSRALFRPVASD

SEQ ID NO: 4668 - protein, 25 aa, synthetic construct
  source 1..25: note = Seed: LNVIVHSATGFKQSSKALQRPVASD
LNVIVHSATGIKQNSRALIRPVASD

SEQ ID NO: 4669 - protein, 25 aa, synthetic construct
  source 1..25: note = Seed: LNVIVHSATGFKQSSKALQRPVASD
LNVIVHSATGIKQNSRALRRPVASD

SEQ ID NO: 4670 - protein, 25 aa, synthetic construct
  source 1..25: note = Seed: LNVIVHSATGFKQSSKALQRPVASD
LNVIVHSATGIKQNSRALVRPVASD

SEQ ID NO: 4671 - protein, 25 aa, synthetic construct
  source 1..25: note = Seed: LNVIVHSATGFKQSSKALQRPVASD
LNVIVHSATGIKQNSRALYRPVASD

SEQ ID NO: 4672 - protein, 25 aa, synthetic construct
  source 1..25: note = Seed: LNVIVHSATGFKQSSKALQRPVASD
LNVIVHSATGIKQNSSALARPVASD

SEQ ID NO: 4673 - protein, 25 aa, synthetic construct
  source 1..25: note = Seed: LNVIVHSATGFKQSSKALQRPVASD
LNVIVHSATGIKQNSSALFRPVASD

SEQ ID NO: 4674 - protein, 25 aa, synthetic construct
  source 1..25: note = Seed: LNVIVHSATGFKQSSKALQRPVASD
LNVIVHSATGIKQNSSALGRPVASD

SEQ ID NO: 4675 - protein, 25 aa, synthetic construct
  source 1..25: note = Seed: LNVIVHSATGFKQSSKALQRPVASD
LNVIVHSATGIKQNSSALHRPVASD

SEQ ID NO: 4676 - protein, 25 aa, synthetic construct
  source 1..25: note = Seed: LNVIVHSATGFKQSSKALQRPVASD
LNVIVHSATGIKQNSSALIRPVASD

SEQ ID NO: 4677 - protein, 25 aa, synthetic construct
  source 1..25: note = Seed: LNVIVHSATGFKQSSKALQRPVASD
LNVIVHSATGIKQNSSALLRPVASD

SEQ ID NO: 4678 - protein, 25 aa, synthetic construct
  source 1..25: note = Seed: LNVIVHSATGFKQSSKALQRPVASD
LNVIVHSATGIKQNSSALMRPVASD

SEQ ID NO: 4679 - protein, 25 aa, synthetic construct
  source 1..25: note = Seed: LNVIVHSATGFKQSSKALQRPVASD
LNVIVHSATGIKQNSSALNRPVASD

SEQ ID NO: 4680 - protein, 25 aa, synthetic construct
  source 1..25: note = Seed: LNVIVHSATGFKQSSKALQRPVASD
LNVIVHSATGIKQNSSALQRPVASD

SEQ ID NO: 4681 - protein, 25 aa, synthetic construct
  source 1..25: note = Seed: LNVIVHSATGFKQSSKALQRPVASD
LNVIVHSATGIKQNSSALSRPVASD

SEQ ID NO: 4682 - protein, 25 aa, synthetic construct
  source 1..25: note = Seed: LNVIVHSATGFKQSSKALQRPVASD
LNVIVHSATGIKQNSSALTRPVASD

SEQ ID NO: 4683 - protein, 25 aa, synthetic construct
  source 1..25: note = Seed: LNVIVHSATGFKQSSKALQRPVASD
LNVIVHSATGIKQNSSALVRPVASD

SEQ ID NO: 4684 - protein, 25 aa, synthetic construct
  source 1..25: note = Seed: LNVIVHSATGFKQSSKALQRPVASD
LNVIVHSATGIKQNSSALWRPVASD

SEQ ID NO: 4685 - protein, 25 aa, synthetic construct
  source 1..25: note = Seed: LNVIVHSATGFKQSSKALQRPVASD
LNVIVHSATGIKQNSSALYRPVASD

SEQ ID NO: 4686 - protein, 25 aa, synthetic construct
  source 1..25: note = Seed: LNVIVHSATGFKQSSKALQRPVASD
LNVIVHSATGIKQNSTALARPVASD

SEQ ID NO: 4687 - protein, 25 aa, synthetic construct
  source 1..25: note = Seed: LNVIVHSATGFKQSSKALQRPVASD
LNVIVHSATGIKQNSTALFRPVASD

SEQ ID NO: 4688 - protein, 25 aa, synthetic construct
  source 1..25: note = Seed: LNVIVHSATGFKQSSKALQRPVASD
LNVIVHSATGIKQNSTALIRPVASD

SEQ ID NO: 4689 - protein, 25 aa, synthetic construct
  source 1..25: note = Seed: LNVIVHSATGFKQSSKALQRPVASD
LNVIVHSATGIKQNSTALLRPVASD

SEQ ID NO: 4690 - protein, 25 aa, synthetic construct
  source 1..25: note = Seed: LNVIVHSATGFKQSSKALQRPVASD
LNVIVHSATGIKQNSTALMRPVASD

SEQ ID NO: 4691 - protein, 25 aa, synthetic construct
  source 1..25: note = Seed: LNVIVHSATGFKQSSKALQRPVASD
LNVIVHSATGIKQNSTALSRPVASD

SEQ ID NO: 4692 - protein, 25 aa, synthetic construct
  source 1..25: note = Seed: LNVIVHSATGFKQSSKALQRPVASD
LNVIVHSATGIKQNSTALTRPVASD

SEQ ID NO: 4693 - protein, 25 aa, synthetic construct
  source 1..25: note = Seed: LNVIVHSATGFKQSSKALQRPVASD
LNVIVHSATGIKQNSTALVRPVASD

SEQ ID NO: 4694 - protein, 25 aa, synthetic construct
  source 1..25: note = Seed: LNVIVHSATGFKQSSKALQRPVASD
LNVIVHSATGIKQNSTALWRPVASD

SEQ ID NO: 4695 - protein, 25 aa, synthetic construct
  source 1..25: note = Seed: LNVIVHSATGFKQSSKALQRPVASD
LNVIVHSATGIKQNSTALYRPVASD

SEQ ID NO: 4696 - protein, 25 aa, synthetic construct
  source 1..25: note = Seed: LNVIVHSATGFKQSSKALQRPVASD
LNVIVHSATGIKQNSVALARPVASD

SEQ ID NO: 4697 - protein, 25 aa, synthetic construct
  source 1..25: note = Seed: LNVIVHSATGFKQSSKALQRPVASD
LNVIVHSATGIKQNSVALFRPVASD

SEQ ID NO: 4698 - protein, 25 aa, synthetic construct
  source 1..25: note = Seed: LNVIVHSATGFKQSSKALQRPVASD
LNVIVHSATGIKQNSVALHRPVASD

SEQ ID NO: 4699 - protein, 25 aa, synthetic construct
  source 1..25: note = Seed: LNVIVHSATGFKQSSKALQRPVASD
LNVIVHSATGIKQNSVALIRPVASD

SEQ ID NO: 4700 - protein, 25 aa, synthetic construct
  source 1..25: note = Seed: LNVIVHSATGFKQSSKALQRPVASD
LNVIVHSATGIKQNSVALLRPVASD

SEQ ID NO: 4701 - protein, 25 aa, synthetic construct
  source 1..25: note = Seed: LNVIVHSATGFKQSSKALQRPVASD
LNVIVHSATGIKQNSVALMRPVASD

SEQ ID NO: 4702 - protein, 25 aa, synthetic construct
  source 1..25: note = Seed: LNVIVHSATGFKQSSKALQRPVASD
LNVIVHSATGIKQNSVALNRPVASD

SEQ ID NO: 4703 - protein, 25 aa, synthetic construct
  source 1..25: note = Seed: LNVIVHSATGFKQSSKALQRPVASD
LNVIVHSATGIKQNSVALSRPVASD

SEQ ID NO: 4704 - protein, 25 aa, synthetic construct
  source 1..25: note = Seed: LNVIVHSATGFKQSSKALQRPVASD
LNVIVHSATGIKQNSVALTRPVASD

SEQ ID NO: 4705 - protein, 25 aa, synthetic construct
  source 1..25: note = Seed: LNVIVHSATGFKQSSKALQRPVASD
LNVIVHSATGIKQNSVALVRPVASD

SEQ ID NO: 4706 - protein, 25 aa, synthetic construct
  source 1..25: note = Seed: LNVIVHSATGFKQSSKALQRPVASD
LNVIVHSATGIKQNSVALWRPVASD

SEQ ID NO: 4707 - protein, 25 aa, synthetic construct
  source 1..25: note = Seed: LNVIVHSATGFKQSSKALQRPVASD
LNVIVHSATGIKQNSVALYRPVASD

SEQ ID NO: 4708 - protein, 25 aa, synthetic construct
  source 1..25: note = Seed: LNVIVHSATGFKQSSKALQRPVASD
LNVIVHSATGIKQNSWALIRPVASD

SEQ ID NO: 4709 - protein, 25 aa, synthetic construct
  source 1..25: note = Seed: LNVIVHSATGFKQSSKALQRPVASD
LNVIVHSATGIKQNSWALLRPVASD

SEQ ID NO: 4710 - protein, 25 aa, synthetic construct
  source 1..25: note = Seed: LNVIVHSATGFKQSSKALQRPVASD
LNVIVHSATGIKQNSWALVRPVASD

SEQ ID NO: 4711 - protein, 25 aa, synthetic construct
  source 1..25: note = Seed: LNVIVHSATGFKQSSKALQRPVASD
LNVIVHSATGIKQNSYALFRPVASD

SEQ ID NO: 4712 - protein, 25 aa, synthetic construct
  source 1..25: note = Seed: LNVIVHSATGFKQSSKALQRPVASD
LNVIVHSATGIKQNSYALIRPVASD

SEQ ID NO: 4713 - protein, 25 aa, synthetic construct
  source 1..25: note = Seed: LNVIVHSATGFKQSSKALQRPVASD
LNVIVHSATGIKQNSYALLRPVASD

SEQ ID NO: 4714 - protein, 25 aa, synthetic construct
  source 1..25: note = Seed: LNVIVHSATGFKQSSKALQRPVASD
LNVIVHSATGIKQNSYALMRPVASD

SEQ ID NO: 4715 - protein, 25 aa, synthetic construct
  source 1..25: note = Seed: LNVIVHSATGFKQSSKALQRPVASD
LNVIVHSATGIKQNSYALVRPVASD

SEQ ID NO: 4716 - protein, 25 aa, synthetic construct
  source 1..25: note = Seed: LNVIVHSATGFKQSSKALQRPVASD
LNVIVHSATGIKQNSYALYRPVASD

SEQ ID NO: 4717 - protein, 25 aa, synthetic construct
  source 1..25: note = Seed: LNVIVHSATGFKQSSKALQRPVASD
LNVIVHSATGIKQQSAALARPVASD

SEQ ID NO: 4718 - protein, 25 aa, synthetic construct
  source 1..25: note = Seed: LNVIVHSATGFKQSSKALQRPVASD
LNVIVHSATGIKQQSAALCRPVASD

SEQ ID NO: 4719 - protein, 25 aa, synthetic construct
  source 1..25: note = Seed: LNVIVHSATGFKQSSKALQRPVASD
LNVIVHSATGIKQQSAALGRPVASD

SEQ ID NO: 4720 - protein, 25 aa, synthetic construct
  source 1..25: note = Seed: LNVIVHSATGFKQSSKALQRPVASD
LNVIVHSATGIKQQSAALIRPVASD

SEQ ID NO: 4721 - protein, 25 aa, synthetic construct
  source 1..25: note = Seed: LNVIVHSATGFKQSSKALQRPVASD
LNVIVHSATGIKQQSAALLRPVASD

SEQ ID NO: 4722 - protein, 25 aa, synthetic construct
  source 1..25: note = Seed: LNVIVHSATGFKQSSKALQRPVASD
LNVIVHSATGIKQQSAALMRPVASD

SEQ ID NO: 4723 - protein, 25 aa, synthetic construct
  source 1..25: note = Seed: LNVIVHSATGFKQSSKALQRPVASD
LNVIVHSATGIKQQSAALNRPVASD

SEQ ID NO: 4724 - protein, 25 aa, synthetic construct
  source 1..25: note = Seed: LNVIVHSATGFKQSSKALQRPVASD
LNVIVHSATGIKQQSAALSRPVASD

SEQ ID NO: 4725 - protein, 25 aa, synthetic construct
  source 1..25: note = Seed: LNVIVHSATGFKQSSKALQRPVASD
LNVIVHSATGIKQQSAALTRPVASD

SEQ ID NO: 4726 - protein, 25 aa, synthetic construct
  source 1..25: note = Seed: LNVIVHSATGFKQSSKALQRPVASD
LNVIVHSATGIKQQSAALVRPVASD

SEQ ID NO: 4727 - protein, 25 aa, synthetic construct
  source 1..25: note = Seed: LNVIVHSATGFKQSSKALQRPVASD
LNVIVHSATGIKQQSGALARPVASD

SEQ ID NO: 4728 - protein, 25 aa, synthetic construct
  source 1..25: note = Seed: LNVIVHSATGFKQSSKALQRPVASD
LNVIVHSATGIKQQSGALIRPVASD

SEQ ID NO: 4729 - protein, 25 aa, synthetic construct
  source 1..25: note = Seed: LNVIVHSATGFKQSSKALQRPVASD
LNVIVHSATGIKQQSGALLRPVASD

SEQ ID NO: 4730 - protein, 25 aa, synthetic construct
  source 1..25: note = Seed: LNVIVHSATGFKQSSKALQRPVASD
LNVIVHSATGIKQQSGALMRPVASD

SEQ ID NO: 4731 - protein, 25 aa, synthetic construct
  source 1..25: note = Seed: LNVIVHSATGFKQSSKALQRPVASD
LNVIVHSATGIKQQSGALSRPVASD

SEQ ID NO: 4732 - protein, 25 aa, synthetic construct
  source 1..25: note = Seed: LNVIVHSATGFKQSSKALQRPVASD
LNVIVHSATGIKQQSGALTRPVASD

SEQ ID NO: 4733 - protein, 25 aa, synthetic construct
  source 1..25: note = Seed: LNVIVHSATGFKQSSKALQRPVASD
LNVIVHSATGIKQQSGALVRPVASD

SEQ ID NO: 4734 - protein, 25 aa, synthetic construct
  source 1..25: note = Seed: LNVIVHSATGFKQSSKALQRPVASD
LNVIVHSATGIKQQSIALARPVASD

SEQ ID NO: 4735 - protein, 25 aa, synthetic construct
  source 1..25: note = Seed: LNVIVHSATGFKQSSKALQRPVASD
LNVIVHSATGIKQQSIALIRPVASD

SEQ ID NO: 4736 - protein, 25 aa, synthetic construct
  source 1..25: note = Seed: LNVIVHSATGFKQSSKALQRPVASD
LNVIVHSATGIKQQSIALNRPVASD

SEQ ID NO: 4737 - protein, 25 aa, synthetic construct
  source 1..25: note = Seed: LNVIVHSATGFKQSSKALQRPVASD
LNVIVHSATGIKQQSIALSRPVASD

SEQ ID NO: 4738 - protein, 25 aa, synthetic construct
  source 1..25: note = Seed: LNVIVHSATGFKQSSKALQRPVASD
LNVIVHSATGIKQQSIALVRPVASD

SEQ ID NO: 4739 - protein, 25 aa, synthetic construct
  source 1..25: note = Seed: LNVIVHSATGFKQSSKALQRPVASD
LNVIVHSATGIKQQSKALARPVASD

SEQ ID NO: 4740 - protein, 25 aa, synthetic construct
  source 1..25: note = Seed: LNVIVHSATGFKQSSKALQRPVASD
LNVIVHSATGIKQQSKALFRPVASD

SEQ ID NO: 4741 - protein, 25 aa, synthetic construct
  source 1..25: note = Seed: LNVIVHSATGFKQSSKALQRPVASD
LNVIVHSATGIKQQSKALHRPVASD

SEQ ID NO: 4742 - protein, 25 aa, synthetic construct
  source 1..25: note = Seed: LNVIVHSATGFKQSSKALQRPVASD
LNVIVHSATGIKQQSKALQRPVASD

SEQ ID NO: 4743 - protein, 25 aa, synthetic construct
  source 1..25: note = Seed: LNVIVHSATGFKQSSKALQRPVASD
LNVIVHSATGIKQQSKALRRPVASD

SEQ ID NO: 4744 - protein, 25 aa, synthetic construct
  source 1..25: note = Seed: LNVIVHSATGFKQSSKALQRPVASD
LNVIVHSATGIKQQSKALSRPVASD

SEQ ID NO: 4745 - protein, 25 aa, synthetic construct
  source 1..25: note = Seed: LNVIVHSATGFKQSSKALQRPVASD
LNVIVHSATGIKQQSKALVRPVASD

SEQ ID NO: 4746 - protein, 25 aa, synthetic construct
  source 1..25: note = Seed: LNVIVHSATGFKQSSKALQRPVASD
LNVIVHSATGIKQQSKALYRPVASD

SEQ ID NO: 4747 - protein, 25 aa, synthetic construct
  source 1..25: note = Seed: LNVIVHSATGFKQSSKALQRPVASD
LNVIVHSATGIKQQSLALARPVASD

SEQ ID NO: 4748 - protein, 25 aa, synthetic construct
  source 1..25: note = Seed: LNVIVHSATGFKQSSKALQRPVASD
LNVIVHSATGIKQQSLALVRPVASD

SEQ ID NO: 4749 - protein, 25 aa, synthetic construct
  source 1..25: note = Seed: LNVIVHSATGFKQSSKALQRPVASD
LNVIVHSATGIKQQSMALARPVASD

SEQ ID NO: 4750 - protein, 25 aa, synthetic construct
  source 1..25: note = Seed: LNVIVHSATGFKQSSKALQRPVASD
LNVIVHSATGIKQQSNALARPVASD

SEQ ID NO: 4751 - protein, 25 aa, synthetic construct
  source 1..25: note = Seed: LNVIVHSATGFKQSSKALQRPVASD
LNVIVHSATGIKQQSNALIRPVASD

SEQ ID NO: 4752 - protein, 25 aa, synthetic construct
  source 1..25: note = Seed: LNVIVHSATGFKQSSKALQRPVASD
LNVIVHSATGIKQQSNALLRPVASD

SEQ ID NO: 4753 - protein, 25 aa, synthetic construct
  source 1..25: note = Seed: LNVIVHSATGFKQSSKALQRPVASD
LNVIVHSATGIKQQSNALVRPVASD

SEQ ID NO: 4754 - protein, 25 aa, synthetic construct
  source 1..25: note = Seed: LNVIVHSATGFKQSSKALQRPVASD
LNVIVHSATGIKQQSPALARPVASD

SEQ ID NO: 4755 - protein, 25 aa, synthetic construct
  source 1..25: note = Seed: LNVIVHSATGFKQSSKALQRPVASD
LNVIVHSATGIKQQSPALIRPVASD

SEQ ID NO: 4756 - protein, 25 aa, synthetic construct
  source 1..25: note = Seed: LNVIVHSATGFKQSSKALQRPVASD
LNVIVHSATGIKQQSPALLRPVASD

SEQ ID NO: 4757 - protein, 25 aa, synthetic construct
  source 1..25: note = Seed: LNVIVHSATGFKQSSKALQRPVASD
LNVIVHSATGIKQQSPALMRPVASD

SEQ ID NO: 4758 - protein, 25 aa, synthetic construct
  source 1..25: note = Seed: LNVIVHSATGFKQSSKALQRPVASD
LNVIVHSATGIKQQSPALSRPVASD

SEQ ID NO: 4759 - protein, 25 aa, synthetic construct
  source 1..25: note = Seed: LNVIVHSATGFKQSSKALQRPVASD
LNVIVHSATGIKQQSPALTRPVASD

SEQ ID NO: 4760 - protein, 25 aa, synthetic construct
  source 1..25: note = Seed: LNVIVHSATGFKQSSKALQRPVASD
LNVIVHSATGIKQQSPALVRPVASD

SEQ ID NO: 4761 - protein, 25 aa, synthetic construct
  source 1..25: note = Seed: LNVIVHSATGFKQSSKALQRPVASD
LNVIVHSATGIKQQSRALARPVASD

SEQ ID NO: 4762 - protein, 25 aa, synthetic construct
  source 1..25: note = Seed: LNVIVHSATGFKQSSKALQRPVASD
LNVIVHSATGIKQQSRALFRPVASD

SEQ ID NO: 4763 - protein, 25 aa, synthetic construct
  source 1..25: note = Seed: LNVIVHSATGFKQSSKALQRPVASD
LNVIVHSATGIKQQSRALGRPVASD

SEQ ID NO: 4764 - protein, 25 aa, synthetic construct
  source 1..25: note = Seed: LNVIVHSATGFKQSSKALQRPVASD
LNVIVHSATGIKQQSRALHRPVASD

SEQ ID NO: 4765 - protein, 25 aa, synthetic construct
  source 1..25: note = Seed: LNVIVHSATGFKQSSKALQRPVASD
LNVIVHSATGIKQQSRALIRPVASD

SEQ ID NO: 4766 - protein, 25 aa, synthetic construct
  source 1..25: note = Seed: LNVIVHSATGFKQSSKALQRPVASD
LNVIVHSATGIKQQSRALKRPVASD

SEQ ID NO: 4767 - protein, 25 aa, synthetic construct
  source 1..25: note = Seed: LNVIVHSATGFKQSSKALQRPVASD
LNVIVHSATGIKQQSRALLRPVASD

SEQ ID NO: 4768 - protein, 25 aa, synthetic construct
  source 1..25: note = Seed: LNVIVHSATGFKQSSKALQRPVASD
LNVIVHSATGIKQQSRALMRPVASD

SEQ ID NO: 4769 - protein, 25 aa, synthetic construct
  source 1..25: note = Seed: LNVIVHSATGFKQSSKALQRPVASD
LNVIVHSATGIKQQSRALQRPVASD

SEQ ID NO: 4770 - protein, 25 aa, synthetic construct
  source 1..25: note = Seed: LNVIVHSATGFKQSSKALQRPVASD
LNVIVHSATGIKQQSRALRRPVASD

SEQ ID NO: 4771 - protein, 25 aa, synthetic construct
  source 1..25: note = Seed: LNVIVHSATGFKQSSKALQRPVASD
LNVIVHSATGIKQQSRALSRPVASD

SEQ ID NO: 4772 - protein, 25 aa, synthetic construct
  source 1..25: note = Seed: LNVIVHSATGFKQSSKALQRPVASD
LNVIVHSATGIKQQSRALTRPVASD

SEQ ID NO: 4773 - protein, 25 aa, synthetic construct
  source 1..25: note = Seed: LNVIVHSATGFKQSSKALQRPVASD
LNVIVHSATGIKQQSRALVRPVASD

SEQ ID NO: 4774 - protein, 25 aa, synthetic construct
  source 1..25: note = Seed: LNVIVHSATGFKQSSKALQRPVASD
LNVIVHSATGIKQQSRALYRPVASD

SEQ ID NO: 4775 - protein, 25 aa, synthetic construct
  source 1..25: note = Seed: LNVIVHSATGFKQSSKALQRPVASD
LNVIVHSATGIKQQSSALARPVASD

SEQ ID NO: 4776 - protein, 25 aa, synthetic construct
  source 1..25: note = Seed: LNVIVHSATGFKQSSKALQRPVASD
LNVIVHSATGIKQQSSALIRPVASD

SEQ ID NO: 4777 - protein, 25 aa, synthetic construct
  source 1..25: note = Seed: LNVIVHSATGFKQSSKALQRPVASD
LNVIVHSATGIKQQSSALLRPVASD

SEQ ID NO: 4778 - protein, 25 aa, synthetic construct
  source 1..25: note = Seed: LNVIVHSATGFKQSSKALQRPVASD
LNVIVHSATGIKQQSSALMRPVASD

SEQ ID NO: 4779 - protein, 25 aa, synthetic construct
  source 1..25: note = Seed: LNVIVHSATGFKQSSKALQRPVASD
LNVIVHSATGIKQQSSALSRPVASD

SEQ ID NO: 4780 - protein, 25 aa, synthetic construct
  source 1..25: note = Seed: LNVIVHSATGFKQSSKALQRPVASD
LNVIVHSATGIKQQSSALTRPVASD

SEQ ID NO: 4781 - protein, 25 aa, synthetic construct
  source 1..25: note = Seed: LNVIVHSATGFKQSSKALQRPVASD
LNVIVHSATGIKQQSSALVRPVASD

SEQ ID NO: 4782 - protein, 25 aa, synthetic construct
  source 1..25: note = Seed: LNVIVHSATGFKQSSKALQRPVASD
LNVIVHSATGIKQQSTALARPVASD

SEQ ID NO: 4783 - protein, 25 aa, synthetic construct
  source 1..25: note = Seed: LNVIVHSATGFKQSSKALQRPVASD
LNVIVHSATGIKQQSTALIRPVASD

SEQ ID NO: 4784 - protein, 25 aa, synthetic construct
  source 1..25: note = Seed: LNVIVHSATGFKQSSKALQRPVASD
LNVIVHSATGIKQQSTALLRPVASD

SEQ ID NO: 4785 - protein, 25 aa, synthetic construct
  source 1..25: note = Seed: LNVIVHSATGFKQSSKALQRPVASD
LNVIVHSATGIKQQSTALVRPVASD

SEQ ID NO: 4786 - protein, 25 aa, synthetic construct
  source 1..25: note = Seed: LNVIVHSATGFKQSSKALQRPVASD
LNVIVHSATGIKQQSVALARPVASD

SEQ ID NO: 4787 - protein, 25 aa, synthetic construct
  source 1..25: note = Seed: LNVIVHSATGFKQSSKALQRPVASD
LNVIVHSATGIKQQSVALIRPVASD

SEQ ID NO: 4788 - protein, 25 aa, synthetic construct
  source 1..25: note = Seed: LNVIVHSATGFKQSSKALQRPVASD
LNVIVHSATGIKQQSVALLRPVASD

SEQ ID NO: 4789 - protein, 25 aa, synthetic construct
  source 1..25: note = Seed: LNVIVHSATGFKQSSKALQRPVASD
LNVIVHSATGIKQQSVALMRPVASD

SEQ ID NO: 4790 - protein, 25 aa, synthetic construct
  source 1..25: note = Seed: LNVIVHSATGFKQSSKALQRPVASD
LNVIVHSATGIKQQSVALSRPVASD

SEQ ID NO: 4791 - protein, 25 aa, synthetic construct
  source 1..25: note = Seed: LNVIVHSATGFKQSSKALQRPVASD
LNVIVHSATGIKQRSAALRRPVASD

SEQ ID NO: 4792 - protein, 25 aa, synthetic construct
  source 1..25: note = Seed: LNVIVHSATGFKQSSKALQRPVASD
LNVIVHSATGIKQRSAALYRPVASD

SEQ ID NO: 4793 - protein, 25 aa, synthetic construct
  source 1..25: note = Seed: LNVIVHSATGFKQSSKALQRPVASD
LNVIVHSATGIKQRSIALRRPVASD

SEQ ID NO: 4794 - protein, 25 aa, synthetic construct
  source 1..25: note = Seed: LNVIVHSATGFKQSSKALQRPVASD
LNVIVHSATGIKQRSKALARPVASD

SEQ ID NO: 4795 - protein, 25 aa, synthetic construct
  source 1..25: note = Seed: LNVIVHSATGFKQSSKALQRPVASD
LNVIVHSATGIKQRSKALFRPVASD

SEQ ID NO: 4796 - protein, 25 aa, synthetic construct
  source 1..25: note = Seed: LNVIVHSATGFKQSSKALQRPVASD
LNVIVHSATGIKQRSKALIRPVASD

SEQ ID NO: 4797 - protein, 25 aa, synthetic construct
  source 1..25: note = Seed: LNVIVHSATGFKQSSKALQRPVASD
LNVIVHSATGIKQRSKALLRPVASD

SEQ ID NO: 4798 - protein, 25 aa, synthetic construct
  source 1..25: note = Seed: LNVIVHSATGFKQSSKALQRPVASD
LNVIVHSATGIKQRSKALMRPVASD

SEQ ID NO: 4799 - protein, 25 aa, synthetic construct
  source 1..25: note = Seed: LNVIVHSATGFKQSSKALQRPVASD
LNVIVHSATGIKQRSKALRRPVASD

SEQ ID NO: 4800 - protein, 25 aa, synthetic construct
  source 1..25: note = Seed: LNVIVHSATGFKQSSKALQRPVASD
LNVIVHSATGIKQRSKALSRPVASD

SEQ ID NO: 4801 - protein, 25 aa, synthetic construct
  source 1..25: note = Seed: LNVIVHSATGFKQSSKALQRPVASD
LNVIVHSATGIKQRSKALVRPVASD

SEQ ID NO: 4802 - protein, 25 aa, synthetic construct
  source 1..25: note = Seed: LNVIVHSATGFKQSSKALQRPVASD
LNVIVHSATGIKQRSKALYRPVASD

SEQ ID NO: 4803 - protein, 25 aa, synthetic construct
  source 1..25: note = Seed: LNVIVHSATGFKQSSKALQRPVASD
LNVIVHSATGIKQRSLALRRPVASD

SEQ ID NO: 4804 - protein, 25 aa, synthetic construct
  source 1..25: note = Seed: LNVIVHSATGFKQSSKALQRPVASD
LNVIVHSATGIKQRSNALYRPVASD

SEQ ID NO: 4805 - protein, 25 aa, synthetic construct
  source 1..25: note = Seed: LNVIVHSATGFKQSSKALQRPVASD
LNVIVHSATGIKQRSRALARPVASD

SEQ ID NO: 4806 - protein, 25 aa, synthetic construct
  source 1..25: note = Seed: LNVIVHSATGFKQSSKALQRPVASD
LNVIVHSATGIKQRSRALFRPVASD

SEQ ID NO: 4807 - protein, 25 aa, synthetic construct
  source 1..25: note = Seed: LNVIVHSATGFKQSSKALQRPVASD
LNVIVHSATGIKQRSRALGRPVASD

SEQ ID NO: 4808 - protein, 25 aa, synthetic construct
  source 1..25: note = Seed: LNVIVHSATGFKQSSKALQRPVASD
LNVIVHSATGIKQRSRALHRPVASD

SEQ ID NO: 4809 - protein, 25 aa, synthetic construct
  source 1..25: note = Seed: LNVIVHSATGFKQSSKALQRPVASD
LNVIVHSATGIKQRSRALIRPVASD

SEQ ID NO: 4810 - protein, 25 aa, synthetic construct
  source 1..25: note = Seed: LNVIVHSATGFKQSSKALQRPVASD
LNVIVHSATGIKQRSRALKRPVASD

SEQ ID NO: 4811 - protein, 25 aa, synthetic construct
  source 1..25: note = Seed: LNVIVHSATGFKQSSKALQRPVASD
LNVIVHSATGIKQRSRALLRPVASD

SEQ ID NO: 4812 - protein, 25 aa, synthetic construct
  source 1..25: note = Seed: LNVIVHSATGFKQSSKALQRPVASD
LNVIVHSATGIKQRSRALMRPVASD

SEQ ID NO: 4813 - protein, 25 aa, synthetic construct
  source 1..25: note = Seed: LNVIVHSATGFKQSSKALQRPVASD
LNVIVHSATGIKQRSRALQRPVASD

SEQ ID NO: 4814 - protein, 25 aa, synthetic construct
  source 1..25: note = Seed: LNVIVHSATGFKQSSKALQRPVASD
LNVIVHSATGIKQRSRALRRPVASD

SEQ ID NO: 4815 - protein, 25 aa, synthetic construct
  source 1..25: note = Seed: LNVIVHSATGFKQSSKALQRPVASD
LNVIVHSATGIKQRSRALSRPVASD

SEQ ID NO: 4816 - protein, 25 aa, synthetic construct
  source 1..25: note = Seed: LNVIVHSATGFKQSSKALQRPVASD
LNVIVHSATGIKQRSRALTRPVASD

SEQ ID NO: 4817 - protein, 25 aa, synthetic construct
  source 1..25: note = Seed: LNVIVHSATGFKQSSKALQRPVASD
LNVIVHSATGIKQRSRALVRPVASD

SEQ ID NO: 4818 - protein, 25 aa, synthetic construct
  source 1..25: note = Seed: LNVIVHSATGFKQSSKALQRPVASD
LNVIVHSATGIKQRSRALWRPVASD

SEQ ID NO: 4819 - protein, 25 aa, synthetic construct
  source 1..25: note = Seed: LNVIVHSATGFKQSSKALQRPVASD
LNVIVHSATGIKQRSRALYRPVASD

SEQ ID NO: 4820 - protein, 25 aa, synthetic construct
  source 1..25: note = Seed: LNVIVHSATGFKQSSKALQRPVASD
LNVIVHSATGIKQRSSALRRPVASD

SEQ ID NO: 4821 - protein, 25 aa, synthetic construct
  source 1..25: note = Seed: LNVIVHSATGFKQSSKALQRPVASD
LNVIVHSATGIKQRSSALYRPVASD

SEQ ID NO: 4822 - protein, 25 aa, synthetic construct
  source 1..25: note = Seed: LNVIVHSATGFKQSSKALQRPVASD
LNVIVHSATGIKQRSTALRRPVASD

SEQ ID NO: 4823 - protein, 25 aa, synthetic construct
  source 1..25: note = Seed: LNVIVHSATGFKQSSKALQRPVASD
LNVIVHSATGIKQRSTALYRPVASD

SEQ ID NO: 4824 - protein, 25 aa, synthetic construct
  source 1..25: note = Seed: LNVIVHSATGFKQSSKALQRPVASD
LNVIVHSATGIKQRSVALRRPVASD

SEQ ID NO: 4825 - protein, 25 aa, synthetic construct
  source 1..25: note = Seed: LNVIVHSATGFKQSSKALQRPVASD
LNVIVHSATGIKQSSAALARPVASD

SEQ ID NO: 4826 - protein, 25 aa, synthetic construct
  source 1..25: note = Seed: LNVIVHSATGFKQSSKALQRPVASD
LNVIVHSATGIKQSSAALFRPVASD

SEQ ID NO: 4827 - protein, 25 aa, synthetic construct
  source 1..25: note = Seed: LNVIVHSATGFKQSSKALQRPVASD
LNVIVHSATGIKQSSAALIRPVASD

SEQ ID NO: 4828 - protein, 25 aa, synthetic construct
  source 1..25: note = Seed: LNVIVHSATGFKQSSKALQRPVASD
LNVIVHSATGIKQSSAALLRPVASD

SEQ ID NO: 4829 - protein, 25 aa, synthetic construct
  source 1..25: note = Seed: LNVIVHSATGFKQSSKALQRPVASD
LNVIVHSATGIKQSSAALMRPVASD

SEQ ID NO: 4830 - protein, 25 aa, synthetic construct
  source 1..25: note = Seed: LNVIVHSATGFKQSSKALQRPVASD
LNVIVHSATGIKQSSAALRRPVASD

SEQ ID NO: 4831 - protein, 25 aa, synthetic construct
  source 1..25: note = Seed: LNVIVHSATGFKQSSKALQRPVASD
LNVIVHSATGIKQSSAALSRPVASD

SEQ ID NO: 4832 - protein, 25 aa, synthetic construct
  source 1..25: note = Seed: LNVIVHSATGFKQSSKALQRPVASD
LNVIVHSATGIKQSSAALTRPVASD

SEQ ID NO: 4833 - protein, 25 aa, synthetic construct
  source 1..25: note = Seed: LNVIVHSATGFKQSSKALQRPVASD
LNVIVHSATGIKQSSAALVRPVASD

SEQ ID NO: 4834 - protein, 25 aa, synthetic construct
  source 1..25: note = Seed: LNVIVHSATGFKQSSKALQRPVASD
LNVIVHSATGIKQSSAALYRPVASD

SEQ ID NO: 4835 - protein, 25 aa, synthetic construct
  source 1..25: note = Seed: LNVIVHSATGFKQSSKALQRPVASD
LNVIVHSATGIKQSSFALIRPVASD

SEQ ID NO: 4836 - protein, 25 aa, synthetic construct
  source 1..25: note = Seed: LNVIVHSATGFKQSSKALQRPVASD
LNVIVHSATGIKQSSFALLRPVASD

SEQ ID NO: 4837 - protein, 25 aa, synthetic construct
  source 1..25: note = Seed: LNVIVHSATGFKQSSKALQRPVASD
LNVIVHSATGIKQSSFALVRPVASD

SEQ ID NO: 4838 - protein, 25 aa, synthetic construct
  source 1..25: note = Seed: LNVIVHSATGFKQSSKALQRPVASD
LNVIVHSATGIKQSSGALARPVASD

SEQ ID NO: 4839 - protein, 25 aa, synthetic construct
  source 1..25: note = Seed: LNVIVHSATGFKQSSKALQRPVASD
LNVIVHSATGIKQSSGALFRPVASD

SEQ ID NO: 4840 - protein, 25 aa, synthetic construct
  source 1..25: note = Seed: LNVIVHSATGFKQSSKALQRPVASD
LNVIVHSATGIKQSSGALIRPVASD

SEQ ID NO: 4841 - protein, 25 aa, synthetic construct
  source 1..25: note = Seed: LNVIVHSATGFKQSSKALQRPVASD
LNVIVHSATGIKQSSGALLRPVASD

SEQ ID NO: 4842 - protein, 25 aa, synthetic construct
  source 1..25: note = Seed: LNVIVHSATGFKQSSKALQRPVASD
LNVIVHSATGIKQSSGALVRPVASD

SEQ ID NO: 4843 - protein, 25 aa, synthetic construct
  source 1..25: note = Seed: LNVIVHSATGFKQSSKALQRPVASD
LNVIVHSATGIKQSSIALARPVASD

SEQ ID NO: 4844 - protein, 25 aa, synthetic construct
  source 1..25: note = Seed: LNVIVHSATGFKQSSKALQRPVASD
LNVIVHSATGIKQSSIALIRPVASD

SEQ ID NO: 4845 - protein, 25 aa, synthetic construct
  source 1..25: note = Seed: LNVIVHSATGFKQSSKALQRPVASD
LNVIVHSATGIKQSSIALVRPVASD

SEQ ID NO: 4846 - protein, 25 aa, synthetic construct
  source 1..25: note = Seed: LNVIVHSATGFKQSSKALQRPVASD
LNVIVHSATGIKQSSKALARPVASD

SEQ ID NO: 4847 - protein, 25 aa, synthetic construct
  source 1..25: note = Seed: LNVIVHSATGFKQSSKALQRPVASD
LNVIVHSATGIKQSSKALRRPVASD

SEQ ID NO: 4848 - protein, 25 aa, synthetic construct
  source 1..25: note = Seed: LNVIVHSATGFKQSSKALQRPVASD
LNVIVHSATGIKQSSKALSRPVASD

SEQ ID NO: 4849 - protein, 25 aa, synthetic construct
  source 1..25: note = Seed: LNVIVHSATGFKQSSKALQRPVASD
LNVIVHSATGIKQSSKALYRPVASD

SEQ ID NO: 4850 - protein, 25 aa, synthetic construct
  source 1..25: note = Seed: LNVIVHSATGFKQSSKALQRPVASD
LNVIVHSATGIKQSSNALFRPVASD

SEQ ID NO: 4851 - protein, 25 aa, synthetic construct
  source 1..25: note = Seed: LNVIVHSATGFKQSSKALQRPVASD
LNVIVHSATGIKQSSNALIRPVASD

SEQ ID NO: 4852 - protein, 25 aa, synthetic construct
  source 1..25: note = Seed: LNVIVHSATGFKQSSKALQRPVASD
LNVIVHSATGIKQSSNALLRPVASD

SEQ ID NO: 4853 - protein, 25 aa, synthetic construct
  source 1..25: note = Seed: LNVIVHSATGFKQSSKALQRPVASD
LNVIVHSATGIKQSSNALMRPVASD

SEQ ID NO: 4854 - protein, 25 aa, synthetic construct
  source 1..25: note = Seed: LNVIVHSATGFKQSSKALQRPVASD
LNVIVHSATGIKQSSNALVRPVASD

SEQ ID NO: 4855 - protein, 25 aa, synthetic construct
  source 1..25: note = Seed: LNVIVHSATGFKQSSKALQRPVASD
LNVIVHSATGIKQSSNALYRPVASD

SEQ ID NO: 4856 - protein, 25 aa, synthetic construct
  source 1..25: note = Seed: LNVIVHSATGFKQSSKALQRPVASD
LNVIVHSATGIKQSSPALARPVASD

SEQ ID NO: 4857 - protein, 25 aa, synthetic construct
  source 1..25: note = Seed: LNVIVHSATGFKQSSKALQRPVASD
LNVIVHSATGIKQSSPALFRPVASD

SEQ ID NO: 4858 - protein, 25 aa, synthetic construct
  source 1..25: note = Seed: LNVIVHSATGFKQSSKALQRPVASD
LNVIVHSATGIKQSSPALIRPVASD

SEQ ID NO: 4859 - protein, 25 aa, synthetic construct
  source 1..25: note = Seed: LNVIVHSATGFKQSSKALQRPVASD
LNVIVHSATGIKQSSPALLRPVASD

SEQ ID NO: 4860 - protein, 25 aa, synthetic construct
  source 1..25: note = Seed: LNVIVHSATGFKQSSKALQRPVASD
LNVIVHSATGIKQSSPALVRPVASD

SEQ ID NO: 4861 - protein, 25 aa, synthetic construct
  source 1..25: note = Seed: LNVIVHSATGFKQSSKALQRPVASD
LNVIVHSATGIKQSSPALYRPVASD

SEQ ID NO: 4862 - protein, 25 aa, synthetic construct
  source 1..25: note = Seed: LNVIVHSATGFKQSSKALQRPVASD
LNVIVHSATGIKQSSRALARPVASD

SEQ ID NO: 4863 - protein, 25 aa, synthetic construct
  source 1..25: note = Seed: LNVIVHSATGFKQSSKALQRPVASD
LNVIVHSATGIKQSSRALFRPVASD

SEQ ID NO: 4864 - protein, 25 aa, synthetic construct
  source 1..25: note = Seed: LNVIVHSATGFKQSSKALQRPVASD
LNVIVHSATGIKQSSRALGRPVASD

SEQ ID NO: 4865 - protein, 25 aa, synthetic construct
  source 1..25: note = Seed: LNVIVHSATGFKQSSKALQRPVASD
LNVIVHSATGIKQSSRALHRPVASD

SEQ ID NO: 4866 - protein, 25 aa, synthetic construct
  source 1..25: note = Seed: LNVIVHSATGFKQSSKALQRPVASD
LNVIVHSATGIKQSSRALKRPVASD

SEQ ID NO: 4867 - protein, 25 aa, synthetic construct
  source 1..25: note = Seed: LNVIVHSATGFKQSSKALQRPVASD
LNVIVHSATGIKQSSRALMRPVASD

SEQ ID NO: 4868 - protein, 25 aa, synthetic construct
  source 1..25: note = Seed: LNVIVHSATGFKQSSKALQRPVASD
LNVIVHSATGIKQSSRALQRPVASD

SEQ ID NO: 4869 - protein, 25 aa, synthetic construct
  source 1..25: note = Seed: LNVIVHSATGFKQSSKALQRPVASD
LNVIVHSATGIKQSSRALRRPVASD

SEQ ID NO: 4870 - protein, 25 aa, synthetic construct
  source 1..25: note = Seed: LNVIVHSATGFKQSSKALQRPVASD
LNVIVHSATGIKQSSRALSRPVASD

SEQ ID NO: 4871 - protein, 25 aa, synthetic construct
  source 1..25: note = Seed: LNVIVHSATGFKQSSKALQRPVASD
LNVIVHSATGIKQSSRALTRPVASD

SEQ ID NO: 4872 - protein, 25 aa, synthetic construct
  source 1..25: note = Seed: LNVIVHSATGFKQSSKALQRPVASD
LNVIVHSATGIKQSSRALVRPVASD

SEQ ID NO: 4873 - protein, 25 aa, synthetic construct
  source 1..25: note = Seed: LNVIVHSATGFKQSSKALQRPVASD
LNVIVHSATGIKQSSRALYRPVASD

SEQ ID NO: 4874 - protein, 25 aa, synthetic construct
  source 1..25: note = Seed: LNVIVHSATGFKQSSKALQRPVASD
LNVIVHSATGIKQSSSALARPVASD

SEQ ID NO: 4875 - protein, 25 aa, synthetic construct
  source 1..25: note = Seed: LNVIVHSATGFKQSSKALQRPVASD
LNVIVHSATGIKQSSSALFRPVASD

SEQ ID NO: 4876 - protein, 25 aa, synthetic construct
  source 1..25: note = Seed: LNVIVHSATGFKQSSKALQRPVASD
LNVIVHSATGIKQSSSALIRPVASD

SEQ ID NO: 4877 - protein, 25 aa, synthetic construct
  source 1..25: note = Seed: LNVIVHSATGFKQSSKALQRPVASD
LNVIVHSATGIKQSSSALLRPVASD

SEQ ID NO: 4878 - protein, 25 aa, synthetic construct
  source 1..25: note = Seed: LNVIVHSATGFKQSSKALQRPVASD
LNVIVHSATGIKQSSSALMRPVASD

SEQ ID NO: 4879 - protein, 25 aa, synthetic construct
  source 1..25: note = Seed: LNVIVHSATGFKQSSKALQRPVASD
LNVIVHSATGIKQSSSALVRPVASD

SEQ ID NO: 4880 - protein, 25 aa, synthetic construct
  source 1..25: note = Seed: LNVIVHSATGFKQSSKALQRPVASD
LNVIVHSATGIKQSSSALYRPVASD

SEQ ID NO: 4881 - protein, 25 aa, synthetic construct
  source 1..25: note = Seed: LNVIVHSATGFKQSSKALQRPVASD
LNVIVHSATGIKQSSTALIRPVASD

SEQ ID NO: 4882 - protein, 25 aa, synthetic construct
  source 1..25: note = Seed: LNVIVHSATGFKQSSKALQRPVASD
LNVIVHSATGIKQSSTALLRPVASD

SEQ ID NO: 4883 - protein, 25 aa, synthetic construct
  source 1..25: note = Seed: LNVIVHSATGFKQSSKALQRPVASD
LNVIVHSATGIKQSSTALVRPVASD

SEQ ID NO: 4884 - protein, 25 aa, synthetic construct
  source 1..25: note = Seed: LNVIVHSATGFKQSSKALQRPVASD
LNVIVHSATGIKQSSVALARPVASD

SEQ ID NO: 4885 - protein, 25 aa, synthetic construct
  source 1..25: note = Seed: LNVIVHSATGFKQSSKALQRPVASD
LNVIVHSATGIKQSSVALIRPVASD

SEQ ID NO: 4886 - protein, 25 aa, synthetic construct
  source 1..25: note = Seed: LNVIVHSATGFKQSSKALQRPVASD
LNVIVHSATGIKQSSVALVRPVASD

SEQ ID NO: 4887 - protein, 25 aa, synthetic construct
  source 1..25: note = Seed: LNVIVHSATGFKQSSKALQRPVASD
LNVIVHSATGIKQTSAALARPVASD

SEQ ID NO: 4888 - protein, 25 aa, synthetic construct
  source 1..25: note = Seed: LNVIVHSATGFKQSSKALQRPVASD
LNVIVHSATGIKQTSAALFRPVASD

SEQ ID NO: 4889 - protein, 25 aa, synthetic construct
  source 1..25: note = Seed: LNVIVHSATGFKQSSKALQRPVASD
LNVIVHSATGIKQTSAALIRPVASD

SEQ ID NO: 4890 - protein, 25 aa, synthetic construct
  source 1..25: note = Seed: LNVIVHSATGFKQSSKALQRPVASD
LNVIVHSATGIKQTSAALLRPVASD

SEQ ID NO: 4891 - protein, 25 aa, synthetic construct
  source 1..25: note = Seed: LNVIVHSATGFKQSSKALQRPVASD
LNVIVHSATGIKQTSAALMRPVASD

SEQ ID NO: 4892 - protein, 25 aa, synthetic construct
  source 1..25: note = Seed: LNVIVHSATGFKQSSKALQRPVASD
LNVIVHSATGIKQTSAALVRPVASD

SEQ ID NO: 4893 - protein, 25 aa, synthetic construct
  source 1..25: note = Seed: LNVIVHSATGFKQSSKALQRPVASD
LNVIVHSATGIKQTSFALFRPVASD

SEQ ID NO: 4894 - protein, 25 aa, synthetic construct
  source 1..25: note = Seed: LNVIVHSATGFKQSSKALQRPVASD
LNVIVHSATGIKQTSFALIRPVASD

SEQ ID NO: 4895 - protein, 25 aa, synthetic construct
  source 1..25: note = Seed: LNVIVHSATGFKQSSKALQRPVASD
LNVIVHSATGIKQTSFALLRPVASD

SEQ ID NO: 4896 - protein, 25 aa, synthetic construct
  source 1..25: note = Seed: LNVIVHSATGFKQSSKALQRPVASD
LNVIVHSATGIKQTSFALVRPVASD

SEQ ID NO: 4897 - protein, 25 aa, synthetic construct
  source 1..25: note = Seed: LNVIVHSATGFKQSSKALQRPVASD
LNVIVHSATGIKQTSGALARPVASD

SEQ ID NO: 4898 - protein, 25 aa, synthetic construct
  source 1..25: note = Seed: LNVIVHSATGFKQSSKALQRPVASD
LNVIVHSATGIKQTSGALFRPVASD

SEQ ID NO: 4899 - protein, 25 aa, synthetic construct
  source 1..25: note = Seed: LNVIVHSATGFKQSSKALQRPVASD
LNVIVHSATGIKQTSGALIRPVASD

SEQ ID NO: 4900 - protein, 25 aa, synthetic construct
  source 1..25: note = Seed: LNVIVHSATGFKQSSKALQRPVASD
LNVIVHSATGIKQTSGALLRPVASD

SEQ ID NO: 4901 - protein, 25 aa, synthetic construct
  source 1..25: note = Seed: LNVIVHSATGFKQSSKALQRPVASD
LNVIVHSATGIKQTSGALMRPVASD

SEQ ID NO: 4902 - protein, 25 aa, synthetic construct
  source 1..25: note = Seed: LNVIVHSATGFKQSSKALQRPVASD
LNVIVHSATGIKQTSGALVRPVASD

SEQ ID NO: 4903 - protein, 25 aa, synthetic construct
  source 1..25: note = Seed: LNVIVHSATGFKQSSKALQRPVASD
LNVIVHSATGIKQTSIALARPVASD

SEQ ID NO: 4904 - protein, 25 aa, synthetic construct
  source 1..25: note = Seed: LNVIVHSATGFKQSSKALQRPVASD
LNVIVHSATGIKQTSKALARPVASD

SEQ ID NO: 4905 - protein, 25 aa, synthetic construct
  source 1..25: note = Seed: LNVIVHSATGFKQSSKALQRPVASD
LNVIVHSATGIKQTSKALRRPVASD

SEQ ID NO: 4906 - protein, 25 aa, synthetic construct
  source 1..25: note = Seed: LNVIVHSATGFKQSSKALQRPVASD
LNVIVHSATGIKQTSKALSRPVASD

SEQ ID NO: 4907 - protein, 25 aa, synthetic construct
  source 1..25: note = Seed: LNVIVHSATGFKQSSKALQRPVASD
LNVIVHSATGIKQTSNALIRPVASD

SEQ ID NO: 4908 - protein, 25 aa, synthetic construct
  source 1..25: note = Seed: LNVIVHSATGFKQSSKALQRPVASD
LNVIVHSATGIKQTSNALLRPVASD

SEQ ID NO: 4909 - protein, 25 aa, synthetic construct
  source 1..25: note = Seed: LNVIVHSATGFKQSSKALQRPVASD
LNVIVHSATGIKQTSNALVRPVASD

SEQ ID NO: 4910 - protein, 25 aa, synthetic construct
  source 1..25: note = Seed: LNVIVHSATGFKQSSKALQRPVASD
LNVIVHSATGIKQTSPALFRPVASD

SEQ ID NO: 4911 - protein, 25 aa, synthetic construct
  source 1..25: note = Seed: LNVIVHSATGFKQSSKALQRPVASD
LNVIVHSATGIKQTSPALIRPVASD

SEQ ID NO: 4912 - protein, 25 aa, synthetic construct
  source 1..25: note = Seed: LNVIVHSATGFKQSSKALQRPVASD
LNVIVHSATGIKQTSPALLRPVASD

SEQ ID NO: 4913 - protein, 25 aa, synthetic construct
  source 1..25: note = Seed: LNVIVHSATGFKQSSKALQRPVASD
LNVIVHSATGIKQTSPALMRPVASD

SEQ ID NO: 4914 - protein, 25 aa, synthetic construct
  source 1..25: note = Seed: LNVIVHSATGFKQSSKALQRPVASD
LNVIVHSATGIKQTSPALVRPVASD

SEQ ID NO: 4915 - protein, 25 aa, synthetic construct
  source 1..25: note = Seed: LNVIVHSATGFKQSSKALQRPVASD
LNVIVHSATGIKQTSRALARPVASD

SEQ ID NO: 4916 - protein, 25 aa, synthetic construct
  source 1..25: note = Seed: LNVIVHSATGFKQSSKALQRPVASD
LNVIVHSATGIKQTSRALGRPVASD

SEQ ID NO: 4917 - protein, 25 aa, synthetic construct
  source 1..25: note = Seed: LNVIVHSATGFKQSSKALQRPVASD
LNVIVHSATGIKQTSRALHRPVASD

SEQ ID NO: 4918 - protein, 25 aa, synthetic construct
  source 1..25: note = Seed: LNVIVHSATGFKQSSKALQRPVASD
LNVIVHSATGIKQTSRALKRPVASD

SEQ ID NO: 4919 - protein, 25 aa, synthetic construct
  source 1..25: note = Seed: LNVIVHSATGFKQSSKALQRPVASD
LNVIVHSATGIKQTSRALQRPVASD

SEQ ID NO: 4920 - protein, 25 aa, synthetic construct
  source 1..25: note = Seed: LNVIVHSATGFKQSSKALQRPVASD
LNVIVHSATGIKQTSRALRRPVASD

SEQ ID NO: 4921 - protein, 25 aa, synthetic construct
  source 1..25: note = Seed: LNVIVHSATGFKQSSKALQRPVASD
LNVIVHSATGIKQTSRALSRPVASD

SEQ ID NO: 4922 - protein, 25 aa, synthetic construct
  source 1..25: note = Seed: LNVIVHSATGFKQSSKALQRPVASD
LNVIVHSATGIKQTSRALTRPVASD

SEQ ID NO: 4923 - protein, 25 aa, synthetic construct
  source 1..25: note = Seed: LNVIVHSATGFKQSSKALQRPVASD
LNVIVHSATGIKQTSRALYRPVASD

SEQ ID NO: 4924 - protein, 25 aa, synthetic construct
  source 1..25: note = Seed: LNVIVHSATGFKQSSKALQRPVASD
LNVIVHSATGIKQTSSALARPVASD

SEQ ID NO: 4925 - protein, 25 aa, synthetic construct
  source 1..25: note = Seed: LNVIVHSATGFKQSSKALQRPVASD
LNVIVHSATGIKQTSSALFRPVASD

SEQ ID NO: 4926 - protein, 25 aa, synthetic construct
  source 1..25: note = Seed: LNVIVHSATGFKQSSKALQRPVASD
LNVIVHSATGIKQTSSALIRPVASD

SEQ ID NO: 4927 - protein, 25 aa, synthetic construct
  source 1..25: note = Seed: LNVIVHSATGFKQSSKALQRPVASD
LNVIVHSATGIKQTSSALLRPVASD

SEQ ID NO: 4928 - protein, 25 aa, synthetic construct
  source 1..25: note = Seed: LNVIVHSATGFKQSSKALQRPVASD
LNVIVHSATGIKQTSSALMRPVASD

SEQ ID NO: 4929 - protein, 25 aa, synthetic construct
  source 1..25: note = Seed: LNVIVHSATGFKQSSKALQRPVASD
LNVIVHSATGIKQTSSALTRPVASD

SEQ ID NO: 4930 - protein, 25 aa, synthetic construct
  source 1..25: note = Seed: LNVIVHSATGFKQSSKALQRPVASD
LNVIVHSATGIKQTSSALVRPVASD

SEQ ID NO: 4931 - protein, 25 aa, synthetic construct
  source 1..25: note = Seed: LNVIVHSATGFKQSSKALQRPVASD
LNVIVHSATGIKQTSSALYRPVASD

SEQ ID NO: 4932 - protein, 25 aa, synthetic construct
  source 1..25: note = Seed: LNVIVHSATGFKQSSKALQRPVASD
LNVIVHSATGIKQTSTALFRPVASD

SEQ ID NO: 4933 - protein, 25 aa, synthetic construct
  source 1..25: note = Seed: LNVIVHSATGFKQSSKALQRPVASD
LNVIVHSATGIKQTSTALIRPVASD

SEQ ID NO: 4934 - protein, 25 aa, synthetic construct
  source 1..25: note = Seed: LNVIVHSATGFKQSSKALQRPVASD
LNVIVHSATGIKQTSTALLRPVASD

SEQ ID NO: 4935 - protein, 25 aa, synthetic construct
  source 1..25: note = Seed: LNVIVHSATGFKQSSKALQRPVASD
LNVIVHSATGIKQTSTALVRPVASD

SEQ ID NO: 4936 - protein, 25 aa, synthetic construct
  source 1..25: note = Seed: LNVIVHSATGFKQSSKALQRPVASD
LNVIVHSATGIKQTSVALIRPVASD

SEQ ID NO: 4937 - protein, 25 aa, synthetic construct
  source 1..25: note = Seed: LNVIVHSATGFKQSSKALQRPVASD
LNVIVHSATGIKQTSVALLRPVASD

SEQ ID NO: 4938 - protein, 25 aa, synthetic construct
  source 1..25: note = Seed: LNVIVHSATGFKQSSKALQRPVASD
LNVIVHSATGIKQTSVALVRPVASD

SEQ ID NO: 4939 - protein, 25 aa, synthetic construct
  source 1..25: note = Seed: LNVIVHSATGFKQSSKALQRPVASD
LNVIVHSATGIKQVSAALARPVASD

SEQ ID NO: 4940 - protein, 25 aa, synthetic construct
  source 1..25: note = Seed: LNVIVHSATGFKQSSKALQRPVASD
LNVIVHSATGIKQVSAALGRPVASD

SEQ ID NO: 4941 - protein, 25 aa, synthetic construct
  source 1..25: note = Seed: LNVIVHSATGFKQSSKALQRPVASD
LNVIVHSATGIKQVSAALIRPVASD

SEQ ID NO: 4942 - protein, 25 aa, synthetic construct
  source 1..25: note = Seed: LNVIVHSATGFKQSSKALQRPVASD
LNVIVHSATGIKQVSAALLRPVASD

SEQ ID NO: 4943 - protein, 25 aa, synthetic construct
  source 1..25: note = Seed: LNVIVHSATGFKQSSKALQRPVASD
LNVIVHSATGIKQVSAALMRPVASD

SEQ ID NO: 4944 - protein, 25 aa, synthetic construct
  source 1..25: note = Seed: LNVIVHSATGFKQSSKALQRPVASD
LNVIVHSATGIKQVSAALNRPVASD

SEQ ID NO: 4945 - protein, 25 aa, synthetic construct
  source 1..25: note = Seed: LNVIVHSATGFKQSSKALQRPVASD
LNVIVHSATGIKQVSAALRRPVASD

SEQ ID NO: 4946 - protein, 25 aa, synthetic construct
  source 1..25: note = Seed: LNVIVHSATGFKQSSKALQRPVASD
LNVIVHSATGIKQVSAALSRPVASD

SEQ ID NO: 4947 - protein, 25 aa, synthetic construct
  source 1..25: note = Seed: LNVIVHSATGFKQSSKALQRPVASD
LNVIVHSATGIKQVSAALTRPVASD

SEQ ID NO: 4948 - protein, 25 aa, synthetic construct
  source 1..25: note = Seed: LNVIVHSATGFKQSSKALQRPVASD
LNVIVHSATGIKQVSAALVRPVASD

SEQ ID NO: 4949 - protein, 25 aa, synthetic construct
  source 1..25: note = Seed: LNVIVHSATGFKQSSKALQRPVASD
LNVIVHSATGIKQVSFALIRPVASD

SEQ ID NO: 4950 - protein, 25 aa, synthetic construct
  source 1..25: note = Seed: LNVIVHSATGFKQSSKALQRPVASD
LNVIVHSATGIKQVSFALLRPVASD

SEQ ID NO: 4951 - protein, 25 aa, synthetic construct
  source 1..25: note = Seed: LNVIVHSATGFKQSSKALQRPVASD
LNVIVHSATGIKQVSGALARPVASD

SEQ ID NO: 4952 - protein, 25 aa, synthetic construct
  source 1..25: note = Seed: LNVIVHSATGFKQSSKALQRPVASD
LNVIVHSATGIKQVSGALGRPVASD

SEQ ID NO: 4953 - protein, 25 aa, synthetic construct
  source 1..25: note = Seed: LNVIVHSATGFKQSSKALQRPVASD
LNVIVHSATGIKQVSGALIRPVASD

SEQ ID NO: 4954 - protein, 25 aa, synthetic construct
  source 1..25: note = Seed: LNVIVHSATGFKQSSKALQRPVASD
LNVIVHSATGIKQVSGALLRPVASD

SEQ ID NO: 4955 - protein, 25 aa, synthetic construct
  source 1..25: note = Seed: LNVIVHSATGFKQSSKALQRPVASD
LNVIVHSATGIKQVSGALMRPVASD

SEQ ID NO: 4956 - protein, 25 aa, synthetic construct
  source 1..25: note = Seed: LNVIVHSATGFKQSSKALQRPVASD
LNVIVHSATGIKQVSGALRRPVASD

SEQ ID NO: 4957 - protein, 25 aa, synthetic construct
  source 1..25: note = Seed: LNVIVHSATGFKQSSKALQRPVASD
LNVIVHSATGIKQVSGALSRPVASD

SEQ ID NO: 4958 - protein, 25 aa, synthetic construct
  source 1..25: note = Seed: LNVIVHSATGFKQSSKALQRPVASD
LNVIVHSATGIKQVSGALTRPVASD

SEQ ID NO: 4959 - protein, 25 aa, synthetic construct
  source 1..25: note = Seed: LNVIVHSATGFKQSSKALQRPVASD
LNVIVHSATGIKQVSGALVRPVASD

SEQ ID NO: 4960 - protein, 25 aa, synthetic construct
  source 1..25: note = Seed: LNVIVHSATGFKQSSKALQRPVASD
LNVIVHSATGIKQVSHALKRPVASD

SEQ ID NO: 4961 - protein, 25 aa, synthetic construct
  source 1..25: note = Seed: LNVIVHSATGFKQSSKALQRPVASD
LNVIVHSATGIKQVSHALRRPVASD

SEQ ID NO: 4962 - protein, 25 aa, synthetic construct
  source 1..25: note = Seed: LNVIVHSATGFKQSSKALQRPVASD
LNVIVHSATGIKQVSIALARPVASD

SEQ ID NO: 4963 - protein, 25 aa, synthetic construct
  source 1..25: note = Seed: LNVIVHSATGFKQSSKALQRPVASD
LNVIVHSATGIKQVSIALNRPVASD

SEQ ID NO: 4964 - protein, 25 aa, synthetic construct
  source 1..25: note = Seed: LNVIVHSATGFKQSSKALQRPVASD
LNVIVHSATGIKQVSIALQRPVASD

SEQ ID NO: 4965 - protein, 25 aa, synthetic construct
  source 1..25: note = Seed: LNVIVHSATGFKQSSKALQRPVASD
LNVIVHSATGIKQVSIALRRPVASD

SEQ ID NO: 4966 - protein, 25 aa, synthetic construct
  source 1..25: note = Seed: LNVIVHSATGFKQSSKALQRPVASD
LNVIVHSATGIKQVSIALSRPVASD

SEQ ID NO: 4967 - protein, 25 aa, synthetic construct
  source 1..25: note = Seed: LNVIVHSATGFKQSSKALQRPVASD
LNVIVHSATGIKQVSIALTRPVASD

SEQ ID NO: 4968 - protein, 25 aa, synthetic construct
  source 1..25: note = Seed: LNVIVHSATGFKQSSKALQRPVASD
LNVIVHSATGIKQVSIALVRPVASD

SEQ ID NO: 4969 - protein, 25 aa, synthetic construct
  source 1..25: note = Seed: LNVIVHSATGFKQSSKALQRPVASD
LNVIVHSATGIKQVSKALARPVASD

SEQ ID NO: 4970 - protein, 25 aa, synthetic construct
  source 1..25: note = Seed: LNVIVHSATGFKQSSKALQRPVASD
LNVIVHSATGIKQVSKALFRPVASD

SEQ ID NO: 4971 - protein, 25 aa, synthetic construct
  source 1..25: note = Seed: LNVIVHSATGFKQSSKALQRPVASD
LNVIVHSATGIKQVSKALGRPVASD

SEQ ID NO: 4972 - protein, 25 aa, synthetic construct
  source 1..25: note = Seed: LNVIVHSATGFKQSSKALQRPVASD
LNVIVHSATGIKQVSKALHRPVASD

SEQ ID NO: 4973 - protein, 25 aa, synthetic construct
  source 1..25: note = Seed: LNVIVHSATGFKQSSKALQRPVASD
LNVIVHSATGIKQVSKALIRPVASD

SEQ ID NO: 4974 - protein, 25 aa, synthetic construct
  source 1..25: note = Seed: LNVIVHSATGFKQSSKALQRPVASD
LNVIVHSATGIKQVSKALKRPVASD

SEQ ID NO: 4975 - protein, 25 aa, synthetic construct
  source 1..25: note = Seed: LNVIVHSATGFKQSSKALQRPVASD
LNVIVHSATGIKQVSKALLRPVASD

SEQ ID NO: 4976 - protein, 25 aa, synthetic construct
  source 1..25: note = Seed: LNVIVHSATGFKQSSKALQRPVASD
LNVIVHSATGIKQVSKALMRPVASD

SEQ ID NO: 4977 - protein, 25 aa, synthetic construct
  source 1..25: note = Seed: LNVIVHSATGFKQSSKALQRPVASD
LNVIVHSATGIKQVSKALNRPVASD

SEQ ID NO: 4978 - protein, 25 aa, synthetic construct
  source 1..25: note = Seed: LNVIVHSATGFKQSSKALQRPVASD
LNVIVHSATGIKQVSKALPRPVASD

SEQ ID NO: 4979 - protein, 25 aa, synthetic construct
  source 1..25: note = Seed: LNVIVHSATGFKQSSKALQRPVASD
LNVIVHSATGIKQVSKALQRPVASD

SEQ ID NO: 4980 - protein, 25 aa, synthetic construct
  source 1..25: note = Seed: LNVIVHSATGFKQSSKALQRPVASD
LNVIVHSATGIKQVSKALRRPVASD

SEQ ID NO: 4981 - protein, 25 aa, synthetic construct
  source 1..25: note = Seed: LNVIVHSATGFKQSSKALQRPVASD
LNVIVHSATGIKQVSKALSRPVASD

SEQ ID NO: 4982 - protein, 25 aa, synthetic construct
  source 1..25: note = Seed: LNVIVHSATGFKQSSKALQRPVASD
LNVIVHSATGIKQVSKALTRPVASD

SEQ ID NO: 4983 - protein, 25 aa, synthetic construct
  source 1..25: note = Seed: LNVIVHSATGFKQSSKALQRPVASD
LNVIVHSATGIKQVSKALVRPVASD

SEQ ID NO: 4984 - protein, 25 aa, synthetic construct
  source 1..25: note = Seed: LNVIVHSATGFKQSSKALQRPVASD
LNVIVHSATGIKQVSKALYRPVASD

SEQ ID NO: 4985 - protein, 25 aa, synthetic construct
  source 1..25: note = Seed: LNVIVHSATGFKQSSKALQRPVASD
LNVIVHSATGIKQVSLALLRPVASD

SEQ ID NO: 4986 - protein, 25 aa, synthetic construct
  source 1..25: note = Seed: LNVIVHSATGFKQSSKALQRPVASD
LNVIVHSATGIKQVSLALRRPVASD

SEQ ID NO: 4987 - protein, 25 aa, synthetic construct
  source 1..25: note = Seed: LNVIVHSATGFKQSSKALQRPVASD
LNVIVHSATGIKQVSLALSRPVASD

SEQ ID NO: 4988 - protein, 25 aa, synthetic construct
  source 1..25: note = Seed: LNVIVHSATGFKQSSKALQRPVASD
LNVIVHSATGIKQVSMALNRPVASD

SEQ ID NO: 4989 - protein, 25 aa, synthetic construct
  source 1..25: note = Seed: LNVIVHSATGFKQSSKALQRPVASD
LNVIVHSATGIKQVSMALRRPVASD

SEQ ID NO: 4990 - protein, 25 aa, synthetic construct
  source 1..25: note = Seed: LNVIVHSATGFKQSSKALQRPVASD
LNVIVHSATGIKQVSNALARPVASD

SEQ ID NO: 4991 - protein, 25 aa, synthetic construct
  source 1..25: note = Seed: LNVIVHSATGFKQSSKALQRPVASD
LNVIVHSATGIKQVSNALIRPVASD

SEQ ID NO: 4992 - protein, 25 aa, synthetic construct
  source 1..25: note = Seed: LNVIVHSATGFKQSSKALQRPVASD
LNVIVHSATGIKQVSNALLRPVASD

SEQ ID NO: 4993 - protein, 25 aa, synthetic construct
  source 1..25: note = Seed: LNVIVHSATGFKQSSKALQRPVASD
LNVIVHSATGIKQVSNALRRPVASD

SEQ ID NO: 4994 - protein, 25 aa, synthetic construct
  source 1..25: note = Seed: LNVIVHSATGFKQSSKALQRPVASD
LNVIVHSATGIKQVSNALSRPVASD

SEQ ID NO: 4995 - protein, 25 aa, synthetic construct
  source 1..25: note = Seed: LNVIVHSATGFKQSSKALQRPVASD
LNVIVHSATGIKQVSNALVRPVASD

SEQ ID NO: 4996 - protein, 25 aa, synthetic construct
  source 1..25: note = Seed: LNVIVHSATGFKQSSKALQRPVASD
LNVIVHSATGIKQVSPALARPVASD

SEQ ID NO: 4997 - protein, 25 aa, synthetic construct
  source 1..25: note = Seed: LNVIVHSATGFKQSSKALQRPVASD
LNVIVHSATGIKQVSPALGRPVASD

SEQ ID NO: 4998 - protein, 25 aa, synthetic construct
  source 1..25: note = Seed: LNVIVHSATGFKQSSKALQRPVASD
LNVIVHSATGIKQVSPALIRPVASD

SEQ ID NO: 4999 - protein, 25 aa, synthetic construct
  source 1..25: note = Seed: LNVIVHSATGFKQSSKALQRPVASD
LNVIVHSATGIKQVSPALLRPVASD

SEQ ID NO: 5000 - protein, 25 aa, synthetic construct
  source 1..25: note = Seed: LNVIVHSATGFKQSSKALQRPVASD
LNVIVHSATGIKQVSPALMRPVASD

SEQ ID NO: 5001 - protein, 25 aa, synthetic construct
  source 1..25: note = Seed: LNVIVHSATGFKQSSKALQRPVASD
LNVIVHSATGIKQVSPALNRPVASD

SEQ ID NO: 5002 - protein, 25 aa, synthetic construct
  source 1..25: note = Seed: LNVIVHSATGFKQSSKALQRPVASD
LNVIVHSATGIKQVSPALRRPVASD

SEQ ID NO: 5003 - protein, 25 aa, synthetic construct
  source 1..25: note = Seed: LNVIVHSATGFKQSSKALQRPVASD
LNVIVHSATGIKQVSPALSRPVASD

SEQ ID NO: 5004 - protein, 25 aa, synthetic construct
  source 1..25: note = Seed: LNVIVHSATGFKQSSKALQRPVASD
LNVIVHSATGIKQVSPALTRPVASD

SEQ ID NO: 5005 - protein, 25 aa, synthetic construct
  source 1..25: note = Seed: LNVIVHSATGFKQSSKALQRPVASD
LNVIVHSATGIKQVSPALVRPVASD

SEQ ID NO: 5006 - protein, 25 aa, synthetic construct
  source 1..25: note = Seed: LNVIVHSATGFKQSSKALQRPVASD
LNVIVHSATGIKQVSQALRRPVASD

SEQ ID NO: 5007 - protein, 25 aa, synthetic construct
  source 1..25: note = Seed: LNVIVHSATGFKQSSKALQRPVASD
LNVIVHSATGIKQVSRALARPVASD

SEQ ID NO: 5008 - protein, 25 aa, synthetic construct
  source 1..25: note = Seed: LNVIVHSATGFKQSSKALQRPVASD
LNVIVHSATGIKQVSRALFRPVASD

SEQ ID NO: 5009 - protein, 25 aa, synthetic construct
  source 1..25: note = Seed: LNVIVHSATGFKQSSKALQRPVASD
LNVIVHSATGIKQVSRALGRPVASD

SEQ ID NO: 5010 - protein, 25 aa, synthetic construct
  source 1..25: note = Seed: LNVIVHSATGFKQSSKALQRPVASD
LNVIVHSATGIKQVSRALHRPVASD

SEQ ID NO: 5011 - protein, 25 aa, synthetic construct
  source 1..25: note = Seed: LNVIVHSATGFKQSSKALQRPVASD
LNVIVHSATGIKQVSRALIRPVASD

SEQ ID NO: 5012 - protein, 25 aa, synthetic construct
  source 1..25: note = Seed: LNVIVHSATGFKQSSKALQRPVASD
LNVIVHSATGIKQVSRALKRPVASD

SEQ ID NO: 5013 - protein, 25 aa, synthetic construct
  source 1..25: note = Seed: LNVIVHSATGFKQSSKALQRPVASD
LNVIVHSATGIKQVSRALLRPVASD

SEQ ID NO: 5014 - protein, 25 aa, synthetic construct
  source 1..25: note = Seed: LNVIVHSATGFKQSSKALQRPVASD
LNVIVHSATGIKQVSRALMRPVASD

SEQ ID NO: 5015 - protein, 25 aa, synthetic construct
  source 1..25: note = Seed: LNVIVHSATGFKQSSKALQRPVASD
LNVIVHSATGIKQVSRALNRPVASD

SEQ ID NO: 5016 - protein, 25 aa, synthetic construct
  source 1..25: note = Seed: LNVIVHSATGFKQSSKALQRPVASD
LNVIVHSATGIKQVSRALPRPVASD

SEQ ID NO: 5017 - protein, 25 aa, synthetic construct
  source 1..25: note = Seed: LNVIVHSATGFKQSSKALQRPVASD
LNVIVHSATGIKQVSRALQRPVASD

SEQ ID NO: 5018 - protein, 25 aa, synthetic construct
  source 1..25: note = Seed: LNVIVHSATGFKQSSKALQRPVASD
LNVIVHSATGIKQVSRALRRPVASD

SEQ ID NO: 5019 - protein, 25 aa, synthetic construct
  source 1..25: note = Seed: LNVIVHSATGFKQSSKALQRPVASD
LNVIVHSATGIKQVSRALSRPVASD

SEQ ID NO: 5020 - protein, 25 aa, synthetic construct
  source 1..25: note = Seed: LNVIVHSATGFKQSSKALQRPVASD
LNVIVHSATGIKQVSRALTRPVASD

SEQ ID NO: 5021 - protein, 25 aa, synthetic construct
  source 1..25: note = Seed: LNVIVHSATGFKQSSKALQRPVASD
LNVIVHSATGIKQVSRALVRPVASD

SEQ ID NO: 5022 - protein, 25 aa, synthetic construct
  source 1..25: note = Seed: LNVIVHSATGFKQSSKALQRPVASD
LNVIVHSATGIKQVSRALYRPVASD

SEQ ID NO: 5023 - protein, 25 aa, synthetic construct
  source 1..25: note = Seed: LNVIVHSATGFKQSSKALQRPVASD
LNVIVHSATGIKQVSSALARPVASD

SEQ ID NO: 5024 - protein, 25 aa, synthetic construct
  source 1..25: note = Seed: LNVIVHSATGFKQSSKALQRPVASD
LNVIVHSATGIKQVSSALFRPVASD

SEQ ID NO: 5025 - protein, 25 aa, synthetic construct
  source 1..25: note = Seed: LNVIVHSATGFKQSSKALQRPVASD
LNVIVHSATGIKQVSSALGRPVASD

SEQ ID NO: 5026 - protein, 25 aa, synthetic construct
  source 1..25: note = Seed: LNVIVHSATGFKQSSKALQRPVASD
LNVIVHSATGIKQVSSALIRPVASD

SEQ ID NO: 5027 - protein, 25 aa, synthetic construct
  source 1..25: note = Seed: LNVIVHSATGFKQSSKALQRPVASD
LNVIVHSATGIKQVSSALLRPVASD

SEQ ID NO: 5028 - protein, 25 aa, synthetic construct
  source 1..25: note = Seed: LNVIVHSATGFKQSSKALQRPVASD
LNVIVHSATGIKQVSSALMRPVASD

SEQ ID NO: 5029 - protein, 25 aa, synthetic construct
  source 1..25: note = Seed: LNVIVHSATGFKQSSKALQRPVASD
LNVIVHSATGIKQVSSALNRPVASD

SEQ ID NO: 5030 - protein, 25 aa, synthetic construct
  source 1..25: note = Seed: LNVIVHSATGFKQSSKALQRPVASD
LNVIVHSATGIKQVSSALRRPVASD

SEQ ID NO: 5031 - protein, 25 aa, synthetic construct
  source 1..25: note = Seed: LNVIVHSATGFKQSSKALQRPVASD
LNVIVHSATGIKQVSSALSRPVASD

SEQ ID NO: 5032 - protein, 25 aa, synthetic construct
  source 1..25: note = Seed: LNVIVHSATGFKQSSKALQRPVASD
LNVIVHSATGIKQVSSALTRPVASD

SEQ ID NO: 5033 - protein, 25 aa, synthetic construct
  source 1..25: note = Seed: LNVIVHSATGFKQSSKALQRPVASD
LNVIVHSATGIKQVSSALVRPVASD

SEQ ID NO: 5034 - protein, 25 aa, synthetic construct
  source 1..25: note = Seed: LNVIVHSATGFKQSSKALQRPVASD
LNVIVHSATGIKQVSTALARPVASD

SEQ ID NO: 5035 - protein, 25 aa, synthetic construct
  source 1..25: note = Seed: LNVIVHSATGFKQSSKALQRPVASD
LNVIVHSATGIKQVSTALIRPVASD

SEQ ID NO: 5036 - protein, 25 aa, synthetic construct
  source 1..25: note = Seed: LNVIVHSATGFKQSSKALQRPVASD
LNVIVHSATGIKQVSTALNRPVASD

SEQ ID NO: 5037 - protein, 25 aa, synthetic construct
  source 1..25: note = Seed: LNVIVHSATGFKQSSKALQRPVASD
LNVIVHSATGIKQVSTALRRPVASD

SEQ ID NO: 5038 - protein, 25 aa, synthetic construct
  source 1..25: note = Seed: LNVIVHSATGFKQSSKALQRPVASD
LNVIVHSATGIKQVSTALSRPVASD

SEQ ID NO: 5039 - protein, 25 aa, synthetic construct
  source 1..25: note = Seed: LNVIVHSATGFKQSSKALQRPVASD
LNVIVHSATGIKQVSTALVRPVASD

SEQ ID NO: 5040 - protein, 25 aa, synthetic construct
  source 1..25: note = Seed: LNVIVHSATGFKQSSKALQRPVASD
LNVIVHSATGIKQVSVALARPVASD

SEQ ID NO: 5041 - protein, 25 aa, synthetic construct
  source 1..25: note = Seed: LNVIVHSATGFKQSSKALQRPVASD
LNVIVHSATGIKQVSVALIRPVASD

SEQ ID NO: 5042 - protein, 25 aa, synthetic construct
  source 1..25: note = Seed: LNVIVHSATGFKQSSKALQRPVASD
LNVIVHSATGIKQVSVALLRPVASD

SEQ ID NO: 5043 - protein, 25 aa, synthetic construct
  source 1..25: note = Seed: LNVIVHSATGFKQSSKALQRPVASD
LNVIVHSATGIKQVSVALMRPVASD

SEQ ID NO: 5044 - protein, 25 aa, synthetic construct
  source 1..25: note = Seed: LNVIVHSATGFKQSSKALQRPVASD
LNVIVHSATGIKQVSVALNRPVASD

SEQ ID NO: 5045 - protein, 25 aa, synthetic construct
  source 1..25: note = Seed: LNVIVHSATGFKQSSKALQRPVASD
LNVIVHSATGIKQVSVALRRPVASD

SEQ ID NO: 5046 - protein, 25 aa, synthetic construct
  source 1..25: note = Seed: LNVIVHSATGFKQSSKALQRPVASD
LNVIVHSATGIKQVSVALSRPVASD

SEQ ID NO: 5047 - protein, 25 aa, synthetic construct
  source 1..25: note = Seed: LNVIVHSATGFKQSSKALQRPVASD
LNVIVHSATGIKQVSVALTRPVASD

SEQ ID NO: 5048 - protein, 25 aa, synthetic construct
  source 1..25: note = Seed: LNVIVHSATGFKQSSKALQRPVASD
LNVIVHSATGIKQVSVALVRPVASD

SEQ ID NO: 5049 - protein, 25 aa, synthetic construct
  source 1..25: note = Seed: LNVIVHSATGFKQSSKALQRPVASD
LNVIVHSATGIKQWSAALARPVASD

SEQ ID NO: 5050 - protein, 25 aa, synthetic construct
  source 1..25: note = Seed: LNVIVHSATGFKQSSKALQRPVASD
LNVIVHSATGIKQWSAALIRPVASD

SEQ ID NO: 5051 - protein, 25 aa, synthetic construct
  source 1..25: note = Seed: LNVIVHSATGFKQSSKALQRPVASD
LNVIVHSATGIKQWSAALKRPVASD

SEQ ID NO: 5052 - protein, 25 aa, synthetic construct
  source 1..25: note = Seed: LNVIVHSATGFKQSSKALQRPVASD
LNVIVHSATGIKQWSAALLRPVASD

SEQ ID NO: 5053 - protein, 25 aa, synthetic construct
  source 1..25: note = Seed: LNVIVHSATGFKQSSKALQRPVASD
LNVIVHSATGIKQWSAALMRPVASD

SEQ ID NO: 5054 - protein, 25 aa, synthetic construct
  source 1..25: note = Seed: LNVIVHSATGFKQSSKALQRPVASD
LNVIVHSATGIKQWSAALNRPVASD

SEQ ID NO: 5055 - protein, 25 aa, synthetic construct
  source 1..25: note = Seed: LNVIVHSATGFKQSSKALQRPVASD
LNVIVHSATGIKQWSAALRRPVASD

SEQ ID NO: 5056 - protein, 25 aa, synthetic construct
  source 1..25: note = Seed: LNVIVHSATGFKQSSKALQRPVASD
LNVIVHSATGIKQWSAALVRPVASD

SEQ ID NO: 5057 - protein, 25 aa, synthetic construct
  source 1..25: note = Seed: LNVIVHSATGFKQSSKALQRPVASD
LNVIVHSATGIKQWSAALYRPVASD

SEQ ID NO: 5058 - protein, 25 aa, synthetic construct
  source 1..25: note = Seed: LNVIVHSATGFKQSSKALQRPVASD
LNVIVHSATGIKQWSFALIRPVASD

SEQ ID NO: 5059 - protein, 25 aa, synthetic construct
  source 1..25: note = Seed: LNVIVHSATGFKQSSKALQRPVASD
LNVIVHSATGIKQWSFALLRPVASD

SEQ ID NO: 5060 - protein, 25 aa, synthetic construct
  source 1..25: note = Seed: LNVIVHSATGFKQSSKALQRPVASD
LNVIVHSATGIKQWSGALVRPVASD

SEQ ID NO: 5061 - protein, 25 aa, synthetic construct
  source 1..25: note = Seed: LNVIVHSATGFKQSSKALQRPVASD
LNVIVHSATGIKQWSHALRRPVASD

SEQ ID NO: 5062 - protein, 25 aa, synthetic construct
  source 1..25: note = Seed: LNVIVHSATGFKQSSKALQRPVASD
LNVIVHSATGIKQWSHALYRPVASD

SEQ ID NO: 5063 - protein, 25 aa, synthetic construct
  source 1..25: note = Seed: LNVIVHSATGFKQSSKALQRPVASD
LNVIVHSATGIKQWSIALKRPVASD

SEQ ID NO: 5064 - protein, 25 aa, synthetic construct
  source 1..25: note = Seed: LNVIVHSATGFKQSSKALQRPVASD
LNVIVHSATGIKQWSIALQRPVASD

SEQ ID NO: 5065 - protein, 25 aa, synthetic construct
  source 1..25: note = Seed: LNVIVHSATGFKQSSKALQRPVASD
LNVIVHSATGIKQWSIALRRPVASD

SEQ ID NO: 5066 - protein, 25 aa, synthetic construct
  source 1..25: note = Seed: LNVIVHSATGFKQSSKALQRPVASD
LNVIVHSATGIKQWSKALARPVASD

SEQ ID NO: 5067 - protein, 25 aa, synthetic construct
  source 1..25: note = Seed: LNVIVHSATGFKQSSKALQRPVASD
LNVIVHSATGIKQWSKALFRPVASD

SEQ ID NO: 5068 - protein, 25 aa, synthetic construct
  source 1..25: note = Seed: LNVIVHSATGFKQSSKALQRPVASD
LNVIVHSATGIKQWSKALGRPVASD

SEQ ID NO: 5069 - protein, 25 aa, synthetic construct
  source 1..25: note = Seed: LNVIVHSATGFKQSSKALQRPVASD
LNVIVHSATGIKQWSKALHRPVASD

SEQ ID NO: 5070 - protein, 25 aa, synthetic construct
  source 1..25: note = Seed: LNVIVHSATGFKQSSKALQRPVASD
LNVIVHSATGIKQWSKALIRPVASD

SEQ ID NO: 5071 - protein, 25 aa, synthetic construct
  source 1..25: note = Seed: LNVIVHSATGFKQSSKALQRPVASD
LNVIVHSATGIKQWSKALKRPVASD

SEQ ID NO: 5072 - protein, 25 aa, synthetic construct
  source 1..25: note = Seed: LNVIVHSATGFKQSSKALQRPVASD
LNVIVHSATGIKQWSKALLRPVASD

SEQ ID NO: 5073 - protein, 25 aa, synthetic construct
  source 1..25: note = Seed: LNVIVHSATGFKQSSKALQRPVASD
LNVIVHSATGIKQWSKALMRPVASD

SEQ ID NO: 5074 - protein, 25 aa, synthetic construct
  source 1..25: note = Seed: LNVIVHSATGFKQSSKALQRPVASD
LNVIVHSATGIKQWSKALQRPVASD

SEQ ID NO: 5075 - protein, 25 aa, synthetic construct
  source 1..25: note = Seed: LNVIVHSATGFKQSSKALQRPVASD
LNVIVHSATGIKQWSKALRRPVASD

SEQ ID NO: 5076 - protein, 25 aa, synthetic construct
  source 1..25: note = Seed: LNVIVHSATGFKQSSKALQRPVASD
LNVIVHSATGIKQWSKALSRPVASD

SEQ ID NO: 5077 - protein, 25 aa, synthetic construct
  source 1..25: note = Seed: LNVIVHSATGFKQSSKALQRPVASD
LNVIVHSATGIKQWSKALTRPVASD

SEQ ID NO: 5078 - protein, 25 aa, synthetic construct
  source 1..25: note = Seed: LNVIVHSATGFKQSSKALQRPVASD
LNVIVHSATGIKQWSKALVRPVASD

SEQ ID NO: 5079 - protein, 25 aa, synthetic construct
  source 1..25: note = Seed: LNVIVHSATGFKQSSKALQRPVASD
LNVIVHSATGIKQWSKALYRPVASD

SEQ ID NO: 5080 - protein, 25 aa, synthetic construct
  source 1..25: note = Seed: LNVIVHSATGFKQSSKALQRPVASD
LNVIVHSATGIKQWSLALKRPVASD

SEQ ID NO: 5081 - protein, 25 aa, synthetic construct
  source 1..25: note = Seed: LNVIVHSATGFKQSSKALQRPVASD
LNVIVHSATGIKQWSLALLRPVASD

SEQ ID NO: 5082 - protein, 25 aa, synthetic construct
  source 1..25: note = Seed: LNVIVHSATGFKQSSKALQRPVASD
LNVIVHSATGIKQWSLALRRPVASD

SEQ ID NO: 5083 - protein, 25 aa, synthetic construct
  source 1..25: note = Seed: LNVIVHSATGFKQSSKALQRPVASD
LNVIVHSATGIKQWSMALKRPVASD

SEQ ID NO: 5084 - protein, 25 aa, synthetic construct
  source 1..25: note = Seed: LNVIVHSATGFKQSSKALQRPVASD
LNVIVHSATGIKQWSMALRRPVASD

SEQ ID NO: 5085 - protein, 25 aa, synthetic construct
  source 1..25: note = Seed: LNVIVHSATGFKQSSKALQRPVASD
LNVIVHSATGIKQWSNALRRPVASD

SEQ ID NO: 5086 - protein, 25 aa, synthetic construct
  source 1..25: note = Seed: LNVIVHSATGFKQSSKALQRPVASD
LNVIVHSATGIKQWSPALRRPVASD

SEQ ID NO: 5087 - protein, 25 aa, synthetic construct
  source 1..25: note = Seed: LNVIVHSATGFKQSSKALQRPVASD
LNVIVHSATGIKQWSPALVRPVASD

SEQ ID NO: 5088 - protein, 25 aa, synthetic construct
  source 1..25: note = Seed: LNVIVHSATGFKQSSKALQRPVASD
LNVIVHSATGIKQWSRALARPVASD

SEQ ID NO: 5089 - protein, 25 aa, synthetic construct
  source 1..25: note = Seed: LNVIVHSATGFKQSSKALQRPVASD
LNVIVHSATGIKQWSRALFRPVASD

SEQ ID NO: 5090 - protein, 25 aa, synthetic construct
  source 1..25: note = Seed: LNVIVHSATGFKQSSKALQRPVASD
LNVIVHSATGIKQWSRALGRPVASD

SEQ ID NO: 5091 - protein, 25 aa, synthetic construct
  source 1..25: note = Seed: LNVIVHSATGFKQSSKALQRPVASD
LNVIVHSATGIKQWSRALHRPVASD

SEQ ID NO: 5092 - protein, 25 aa, synthetic construct
  source 1..25: note = Seed: LNVIVHSATGFKQSSKALQRPVASD
LNVIVHSATGIKQWSRALIRPVASD

SEQ ID NO: 5093 - protein, 25 aa, synthetic construct
  source 1..25: note = Seed: LNVIVHSATGFKQSSKALQRPVASD
LNVIVHSATGIKQWSRALKRPVASD

SEQ ID NO: 5094 - protein, 25 aa, synthetic construct
  source 1..25: note = Seed: LNVIVHSATGFKQSSKALQRPVASD
LNVIVHSATGIKQWSRALLRPVASD

SEQ ID NO: 5095 - protein, 25 aa, synthetic construct
  source 1..25: note = Seed: LNVIVHSATGFKQSSKALQRPVASD
LNVIVHSATGIKQWSRALMRPVASD

SEQ ID NO: 5096 - protein, 25 aa, synthetic construct
  source 1..25: note = Seed: LNVIVHSATGFKQSSKALQRPVASD
LNVIVHSATGIKQWSRALQRPVASD

SEQ ID NO: 5097 - protein, 25 aa, synthetic construct
  source 1..25: note = Seed: LNVIVHSATGFKQSSKALQRPVASD
LNVIVHSATGIKQWSRALRRPVASD

SEQ ID NO: 5098 - protein, 25 aa, synthetic construct
  source 1..25: note = Seed: LNVIVHSATGFKQSSKALQRPVASD
LNVIVHSATGIKQWSRALSRPVASD

SEQ ID NO: 5099 - protein, 25 aa, synthetic construct
  source 1..25: note = Seed: LNVIVHSATGFKQSSKALQRPVASD
LNVIVHSATGIKQWSRALTRPVASD

SEQ ID NO: 5100 - protein, 25 aa, synthetic construct
  source 1..25: note = Seed: LNVIVHSATGFKQSSKALQRPVASD
LNVIVHSATGIKQWSRALVRPVASD

SEQ ID NO: 5101 - protein, 25 aa, synthetic construct
  source 1..25: note = Seed: LNVIVHSATGFKQSSKALQRPVASD
LNVIVHSATGIKQWSRALYRPVASD

SEQ ID NO: 5102 - protein, 25 aa, synthetic construct
  source 1..25: note = Seed: LNVIVHSATGFKQSSKALQRPVASD
LNVIVHSATGIKQWSSALARPVASD

SEQ ID NO: 5103 - protein, 25 aa, synthetic construct
  source 1..25: note = Seed: LNVIVHSATGFKQSSKALQRPVASD
LNVIVHSATGIKQWSSALIRPVASD

SEQ ID NO: 5104 - protein, 25 aa, synthetic construct
  source 1..25: note = Seed: LNVIVHSATGFKQSSKALQRPVASD
LNVIVHSATGIKQWSSALRRPVASD

SEQ ID NO: 5105 - protein, 25 aa, synthetic construct
  source 1..25: note = Seed: LNVIVHSATGFKQSSKALQRPVASD
LNVIVHSATGIKQWSSALSRPVASD

SEQ ID NO: 5106 - protein, 25 aa, synthetic construct
  source 1..25: note = Seed: LNVIVHSATGFKQSSKALQRPVASD
LNVIVHSATGIKQWSSALVRPVASD

SEQ ID NO: 5107 - protein, 25 aa, synthetic construct
  source 1..25: note = Seed: LNVIVHSATGFKQSSKALQRPVASD
LNVIVHSATGIKQWSTALRRPVASD

SEQ ID NO: 5108 - protein, 25 aa, synthetic construct
  source 1..25: note = Seed: LNVIVHSATGFKQSSKALQRPVASD
LNVIVHSATGIKQWSTALVRPVASD

SEQ ID NO: 5109 - protein, 25 aa, synthetic construct
  source 1..25: note = Seed: LNVIVHSATGFKQSSKALQRPVASD
LNVIVHSATGIKQWSVALKRPVASD

SEQ ID NO: 5110 - protein, 25 aa, synthetic construct
  source 1..25: note = Seed: LNVIVHSATGFKQSSKALQRPVASD
LNVIVHSATGIKQWSVALMRPVASD

SEQ ID NO: 5111 - protein, 25 aa, synthetic construct
  source 1..25: note = Seed: LNVIVHSATGFKQSSKALQRPVASD
LNVIVHSATGIKQWSVALNRPVASD

SEQ ID NO: 5112 - protein, 25 aa, synthetic construct
  source 1..25: note = Seed: LNVIVHSATGFKQSSKALQRPVASD
LNVIVHSATGIKQWSVALRRPVASD

SEQ ID NO: 5113 - protein, 25 aa, synthetic construct
  source 1..25: note = Seed: LNVIVHSATGFKQSSKALQRPVASD
LNVIVHSATGIKQYSAALARPVASD

SEQ ID NO: 5114 - protein, 25 aa, synthetic construct
  source 1..25: note = Seed: LNVIVHSATGFKQSSKALQRPVASD
LNVIVHSATGIKQYSAALGRPVASD

SEQ ID NO: 5115 - protein, 25 aa, synthetic construct
  source 1..25: note = Seed: LNVIVHSATGFKQSSKALQRPVASD
LNVIVHSATGIKQYSAALLRPVASD

SEQ ID NO: 5116 - protein, 25 aa, synthetic construct
  source 1..25: note = Seed: LNVIVHSATGFKQSSKALQRPVASD
LNVIVHSATGIKQYSAALMRPVASD

SEQ ID NO: 5117 - protein, 25 aa, synthetic construct
  source 1..25: note = Seed: LNVIVHSATGFKQSSKALQRPVASD
LNVIVHSATGIKQYSAALRRPVASD

SEQ ID NO: 5118 - protein, 25 aa, synthetic construct
  source 1..25: note = Seed: LNVIVHSATGFKQSSKALQRPVASD
LNVIVHSATGIKQYSAALTRPVASD

SEQ ID NO: 5119 - protein, 25 aa, synthetic construct
  source 1..25: note = Seed: LNVIVHSATGFKQSSKALQRPVASD
LNVIVHSATGIKQYSAALVRPVASD

SEQ ID NO: 5120 - protein, 25 aa, synthetic construct
  source 1..25: note = Seed: LNVIVHSATGFKQSSKALQRPVASD
LNVIVHSATGIKQYSGALARPVASD

SEQ ID NO: 5121 - protein, 25 aa, synthetic construct
  source 1..25: note = Seed: LNVIVHSATGFKQSSKALQRPVASD
LNVIVHSATGIKQYSGALIRPVASD

SEQ ID NO: 5122 - protein, 25 aa, synthetic construct
  source 1..25: note = Seed: LNVIVHSATGFKQSSKALQRPVASD
LNVIVHSATGIKQYSGALSRPVASD

SEQ ID NO: 5123 - protein, 25 aa, synthetic construct
  source 1..25: note = Seed: LNVIVHSATGFKQSSKALQRPVASD
LNVIVHSATGIKQYSGALVRPVASD

SEQ ID NO: 5124 - protein, 25 aa, synthetic construct
  source 1..25: note = Seed: LNVIVHSATGFKQSSKALQRPVASD
LNVIVHSATGIKQYSHALRRPVASD

SEQ ID NO: 5125 - protein, 25 aa, synthetic construct
  source 1..25: note = Seed: LNVIVHSATGFKQSSKALQRPVASD
LNVIVHSATGIKQYSIALHRPVASD

SEQ ID NO: 5126 - protein, 25 aa, synthetic construct
  source 1..25: note = Seed: LNVIVHSATGFKQSSKALQRPVASD
LNVIVHSATGIKQYSIALRRPVASD

SEQ ID NO: 5127 - protein, 25 aa, synthetic construct
  source 1..25: note = Seed: LNVIVHSATGFKQSSKALQRPVASD
LNVIVHSATGIKQYSKALARPVASD

SEQ ID NO: 5128 - protein, 25 aa, synthetic construct
  source 1..25: note = Seed: LNVIVHSATGFKQSSKALQRPVASD
LNVIVHSATGIKQYSKALHRPVASD

SEQ ID NO: 5129 - protein, 25 aa, synthetic construct
  source 1..25: note = Seed: LNVIVHSATGFKQSSKALQRPVASD
LNVIVHSATGIKQYSKALKRPVASD

SEQ ID NO: 5130 - protein, 25 aa, synthetic construct
  source 1..25: note = Seed: LNVIVHSATGFKQSSKALQRPVASD
LNVIVHSATGIKQYSKALRRPVASD

SEQ ID NO: 5131 - protein, 25 aa, synthetic construct
  source 1..25: note = Seed: LNVIVHSATGFKQSSKALQRPVASD
LNVIVHSATGIKQYSKALSRPVASD

SEQ ID NO: 5132 - protein, 25 aa, synthetic construct
  source 1..25: note = Seed: LNVIVHSATGFKQSSKALQRPVASD
LNVIVHSATGIKQYSKALYRPVASD

SEQ ID NO: 5133 - protein, 25 aa, synthetic construct
  source 1..25: note = Seed: LNVIVHSATGFKQSSKALQRPVASD
LNVIVHSATGIKQYSLALRRPVASD

SEQ ID NO: 5134 - protein, 25 aa, synthetic construct
  source 1..25: note = Seed: LNVIVHSATGFKQSSKALQRPVASD
LNVIVHSATGIKQYSMALRRPVASD

SEQ ID NO: 5135 - protein, 25 aa, synthetic construct
  source 1..25: note = Seed: LNVIVHSATGFKQSSKALQRPVASD
LNVIVHSATGIKQYSNALARPVASD

SEQ ID NO: 5136 - protein, 25 aa, synthetic construct
  source 1..25: note = Seed: LNVIVHSATGFKQSSKALQRPVASD
LNVIVHSATGIKQYSNALSRPVASD

SEQ ID NO: 5137 - protein, 25 aa, synthetic construct
  source 1..25: note = Seed: LNVIVHSATGFKQSSKALQRPVASD
LNVIVHSATGIKQYSNALVRPVASD

SEQ ID NO: 5138 - protein, 25 aa, synthetic construct
  source 1..25: note = Seed: LNVIVHSATGFKQSSKALQRPVASD
LNVIVHSATGIKQYSPALRRPVASD

SEQ ID NO: 5139 - protein, 25 aa, synthetic construct
  source 1..25: note = Seed: LNVIVHSATGFKQSSKALQRPVASD
LNVIVHSATGIKQYSRALARPVASD

SEQ ID NO: 5140 - protein, 25 aa, synthetic construct
  source 1..25: note = Seed: LNVIVHSATGFKQSSKALQRPVASD
LNVIVHSATGIKQYSRALHRPVASD

SEQ ID NO: 5141 - protein, 25 aa, synthetic construct
  source 1..25: note = Seed: LNVIVHSATGFKQSSKALQRPVASD
LNVIVHSATGIKQYSRALKRPVASD

SEQ ID NO: 5142 - protein, 25 aa, synthetic construct
  source 1..25: note = Seed: LNVIVHSATGFKQSSKALQRPVASD
LNVIVHSATGIKQYSRALMRPVASD

SEQ ID NO: 5143 - protein, 25 aa, synthetic construct
  source 1..25: note = Seed: LNVIVHSATGFKQSSKALQRPVASD
LNVIVHSATGIKQYSRALRRPVASD

SEQ ID NO: 5144 - protein, 25 aa, synthetic construct
  source 1..25: note = Seed: LNVIVHSATGFKQSSKALQRPVASD
LNVIVHSATGIKQYSRALSRPVASD

SEQ ID NO: 5145 - protein, 25 aa, synthetic construct
  source 1..25: note = Seed: LNVIVHSATGFKQSSKALQRPVASD
LNVIVHSATGIKQYSRALYRPVASD

SEQ ID NO: 5146 - protein, 25 aa, synthetic construct
  source 1..25: note = Seed: LNVIVHSATGFKQSSKALQRPVASD
LNVIVHSATGIKQYSSALARPVASD

SEQ ID NO: 5147 - protein, 25 aa, synthetic construct
  source 1..25: note = Seed: LNVIVHSATGFKQSSKALQRPVASD
LNVIVHSATGIKQYSSALGRPVASD

SEQ ID NO: 5148 - protein, 25 aa, synthetic construct
  source 1..25: note = Seed: LNVIVHSATGFKQSSKALQRPVASD
LNVIVHSATGIKQYSSALIRPVASD

SEQ ID NO: 5149 - protein, 25 aa, synthetic construct
  source 1..25: note = Seed: LNVIVHSATGFKQSSKALQRPVASD
LNVIVHSATGIKQYSSALLRPVASD

SEQ ID NO: 5150 - protein, 25 aa, synthetic construct
  source 1..25: note = Seed: LNVIVHSATGFKQSSKALQRPVASD
LNVIVHSATGIKQYSSALMRPVASD

SEQ ID NO: 5151 - protein, 25 aa, synthetic construct
  source 1..25: note = Seed: LNVIVHSATGFKQSSKALQRPVASD
LNVIVHSATGIKQYSSALRRPVASD

SEQ ID NO: 5152 - protein, 25 aa, synthetic construct
  source 1..25: note = Seed: LNVIVHSATGFKQSSKALQRPVASD
LNVIVHSATGIKQYSSALSRPVASD

SEQ ID NO: 5153 - protein, 25 aa, synthetic construct
  source 1..25: note = Seed: LNVIVHSATGFKQSSKALQRPVASD
LNVIVHSATGIKQYSSALTRPVASD

SEQ ID NO: 5154 - protein, 25 aa, synthetic construct
  source 1..25: note = Seed: LNVIVHSATGFKQSSKALQRPVASD
LNVIVHSATGIKQYSSALVRPVASD

SEQ ID NO: 5155 - protein, 25 aa, synthetic construct
  source 1..25: note = Seed: LNVIVHSATGFKQSSKALQRPVASD
LNVIVHSATGIKQYSTALARPVASD

SEQ ID NO: 5156 - protein, 25 aa, synthetic construct
  source 1..25: note = Seed: LNVIVHSATGFKQSSKALQRPVASD
LNVIVHSATGIKQYSVALQRPVASD

SEQ ID NO: 5157 - protein, 25 aa, synthetic construct
  source 1..25: note = Seed: LNVIVHSATGFKQSSKALQRPVASD
LNVIVHSATGIKQYSVALRRPVASD

SEQ ID NO: 5158 - protein, 25 aa, synthetic construct
  source 1..25: note = Seed: LNVIVHSATGFKQSSKALQRPVASD
LNVIVHSATGKKQFSMALARPVASD

SEQ ID NO: 5159 - protein, 25 aa, synthetic construct
  source 1..25: note = Seed: LNVIVHSATGFKQSSKALQRPVASD
LNVIVHSATGKKQFSMALMRPVASD

SEQ ID NO: 5160 - protein, 25 aa, synthetic construct
  source 1..25: note = Seed: LNVIVHSATGFKQSSKALQRPVASD
LNVIVHSATGKKQLSGALVRPVASD

SEQ ID NO: 5161 - protein, 25 aa, synthetic construct
  source 1..25: note = Seed: LNVIVHSATGFKQSSKALQRPVASD
LNVIVHSATGKKQMSAALIRPVASD

SEQ ID NO: 5162 - protein, 25 aa, synthetic construct
  source 1..25: note = Seed: LNVIVHSATGFKQSSKALQRPVASD
LNVIVHSATGLKQASAALARPVASD

SEQ ID NO: 5163 - protein, 25 aa, synthetic construct
  source 1..25: note = Seed: LNVIVHSATGFKQSSKALQRPVASD
LNVIVHSATGLKQASAALCRPVASD

SEQ ID NO: 5164 - protein, 25 aa, synthetic construct
  source 1..25: note = Seed: LNVIVHSATGFKQSSKALQRPVASD
LNVIVHSATGLKQASAALGRPVASD

SEQ ID NO: 5165 - protein, 25 aa, synthetic construct
  source 1..25: note = Seed: LNVIVHSATGFKQSSKALQRPVASD
LNVIVHSATGLKQASAALHRPVASD

SEQ ID NO: 5166 - protein, 25 aa, synthetic construct
  source 1..25: note = Seed: LNVIVHSATGFKQSSKALQRPVASD
LNVIVHSATGLKQASAALIRPVASD

SEQ ID NO: 5167 - protein, 25 aa, synthetic construct
  source 1..25: note = Seed: LNVIVHSATGFKQSSKALQRPVASD
LNVIVHSATGLKQASAALLRPVASD

SEQ ID NO: 5168 - protein, 25 aa, synthetic construct
  source 1..25: note = Seed: LNVIVHSATGFKQSSKALQRPVASD
LNVIVHSATGLKQASAALMRPVASD

SEQ ID NO: 5169 - protein, 25 aa, synthetic construct
  source 1..25: note = Seed: LNVIVHSATGFKQSSKALQRPVASD
LNVIVHSATGLKQASAALNRPVASD

SEQ ID NO: 5170 - protein, 25 aa, synthetic construct
  source 1..25: note = Seed: LNVIVHSATGFKQSSKALQRPVASD
LNVIVHSATGLKQASAALSRPVASD

SEQ ID NO: 5171 - protein, 25 aa, synthetic construct
  source 1..25: note = Seed: LNVIVHSATGFKQSSKALQRPVASD
LNVIVHSATGLKQASAALTRPVASD

SEQ ID NO: 5172 - protein, 25 aa, synthetic construct
  source 1..25: note = Seed: LNVIVHSATGFKQSSKALQRPVASD
LNVIVHSATGLKQASAALVRPVASD

SEQ ID NO: 5173 - protein, 25 aa, synthetic construct
  source 1..25: note = Seed: LNVIVHSATGFKQSSKALQRPVASD
LNVIVHSATGLKQASGALARPVASD

SEQ ID NO: 5174 - protein, 25 aa, synthetic construct
  source 1..25: note = Seed: LNVIVHSATGFKQSSKALQRPVASD
LNVIVHSATGLKQASGALGRPVASD

SEQ ID NO: 5175 - protein, 25 aa, synthetic construct
  source 1..25: note = Seed: LNVIVHSATGFKQSSKALQRPVASD
LNVIVHSATGLKQASGALIRPVASD

SEQ ID NO: 5176 - protein, 25 aa, synthetic construct
  source 1..25: note = Seed: LNVIVHSATGFKQSSKALQRPVASD
LNVIVHSATGLKQASGALLRPVASD

SEQ ID NO: 5177 - protein, 25 aa, synthetic construct
  source 1..25: note = Seed: LNVIVHSATGFKQSSKALQRPVASD
LNVIVHSATGLKQASGALMRPVASD

SEQ ID NO: 5178 - protein, 25 aa, synthetic construct
  source 1..25: note = Seed: LNVIVHSATGFKQSSKALQRPVASD
LNVIVHSATGLKQASGALSRPVASD

SEQ ID NO: 5179 - protein, 25 aa, synthetic construct
  source 1..25: note = Seed: LNVIVHSATGFKQSSKALQRPVASD
LNVIVHSATGLKQASGALTRPVASD

SEQ ID NO: 5180 - protein, 25 aa, synthetic construct
  source 1..25: note = Seed: LNVIVHSATGFKQSSKALQRPVASD
LNVIVHSATGLKQASGALVRPVASD

SEQ ID NO: 5181 - protein, 25 aa, synthetic construct
  source 1..25: note = Seed: LNVIVHSATGFKQSSKALQRPVASD
LNVIVHSATGLKQASIALARPVASD

SEQ ID NO: 5182 - protein, 25 aa, synthetic construct
  source 1..25: note = Seed: LNVIVHSATGFKQSSKALQRPVASD
LNVIVHSATGLKQASIALNRPVASD

SEQ ID NO: 5183 - protein, 25 aa, synthetic construct
  source 1..25: note = Seed: LNVIVHSATGFKQSSKALQRPVASD
LNVIVHSATGLKQASIALQRPVASD

SEQ ID NO: 5184 - protein, 25 aa, synthetic construct
  source 1..25: note = Seed: LNVIVHSATGFKQSSKALQRPVASD
LNVIVHSATGLKQASIALSRPVASD

SEQ ID NO: 5185 - protein, 25 aa, synthetic construct
  source 1..25: note = Seed: LNVIVHSATGFKQSSKALQRPVASD
LNVIVHSATGLKQASIALTRPVASD

SEQ ID NO: 5186 - protein, 25 aa, synthetic construct
  source 1..25: note = Seed: LNVIVHSATGFKQSSKALQRPVASD
LNVIVHSATGLKQASIALVRPVASD

SEQ ID NO: 5187 - protein, 25 aa, synthetic construct
  source 1..25: note = Seed: LNVIVHSATGFKQSSKALQRPVASD
LNVIVHSATGLKQASKALARPVASD

SEQ ID NO: 5188 - protein, 25 aa, synthetic construct
  source 1..25: note = Seed: LNVIVHSATGFKQSSKALQRPVASD
LNVIVHSATGLKQASKALGRPVASD

SEQ ID NO: 5189 - protein, 25 aa, synthetic construct
  source 1..25: note = Seed: LNVIVHSATGFKQSSKALQRPVASD
LNVIVHSATGLKQASKALHRPVASD

SEQ ID NO: 5190 - protein, 25 aa, synthetic construct
  source 1..25: note = Seed: LNVIVHSATGFKQSSKALQRPVASD
LNVIVHSATGLKQASKALKRPVASD

SEQ ID NO: 5191 - protein, 25 aa, synthetic construct
  source 1..25: note = Seed: LNVIVHSATGFKQSSKALQRPVASD
LNVIVHSATGLKQASKALMRPVASD

SEQ ID NO: 5192 - protein, 25 aa, synthetic construct
  source 1..25: note = Seed: LNVIVHSATGFKQSSKALQRPVASD
LNVIVHSATGLKQASKALQRPVASD

SEQ ID NO: 5193 - protein, 25 aa, synthetic construct
  source 1..25: note = Seed: LNVIVHSATGFKQSSKALQRPVASD
LNVIVHSATGLKQASKALRRPVASD

SEQ ID NO: 5194 - protein, 25 aa, synthetic construct
  source 1..25: note = Seed: LNVIVHSATGFKQSSKALQRPVASD
LNVIVHSATGLKQASKALSRPVASD

SEQ ID NO: 5195 - protein, 25 aa, synthetic construct
  source 1..25: note = Seed: LNVIVHSATGFKQSSKALQRPVASD
LNVIVHSATGLKQASKALTRPVASD

SEQ ID NO: 5196 - protein, 25 aa, synthetic construct
  source 1..25: note = Seed: LNVIVHSATGFKQSSKALQRPVASD
LNVIVHSATGLKQASKALVRPVASD

SEQ ID NO: 5197 - protein, 25 aa, synthetic construct
  source 1..25: note = Seed: LNVIVHSATGFKQSSKALQRPVASD
LNVIVHSATGLKQASKALYRPVASD

SEQ ID NO: 5198 - protein, 25 aa, synthetic construct
  source 1..25: note = Seed: LNVIVHSATGFKQSSKALQRPVASD
LNVIVHSATGLKQASLALARPVASD

SEQ ID NO: 5199 - protein, 25 aa, synthetic construct
  source 1..25: note = Seed: LNVIVHSATGFKQSSKALQRPVASD
LNVIVHSATGLKQASLALSRPVASD

SEQ ID NO: 5200 - protein, 25 aa, synthetic construct
  source 1..25: note = Seed: LNVIVHSATGFKQSSKALQRPVASD
LNVIVHSATGLKQASLALVRPVASD

SEQ ID NO: 5201 - protein, 25 aa, synthetic construct
  source 1..25: note = Seed: LNVIVHSATGFKQSSKALQRPVASD
LNVIVHSATGLKQASMALARPVASD

SEQ ID NO: 5202 - protein, 25 aa, synthetic construct
  source 1..25: note = Seed: LNVIVHSATGFKQSSKALQRPVASD
LNVIVHSATGLKQASMALSRPVASD

SEQ ID NO: 5203 - protein, 25 aa, synthetic construct
  source 1..25: note = Seed: LNVIVHSATGFKQSSKALQRPVASD
LNVIVHSATGLKQASNALARPVASD

SEQ ID NO: 5204 - protein, 25 aa, synthetic construct
  source 1..25: note = Seed: LNVIVHSATGFKQSSKALQRPVASD
LNVIVHSATGLKQASNALIRPVASD

SEQ ID NO: 5205 - protein, 25 aa, synthetic construct
  source 1..25: note = Seed: LNVIVHSATGFKQSSKALQRPVASD
LNVIVHSATGLKQASNALLRPVASD

SEQ ID NO: 5206 - protein, 25 aa, synthetic construct
  source 1..25: note = Seed: LNVIVHSATGFKQSSKALQRPVASD
LNVIVHSATGLKQASNALVRPVASD

SEQ ID NO: 5207 - protein, 25 aa, synthetic construct
  source 1..25: note = Seed: LNVIVHSATGFKQSSKALQRPVASD
LNVIVHSATGLKQASPALARPVASD

SEQ ID NO: 5208 - protein, 25 aa, synthetic construct
  source 1..25: note = Seed: LNVIVHSATGFKQSSKALQRPVASD
LNVIVHSATGLKQASPALIRPVASD

SEQ ID NO: 5209 - protein, 25 aa, synthetic construct
  source 1..25: note = Seed: LNVIVHSATGFKQSSKALQRPVASD
LNVIVHSATGLKQASPALLRPVASD

SEQ ID NO: 5210 - protein, 25 aa, synthetic construct
  source 1..25: note = Seed: LNVIVHSATGFKQSSKALQRPVASD
LNVIVHSATGLKQASPALMRPVASD

SEQ ID NO: 5211 - protein, 25 aa, synthetic construct
  source 1..25: note = Seed: LNVIVHSATGFKQSSKALQRPVASD
LNVIVHSATGLKQASPALNRPVASD

SEQ ID NO: 5212 - protein, 25 aa, synthetic construct
  source 1..25: note = Seed: LNVIVHSATGFKQSSKALQRPVASD
LNVIVHSATGLKQASPALSRPVASD

SEQ ID NO: 5213 - protein, 25 aa, synthetic construct
  source 1..25: note = Seed: LNVIVHSATGFKQSSKALQRPVASD
LNVIVHSATGLKQASPALTRPVASD

SEQ ID NO: 5214 - protein, 25 aa, synthetic construct
  source 1..25: note = Seed: LNVIVHSATGFKQSSKALQRPVASD
LNVIVHSATGLKQASPALVRPVASD

SEQ ID NO: 5215 - protein, 25 aa, synthetic construct
  source 1..25: note = Seed: LNVIVHSATGFKQSSKALQRPVASD
LNVIVHSATGLKQASRALARPVASD

SEQ ID NO: 5216 - protein, 25 aa, synthetic construct
  source 1..25: note = Seed: LNVIVHSATGFKQSSKALQRPVASD
LNVIVHSATGLKQASRALFRPVASD

SEQ ID NO: 5217 - protein, 25 aa, synthetic construct
  source 1..25: note = Seed: LNVIVHSATGFKQSSKALQRPVASD
LNVIVHSATGLKQASRALGRPVASD

SEQ ID NO: 5218 - protein, 25 aa, synthetic construct
  source 1..25: note = Seed: LNVIVHSATGFKQSSKALQRPVASD
LNVIVHSATGLKQASRALHRPVASD

SEQ ID NO: 5219 - protein, 25 aa, synthetic construct
  source 1..25: note = Seed: LNVIVHSATGFKQSSKALQRPVASD
LNVIVHSATGLKQASRALIRPVASD

SEQ ID NO: 5220 - protein, 25 aa, synthetic construct
  source 1..25: note = Seed: LNVIVHSATGFKQSSKALQRPVASD
LNVIVHSATGLKQASRALKRPVASD

SEQ ID NO: 5221 - protein, 25 aa, synthetic construct
  source 1..25: note = Seed: LNVIVHSATGFKQSSKALQRPVASD
LNVIVHSATGLKQASRALLRPVASD

SEQ ID NO: 5222 - protein, 25 aa, synthetic construct
  source 1..25: note = Seed: LNVIVHSATGFKQSSKALQRPVASD
LNVIVHSATGLKQASRALMRPVASD

SEQ ID NO: 5223 - protein, 25 aa, synthetic construct
  source 1..25: note = Seed: LNVIVHSATGFKQSSKALQRPVASD
LNVIVHSATGLKQASRALQRPVASD

SEQ ID NO: 5224 - protein, 25 aa, synthetic construct
  source 1..25: note = Seed: LNVIVHSATGFKQSSKALQRPVASD
LNVIVHSATGLKQASRALRRPVASD

SEQ ID NO: 5225 - protein, 25 aa, synthetic construct
  source 1..25: note = Seed: LNVIVHSATGFKQSSKALQRPVASD
LNVIVHSATGLKQASRALSRPVASD

SEQ ID NO: 5226 - protein, 25 aa, synthetic construct
  source 1..25: note = Seed: LNVIVHSATGFKQSSKALQRPVASD
LNVIVHSATGLKQASRALTRPVASD

SEQ ID NO: 5227 - protein, 25 aa, synthetic construct
  source 1..25: note = Seed: LNVIVHSATGFKQSSKALQRPVASD
LNVIVHSATGLKQASRALVRPVASD

SEQ ID NO: 5228 - protein, 25 aa, synthetic construct
  source 1..25: note = Seed: LNVIVHSATGFKQSSKALQRPVASD
LNVIVHSATGLKQASRALYRPVASD

SEQ ID NO: 5229 - protein, 25 aa, synthetic construct
  source 1..25: note = Seed: LNVIVHSATGFKQSSKALQRPVASD
LNVIVHSATGLKQASSALARPVASD

SEQ ID NO: 5230 - protein, 25 aa, synthetic construct
  source 1..25: note = Seed: LNVIVHSATGFKQSSKALQRPVASD
LNVIVHSATGLKQASSALIRPVASD

SEQ ID NO: 5231 - protein, 25 aa, synthetic construct
  source 1..25: note = Seed: LNVIVHSATGFKQSSKALQRPVASD
LNVIVHSATGLKQASSALLRPVASD

SEQ ID NO: 5232 - protein, 25 aa, synthetic construct
  source 1..25: note = Seed: LNVIVHSATGFKQSSKALQRPVASD
LNVIVHSATGLKQASSALMRPVASD

SEQ ID NO: 5233 - protein, 25 aa, synthetic construct
  source 1..25: note = Seed: LNVIVHSATGFKQSSKALQRPVASD
LNVIVHSATGLKQASSALNRPVASD

SEQ ID NO: 5234 - protein, 25 aa, synthetic construct
  source 1..25: note = Seed: LNVIVHSATGFKQSSKALQRPVASD
LNVIVHSATGLKQASSALSRPVASD

SEQ ID NO: 5235 - protein, 25 aa, synthetic construct
  source 1..25: note = Seed: LNVIVHSATGFKQSSKALQRPVASD
LNVIVHSATGLKQASSALTRPVASD

SEQ ID NO: 5236 - protein, 25 aa, synthetic construct
  source 1..25: note = Seed: LNVIVHSATGFKQSSKALQRPVASD
LNVIVHSATGLKQASSALVRPVASD

SEQ ID NO: 5237 - protein, 25 aa, synthetic construct
  source 1..25: note = Seed: LNVIVHSATGFKQSSKALQRPVASD
LNVIVHSATGLKQASTALARPVASD

SEQ ID NO: 5238 - protein, 25 aa, synthetic construct
  source 1..25: note = Seed: LNVIVHSATGFKQSSKALQRPVASD
LNVIVHSATGLKQASTALIRPVASD

SEQ ID NO: 5239 - protein, 25 aa, synthetic construct
  source 1..25: note = Seed: LNVIVHSATGFKQSSKALQRPVASD
LNVIVHSATGLKQASTALLRPVASD

SEQ ID NO: 5240 - protein, 25 aa, synthetic construct
  source 1..25: note = Seed: LNVIVHSATGFKQSSKALQRPVASD
LNVIVHSATGLKQASTALNRPVASD

SEQ ID NO: 5241 - protein, 25 aa, synthetic construct
  source 1..25: note = Seed: LNVIVHSATGFKQSSKALQRPVASD
LNVIVHSATGLKQASTALSRPVASD

SEQ ID NO: 5242 - protein, 25 aa, synthetic construct
  source 1..25: note = Seed: LNVIVHSATGFKQSSKALQRPVASD
LNVIVHSATGLKQASTALVRPVASD

SEQ ID NO: 5243 - protein, 25 aa, synthetic construct
  source 1..25: note = Seed: LNVIVHSATGFKQSSKALQRPVASD
LNVIVHSATGLKQASVALARPVASD

SEQ ID NO: 5244 - protein, 25 aa, synthetic construct
  source 1..25: note = Seed: LNVIVHSATGFKQSSKALQRPVASD
LNVIVHSATGLKQASVALIRPVASD

SEQ ID NO: 5245 - protein, 25 aa, synthetic construct
  source 1..25: note = Seed: LNVIVHSATGFKQSSKALQRPVASD
LNVIVHSATGLKQASVALLRPVASD

SEQ ID NO: 5246 - protein, 25 aa, synthetic construct
  source 1..25: note = Seed: LNVIVHSATGFKQSSKALQRPVASD
LNVIVHSATGLKQASVALMRPVASD

SEQ ID NO: 5247 - protein, 25 aa, synthetic construct
  source 1..25: note = Seed: LNVIVHSATGFKQSSKALQRPVASD
LNVIVHSATGLKQASVALNRPVASD

SEQ ID NO: 5248 - protein, 25 aa, synthetic construct
  source 1..25: note = Seed: LNVIVHSATGFKQSSKALQRPVASD
LNVIVHSATGLKQASVALQRPVASD

SEQ ID NO: 5249 - protein, 25 aa, synthetic construct
  source 1..25: note = Seed: LNVIVHSATGFKQSSKALQRPVASD
LNVIVHSATGLKQASVALSRPVASD

SEQ ID NO: 5250 - protein, 25 aa, synthetic construct
  source 1..25: note = Seed: LNVIVHSATGFKQSSKALQRPVASD
LNVIVHSATGLKQASVALTRPVASD

SEQ ID NO: 5251 - protein, 25 aa, synthetic construct
  source 1..25: note = Seed: LNVIVHSATGFKQSSKALQRPVASD
LNVIVHSATGLKQASVALVRPVASD

SEQ ID NO: 5252 - protein, 25 aa, synthetic construct
  source 1..25: note = Seed: LNVIVHSATGFKQSSKALQRPVASD
LNVIVHSATGLKQCSAALARPVASD

SEQ ID NO: 5253 - protein, 25 aa, synthetic construct
  source 1..25: note = Seed: LNVIVHSATGFKQSSKALQRPVASD
LNVIVHSATGLKQCSAALIRPVASD

SEQ ID NO: 5254 - protein, 25 aa, synthetic construct
  source 1..25: note = Seed: LNVIVHSATGFKQSSKALQRPVASD
LNVIVHSATGLKQCSAALLRPVASD

SEQ ID NO: 5255 - protein, 25 aa, synthetic construct
  source 1..25: note = Seed: LNVIVHSATGFKQSSKALQRPVASD
LNVIVHSATGLKQCSAALVRPVASD

SEQ ID NO: 5256 - protein, 25 aa, synthetic construct
  source 1..25: note = Seed: LNVIVHSATGFKQSSKALQRPVASD
LNVIVHSATGLKQCSFALFRPVASD

SEQ ID NO: 5257 - protein, 25 aa, synthetic construct
  source 1..25: note = Seed: LNVIVHSATGFKQSSKALQRPVASD
LNVIVHSATGLKQCSKALSRPVASD

SEQ ID NO: 5258 - protein, 25 aa, synthetic construct
  source 1..25: note = Seed: LNVIVHSATGFKQSSKALQRPVASD
LNVIVHSATGLKQCSRALARPVASD

SEQ ID NO: 5259 - protein, 25 aa, synthetic construct
  source 1..25: note = Seed: LNVIVHSATGFKQSSKALQRPVASD
LNVIVHSATGLKQCSRALQRPVASD

SEQ ID NO: 5260 - protein, 25 aa, synthetic construct
  source 1..25: note = Seed: LNVIVHSATGFKQSSKALQRPVASD
LNVIVHSATGLKQCSRALRRPVASD

SEQ ID NO: 5261 - protein, 25 aa, synthetic construct
  source 1..25: note = Seed: LNVIVHSATGFKQSSKALQRPVASD
LNVIVHSATGLKQCSRALSRPVASD

SEQ ID NO: 5262 - protein, 25 aa, synthetic construct
  source 1..25: note = Seed: LNVIVHSATGFKQSSKALQRPVASD
LNVIVHSATGLKQCSSALARPVASD

SEQ ID NO: 5263 - protein, 25 aa, synthetic construct
  source 1..25: note = Seed: LNVIVHSATGFKQSSKALQRPVASD
LNVIVHSATGLKQCSVALARPVASD

SEQ ID NO: 5264 - protein, 25 aa, synthetic construct
  source 1..25: note = Seed: LNVIVHSATGFKQSSKALQRPVASD
LNVIVHSATGLKQDSAALIRPVASD

SEQ ID NO: 5265 - protein, 25 aa, synthetic construct
  source 1..25: note = Seed: LNVIVHSATGFKQSSKALQRPVASD
LNVIVHSATGLKQDSAALVRPVASD

SEQ ID NO: 5266 - protein, 25 aa, synthetic construct
  source 1..25: note = Seed: LNVIVHSATGFKQSSKALQRPVASD
LNVIVHSATGLKQESAALARPVASD

SEQ ID NO: 5267 - protein, 25 aa, synthetic construct
  source 1..25: note = Seed: LNVIVHSATGFKQSSKALQRPVASD
LNVIVHSATGLKQESAALIRPVASD

SEQ ID NO: 5268 - protein, 25 aa, synthetic construct
  source 1..25: note = Seed: LNVIVHSATGFKQSSKALQRPVASD
LNVIVHSATGLKQESAALLRPVASD

SEQ ID NO: 5269 - protein, 25 aa, synthetic construct
  source 1..25: note = Seed: LNVIVHSATGFKQSSKALQRPVASD
LNVIVHSATGLKQESAALVRPVASD

SEQ ID NO: 5270 - protein, 25 aa, synthetic construct
  source 1..25: note = Seed: LNVIVHSATGFKQSSKALQRPVASD
LNVIVHSATGLKQESGALARPVASD

SEQ ID NO: 5271 - protein, 25 aa, synthetic construct
  source 1..25: note = Seed: LNVIVHSATGFKQSSKALQRPVASD
LNVIVHSATGLKQESGALIRPVASD

SEQ ID NO: 5272 - protein, 25 aa, synthetic construct
  source 1..25: note = Seed: LNVIVHSATGFKQSSKALQRPVASD
LNVIVHSATGLKQESGALLRPVASD

SEQ ID NO: 5273 - protein, 25 aa, synthetic construct
  source 1..25: note = Seed: LNVIVHSATGFKQSSKALQRPVASD
LNVIVHSATGLKQESGALVRPVASD

SEQ ID NO: 5274 - protein, 25 aa, synthetic construct
  source 1..25: note = Seed: LNVIVHSATGFKQSSKALQRPVASD
LNVIVHSATGLKQESIALARPVASD

SEQ ID NO: 5275 - protein, 25 aa, synthetic construct
  source 1..25: note = Seed: LNVIVHSATGFKQSSKALQRPVASD
LNVIVHSATGLKQESLALARPVASD

SEQ ID NO: 5276 - protein, 25 aa, synthetic construct
  source 1..25: note = Seed: LNVIVHSATGFKQSSKALQRPVASD
LNVIVHSATGLKQESSALVRPVASD

SEQ ID NO: 5277 - protein, 25 aa, synthetic construct
  source 1..25: note = Seed: LNVIVHSATGFKQSSKALQRPVASD
LNVIVHSATGLKQESVALMRPVASD

SEQ ID NO: 5278 - protein, 25 aa, synthetic construct
  source 1..25: note = Seed: LNVIVHSATGFKQSSKALQRPVASD
LNVIVHSATGLKQFSAALARPVASD

SEQ ID NO: 5279 - protein, 25 aa, synthetic construct
  source 1..25: note = Seed: LNVIVHSATGFKQSSKALQRPVASD
LNVIVHSATGLKQFSAALCRPVASD

SEQ ID NO: 5280 - protein, 25 aa, synthetic construct
  source 1..25: note = Seed: LNVIVHSATGFKQSSKALQRPVASD
LNVIVHSATGLKQFSAALFRPVASD

SEQ ID NO: 5281 - protein, 25 aa, synthetic construct
  source 1..25: note = Seed: LNVIVHSATGFKQSSKALQRPVASD
LNVIVHSATGLKQFSAALGRPVASD

SEQ ID NO: 5282 - protein, 25 aa, synthetic construct
  source 1..25: note = Seed: LNVIVHSATGFKQSSKALQRPVASD
LNVIVHSATGLKQFSAALHRPVASD

SEQ ID NO: 5283 - protein, 25 aa, synthetic construct
  source 1..25: note = Seed: LNVIVHSATGFKQSSKALQRPVASD
LNVIVHSATGLKQFSAALIRPVASD

SEQ ID NO: 5284 - protein, 25 aa, synthetic construct
  source 1..25: note = Seed: LNVIVHSATGFKQSSKALQRPVASD
LNVIVHSATGLKQFSAALLRPVASD

SEQ ID NO: 5285 - protein, 25 aa, synthetic construct
  source 1..25: note = Seed: LNVIVHSATGFKQSSKALQRPVASD
LNVIVHSATGLKQFSAALMRPVASD

SEQ ID NO: 5286 - protein, 25 aa, synthetic construct
  source 1..25: note = Seed: LNVIVHSATGFKQSSKALQRPVASD
LNVIVHSATGLKQFSAALQRPVASD

SEQ ID NO: 5287 - protein, 25 aa, synthetic construct
  source 1..25: note = Seed: LNVIVHSATGFKQSSKALQRPVASD
LNVIVHSATGLKQFSAALRRPVASD

SEQ ID NO: 5288 - protein, 25 aa, synthetic construct
  source 1..25: note = Seed: LNVIVHSATGFKQSSKALQRPVASD
LNVIVHSATGLKQFSAALVRPVASD

SEQ ID NO: 5289 - protein, 25 aa, synthetic construct
  source 1..25: note = Seed: LNVIVHSATGFKQSSKALQRPVASD
LNVIVHSATGLKQFSFALVRPVASD

SEQ ID NO: 5290 - protein, 25 aa, synthetic construct
  source 1..25: note = Seed: LNVIVHSATGFKQSSKALQRPVASD
LNVIVHSATGLKQFSGALARPVASD

SEQ ID NO: 5291 - protein, 25 aa, synthetic construct
  source 1..25: note = Seed: LNVIVHSATGFKQSSKALQRPVASD
LNVIVHSATGLKQFSGALIRPVASD

SEQ ID NO: 5292 - protein, 25 aa, synthetic construct
  source 1..25: note = Seed: LNVIVHSATGFKQSSKALQRPVASD
LNVIVHSATGLKQFSGALLRPVASD

SEQ ID NO: 5293 - protein, 25 aa, synthetic construct
  source 1..25: note = Seed: LNVIVHSATGFKQSSKALQRPVASD
LNVIVHSATGLKQFSGALMRPVASD

SEQ ID NO: 5294 - protein, 25 aa, synthetic construct
  source 1..25: note = Seed: LNVIVHSATGFKQSSKALQRPVASD
LNVIVHSATGLKQFSGALSRPVASD

SEQ ID NO: 5295 - protein, 25 aa, synthetic construct
  source 1..25: note = Seed: LNVIVHSATGFKQSSKALQRPVASD
LNVIVHSATGLKQFSGALVRPVASD

SEQ ID NO: 5296 - protein, 25 aa, synthetic construct
  source 1..25: note = Seed: LNVIVHSATGFKQSSKALQRPVASD
LNVIVHSATGLKQFSHALKRPVASD

SEQ ID NO: 5297 - protein, 25 aa, synthetic construct
  source 1..25: note = Seed: LNVIVHSATGFKQSSKALQRPVASD
LNVIVHSATGLKQFSHALRRPVASD

SEQ ID NO: 5298 - protein, 25 aa, synthetic construct
  source 1..25: note = Seed: LNVIVHSATGFKQSSKALQRPVASD
LNVIVHSATGLKQFSIALRRPVASD

SEQ ID NO: 5299 - protein, 25 aa, synthetic construct
  source 1..25: note = Seed: LNVIVHSATGFKQSSKALQRPVASD
LNVIVHSATGLKQFSKALARPVASD

SEQ ID NO: 5300 - protein, 25 aa, synthetic construct
  source 1..25: note = Seed: LNVIVHSATGFKQSSKALQRPVASD
LNVIVHSATGLKQFSKALFRPVASD

SEQ ID NO: 5301 - protein, 25 aa, synthetic construct
  source 1..25: note = Seed: LNVIVHSATGFKQSSKALQRPVASD
LNVIVHSATGLKQFSKALGRPVASD

SEQ ID NO: 5302 - protein, 25 aa, synthetic construct
  source 1..25: note = Seed: LNVIVHSATGFKQSSKALQRPVASD
LNVIVHSATGLKQFSKALHRPVASD

SEQ ID NO: 5303 - protein, 25 aa, synthetic construct
  source 1..25: note = Seed: LNVIVHSATGFKQSSKALQRPVASD
LNVIVHSATGLKQFSKALIRPVASD

SEQ ID NO: 5304 - protein, 25 aa, synthetic construct
  source 1..25: note = Seed: LNVIVHSATGFKQSSKALQRPVASD
LNVIVHSATGLKQFSKALKRPVASD

SEQ ID NO: 5305 - protein, 25 aa, synthetic construct
  source 1..25: note = Seed: LNVIVHSATGFKQSSKALQRPVASD
LNVIVHSATGLKQFSKALLRPVASD

SEQ ID NO: 5306 - protein, 25 aa, synthetic construct
  source 1..25: note = Seed: LNVIVHSATGFKQSSKALQRPVASD
LNVIVHSATGLKQFSKALMRPVASD

SEQ ID NO: 5307 - protein, 25 aa, synthetic construct
  source 1..25: note = Seed: LNVIVHSATGFKQSSKALQRPVASD
LNVIVHSATGLKQFSKALNRPVASD

SEQ ID NO: 5308 - protein, 25 aa, synthetic construct
  source 1..25: note = Seed: LNVIVHSATGFKQSSKALQRPVASD
LNVIVHSATGLKQFSKALQRPVASD

SEQ ID NO: 5309 - protein, 25 aa, synthetic construct
  source 1..25: note = Seed: LNVIVHSATGFKQSSKALQRPVASD
LNVIVHSATGLKQFSKALRRPVASD

SEQ ID NO: 5310 - protein, 25 aa, synthetic construct
  source 1..25: note = Seed: LNVIVHSATGFKQSSKALQRPVASD
LNVIVHSATGLKQFSKALSRPVASD

SEQ ID NO: 5311 - protein, 25 aa, synthetic construct
  source 1..25: note = Seed: LNVIVHSATGFKQSSKALQRPVASD
LNVIVHSATGLKQFSKALTRPVASD

SEQ ID NO: 5312 - protein, 25 aa, synthetic construct
  source 1..25: note = Seed: LNVIVHSATGFKQSSKALQRPVASD
LNVIVHSATGLKQFSKALVRPVASD

SEQ ID NO: 5313 - protein, 25 aa, synthetic construct
  source 1..25: note = Seed: LNVIVHSATGFKQSSKALQRPVASD
LNVIVHSATGLKQFSKALYRPVASD

SEQ ID NO: 5314 - protein, 25 aa, synthetic construct
  source 1..25: note = Seed: LNVIVHSATGFKQSSKALQRPVASD
LNVIVHSATGLKQFSLALRRPVASD

SEQ ID NO: 5315 - protein, 25 aa, synthetic construct
  source 1..25: note = Seed: LNVIVHSATGFKQSSKALQRPVASD
LNVIVHSATGLKQFSLALVRPVASD

SEQ ID NO: 5316 - protein, 25 aa, synthetic construct
  source 1..25: note = Seed: LNVIVHSATGFKQSSKALQRPVASD
LNVIVHSATGLKQFSNALARPVASD

SEQ ID NO: 5317 - protein, 25 aa, synthetic construct
  source 1..25: note = Seed: LNVIVHSATGFKQSSKALQRPVASD
LNVIVHSATGLKQFSNALIRPVASD

SEQ ID NO: 5318 - protein, 25 aa, synthetic construct
  source 1..25: note = Seed: LNVIVHSATGFKQSSKALQRPVASD
LNVIVHSATGLKQFSNALRRPVASD

SEQ ID NO: 5319 - protein, 25 aa, synthetic construct
  source 1..25: note = Seed: LNVIVHSATGFKQSSKALQRPVASD
LNVIVHSATGLKQFSPALGRPVASD

SEQ ID NO: 5320 - protein, 25 aa, synthetic construct
  source 1..25: note = Seed: LNVIVHSATGFKQSSKALQRPVASD
LNVIVHSATGLKQFSPALIRPVASD

SEQ ID NO: 5321 - protein, 25 aa, synthetic construct
  source 1..25: note = Seed: LNVIVHSATGFKQSSKALQRPVASD
LNVIVHSATGLKQFSPALLRPVASD

SEQ ID NO: 5322 - protein, 25 aa, synthetic construct
  source 1..25: note = Seed: LNVIVHSATGFKQSSKALQRPVASD
LNVIVHSATGLKQFSPALMRPVASD

SEQ ID NO: 5323 - protein, 25 aa, synthetic construct
  source 1..25: note = Seed: LNVIVHSATGFKQSSKALQRPVASD
LNVIVHSATGLKQFSPALNRPVASD

SEQ ID NO: 5324 - protein, 25 aa, synthetic construct
  source 1..25: note = Seed: LNVIVHSATGFKQSSKALQRPVASD
LNVIVHSATGLKQFSPALRRPVASD

SEQ ID NO: 5325 - protein, 25 aa, synthetic construct
  source 1..25: note = Seed: LNVIVHSATGFKQSSKALQRPVASD
LNVIVHSATGLKQFSPALVRPVASD

SEQ ID NO: 5326 - protein, 25 aa, synthetic construct
  source 1..25: note = Seed: LNVIVHSATGFKQSSKALQRPVASD
LNVIVHSATGLKQFSQALRRPVASD

SEQ ID NO: 5327 - protein, 25 aa, synthetic construct
  source 1..25: note = Seed: LNVIVHSATGFKQSSKALQRPVASD
LNVIVHSATGLKQFSRALARPVASD

SEQ ID NO: 5328 - protein, 25 aa, synthetic construct
  source 1..25: note = Seed: LNVIVHSATGFKQSSKALQRPVASD
LNVIVHSATGLKQFSRALFRPVASD

SEQ ID NO: 5329 - protein, 25 aa, synthetic construct
  source 1..25: note = Seed: LNVIVHSATGFKQSSKALQRPVASD
LNVIVHSATGLKQFSRALGRPVASD

SEQ ID NO: 5330 - protein, 25 aa, synthetic construct
  source 1..25: note = Seed: LNVIVHSATGFKQSSKALQRPVASD
LNVIVHSATGLKQFSRALHRPVASD

SEQ ID NO: 5331 - protein, 25 aa, synthetic construct
  source 1..25: note = Seed: LNVIVHSATGFKQSSKALQRPVASD
LNVIVHSATGLKQFSRALIRPVASD

SEQ ID NO: 5332 - protein, 25 aa, synthetic construct
  source 1..25: note = Seed: LNVIVHSATGFKQSSKALQRPVASD
LNVIVHSATGLKQFSRALKRPVASD

SEQ ID NO: 5333 - protein, 25 aa, synthetic construct
  source 1..25: note = Seed: LNVIVHSATGFKQSSKALQRPVASD
LNVIVHSATGLKQFSRALLRPVASD

SEQ ID NO: 5334 - protein, 25 aa, synthetic construct
  source 1..25: note = Seed: LNVIVHSATGFKQSSKALQRPVASD
LNVIVHSATGLKQFSRALMRPVASD

SEQ ID NO: 5335 - protein, 25 aa, synthetic construct
  source 1..25: note = Seed: LNVIVHSATGFKQSSKALQRPVASD
LNVIVHSATGLKQFSRALNRPVASD

SEQ ID NO: 5336 - protein, 25 aa, synthetic construct
  source 1..25: note = Seed: LNVIVHSATGFKQSSKALQRPVASD
LNVIVHSATGLKQFSRALPRPVASD

SEQ ID NO: 5337 - protein, 25 aa, synthetic construct
  source 1..25: note = Seed: LNVIVHSATGFKQSSKALQRPVASD
LNVIVHSATGLKQFSRALQRPVASD

SEQ ID NO: 5338 - protein, 25 aa, synthetic construct
  source 1..25: note = Seed: LNVIVHSATGFKQSSKALQRPVASD
LNVIVHSATGLKQFSRALRRPVASD

SEQ ID NO: 5339 - protein, 25 aa, synthetic construct
  source 1..25: note = Seed: LNVIVHSATGFKQSSKALQRPVASD
LNVIVHSATGLKQFSRALSRPVASD

SEQ ID NO: 5340 - protein, 25 aa, synthetic construct
  source 1..25: note = Seed: LNVIVHSATGFKQSSKALQRPVASD
LNVIVHSATGLKQFSRALTRPVASD

SEQ ID NO: 5341 - protein, 25 aa, synthetic construct
  source 1..25: note = Seed: LNVIVHSATGFKQSSKALQRPVASD
LNVIVHSATGLKQFSRALVRPVASD

SEQ ID NO: 5342 - protein, 25 aa, synthetic construct
  source 1..25: note = Seed: LNVIVHSATGFKQSSKALQRPVASD
LNVIVHSATGLKQFSRALYRPVASD

SEQ ID NO: 5343 - protein, 25 aa, synthetic construct
  source 1..25: note = Seed: LNVIVHSATGFKQSSKALQRPVASD
LNVIVHSATGLKQFSSALARPVASD

SEQ ID NO: 5344 - protein, 25 aa, synthetic construct
  source 1..25: note = Seed: LNVIVHSATGFKQSSKALQRPVASD
LNVIVHSATGLKQFSSALCRPVASD

SEQ ID NO: 5345 - protein, 25 aa, synthetic construct
  source 1..25: note = Seed: LNVIVHSATGFKQSSKALQRPVASD
LNVIVHSATGLKQFSSALFRPVASD

SEQ ID NO: 5346 - protein, 25 aa, synthetic construct
  source 1..25: note = Seed: LNVIVHSATGFKQSSKALQRPVASD
LNVIVHSATGLKQFSSALGRPVASD

SEQ ID NO: 5347 - protein, 25 aa, synthetic construct
  source 1..25: note = Seed: LNVIVHSATGFKQSSKALQRPVASD
LNVIVHSATGLKQFSSALIRPVASD

SEQ ID NO: 5348 - protein, 25 aa, synthetic construct
  source 1..25: note = Seed: LNVIVHSATGFKQSSKALQRPVASD
LNVIVHSATGLKQFSSALLRPVASD

SEQ ID NO: 5349 - protein, 25 aa, synthetic construct
  source 1..25: note = Seed: LNVIVHSATGFKQSSKALQRPVASD
LNVIVHSATGLKQFSSALMRPVASD

SEQ ID NO: 5350 - protein, 25 aa, synthetic construct
  source 1..25: note = Seed: LNVIVHSATGFKQSSKALQRPVASD
LNVIVHSATGLKQFSSALRRPVASD

SEQ ID NO: 5351 - protein, 25 aa, synthetic construct
  source 1..25: note = Seed: LNVIVHSATGFKQSSKALQRPVASD
LNVIVHSATGLKQFSSALTRPVASD

SEQ ID NO: 5352 - protein, 25 aa, synthetic construct
  source 1..25: note = Seed: LNVIVHSATGFKQSSKALQRPVASD
LNVIVHSATGLKQFSSALVRPVASD

SEQ ID NO: 5353 - protein, 25 aa, synthetic construct
  source 1..25: note = Seed: LNVIVHSATGFKQSSKALQRPVASD
LNVIVHSATGLKQFSTALARPVASD

SEQ ID NO: 5354 - protein, 25 aa, synthetic construct
  source 1..25: note = Seed: LNVIVHSATGFKQSSKALQRPVASD
LNVIVHSATGLKQFSTALIRPVASD

SEQ ID NO: 5355 - protein, 25 aa, synthetic construct
  source 1..25: note = Seed: LNVIVHSATGFKQSSKALQRPVASD
LNVIVHSATGLKQFSTALKRPVASD

SEQ ID NO: 5356 - protein, 25 aa, synthetic construct
  source 1..25: note = Seed: LNVIVHSATGFKQSSKALQRPVASD
LNVIVHSATGLKQFSTALLRPVASD

SEQ ID NO: 5357 - protein, 25 aa, synthetic construct
  source 1..25: note = Seed: LNVIVHSATGFKQSSKALQRPVASD
LNVIVHSATGLKQFSTALMRPVASD

SEQ ID NO: 5358 - protein, 25 aa, synthetic construct
  source 1..25: note = Seed: LNVIVHSATGFKQSSKALQRPVASD
LNVIVHSATGLKQFSTALNRPVASD

SEQ ID NO: 5359 - protein, 25 aa, synthetic construct
  source 1..25: note = Seed: LNVIVHSATGFKQSSKALQRPVASD
LNVIVHSATGLKQFSTALRRPVASD

SEQ ID NO: 5360 - protein, 25 aa, synthetic construct
  source 1..25: note = Seed: LNVIVHSATGFKQSSKALQRPVASD
LNVIVHSATGLKQFSVALHRPVASD

SEQ ID NO: 5361 - protein, 25 aa, synthetic construct
  source 1..25: note = Seed: LNVIVHSATGFKQSSKALQRPVASD
LNVIVHSATGLKQFSVALQRPVASD

SEQ ID NO: 5362 - protein, 25 aa, synthetic construct
  source 1..25: note = Seed: LNVIVHSATGFKQSSKALQRPVASD
LNVIVHSATGLKQFSVALRRPVASD

SEQ ID NO: 5363 - protein, 25 aa, synthetic construct
  source 1..25: note = Seed: LNVIVHSATGFKQSSKALQRPVASD
LNVIVHSATGLKQGSAALARPVASD

SEQ ID NO: 5364 - protein, 25 aa, synthetic construct
  source 1..25: note = Seed: LNVIVHSATGFKQSSKALQRPVASD
LNVIVHSATGLKQGSAALIRPVASD

SEQ ID NO: 5365 - protein, 25 aa, synthetic construct
  source 1..25: note = Seed: LNVIVHSATGFKQSSKALQRPVASD
LNVIVHSATGLKQGSAALLRPVASD

SEQ ID NO: 5366 - protein, 25 aa, synthetic construct
  source 1..25: note = Seed: LNVIVHSATGFKQSSKALQRPVASD
LNVIVHSATGLKQGSAALMRPVASD

SEQ ID NO: 5367 - protein, 25 aa, synthetic construct
  source 1..25: note = Seed: LNVIVHSATGFKQSSKALQRPVASD
LNVIVHSATGLKQGSAALVRPVASD

SEQ ID NO: 5368 - protein, 25 aa, synthetic construct
  source 1..25: note = Seed: LNVIVHSATGFKQSSKALQRPVASD
LNVIVHSATGLKQGSGALLRPVASD

SEQ ID NO: 5369 - protein, 25 aa, synthetic construct
  source 1..25: note = Seed: LNVIVHSATGFKQSSKALQRPVASD
LNVIVHSATGLKQGSGALVRPVASD

SEQ ID NO: 5370 - protein, 25 aa, synthetic construct
  source 1..25: note = Seed: LNVIVHSATGFKQSSKALQRPVASD
LNVIVHSATGLKQGSSALLRPVASD

SEQ ID NO: 5371 - protein, 25 aa, synthetic construct
  source 1..25: note = Seed: LNVIVHSATGFKQSSKALQRPVASD
LNVIVHSATGLKQGSSALVRPVASD

SEQ ID NO: 5372 - protein, 25 aa, synthetic construct
  source 1..25: note = Seed: LNVIVHSATGFKQSSKALQRPVASD
LNVIVHSATGLKQHSAALIRPVASD

SEQ ID NO: 5373 - protein, 25 aa, synthetic construct
  source 1..25: note = Seed: LNVIVHSATGFKQSSKALQRPVASD
LNVIVHSATGLKQHSAALRRPVASD

SEQ ID NO: 5374 - protein, 25 aa, synthetic construct
  source 1..25: note = Seed: LNVIVHSATGFKQSSKALQRPVASD
LNVIVHSATGLKQHSIALRRPVASD

SEQ ID NO: 5375 - protein, 25 aa, synthetic construct
  source 1..25: note = Seed: LNVIVHSATGFKQSSKALQRPVASD
LNVIVHSATGLKQHSKALFRPVASD

SEQ ID NO: 5376 - protein, 25 aa, synthetic construct
  source 1..25: note = Seed: LNVIVHSATGFKQSSKALQRPVASD
LNVIVHSATGLKQHSKALMRPVASD

SEQ ID NO: 5377 - protein, 25 aa, synthetic construct
  source 1..25: note = Seed: LNVIVHSATGFKQSSKALQRPVASD
LNVIVHSATGLKQHSKALRRPVASD

SEQ ID NO: 5378 - protein, 25 aa, synthetic construct
  source 1..25: note = Seed: LNVIVHSATGFKQSSKALQRPVASD
LNVIVHSATGLKQHSKALYRPVASD

SEQ ID NO: 5379 - protein, 25 aa, synthetic construct
  source 1..25: note = Seed: LNVIVHSATGFKQSSKALQRPVASD
LNVIVHSATGLKQHSPALRRPVASD

SEQ ID NO: 5380 - protein, 25 aa, synthetic construct
  source 1..25: note = Seed: LNVIVHSATGFKQSSKALQRPVASD
LNVIVHSATGLKQHSRALARPVASD

SEQ ID NO: 5381 - protein, 25 aa, synthetic construct
  source 1..25: note = Seed: LNVIVHSATGFKQSSKALQRPVASD
LNVIVHSATGLKQHSRALFRPVASD

SEQ ID NO: 5382 - protein, 25 aa, synthetic construct
  source 1..25: note = Seed: LNVIVHSATGFKQSSKALQRPVASD
LNVIVHSATGLKQHSRALHRPVASD

SEQ ID NO: 5383 - protein, 25 aa, synthetic construct
  source 1..25: note = Seed: LNVIVHSATGFKQSSKALQRPVASD
LNVIVHSATGLKQHSRALIRPVASD

SEQ ID NO: 5384 - protein, 25 aa, synthetic construct
  source 1..25: note = Seed: LNVIVHSATGFKQSSKALQRPVASD
LNVIVHSATGLKQHSRALKRPVASD

SEQ ID NO: 5385 - protein, 25 aa, synthetic construct
  source 1..25: note = Seed: LNVIVHSATGFKQSSKALQRPVASD
LNVIVHSATGLKQHSRALLRPVASD

SEQ ID NO: 5386 - protein, 25 aa, synthetic construct
  source 1..25: note = Seed: LNVIVHSATGFKQSSKALQRPVASD
LNVIVHSATGLKQHSRALMRPVASD

SEQ ID NO: 5387 - protein, 25 aa, synthetic construct
  source 1..25: note = Seed: LNVIVHSATGFKQSSKALQRPVASD
LNVIVHSATGLKQHSRALRRPVASD

SEQ ID NO: 5388 - protein, 25 aa, synthetic construct
  source 1..25: note = Seed: LNVIVHSATGFKQSSKALQRPVASD
LNVIVHSATGLKQHSRALSRPVASD

SEQ ID NO: 5389 - protein, 25 aa, synthetic construct
  source 1..25: note = Seed: LNVIVHSATGFKQSSKALQRPVASD
LNVIVHSATGLKQHSRALVRPVASD

SEQ ID NO: 5390 - protein, 25 aa, synthetic construct
  source 1..25: note = Seed: LNVIVHSATGFKQSSKALQRPVASD
LNVIVHSATGLKQHSRALYRPVASD

SEQ ID NO: 5391 - protein, 25 aa, synthetic construct
  source 1..25: note = Seed: LNVIVHSATGFKQSSKALQRPVASD
LNVIVHSATGLKQHSSALRRPVASD

SEQ ID NO: 5392 - protein, 25 aa, synthetic construct
  source 1..25: note = Seed: LNVIVHSATGFKQSSKALQRPVASD
LNVIVHSATGLKQHSTALRRPVASD

SEQ ID NO: 5393 - protein, 25 aa, synthetic construct
  source 1..25: note = Seed: LNVIVHSATGFKQSSKALQRPVASD
LNVIVHSATGLKQHSVALRRPVASD

SEQ ID NO: 5394 - protein, 25 aa, synthetic construct
  source 1..25: note = Seed: LNVIVHSATGFKQSSKALQRPVASD
LNVIVHSATGLKQISAALARPVASD

SEQ ID NO: 5395 - protein, 25 aa, synthetic construct
  source 1..25: note = Seed: LNVIVHSATGFKQSSKALQRPVASD
LNVIVHSATGLKQISAALCRPVASD

SEQ ID NO: 5396 - protein, 25 aa, synthetic construct
  source 1..25: note = Seed: LNVIVHSATGFKQSSKALQRPVASD
LNVIVHSATGLKQISAALGRPVASD

SEQ ID NO: 5397 - protein, 25 aa, synthetic construct
  source 1..25: note = Seed: LNVIVHSATGFKQSSKALQRPVASD
LNVIVHSATGLKQISAALHRPVASD

SEQ ID NO: 5398 - protein, 25 aa, synthetic construct
  source 1..25: note = Seed: LNVIVHSATGFKQSSKALQRPVASD
LNVIVHSATGLKQISAALIRPVASD

SEQ ID NO: 5399 - protein, 25 aa, synthetic construct
  source 1..25: note = Seed: LNVIVHSATGFKQSSKALQRPVASD
LNVIVHSATGLKQISAALLRPVASD

SEQ ID NO: 5400 - protein, 25 aa, synthetic construct
  source 1..25: note = Seed: LNVIVHSATGFKQSSKALQRPVASD
LNVIVHSATGLKQISAALMRPVASD

SEQ ID NO: 5401 - protein, 25 aa, synthetic construct
  source 1..25: note = Seed: LNVIVHSATGFKQSSKALQRPVASD
LNVIVHSATGLKQISAALNRPVASD

SEQ ID NO: 5402 - protein, 25 aa, synthetic construct
  source 1..25: note = Seed: LNVIVHSATGFKQSSKALQRPVASD
LNVIVHSATGLKQISAALPRPVASD

SEQ ID NO: 5403 - protein, 25 aa, synthetic construct
  source 1..25: note = Seed: LNVIVHSATGFKQSSKALQRPVASD
LNVIVHSATGLKQISAALQRPVASD

SEQ ID NO: 5404 - protein, 25 aa, synthetic construct
  source 1..25: note = Seed: LNVIVHSATGFKQSSKALQRPVASD
LNVIVHSATGLKQISAALRRPVASD

SEQ ID NO: 5405 - protein, 25 aa, synthetic construct
  source 1..25: note = Seed: LNVIVHSATGFKQSSKALQRPVASD
LNVIVHSATGLKQISAALSRPVASD

SEQ ID NO: 5406 - protein, 25 aa, synthetic construct
  source 1..25: note = Seed: LNVIVHSATGFKQSSKALQRPVASD
LNVIVHSATGLKQISAALTRPVASD

SEQ ID NO: 5407 - protein, 25 aa, synthetic construct
  source 1..25: note = Seed: LNVIVHSATGFKQSSKALQRPVASD
LNVIVHSATGLKQISAALVRPVASD

SEQ ID NO: 5408 - protein, 25 aa, synthetic construct
  source 1..25: note = Seed: LNVIVHSATGFKQSSKALQRPVASD
LNVIVHSATGLKQISFALMRPVASD

SEQ ID NO: 5409 - protein, 25 aa, synthetic construct
  source 1..25: note = Seed: LNVIVHSATGFKQSSKALQRPVASD
LNVIVHSATGLKQISFALVRPVASD

SEQ ID NO: 5410 - protein, 25 aa, synthetic construct
  source 1..25: note = Seed: LNVIVHSATGFKQSSKALQRPVASD
LNVIVHSATGLKQISGALARPVASD

SEQ ID NO: 5411 - protein, 25 aa, synthetic construct
  source 1..25: note = Seed: LNVIVHSATGFKQSSKALQRPVASD
LNVIVHSATGLKQISGALCRPVASD

SEQ ID NO: 5412 - protein, 25 aa, synthetic construct
  source 1..25: note = Seed: LNVIVHSATGFKQSSKALQRPVASD
LNVIVHSATGLKQISGALGRPVASD

SEQ ID NO: 5413 - protein, 25 aa, synthetic construct
  source 1..25: note = Seed: LNVIVHSATGFKQSSKALQRPVASD
LNVIVHSATGLKQISGALIRPVASD

SEQ ID NO: 5414 - protein, 25 aa, synthetic construct
  source 1..25: note = Seed: LNVIVHSATGFKQSSKALQRPVASD
LNVIVHSATGLKQISGALLRPVASD

SEQ ID NO: 5415 - protein, 25 aa, synthetic construct
  source 1..25: note = Seed: LNVIVHSATGFKQSSKALQRPVASD
LNVIVHSATGLKQISGALMRPVASD

SEQ ID NO: 5416 - protein, 25 aa, synthetic construct
  source 1..25: note = Seed: LNVIVHSATGFKQSSKALQRPVASD
LNVIVHSATGLKQISGALNRPVASD

SEQ ID NO: 5417 - protein, 25 aa, synthetic construct
  source 1..25: note = Seed: LNVIVHSATGFKQSSKALQRPVASD
LNVIVHSATGLKQISGALSRPVASD

SEQ ID NO: 5418 - protein, 25 aa, synthetic construct
  source 1..25: note = Seed: LNVIVHSATGFKQSSKALQRPVASD
LNVIVHSATGLKQISGALTRPVASD

SEQ ID NO: 5419 - protein, 25 aa, synthetic construct
  source 1..25: note = Seed: LNVIVHSATGFKQSSKALQRPVASD
LNVIVHSATGLKQISGALVRPVASD

SEQ ID NO: 5420 - protein, 25 aa, synthetic construct
  source 1..25: note = Seed: LNVIVHSATGFKQSSKALQRPVASD
LNVIVHSATGLKQISHALARPVASD

SEQ ID NO: 5421 - protein, 25 aa, synthetic construct
  source 1..25: note = Seed: LNVIVHSATGFKQSSKALQRPVASD
LNVIVHSATGLKQISHALIRPVASD

SEQ ID NO: 5422 - protein, 25 aa, synthetic construct
  source 1..25: note = Seed: LNVIVHSATGFKQSSKALQRPVASD
LNVIVHSATGLKQISHALKRPVASD

SEQ ID NO: 5423 - protein, 25 aa, synthetic construct
  source 1..25: note = Seed: LNVIVHSATGFKQSSKALQRPVASD
LNVIVHSATGLKQISHALRRPVASD

SEQ ID NO: 5424 - protein, 25 aa, synthetic construct
  source 1..25: note = Seed: LNVIVHSATGFKQSSKALQRPVASD
LNVIVHSATGLKQISHALSRPVASD

SEQ ID NO: 5425 - protein, 25 aa, synthetic construct
  source 1..25: note = Seed: LNVIVHSATGFKQSSKALQRPVASD
LNVIVHSATGLKQISHALVRPVASD

SEQ ID NO: 5426 - protein, 25 aa, synthetic construct
  source 1..25: note = Seed: LNVIVHSATGFKQSSKALQRPVASD
LNVIVHSATGLKQISIALARPVASD

SEQ ID NO: 5427 - protein, 25 aa, synthetic construct
  source 1..25: note = Seed: LNVIVHSATGFKQSSKALQRPVASD
LNVIVHSATGLKQISIALGRPVASD

SEQ ID NO: 5428 - protein, 25 aa, synthetic construct
  source 1..25: note = Seed: LNVIVHSATGFKQSSKALQRPVASD
LNVIVHSATGLKQISIALNRPVASD

SEQ ID NO: 5429 - protein, 25 aa, synthetic construct
  source 1..25: note = Seed: LNVIVHSATGFKQSSKALQRPVASD
LNVIVHSATGLKQISIALQRPVASD

SEQ ID NO: 5430 - protein, 25 aa, synthetic construct
  source 1..25: note = Seed: LNVIVHSATGFKQSSKALQRPVASD
LNVIVHSATGLKQISIALSRPVASD

SEQ ID NO: 5431 - protein, 25 aa, synthetic construct
  source 1..25: note = Seed: LNVIVHSATGFKQSSKALQRPVASD
LNVIVHSATGLKQISIALTRPVASD

SEQ ID NO: 5432 - protein, 25 aa, synthetic construct
  source 1..25: note = Seed: LNVIVHSATGFKQSSKALQRPVASD
LNVIVHSATGLKQISIALVRPVASD

SEQ ID NO: 5433 - protein, 25 aa, synthetic construct
  source 1..25: note = Seed: LNVIVHSATGFKQSSKALQRPVASD
LNVIVHSATGLKQISKALARPVASD

SEQ ID NO: 5434 - protein, 25 aa, synthetic construct
  source 1..25: note = Seed: LNVIVHSATGFKQSSKALQRPVASD
LNVIVHSATGLKQISKALCRPVASD

SEQ ID NO: 5435 - protein, 25 aa, synthetic construct
  source 1..25: note = Seed: LNVIVHSATGFKQSSKALQRPVASD
LNVIVHSATGLKQISKALFRPVASD

SEQ ID NO: 5436 - protein, 25 aa, synthetic construct
  source 1..25: note = Seed: LNVIVHSATGFKQSSKALQRPVASD
LNVIVHSATGLKQISKALGRPVASD

SEQ ID NO: 5437 - protein, 25 aa, synthetic construct
  source 1..25: note = Seed: LNVIVHSATGFKQSSKALQRPVASD
LNVIVHSATGLKQISKALHRPVASD

SEQ ID NO: 5438 - protein, 25 aa, synthetic construct
  source 1..25: note = Seed: LNVIVHSATGFKQSSKALQRPVASD
LNVIVHSATGLKQISKALIRPVASD

SEQ ID NO: 5439 - protein, 25 aa, synthetic construct
  source 1..25: note = Seed: LNVIVHSATGFKQSSKALQRPVASD
LNVIVHSATGLKQISKALKRPVASD

SEQ ID NO: 5440 - protein, 25 aa, synthetic construct
  source 1..25: note = Seed: LNVIVHSATGFKQSSKALQRPVASD
LNVIVHSATGLKQISKALLRPVASD

SEQ ID NO: 5441 - protein, 25 aa, synthetic construct
  source 1..25: note = Seed: LNVIVHSATGFKQSSKALQRPVASD
LNVIVHSATGLKQISKALMRPVASD

SEQ ID NO: 5442 - protein, 25 aa, synthetic construct
  source 1..25: note = Seed: LNVIVHSATGFKQSSKALQRPVASD
LNVIVHSATGLKQISKALNRPVASD

SEQ ID NO: 5443 - protein, 25 aa, synthetic construct
  source 1..25: note = Seed: LNVIVHSATGFKQSSKALQRPVASD
LNVIVHSATGLKQISKALPRPVASD

SEQ ID NO: 5444 - protein, 25 aa, synthetic construct
  source 1..25: note = Seed: LNVIVHSATGFKQSSKALQRPVASD
LNVIVHSATGLKQISKALQRPVASD

SEQ ID NO: 5445 - protein, 25 aa, synthetic construct
  source 1..25: note = Seed: LNVIVHSATGFKQSSKALQRPVASD
LNVIVHSATGLKQISKALRRPVASD

SEQ ID NO: 5446 - protein, 25 aa, synthetic construct
  source 1..25: note = Seed: LNVIVHSATGFKQSSKALQRPVASD
LNVIVHSATGLKQISKALSRPVASD

SEQ ID NO: 5447 - protein, 25 aa, synthetic construct
  source 1..25: note = Seed: LNVIVHSATGFKQSSKALQRPVASD
LNVIVHSATGLKQISKALTRPVASD

SEQ ID NO: 5448 - protein, 25 aa, synthetic construct
  source 1..25: note = Seed: LNVIVHSATGFKQSSKALQRPVASD
LNVIVHSATGLKQISKALVRPVASD

SEQ ID NO: 5449 - protein, 25 aa, synthetic construct
  source 1..25: note = Seed: LNVIVHSATGFKQSSKALQRPVASD
LNVIVHSATGLKQISKALYRPVASD

SEQ ID NO: 5450 - protein, 25 aa, synthetic construct
  source 1..25: note = Seed: LNVIVHSATGFKQSSKALQRPVASD
LNVIVHSATGLKQISLALGRPVASD

SEQ ID NO: 5451 - protein, 25 aa, synthetic construct
  source 1..25: note = Seed: LNVIVHSATGFKQSSKALQRPVASD
LNVIVHSATGLKQISLALIRPVASD

SEQ ID NO: 5452 - protein, 25 aa, synthetic construct
  source 1..25: note = Seed: LNVIVHSATGFKQSSKALQRPVASD
LNVIVHSATGLKQISLALMRPVASD

SEQ ID NO: 5453 - protein, 25 aa, synthetic construct
  source 1..25: note = Seed: LNVIVHSATGFKQSSKALQRPVASD
LNVIVHSATGLKQISLALNRPVASD

SEQ ID NO: 5454 - protein, 25 aa, synthetic construct
  source 1..25: note = Seed: LNVIVHSATGFKQSSKALQRPVASD
LNVIVHSATGLKQISLALSRPVASD

SEQ ID NO: 5455 - protein, 25 aa, synthetic construct
  source 1..25: note = Seed: LNVIVHSATGFKQSSKALQRPVASD
LNVIVHSATGLKQISLALVRPVASD

SEQ ID NO: 5456 - protein, 25 aa, synthetic construct
  source 1..25: note = Seed: LNVIVHSATGFKQSSKALQRPVASD
LNVIVHSATGLKQISMALNRPVASD

SEQ ID NO: 5457 - protein, 25 aa, synthetic construct
  source 1..25: note = Seed: LNVIVHSATGFKQSSKALQRPVASD
LNVIVHSATGLKQISNALARPVASD

SEQ ID NO: 5458 - protein, 25 aa, synthetic construct
  source 1..25: note = Seed: LNVIVHSATGFKQSSKALQRPVASD
LNVIVHSATGLKQISNALIRPVASD

SEQ ID NO: 5459 - protein, 25 aa, synthetic construct
  source 1..25: note = Seed: LNVIVHSATGFKQSSKALQRPVASD
LNVIVHSATGLKQISNALLRPVASD

SEQ ID NO: 5460 - protein, 25 aa, synthetic construct
  source 1..25: note = Seed: LNVIVHSATGFKQSSKALQRPVASD
LNVIVHSATGLKQISNALNRPVASD

SEQ ID NO: 5461 - protein, 25 aa, synthetic construct
  source 1..25: note = Seed: LNVIVHSATGFKQSSKALQRPVASD
LNVIVHSATGLKQISNALSRPVASD

SEQ ID NO: 5462 - protein, 25 aa, synthetic construct
  source 1..25: note = Seed: LNVIVHSATGFKQSSKALQRPVASD
LNVIVHSATGLKQISNALTRPVASD

SEQ ID NO: 5463 - protein, 25 aa, synthetic construct
  source 1..25: note = Seed: LNVIVHSATGFKQSSKALQRPVASD
LNVIVHSATGLKQISNALVRPVASD

SEQ ID NO: 5464 - protein, 25 aa, synthetic construct
  source 1..25: note = Seed: LNVIVHSATGFKQSSKALQRPVASD
LNVIVHSATGLKQISPALARPVASD

SEQ ID NO: 5465 - protein, 25 aa, synthetic construct
  source 1..25: note = Seed: LNVIVHSATGFKQSSKALQRPVASD
LNVIVHSATGLKQISPALGRPVASD

SEQ ID NO: 5466 - protein, 25 aa, synthetic construct
  source 1..25: note = Seed: LNVIVHSATGFKQSSKALQRPVASD
LNVIVHSATGLKQISPALHRPVASD

SEQ ID NO: 5467 - protein, 25 aa, synthetic construct
  source 1..25: note = Seed: LNVIVHSATGFKQSSKALQRPVASD
LNVIVHSATGLKQISPALIRPVASD

SEQ ID NO: 5468 - protein, 25 aa, synthetic construct
  source 1..25: note = Seed: LNVIVHSATGFKQSSKALQRPVASD
LNVIVHSATGLKQISPALLRPVASD

SEQ ID NO: 5469 - protein, 25 aa, synthetic construct
  source 1..25: note = Seed: LNVIVHSATGFKQSSKALQRPVASD
LNVIVHSATGLKQISPALMRPVASD

SEQ ID NO: 5470 - protein, 25 aa, synthetic construct
  source 1..25: note = Seed: LNVIVHSATGFKQSSKALQRPVASD
LNVIVHSATGLKQISPALNRPVASD

SEQ ID NO: 5471 - protein, 25 aa, synthetic construct
  source 1..25: note = Seed: LNVIVHSATGFKQSSKALQRPVASD
LNVIVHSATGLKQISPALQRPVASD

SEQ ID NO: 5472 - protein, 25 aa, synthetic construct
  source 1..25: note = Seed: LNVIVHSATGFKQSSKALQRPVASD
LNVIVHSATGLKQISPALRRPVASD

SEQ ID NO: 5473 - protein, 25 aa, synthetic construct
  source 1..25: note = Seed: LNVIVHSATGFKQSSKALQRPVASD
LNVIVHSATGLKQISPALSRPVASD

SEQ ID NO: 5474 - protein, 25 aa, synthetic construct
  source 1..25: note = Seed: LNVIVHSATGFKQSSKALQRPVASD
LNVIVHSATGLKQISPALTRPVASD

SEQ ID NO: 5475 - protein, 25 aa, synthetic construct
  source 1..25: note = Seed: LNVIVHSATGFKQSSKALQRPVASD
LNVIVHSATGLKQISPALVRPVASD

SEQ ID NO: 5476 - protein, 25 aa, synthetic construct
  source 1..25: note = Seed: LNVIVHSATGFKQSSKALQRPVASD
LNVIVHSATGLKQISRALARPVASD

SEQ ID NO: 5477 - protein, 25 aa, synthetic construct
  source 1..25: note = Seed: LNVIVHSATGFKQSSKALQRPVASD
LNVIVHSATGLKQISRALCRPVASD

SEQ ID NO: 5478 - protein, 25 aa, synthetic construct
  source 1..25: note = Seed: LNVIVHSATGFKQSSKALQRPVASD
LNVIVHSATGLKQISRALERPVASD

SEQ ID NO: 5479 - protein, 25 aa, synthetic construct
  source 1..25: note = Seed: LNVIVHSATGFKQSSKALQRPVASD
LNVIVHSATGLKQISRALFRPVASD

SEQ ID NO: 5480 - protein, 25 aa, synthetic construct
  source 1..25: note = Seed: LNVIVHSATGFKQSSKALQRPVASD
LNVIVHSATGLKQISRALGRPVASD

SEQ ID NO: 5481 - protein, 25 aa, synthetic construct
  source 1..25: note = Seed: LNVIVHSATGFKQSSKALQRPVASD
LNVIVHSATGLKQISRALHRPVASD

SEQ ID NO: 5482 - protein, 25 aa, synthetic construct
  source 1..25: note = Seed: LNVIVHSATGFKQSSKALQRPVASD
LNVIVHSATGLKQISRALIRPVASD

SEQ ID NO: 5483 - protein, 25 aa, synthetic construct
  source 1..25: note = Seed: LNVIVHSATGFKQSSKALQRPVASD
LNVIVHSATGLKQISRALKRPVASD

SEQ ID NO: 5484 - protein, 25 aa, synthetic construct
  source 1..25: note = Seed: LNVIVHSATGFKQSSKALQRPVASD
LNVIVHSATGLKQISRALLRPVASD

SEQ ID NO: 5485 - protein, 25 aa, synthetic construct
  source 1..25: note = Seed: LNVIVHSATGFKQSSKALQRPVASD
LNVIVHSATGLKQISRALMRPVASD

SEQ ID NO: 5486 - protein, 25 aa, synthetic construct
  source 1..25: note = Seed: LNVIVHSATGFKQSSKALQRPVASD
LNVIVHSATGLKQISRALNRPVASD

SEQ ID NO: 5487 - protein, 25 aa, synthetic construct
  source 1..25: note = Seed: LNVIVHSATGFKQSSKALQRPVASD
LNVIVHSATGLKQISRALPRPVASD

SEQ ID NO: 5488 - protein, 25 aa, synthetic construct
  source 1..25: note = Seed: LNVIVHSATGFKQSSKALQRPVASD
LNVIVHSATGLKQISRALQRPVASD

SEQ ID NO: 5489 - protein, 25 aa, synthetic construct
  source 1..25: note = Seed: LNVIVHSATGFKQSSKALQRPVASD
LNVIVHSATGLKQISRALRRPVASD

SEQ ID NO: 5490 - protein, 25 aa, synthetic construct
  source 1..25: note = Seed: LNVIVHSATGFKQSSKALQRPVASD
LNVIVHSATGLKQISRALSRPVASD

SEQ ID NO: 5491 - protein, 25 aa, synthetic construct
  source 1..25: note = Seed: LNVIVHSATGFKQSSKALQRPVASD
LNVIVHSATGLKQISRALTRPVASD

SEQ ID NO: 5492 - protein, 25 aa, synthetic construct
  source 1..25: note = Seed: LNVIVHSATGFKQSSKALQRPVASD
LNVIVHSATGLKQISRALVRPVASD

SEQ ID NO: 5493 - protein, 25 aa, synthetic construct
  source 1..25: note = Seed: LNVIVHSATGFKQSSKALQRPVASD
LNVIVHSATGLKQISRALWRPVASD

SEQ ID NO: 5494 - protein, 25 aa, synthetic construct
  source 1..25: note = Seed: LNVIVHSATGFKQSSKALQRPVASD
LNVIVHSATGLKQISRALYRPVASD

SEQ ID NO: 5495 - protein, 25 aa, synthetic construct
  source 1..25: note = Seed: LNVIVHSATGFKQSSKALQRPVASD
LNVIVHSATGLKQISSALARPVASD

SEQ ID NO: 5496 - protein, 25 aa, synthetic construct
  source 1..25: note = Seed: LNVIVHSATGFKQSSKALQRPVASD
LNVIVHSATGLKQISSALCRPVASD

SEQ ID NO: 5497 - protein, 25 aa, synthetic construct
  source 1..25: note = Seed: LNVIVHSATGFKQSSKALQRPVASD
LNVIVHSATGLKQISSALGRPVASD

SEQ ID NO: 5498 - protein, 25 aa, synthetic construct
  source 1..25: note = Seed: LNVIVHSATGFKQSSKALQRPVASD
LNVIVHSATGLKQISSALIRPVASD

SEQ ID NO: 5499 - protein, 25 aa, synthetic construct
  source 1..25: note = Seed: LNVIVHSATGFKQSSKALQRPVASD
LNVIVHSATGLKQISSALLRPVASD

SEQ ID NO: 5500 - protein, 25 aa, synthetic construct
  source 1..25: note = Seed: LNVIVHSATGFKQSSKALQRPVASD
LNVIVHSATGLKQISSALMRPVASD

SEQ ID NO: 5501 - protein, 25 aa, synthetic construct
  source 1..25: note = Seed: LNVIVHSATGFKQSSKALQRPVASD
LNVIVHSATGLKQISSALNRPVASD

SEQ ID NO: 5502 - protein, 25 aa, synthetic construct
  source 1..25: note = Seed: LNVIVHSATGFKQSSKALQRPVASD
LNVIVHSATGLKQISSALRRPVASD

SEQ ID NO: 5503 - protein, 25 aa, synthetic construct
  source 1..25: note = Seed: LNVIVHSATGFKQSSKALQRPVASD
LNVIVHSATGLKQISSALSRPVASD

SEQ ID NO: 5504 - protein, 25 aa, synthetic construct
  source 1..25: note = Seed: LNVIVHSATGFKQSSKALQRPVASD
LNVIVHSATGLKQISSALTRPVASD

SEQ ID NO: 5505 - protein, 25 aa, synthetic construct
  source 1..25: note = Seed: LNVIVHSATGFKQSSKALQRPVASD
LNVIVHSATGLKQISSALVRPVASD

SEQ ID NO: 5506 - protein, 25 aa, synthetic construct
  source 1..25: note = Seed: LNVIVHSATGFKQSSKALQRPVASD
LNVIVHSATGLKQISTALARPVASD

SEQ ID NO: 5507 - protein, 25 aa, synthetic construct
  source 1..25: note = Seed: LNVIVHSATGFKQSSKALQRPVASD
LNVIVHSATGLKQISTALGRPVASD

SEQ ID NO: 5508 - protein, 25 aa, synthetic construct
  source 1..25: note = Seed: LNVIVHSATGFKQSSKALQRPVASD
LNVIVHSATGLKQISTALIRPVASD

SEQ ID NO: 5509 - protein, 25 aa, synthetic construct
  source 1..25: note = Seed: LNVIVHSATGFKQSSKALQRPVASD
LNVIVHSATGLKQISTALLRPVASD

SEQ ID NO: 5510 - protein, 25 aa, synthetic construct
  source 1..25: note = Seed: LNVIVHSATGFKQSSKALQRPVASD
LNVIVHSATGLKQISTALMRPVASD

SEQ ID NO: 5511 - protein, 25 aa, synthetic construct
  source 1..25: note = Seed: LNVIVHSATGFKQSSKALQRPVASD
LNVIVHSATGLKQISTALNRPVASD

SEQ ID NO: 5512 - protein, 25 aa, synthetic construct
  source 1..25: note = Seed: LNVIVHSATGFKQSSKALQRPVASD
LNVIVHSATGLKQISTALRRPVASD

SEQ ID NO: 5513 - protein, 25 aa, synthetic construct
  source 1..25: note = Seed: LNVIVHSATGFKQSSKALQRPVASD
LNVIVHSATGLKQISTALSRPVASD

SEQ ID NO: 5514 - protein, 25 aa, synthetic construct
  source 1..25: note = Seed: LNVIVHSATGFKQSSKALQRPVASD
LNVIVHSATGLKQISTALTRPVASD

SEQ ID NO: 5515 - protein, 25 aa, synthetic construct
  source 1..25: note = Seed: LNVIVHSATGFKQSSKALQRPVASD
LNVIVHSATGLKQISTALVRPVASD

SEQ ID NO: 5516 - protein, 25 aa, synthetic construct
  source 1..25: note = Seed: LNVIVHSATGFKQSSKALQRPVASD
LNVIVHSATGLKQISVALARPVASD

SEQ ID NO: 5517 - protein, 25 aa, synthetic construct
  source 1..25: note = Seed: LNVIVHSATGFKQSSKALQRPVASD
LNVIVHSATGLKQISVALGRPVASD

SEQ ID NO: 5518 - protein, 25 aa, synthetic construct
  source 1..25: note = Seed: LNVIVHSATGFKQSSKALQRPVASD
LNVIVHSATGLKQISVALHRPVASD

SEQ ID NO: 5519 - protein, 25 aa, synthetic construct
  source 1..25: note = Seed: LNVIVHSATGFKQSSKALQRPVASD
LNVIVHSATGLKQISVALIRPVASD

SEQ ID NO: 5520 - protein, 25 aa, synthetic construct
  source 1..25: note = Seed: LNVIVHSATGFKQSSKALQRPVASD
LNVIVHSATGLKQISVALLRPVASD

SEQ ID NO: 5521 - protein, 25 aa, synthetic construct
  source 1..25: note = Seed: LNVIVHSATGFKQSSKALQRPVASD
LNVIVHSATGLKQISVALMRPVASD

SEQ ID NO: 5522 - protein, 25 aa, synthetic construct
  source 1..25: note = Seed: LNVIVHSATGFKQSSKALQRPVASD
LNVIVHSATGLKQISVALNRPVASD

SEQ ID NO: 5523 - protein, 25 aa, synthetic construct
  source 1..25: note = Seed: LNVIVHSATGFKQSSKALQRPVASD
LNVIVHSATGLKQISVALQRPVASD

SEQ ID NO: 5524 - protein, 25 aa, synthetic construct
  source 1..25: note = Seed: LNVIVHSATGFKQSSKALQRPVASD
LNVIVHSATGLKQISVALRRPVASD

SEQ ID NO: 5525 - protein, 25 aa, synthetic construct
  source 1..25: note = Seed: LNVIVHSATGFKQSSKALQRPVASD
LNVIVHSATGLKQISVALSRPVASD

SEQ ID NO: 5526 - protein, 25 aa, synthetic construct
  source 1..25: note = Seed: LNVIVHSATGFKQSSKALQRPVASD
LNVIVHSATGLKQISVALTRPVASD

SEQ ID NO: 5527 - protein, 25 aa, synthetic construct
  source 1..25: note = Seed: LNVIVHSATGFKQSSKALQRPVASD
LNVIVHSATGLKQISVALVRPVASD

SEQ ID NO: 5528 - protein, 25 aa, synthetic construct
  source 1..25: note = Seed: LNVIVHSATGFKQSSKALQRPVASD
LNVIVHSATGLKQKSIALRRPVASD

SEQ ID NO: 5529 - protein, 25 aa, synthetic construct
  source 1..25: note = Seed: LNVIVHSATGFKQSSKALQRPVASD
LNVIVHSATGLKQKSKALARPVASD

SEQ ID NO: 5530 - protein, 25 aa, synthetic construct
  source 1..25: note = Seed: LNVIVHSATGFKQSSKALQRPVASD
LNVIVHSATGLKQKSKALRRPVASD

SEQ ID NO: 5531 - protein, 25 aa, synthetic construct
  source 1..25: note = Seed: LNVIVHSATGFKQSSKALQRPVASD
LNVIVHSATGLKQKSKALYRPVASD

SEQ ID NO: 5532 - protein, 25 aa, synthetic construct
  source 1..25: note = Seed: LNVIVHSATGFKQSSKALQRPVASD
LNVIVHSATGLKQKSRALARPVASD

SEQ ID NO: 5533 - protein, 25 aa, synthetic construct
  source 1..25: note = Seed: LNVIVHSATGFKQSSKALQRPVASD
LNVIVHSATGLKQKSRALFRPVASD

SEQ ID NO: 5534 - protein, 25 aa, synthetic construct
  source 1..25: note = Seed: LNVIVHSATGFKQSSKALQRPVASD
LNVIVHSATGLKQKSRALKRPVASD

SEQ ID NO: 5535 - protein, 25 aa, synthetic construct
  source 1..25: note = Seed: LNVIVHSATGFKQSSKALQRPVASD
LNVIVHSATGLKQKSRALLRPVASD

SEQ ID NO: 5536 - protein, 25 aa, synthetic construct
  source 1..25: note = Seed: LNVIVHSATGFKQSSKALQRPVASD
LNVIVHSATGLKQKSRALRRPVASD

SEQ ID NO: 5537 - protein, 25 aa, synthetic construct
  source 1..25: note = Seed: LNVIVHSATGFKQSSKALQRPVASD
LNVIVHSATGLKQKSRALSRPVASD

SEQ ID NO: 5538 - protein, 25 aa, synthetic construct
  source 1..25: note = Seed: LNVIVHSATGFKQSSKALQRPVASD
LNVIVHSATGLKQKSRALYRPVASD

SEQ ID NO: 5539 - protein, 25 aa, synthetic construct
  source 1..25: note = Seed: LNVIVHSATGFKQSSKALQRPVASD
LNVIVHSATGLKQLSAALARPVASD

SEQ ID NO: 5540 - protein, 25 aa, synthetic construct
  source 1..25: note = Seed: LNVIVHSATGFKQSSKALQRPVASD
LNVIVHSATGLKQLSAALCRPVASD

SEQ ID NO: 5541 - protein, 25 aa, synthetic construct
  source 1..25: note = Seed: LNVIVHSATGFKQSSKALQRPVASD
LNVIVHSATGLKQLSAALDRPVASD

SEQ ID NO: 5542 - protein, 25 aa, synthetic construct
  source 1..25: note = Seed: LNVIVHSATGFKQSSKALQRPVASD
LNVIVHSATGLKQLSAALFRPVASD

SEQ ID NO: 5543 - protein, 25 aa, synthetic construct
  source 1..25: note = Seed: LNVIVHSATGFKQSSKALQRPVASD
LNVIVHSATGLKQLSAALGRPVASD

SEQ ID NO: 5544 - protein, 25 aa, synthetic construct
  source 1..25: note = Seed: LNVIVHSATGFKQSSKALQRPVASD
LNVIVHSATGLKQLSAALHRPVASD

SEQ ID NO: 5545 - protein, 25 aa, synthetic construct
  source 1..25: note = Seed: LNVIVHSATGFKQSSKALQRPVASD
LNVIVHSATGLKQLSAALIRPVASD

SEQ ID NO: 5546 - protein, 25 aa, synthetic construct
  source 1..25: note = Seed: LNVIVHSATGFKQSSKALQRPVASD
LNVIVHSATGLKQLSAALLRPVASD

SEQ ID NO: 5547 - protein, 25 aa, synthetic construct
  source 1..25: note = Seed: LNVIVHSATGFKQSSKALQRPVASD
LNVIVHSATGLKQLSAALMRPVASD

SEQ ID NO: 5548 - protein, 25 aa, synthetic construct
  source 1..25: note = Seed: LNVIVHSATGFKQSSKALQRPVASD
LNVIVHSATGLKQLSAALNRPVASD

SEQ ID NO: 5549 - protein, 25 aa, synthetic construct
  source 1..25: note = Seed: LNVIVHSATGFKQSSKALQRPVASD
LNVIVHSATGLKQLSAALPRPVASD

SEQ ID NO: 5550 - protein, 25 aa, synthetic construct
  source 1..25: note = Seed: LNVIVHSATGFKQSSKALQRPVASD
LNVIVHSATGLKQLSAALQRPVASD

SEQ ID NO: 5551 - protein, 25 aa, synthetic construct
  source 1..25: note = Seed: LNVIVHSATGFKQSSKALQRPVASD
LNVIVHSATGLKQLSAALSRPVASD

SEQ ID NO: 5552 - protein, 25 aa, synthetic construct
  source 1..25: note = Seed: LNVIVHSATGFKQSSKALQRPVASD
LNVIVHSATGLKQLSAALTRPVASD

SEQ ID NO: 5553 - protein, 25 aa, synthetic construct
  source 1..25: note = Seed: LNVIVHSATGFKQSSKALQRPVASD
LNVIVHSATGLKQLSAALVRPVASD

SEQ ID NO: 5554 - protein, 25 aa, synthetic construct
  source 1..25: note = Seed: LNVIVHSATGFKQSSKALQRPVASD
LNVIVHSATGLKQLSAALYRPVASD

SEQ ID NO: 5555 - protein, 25 aa, synthetic construct
  source 1..25: note = Seed: LNVIVHSATGFKQSSKALQRPVASD
LNVIVHSATGLKQLSEALARPVASD

SEQ ID NO: 5556 - protein, 25 aa, synthetic construct
  source 1..25: note = Seed: LNVIVHSATGFKQSSKALQRPVASD
LNVIVHSATGLKQLSFALVRPVASD

SEQ ID NO: 5557 - protein, 25 aa, synthetic construct
  source 1..25: note = Seed: LNVIVHSATGFKQSSKALQRPVASD
LNVIVHSATGLKQLSGALARPVASD

SEQ ID NO: 5558 - protein, 25 aa, synthetic construct
  source 1..25: note = Seed: LNVIVHSATGFKQSSKALQRPVASD
LNVIVHSATGLKQLSGALCRPVASD

SEQ ID NO: 5559 - protein, 25 aa, synthetic construct
  source 1..25: note = Seed: LNVIVHSATGFKQSSKALQRPVASD
LNVIVHSATGLKQLSGALFRPVASD

SEQ ID NO: 5560 - protein, 25 aa, synthetic construct
  source 1..25: note = Seed: LNVIVHSATGFKQSSKALQRPVASD
LNVIVHSATGLKQLSGALGRPVASD

SEQ ID NO: 5561 - protein, 25 aa, synthetic construct
  source 1..25: note = Seed: LNVIVHSATGFKQSSKALQRPVASD
LNVIVHSATGLKQLSGALHRPVASD

SEQ ID NO: 5562 - protein, 25 aa, synthetic construct
  source 1..25: note = Seed: LNVIVHSATGFKQSSKALQRPVASD
LNVIVHSATGLKQLSGALIRPVASD

SEQ ID NO: 5563 - protein, 25 aa, synthetic construct
  source 1..25: note = Seed: LNVIVHSATGFKQSSKALQRPVASD
LNVIVHSATGLKQLSGALLRPVASD

SEQ ID NO: 5564 - protein, 25 aa, synthetic construct
  source 1..25: note = Seed: LNVIVHSATGFKQSSKALQRPVASD
LNVIVHSATGLKQLSGALMRPVASD

SEQ ID NO: 5565 - protein, 25 aa, synthetic construct
  source 1..25: note = Seed: LNVIVHSATGFKQSSKALQRPVASD
LNVIVHSATGLKQLSGALNRPVASD

SEQ ID NO: 5566 - protein, 25 aa, synthetic construct
  source 1..25: note = Seed: LNVIVHSATGFKQSSKALQRPVASD
LNVIVHSATGLKQLSGALPRPVASD

SEQ ID NO: 5567 - protein, 25 aa, synthetic construct
  source 1..25: note = Seed: LNVIVHSATGFKQSSKALQRPVASD
LNVIVHSATGLKQLSGALSRPVASD

SEQ ID NO: 5568 - protein, 25 aa, synthetic construct
  source 1..25: note = Seed: LNVIVHSATGFKQSSKALQRPVASD
LNVIVHSATGLKQLSGALTRPVASD

SEQ ID NO: 5569 - protein, 25 aa, synthetic construct
  source 1..25: note = Seed: LNVIVHSATGFKQSSKALQRPVASD
LNVIVHSATGLKQLSGALVRPVASD

SEQ ID NO: 5570 - protein, 25 aa, synthetic construct
  source 1..25: note = Seed: LNVIVHSATGFKQSSKALQRPVASD
LNVIVHSATGLKQLSHALARPVASD

SEQ ID NO: 5571 - protein, 25 aa, synthetic construct
  source 1..25: note = Seed: LNVIVHSATGFKQSSKALQRPVASD
LNVIVHSATGLKQLSHALIRPVASD

SEQ ID NO: 5572 - protein, 25 aa, synthetic construct
  source 1..25: note = Seed: LNVIVHSATGFKQSSKALQRPVASD
LNVIVHSATGLKQLSHALKRPVASD

SEQ ID NO: 5573 - protein, 25 aa, synthetic construct
  source 1..25: note = Seed: LNVIVHSATGFKQSSKALQRPVASD
LNVIVHSATGLKQLSHALRRPVASD

SEQ ID NO: 5574 - protein, 25 aa, synthetic construct
  source 1..25: note = Seed: LNVIVHSATGFKQSSKALQRPVASD
LNVIVHSATGLKQLSHALSRPVASD

SEQ ID NO: 5575 - protein, 25 aa, synthetic construct
  source 1..25: note = Seed: LNVIVHSATGFKQSSKALQRPVASD
LNVIVHSATGLKQLSHALVRPVASD

SEQ ID NO: 5576 - protein, 25 aa, synthetic construct
  source 1..25: note = Seed: LNVIVHSATGFKQSSKALQRPVASD
LNVIVHSATGLKQLSIALARPVASD

SEQ ID NO: 5577 - protein, 25 aa, synthetic construct
  source 1..25: note = Seed: LNVIVHSATGFKQSSKALQRPVASD
LNVIVHSATGLKQLSIALGRPVASD

SEQ ID NO: 5578 - protein, 25 aa, synthetic construct
  source 1..25: note = Seed: LNVIVHSATGFKQSSKALQRPVASD
LNVIVHSATGLKQLSIALHRPVASD

SEQ ID NO: 5579 - protein, 25 aa, synthetic construct
  source 1..25: note = Seed: LNVIVHSATGFKQSSKALQRPVASD
LNVIVHSATGLKQLSIALIRPVASD

SEQ ID NO: 5580 - protein, 25 aa, synthetic construct
  source 1..25: note = Seed: LNVIVHSATGFKQSSKALQRPVASD
LNVIVHSATGLKQLSIALLRPVASD

SEQ ID NO: 5581 - protein, 25 aa, synthetic construct
  source 1..25: note = Seed: LNVIVHSATGFKQSSKALQRPVASD
LNVIVHSATGLKQLSIALMRPVASD

SEQ ID NO: 5582 - protein, 25 aa, synthetic construct
  source 1..25: note = Seed: LNVIVHSATGFKQSSKALQRPVASD
LNVIVHSATGLKQLSIALNRPVASD

SEQ ID NO: 5583 - protein, 25 aa, synthetic construct
  source 1..25: note = Seed: LNVIVHSATGFKQSSKALQRPVASD
LNVIVHSATGLKQLSIALQRPVASD

SEQ ID NO: 5584 - protein, 25 aa, synthetic construct
  source 1..25: note = Seed: LNVIVHSATGFKQSSKALQRPVASD
LNVIVHSATGLKQLSIALRRPVASD

SEQ ID NO: 5585 - protein, 25 aa, synthetic construct
  source 1..25: note = Seed: LNVIVHSATGFKQSSKALQRPVASD
LNVIVHSATGLKQLSIALSRPVASD

SEQ ID NO: 5586 - protein, 25 aa, synthetic construct
  source 1..25: note = Seed: LNVIVHSATGFKQSSKALQRPVASD
LNVIVHSATGLKQLSIALTRPVASD

SEQ ID NO: 5587 - protein, 25 aa, synthetic construct
  source 1..25: note = Seed: LNVIVHSATGFKQSSKALQRPVASD
LNVIVHSATGLKQLSIALVRPVASD

SEQ ID NO: 5588 - protein, 25 aa, synthetic construct
  source 1..25: note = Seed: LNVIVHSATGFKQSSKALQRPVASD
LNVIVHSATGLKQLSKALARPVASD

SEQ ID NO: 5589 - protein, 25 aa, synthetic construct
  source 1..25: note = Seed: LNVIVHSATGFKQSSKALQRPVASD
LNVIVHSATGLKQLSKALCRPVASD

SEQ ID NO: 5590 - protein, 25 aa, synthetic construct
  source 1..25: note = Seed: LNVIVHSATGFKQSSKALQRPVASD
LNVIVHSATGLKQLSKALFRPVASD

SEQ ID NO: 5591 - protein, 25 aa, synthetic construct
  source 1..25: note = Seed: LNVIVHSATGFKQSSKALQRPVASD
LNVIVHSATGLKQLSKALGRPVASD

SEQ ID NO: 5592 - protein, 25 aa, synthetic construct
  source 1..25: note = Seed: LNVIVHSATGFKQSSKALQRPVASD
LNVIVHSATGLKQLSKALHRPVASD

SEQ ID NO: 5593 - protein, 25 aa, synthetic construct
  source 1..25: note = Seed: LNVIVHSATGFKQSSKALQRPVASD
LNVIVHSATGLKQLSKALIRPVASD

SEQ ID NO: 5594 - protein, 25 aa, synthetic construct
  source 1..25: note = Seed: LNVIVHSATGFKQSSKALQRPVASD
LNVIVHSATGLKQLSKALKRPVASD

SEQ ID NO: 5595 - protein, 25 aa, synthetic construct
  source 1..25: note = Seed: LNVIVHSATGFKQSSKALQRPVASD
LNVIVHSATGLKQLSKALLRPVASD

SEQ ID NO: 5596 - protein, 25 aa, synthetic construct
  source 1..25: note = Seed: LNVIVHSATGFKQSSKALQRPVASD
LNVIVHSATGLKQLSKALMRPVASD

SEQ ID NO: 5597 - protein, 25 aa, synthetic construct
  source 1..25: note = Seed: LNVIVHSATGFKQSSKALQRPVASD
LNVIVHSATGLKQLSKALNRPVASD

SEQ ID NO: 5598 - protein, 25 aa, synthetic construct
  source 1..25: note = Seed: LNVIVHSATGFKQSSKALQRPVASD
LNVIVHSATGLKQLSKALPRPVASD

SEQ ID NO: 5599 - protein, 25 aa, synthetic construct
  source 1..25: note = Seed: LNVIVHSATGFKQSSKALQRPVASD
LNVIVHSATGLKQLSKALQRPVASD

SEQ ID NO: 5600 - protein, 25 aa, synthetic construct
  source 1..25: note = Seed: LNVIVHSATGFKQSSKALQRPVASD
LNVIVHSATGLKQLSKALRRPVASD

SEQ ID NO: 5601 - protein, 25 aa, synthetic construct
  source 1..25: note = Seed: LNVIVHSATGFKQSSKALQRPVASD
LNVIVHSATGLKQLSKALSRPVASD

SEQ ID NO: 5602 - protein, 25 aa, synthetic construct
  source 1..25: note = Seed: LNVIVHSATGFKQSSKALQRPVASD
LNVIVHSATGLKQLSKALTRPVASD

SEQ ID NO: 5603 - protein, 25 aa, synthetic construct
  source 1..25: note = Seed: LNVIVHSATGFKQSSKALQRPVASD
LNVIVHSATGLKQLSKALVRPVASD

SEQ ID NO: 5604 - protein, 25 aa, synthetic construct
  source 1..25: note = Seed: LNVIVHSATGFKQSSKALQRPVASD
LNVIVHSATGLKQLSKALYRPVASD

SEQ ID NO: 5605 - protein, 25 aa, synthetic construct
  source 1..25: note = Seed: LNVIVHSATGFKQSSKALQRPVASD
LNVIVHSATGLKQLSLALARPVASD

SEQ ID NO: 5606 - protein, 25 aa, synthetic construct
  source 1..25: note = Seed: LNVIVHSATGFKQSSKALQRPVASD
LNVIVHSATGLKQLSLALGRPVASD

SEQ ID NO: 5607 - protein, 25 aa, synthetic construct
  source 1..25: note = Seed: LNVIVHSATGFKQSSKALQRPVASD
LNVIVHSATGLKQLSLALHRPVASD

SEQ ID NO: 5608 - protein, 25 aa, synthetic construct
  source 1..25: note = Seed: LNVIVHSATGFKQSSKALQRPVASD
LNVIVHSATGLKQLSLALIRPVASD

SEQ ID NO: 5609 - protein, 25 aa, synthetic construct
  source 1..25: note = Seed: LNVIVHSATGFKQSSKALQRPVASD
LNVIVHSATGLKQLSLALMRPVASD

SEQ ID NO: 5610 - protein, 25 aa, synthetic construct
  source 1..25: note = Seed: LNVIVHSATGFKQSSKALQRPVASD
LNVIVHSATGLKQLSLALNRPVASD

SEQ ID NO: 5611 - protein, 25 aa, synthetic construct
  source 1..25: note = Seed: LNVIVHSATGFKQSSKALQRPVASD
LNVIVHSATGLKQLSLALQRPVASD

SEQ ID NO: 5612 - protein, 25 aa, synthetic construct
  source 1..25: note = Seed: LNVIVHSATGFKQSSKALQRPVASD
LNVIVHSATGLKQLSLALRRPVASD

SEQ ID NO: 5613 - protein, 25 aa, synthetic construct
  source 1..25: note = Seed: LNVIVHSATGFKQSSKALQRPVASD
LNVIVHSATGLKQLSLALSRPVASD

SEQ ID NO: 5614 - protein, 25 aa, synthetic construct
  source 1..25: note = Seed: LNVIVHSATGFKQSSKALQRPVASD
LNVIVHSATGLKQLSLALTRPVASD

SEQ ID NO: 5615 - protein, 25 aa, synthetic construct
  source 1..25: note = Seed: LNVIVHSATGFKQSSKALQRPVASD
LNVIVHSATGLKQLSLALVRPVASD

SEQ ID NO: 5616 - protein, 25 aa, synthetic construct
  source 1..25: note = Seed: LNVIVHSATGFKQSSKALQRPVASD
LNVIVHSATGLKQLSMALGRPVASD

SEQ ID NO: 5617 - protein, 25 aa, synthetic construct
  source 1..25: note = Seed: LNVIVHSATGFKQSSKALQRPVASD
LNVIVHSATGLKQLSMALIRPVASD

SEQ ID NO: 5618 - protein, 25 aa, synthetic construct
  source 1..25: note = Seed: LNVIVHSATGFKQSSKALQRPVASD
LNVIVHSATGLKQLSMALLRPVASD

SEQ ID NO: 5619 - protein, 25 aa, synthetic construct
  source 1..25: note = Seed: LNVIVHSATGFKQSSKALQRPVASD
LNVIVHSATGLKQLSMALMRPVASD

SEQ ID NO: 5620 - protein, 25 aa, synthetic construct
  source 1..25: note = Seed: LNVIVHSATGFKQSSKALQRPVASD
LNVIVHSATGLKQLSMALNRPVASD

SEQ ID NO: 5621 - protein, 25 aa, synthetic construct
  source 1..25: note = Seed: LNVIVHSATGFKQSSKALQRPVASD
LNVIVHSATGLKQLSMALSRPVASD

SEQ ID NO: 5622 - protein, 25 aa, synthetic construct
  source 1..25: note = Seed: LNVIVHSATGFKQSSKALQRPVASD
LNVIVHSATGLKQLSNALARPVASD

SEQ ID NO: 5623 - protein, 25 aa, synthetic construct
  source 1..25: note = Seed: LNVIVHSATGFKQSSKALQRPVASD
LNVIVHSATGLKQLSNALCRPVASD

SEQ ID NO: 5624 - protein, 25 aa, synthetic construct
  source 1..25: note = Seed: LNVIVHSATGFKQSSKALQRPVASD
LNVIVHSATGLKQLSNALGRPVASD

SEQ ID NO: 5625 - protein, 25 aa, synthetic construct
  source 1..25: note = Seed: LNVIVHSATGFKQSSKALQRPVASD
LNVIVHSATGLKQLSNALIRPVASD

SEQ ID NO: 5626 - protein, 25 aa, synthetic construct
  source 1..25: note = Seed: LNVIVHSATGFKQSSKALQRPVASD
LNVIVHSATGLKQLSNALLRPVASD

SEQ ID NO: 5627 - protein, 25 aa, synthetic construct
  source 1..25: note = Seed: LNVIVHSATGFKQSSKALQRPVASD
LNVIVHSATGLKQLSNALMRPVASD

SEQ ID NO: 5628 - protein, 25 aa, synthetic construct
  source 1..25: note = Seed: LNVIVHSATGFKQSSKALQRPVASD
LNVIVHSATGLKQLSNALNRPVASD

SEQ ID NO: 5629 - protein, 25 aa, synthetic construct
  source 1..25: note = Seed: LNVIVHSATGFKQSSKALQRPVASD
LNVIVHSATGLKQLSNALRRPVASD

SEQ ID NO: 5630 - protein, 25 aa, synthetic construct
  source 1..25: note = Seed: LNVIVHSATGFKQSSKALQRPVASD
LNVIVHSATGLKQLSNALSRPVASD

SEQ ID NO: 5631 - protein, 25 aa, synthetic construct
  source 1..25: note = Seed: LNVIVHSATGFKQSSKALQRPVASD
LNVIVHSATGLKQLSNALTRPVASD

SEQ ID NO: 5632 - protein, 25 aa, synthetic construct
  source 1..25: note = Seed: LNVIVHSATGFKQSSKALQRPVASD
LNVIVHSATGLKQLSNALVRPVASD

SEQ ID NO: 5633 - protein, 25 aa, synthetic construct
  source 1..25: note = Seed: LNVIVHSATGFKQSSKALQRPVASD
LNVIVHSATGLKQLSPALARPVASD

SEQ ID NO: 5634 - protein, 25 aa, synthetic construct
  source 1..25: note = Seed: LNVIVHSATGFKQSSKALQRPVASD
LNVIVHSATGLKQLSPALCRPVASD

SEQ ID NO: 5635 - protein, 25 aa, synthetic construct
  source 1..25: note = Seed: LNVIVHSATGFKQSSKALQRPVASD
LNVIVHSATGLKQLSPALFRPVASD

SEQ ID NO: 5636 - protein, 25 aa, synthetic construct
  source 1..25: note = Seed: LNVIVHSATGFKQSSKALQRPVASD
LNVIVHSATGLKQLSPALGRPVASD

SEQ ID NO: 5637 - protein, 25 aa, synthetic construct
  source 1..25: note = Seed: LNVIVHSATGFKQSSKALQRPVASD
LNVIVHSATGLKQLSPALHRPVASD

SEQ ID NO: 5638 - protein, 25 aa, synthetic construct
  source 1..25: note = Seed: LNVIVHSATGFKQSSKALQRPVASD
LNVIVHSATGLKQLSPALIRPVASD

SEQ ID NO: 5639 - protein, 25 aa, synthetic construct
  source 1..25: note = Seed: LNVIVHSATGFKQSSKALQRPVASD
LNVIVHSATGLKQLSPALLRPVASD

SEQ ID NO: 5640 - protein, 25 aa, synthetic construct
  source 1..25: note = Seed: LNVIVHSATGFKQSSKALQRPVASD
LNVIVHSATGLKQLSPALMRPVASD

SEQ ID NO: 5641 - protein, 25 aa, synthetic construct
  source 1..25: note = Seed: LNVIVHSATGFKQSSKALQRPVASD
LNVIVHSATGLKQLSPALNRPVASD

SEQ ID NO: 5642 - protein, 25 aa, synthetic construct
  source 1..25: note = Seed: LNVIVHSATGFKQSSKALQRPVASD
LNVIVHSATGLKQLSPALPRPVASD

SEQ ID NO: 5643 - protein, 25 aa, synthetic construct
  source 1..25: note = Seed: LNVIVHSATGFKQSSKALQRPVASD
LNVIVHSATGLKQLSPALQRPVASD

SEQ ID NO: 5644 - protein, 25 aa, synthetic construct
  source 1..25: note = Seed: LNVIVHSATGFKQSSKALQRPVASD
LNVIVHSATGLKQLSPALSRPVASD

SEQ ID NO: 5645 - protein, 25 aa, synthetic construct
  source 1..25: note = Seed: LNVIVHSATGFKQSSKALQRPVASD
LNVIVHSATGLKQLSPALTRPVASD

SEQ ID NO: 5646 - protein, 25 aa, synthetic construct
  source 1..25: note = Seed: LNVIVHSATGFKQSSKALQRPVASD
LNVIVHSATGLKQLSPALVRPVASD

SEQ ID NO: 5647 - protein, 25 aa, synthetic construct
  source 1..25: note = Seed: LNVIVHSATGFKQSSKALQRPVASD
LNVIVHSATGLKQLSQALRRPVASD

SEQ ID NO: 5648 - protein, 25 aa, synthetic construct
  source 1..25: note = Seed: LNVIVHSATGFKQSSKALQRPVASD
LNVIVHSATGLKQLSQALVRPVASD

SEQ ID NO: 5649 - protein, 25 aa, synthetic construct
  source 1..25: note = Seed: LNVIVHSATGFKQSSKALQRPVASD
LNVIVHSATGLKQLSRALARPVASD

SEQ ID NO: 5650 - protein, 25 aa, synthetic construct
  source 1..25: note = Seed: LNVIVHSATGFKQSSKALQRPVASD
LNVIVHSATGLKQLSRALCRPVASD

SEQ ID NO: 5651 - protein, 25 aa, synthetic construct
  source 1..25: note = Seed: LNVIVHSATGFKQSSKALQRPVASD
LNVIVHSATGLKQLSRALERPVASD

SEQ ID NO: 5652 - protein, 25 aa, synthetic construct
  source 1..25: note = Seed: LNVIVHSATGFKQSSKALQRPVASD
LNVIVHSATGLKQLSRALFRPVASD

SEQ ID NO: 5653 - protein, 25 aa, synthetic construct
  source 1..25: note = Seed: LNVIVHSATGFKQSSKALQRPVASD
LNVIVHSATGLKQLSRALGRPVASD

SEQ ID NO: 5654 - protein, 25 aa, synthetic construct
  source 1..25: note = Seed: LNVIVHSATGFKQSSKALQRPVASD
LNVIVHSATGLKQLSRALHRPVASD

SEQ ID NO: 5655 - protein, 25 aa, synthetic construct
  source 1..25: note = Seed: LNVIVHSATGFKQSSKALQRPVASD
LNVIVHSATGLKQLSRALIRPVASD

SEQ ID NO: 5656 - protein, 25 aa, synthetic construct
  source 1..25: note = Seed: LNVIVHSATGFKQSSKALQRPVASD
LNVIVHSATGLKQLSRALKRPVASD

SEQ ID NO: 5657 - protein, 25 aa, synthetic construct
  source 1..25: note = Seed: LNVIVHSATGFKQSSKALQRPVASD
LNVIVHSATGLKQLSRALLRPVASD

SEQ ID NO: 5658 - protein, 25 aa, synthetic construct
  source 1..25: note = Seed: LNVIVHSATGFKQSSKALQRPVASD
LNVIVHSATGLKQLSRALMRPVASD

SEQ ID NO: 5659 - protein, 25 aa, synthetic construct
  source 1..25: note = Seed: LNVIVHSATGFKQSSKALQRPVASD
LNVIVHSATGLKQLSRALNRPVASD

SEQ ID NO: 5660 - protein, 25 aa, synthetic construct
  source 1..25: note = Seed: LNVIVHSATGFKQSSKALQRPVASD
LNVIVHSATGLKQLSRALPRPVASD

SEQ ID NO: 5661 - protein, 25 aa, synthetic construct
  source 1..25: note = Seed: LNVIVHSATGFKQSSKALQRPVASD
LNVIVHSATGLKQLSRALQRPVASD

SEQ ID NO: 5662 - protein, 25 aa, synthetic construct
  source 1..25: note = Seed: LNVIVHSATGFKQSSKALQRPVASD
LNVIVHSATGLKQLSRALRRPVASD

SEQ ID NO: 5663 - protein, 25 aa, synthetic construct
  source 1..25: note = Seed: LNVIVHSATGFKQSSKALQRPVASD
LNVIVHSATGLKQLSRALSRPVASD

SEQ ID NO: 5664 - protein, 25 aa, synthetic construct
  source 1..25: note = Seed: LNVIVHSATGFKQSSKALQRPVASD
LNVIVHSATGLKQLSRALTRPVASD

SEQ ID NO: 5665 - protein, 25 aa, synthetic construct
  source 1..25: note = Seed: LNVIVHSATGFKQSSKALQRPVASD
LNVIVHSATGLKQLSRALVRPVASD

SEQ ID NO: 5666 - protein, 25 aa, synthetic construct
  source 1..25: note = Seed: LNVIVHSATGFKQSSKALQRPVASD
LNVIVHSATGLKQLSRALWRPVASD

SEQ ID NO: 5667 - protein, 25 aa, synthetic construct
  source 1..25: note = Seed: LNVIVHSATGFKQSSKALQRPVASD
LNVIVHSATGLKQLSRALYRPVASD

SEQ ID NO: 5668 - protein, 25 aa, synthetic construct
  source 1..25: note = Seed: LNVIVHSATGFKQSSKALQRPVASD
LNVIVHSATGLKQLSSALARPVASD

SEQ ID NO: 5669 - protein, 25 aa, synthetic construct
  source 1..25: note = Seed: LNVIVHSATGFKQSSKALQRPVASD
LNVIVHSATGLKQLSSALCRPVASD

SEQ ID NO: 5670 - protein, 25 aa, synthetic construct
  source 1..25: note = Seed: LNVIVHSATGFKQSSKALQRPVASD
LNVIVHSATGLKQLSSALFRPVASD

SEQ ID NO: 5671 - protein, 25 aa, synthetic construct
  source 1..25: note = Seed: LNVIVHSATGFKQSSKALQRPVASD
LNVIVHSATGLKQLSSALGRPVASD

SEQ ID NO: 5672 - protein, 25 aa, synthetic construct
  source 1..25: note = Seed: LNVIVHSATGFKQSSKALQRPVASD
LNVIVHSATGLKQLSSALHRPVASD

SEQ ID NO: 5673 - protein, 25 aa, synthetic construct
  source 1..25: note = Seed: LNVIVHSATGFKQSSKALQRPVASD
LNVIVHSATGLKQLSSALIRPVASD

SEQ ID NO: 5674 - protein, 25 aa, synthetic construct
  source 1..25: note = Seed: LNVIVHSATGFKQSSKALQRPVASD
LNVIVHSATGLKQLSSALLRPVASD

SEQ ID NO: 5675 - protein, 25 aa, synthetic construct
  source 1..25: note = Seed: LNVIVHSATGFKQSSKALQRPVASD
LNVIVHSATGLKQLSSALMRPVASD

SEQ ID NO: 5676 - protein, 25 aa, synthetic construct
  source 1..25: note = Seed: LNVIVHSATGFKQSSKALQRPVASD
LNVIVHSATGLKQLSSALNRPVASD

SEQ ID NO: 5677 - protein, 25 aa, synthetic construct
  source 1..25: note = Seed: LNVIVHSATGFKQSSKALQRPVASD
LNVIVHSATGLKQLSSALPRPVASD

SEQ ID NO: 5678 - protein, 25 aa, synthetic construct
  source 1..25: note = Seed: LNVIVHSATGFKQSSKALQRPVASD
LNVIVHSATGLKQLSSALRRPVASD

SEQ ID NO: 5679 - protein, 25 aa, synthetic construct
  source 1..25: note = Seed: LNVIVHSATGFKQSSKALQRPVASD
LNVIVHSATGLKQLSSALSRPVASD

SEQ ID NO: 5680 - protein, 25 aa, synthetic construct
  source 1..25: note = Seed: LNVIVHSATGFKQSSKALQRPVASD
LNVIVHSATGLKQLSSALTRPVASD

SEQ ID NO: 5681 - protein, 25 aa, synthetic construct
  source 1..25: note = Seed: LNVIVHSATGFKQSSKALQRPVASD
LNVIVHSATGLKQLSSALVRPVASD

SEQ ID NO: 5682 - protein, 25 aa, synthetic construct
  source 1..25: note = Seed: LNVIVHSATGFKQSSKALQRPVASD
LNVIVHSATGLKQLSTALARPVASD

SEQ ID NO: 5683 - protein, 25 aa, synthetic construct
  source 1..25: note = Seed: LNVIVHSATGFKQSSKALQRPVASD
LNVIVHSATGLKQLSTALCRPVASD

SEQ ID NO: 5684 - protein, 25 aa, synthetic construct
  source 1..25: note = Seed: LNVIVHSATGFKQSSKALQRPVASD
LNVIVHSATGLKQLSTALGRPVASD

SEQ ID NO: 5685 - protein, 25 aa, synthetic construct
  source 1..25: note = Seed: LNVIVHSATGFKQSSKALQRPVASD
LNVIVHSATGLKQLSTALHRPVASD

SEQ ID NO: 5686 - protein, 25 aa, synthetic construct
  source 1..25: note = Seed: LNVIVHSATGFKQSSKALQRPVASD
LNVIVHSATGLKQLSTALIRPVASD

SEQ ID NO: 5687 - protein, 25 aa, synthetic construct
  source 1..25: note = Seed: LNVIVHSATGFKQSSKALQRPVASD
LNVIVHSATGLKQLSTALKRPVASD

SEQ ID NO: 5688 - protein, 25 aa, synthetic construct
  source 1..25: note = Seed: LNVIVHSATGFKQSSKALQRPVASD
LNVIVHSATGLKQLSTALLRPVASD

SEQ ID NO: 5689 - protein, 25 aa, synthetic construct
  source 1..25: note = Seed: LNVIVHSATGFKQSSKALQRPVASD
LNVIVHSATGLKQLSTALMRPVASD

SEQ ID NO: 5690 - protein, 25 aa, synthetic construct
  source 1..25: note = Seed: LNVIVHSATGFKQSSKALQRPVASD
LNVIVHSATGLKQLSTALNRPVASD

SEQ ID NO: 5691 - protein, 25 aa, synthetic construct
  source 1..25: note = Seed: LNVIVHSATGFKQSSKALQRPVASD
LNVIVHSATGLKQLSTALPRPVASD

SEQ ID NO: 5692 - protein, 25 aa, synthetic construct
  source 1..25: note = Seed: LNVIVHSATGFKQSSKALQRPVASD
LNVIVHSATGLKQLSTALQRPVASD

SEQ ID NO: 5693 - protein, 25 aa, synthetic construct
  source 1..25: note = Seed: LNVIVHSATGFKQSSKALQRPVASD
LNVIVHSATGLKQLSTALRRPVASD

SEQ ID NO: 5694 - protein, 25 aa, synthetic construct
  source 1..25: note = Seed: LNVIVHSATGFKQSSKALQRPVASD
LNVIVHSATGLKQLSTALSRPVASD

SEQ ID NO: 5695 - protein, 25 aa, synthetic construct
  source 1..25: note = Seed: LNVIVHSATGFKQSSKALQRPVASD
LNVIVHSATGLKQLSTALTRPVASD

SEQ ID NO: 5696 - protein, 25 aa, synthetic construct
  source 1..25: note = Seed: LNVIVHSATGFKQSSKALQRPVASD
LNVIVHSATGLKQLSTALVRPVASD

SEQ ID NO: 5697 - protein, 25 aa, synthetic construct
  source 1..25: note = Seed: LNVIVHSATGFKQSSKALQRPVASD
LNVIVHSATGLKQLSVALARPVASD

SEQ ID NO: 5698 - protein, 25 aa, synthetic construct
  source 1..25: note = Seed: LNVIVHSATGFKQSSKALQRPVASD
LNVIVHSATGLKQLSVALGRPVASD

SEQ ID NO: 5699 - protein, 25 aa, synthetic construct
  source 1..25: note = Seed: LNVIVHSATGFKQSSKALQRPVASD
LNVIVHSATGLKQLSVALHRPVASD

SEQ ID NO: 5700 - protein, 25 aa, synthetic construct
  source 1..25: note = Seed: LNVIVHSATGFKQSSKALQRPVASD
LNVIVHSATGLKQLSVALIRPVASD

SEQ ID NO: 5701 - protein, 25 aa, synthetic construct
  source 1..25: note = Seed: LNVIVHSATGFKQSSKALQRPVASD
LNVIVHSATGLKQLSVALLRPVASD

SEQ ID NO: 5702 - protein, 25 aa, synthetic construct
  source 1..25: note = Seed: LNVIVHSATGFKQSSKALQRPVASD
LNVIVHSATGLKQLSVALMRPVASD

SEQ ID NO: 5703 - protein, 25 aa, synthetic construct
  source 1..25: note = Seed: LNVIVHSATGFKQSSKALQRPVASD
LNVIVHSATGLKQLSVALNRPVASD

SEQ ID NO: 5704 - protein, 25 aa, synthetic construct
  source 1..25: note = Seed: LNVIVHSATGFKQSSKALQRPVASD
LNVIVHSATGLKQLSVALPRPVASD

SEQ ID NO: 5705 - protein, 25 aa, synthetic construct
  source 1..25: note = Seed: LNVIVHSATGFKQSSKALQRPVASD
LNVIVHSATGLKQLSVALQRPVASD

SEQ ID NO: 5706 - protein, 25 aa, synthetic construct
  source 1..25: note = Seed: LNVIVHSATGFKQSSKALQRPVASD
LNVIVHSATGLKQLSVALRRPVASD

SEQ ID NO: 5707 - protein, 25 aa, synthetic construct
  source 1..25: note = Seed: LNVIVHSATGFKQSSKALQRPVASD
LNVIVHSATGLKQLSVALSRPVASD

SEQ ID NO: 5708 - protein, 25 aa, synthetic construct
  source 1..25: note = Seed: LNVIVHSATGFKQSSKALQRPVASD
LNVIVHSATGLKQLSVALTRPVASD

SEQ ID NO: 5709 - protein, 25 aa, synthetic construct
  source 1..25: note = Seed: LNVIVHSATGFKQSSKALQRPVASD
LNVIVHSATGLKQLSVALVRPVASD

SEQ ID NO: 5710 - protein, 25 aa, synthetic construct
  source 1..25: note = Seed: LNVIVHSATGFKQSSKALQRPVASD
LNVIVHSATGLKQMSAALARPVASD

SEQ ID NO: 5711 - protein, 25 aa, synthetic construct
  source 1..25: note = Seed: LNVIVHSATGFKQSSKALQRPVASD
LNVIVHSATGLKQMSAALCRPVASD

SEQ ID NO: 5712 - protein, 25 aa, synthetic construct
  source 1..25: note = Seed: LNVIVHSATGFKQSSKALQRPVASD
LNVIVHSATGLKQMSAALDRPVASD

SEQ ID NO: 5713 - protein, 25 aa, synthetic construct
  source 1..25: note = Seed: LNVIVHSATGFKQSSKALQRPVASD
LNVIVHSATGLKQMSAALERPVASD

SEQ ID NO: 5714 - protein, 25 aa, synthetic construct
  source 1..25: note = Seed: LNVIVHSATGFKQSSKALQRPVASD
LNVIVHSATGLKQMSAALFRPVASD

SEQ ID NO: 5715 - protein, 25 aa, synthetic construct
  source 1..25: note = Seed: LNVIVHSATGFKQSSKALQRPVASD
LNVIVHSATGLKQMSAALGRPVASD

SEQ ID NO: 5716 - protein, 25 aa, synthetic construct
  source 1..25: note = Seed: LNVIVHSATGFKQSSKALQRPVASD
LNVIVHSATGLKQMSAALHRPVASD

SEQ ID NO: 5717 - protein, 25 aa, synthetic construct
  source 1..25: note = Seed: LNVIVHSATGFKQSSKALQRPVASD
LNVIVHSATGLKQMSAALIRPVASD

SEQ ID NO: 5718 - protein, 25 aa, synthetic construct
  source 1..25: note = Seed: LNVIVHSATGFKQSSKALQRPVASD
LNVIVHSATGLKQMSAALKRPVASD

SEQ ID NO: 5719 - protein, 25 aa, synthetic construct
  source 1..25: note = Seed: LNVIVHSATGFKQSSKALQRPVASD
LNVIVHSATGLKQMSAALLRPVASD

SEQ ID NO: 5720 - protein, 25 aa, synthetic construct
  source 1..25: note = Seed: LNVIVHSATGFKQSSKALQRPVASD
LNVIVHSATGLKQMSAALMRPVASD

SEQ ID NO: 5721 - protein, 25 aa, synthetic construct
  source 1..25: note = Seed: LNVIVHSATGFKQSSKALQRPVASD
LNVIVHSATGLKQMSAALNRPVASD

SEQ ID NO: 5722 - protein, 25 aa, synthetic construct
  source 1..25: note = Seed: LNVIVHSATGFKQSSKALQRPVASD
LNVIVHSATGLKQMSAALPRPVASD

SEQ ID NO: 5723 - protein, 25 aa, synthetic construct
  source 1..25: note = Seed: LNVIVHSATGFKQSSKALQRPVASD
LNVIVHSATGLKQMSAALQRPVASD

SEQ ID NO: 5724 - protein, 25 aa, synthetic construct
  source 1..25: note = Seed: LNVIVHSATGFKQSSKALQRPVASD
LNVIVHSATGLKQMSAALRRPVASD

SEQ ID NO: 5725 - protein, 25 aa, synthetic construct
  source 1..25: note = Seed: LNVIVHSATGFKQSSKALQRPVASD
LNVIVHSATGLKQMSAALSRPVASD

SEQ ID NO: 5726 - protein, 25 aa, synthetic construct
  source 1..25: note = Seed: LNVIVHSATGFKQSSKALQRPVASD
LNVIVHSATGLKQMSAALTRPVASD

SEQ ID NO: 5727 - protein, 25 aa, synthetic construct
  source 1..25: note = Seed: LNVIVHSATGFKQSSKALQRPVASD
LNVIVHSATGLKQMSAALVRPVASD

SEQ ID NO: 5728 - protein, 25 aa, synthetic construct
  source 1..25: note = Seed: LNVIVHSATGFKQSSKALQRPVASD
LNVIVHSATGLKQMSAALYRPVASD

SEQ ID NO: 5729 - protein, 25 aa, synthetic construct
  source 1..25: note = Seed: LNVIVHSATGFKQSSKALQRPVASD
LNVIVHSATGLKQMSFALIRPVASD

SEQ ID NO: 5730 - protein, 25 aa, synthetic construct
  source 1..25: note = Seed: LNVIVHSATGFKQSSKALQRPVASD
LNVIVHSATGLKQMSFALMRPVASD

SEQ ID NO: 5731 - protein, 25 aa, synthetic construct
  source 1..25: note = Seed: LNVIVHSATGFKQSSKALQRPVASD
LNVIVHSATGLKQMSFALVRPVASD

SEQ ID NO: 5732 - protein, 25 aa, synthetic construct
  source 1..25: note = Seed: LNVIVHSATGFKQSSKALQRPVASD
LNVIVHSATGLKQMSGALARPVASD

SEQ ID NO: 5733 - protein, 25 aa, synthetic construct
  source 1..25: note = Seed: LNVIVHSATGFKQSSKALQRPVASD
LNVIVHSATGLKQMSGALCRPVASD

SEQ ID NO: 5734 - protein, 25 aa, synthetic construct
  source 1..25: note = Seed: LNVIVHSATGFKQSSKALQRPVASD
LNVIVHSATGLKQMSGALFRPVASD

SEQ ID NO: 5735 - protein, 25 aa, synthetic construct
  source 1..25: note = Seed: LNVIVHSATGFKQSSKALQRPVASD
LNVIVHSATGLKQMSGALGRPVASD

SEQ ID NO: 5736 - protein, 25 aa, synthetic construct
  source 1..25: note = Seed: LNVIVHSATGFKQSSKALQRPVASD
LNVIVHSATGLKQMSGALHRPVASD

SEQ ID NO: 5737 - protein, 25 aa, synthetic construct
  source 1..25: note = Seed: LNVIVHSATGFKQSSKALQRPVASD
LNVIVHSATGLKQMSGALIRPVASD

SEQ ID NO: 5738 - protein, 25 aa, synthetic construct
  source 1..25: note = Seed: LNVIVHSATGFKQSSKALQRPVASD
LNVIVHSATGLKQMSGALLRPVASD

SEQ ID NO: 5739 - protein, 25 aa, synthetic construct
  source 1..25: note = Seed: LNVIVHSATGFKQSSKALQRPVASD
LNVIVHSATGLKQMSGALMRPVASD

SEQ ID NO: 5740 - protein, 25 aa, synthetic construct
  source 1..25: note = Seed: LNVIVHSATGFKQSSKALQRPVASD
LNVIVHSATGLKQMSGALNRPVASD

SEQ ID NO: 5741 - protein, 25 aa, synthetic construct
  source 1..25: note = Seed: LNVIVHSATGFKQSSKALQRPVASD
LNVIVHSATGLKQMSGALPRPVASD

SEQ ID NO: 5742 - protein, 25 aa, synthetic construct
  source 1..25: note = Seed: LNVIVHSATGFKQSSKALQRPVASD
LNVIVHSATGLKQMSGALQRPVASD

SEQ ID NO: 5743 - protein, 25 aa, synthetic construct
  source 1..25: note = Seed: LNVIVHSATGFKQSSKALQRPVASD
LNVIVHSATGLKQMSGALSRPVASD

SEQ ID NO: 5744 - protein, 25 aa, synthetic construct
  source 1..25: note = Seed: LNVIVHSATGFKQSSKALQRPVASD
LNVIVHSATGLKQMSGALTRPVASD

SEQ ID NO: 5745 - protein, 25 aa, synthetic construct
  source 1..25: note = Seed: LNVIVHSATGFKQSSKALQRPVASD
LNVIVHSATGLKQMSGALVRPVASD

SEQ ID NO: 5746 - protein, 25 aa, synthetic construct
  source 1..25: note = Seed: LNVIVHSATGFKQSSKALQRPVASD
LNVIVHSATGLKQMSHALARPVASD

SEQ ID NO: 5747 - protein, 25 aa, synthetic construct
  source 1..25: note = Seed: LNVIVHSATGFKQSSKALQRPVASD
LNVIVHSATGLKQMSHALGRPVASD

SEQ ID NO: 5748 - protein, 25 aa, synthetic construct
  source 1..25: note = Seed: LNVIVHSATGFKQSSKALQRPVASD
LNVIVHSATGLKQMSHALIRPVASD

SEQ ID NO: 5749 - protein, 25 aa, synthetic construct
  source 1..25: note = Seed: LNVIVHSATGFKQSSKALQRPVASD
LNVIVHSATGLKQMSHALKRPVASD

SEQ ID NO: 5750 - protein, 25 aa, synthetic construct
  source 1..25: note = Seed: LNVIVHSATGFKQSSKALQRPVASD
LNVIVHSATGLKQMSHALRRPVASD

SEQ ID NO: 5751 - protein, 25 aa, synthetic construct
  source 1..25: note = Seed: LNVIVHSATGFKQSSKALQRPVASD
LNVIVHSATGLKQMSHALSRPVASD

SEQ ID NO: 5752 - protein, 25 aa, synthetic construct
  source 1..25: note = Seed: LNVIVHSATGFKQSSKALQRPVASD
LNVIVHSATGLKQMSHALVRPVASD

SEQ ID NO: 5753 - protein, 25 aa, synthetic construct
  source 1..25: note = Seed: LNVIVHSATGFKQSSKALQRPVASD
LNVIVHSATGLKQMSIALARPVASD

SEQ ID NO: 5754 - protein, 25 aa, synthetic construct
  source 1..25: note = Seed: LNVIVHSATGFKQSSKALQRPVASD
LNVIVHSATGLKQMSIALERPVASD

SEQ ID NO: 5755 - protein, 25 aa, synthetic construct
  source 1..25: note = Seed: LNVIVHSATGFKQSSKALQRPVASD
LNVIVHSATGLKQMSIALFRPVASD

SEQ ID NO: 5756 - protein, 25 aa, synthetic construct
  source 1..25: note = Seed: LNVIVHSATGFKQSSKALQRPVASD
LNVIVHSATGLKQMSIALGRPVASD

SEQ ID NO: 5757 - protein, 25 aa, synthetic construct
  source 1..25: note = Seed: LNVIVHSATGFKQSSKALQRPVASD
LNVIVHSATGLKQMSIALHRPVASD

SEQ ID NO: 5758 - protein, 25 aa, synthetic construct
  source 1..25: note = Seed: LNVIVHSATGFKQSSKALQRPVASD
LNVIVHSATGLKQMSIALIRPVASD

SEQ ID NO: 5759 - protein, 25 aa, synthetic construct
  source 1..25: note = Seed: LNVIVHSATGFKQSSKALQRPVASD
LNVIVHSATGLKQMSIALLRPVASD

SEQ ID NO: 5760 - protein, 25 aa, synthetic construct
  source 1..25: note = Seed: LNVIVHSATGFKQSSKALQRPVASD
LNVIVHSATGLKQMSIALMRPVASD

SEQ ID NO: 5761 - protein, 25 aa, synthetic construct
  source 1..25: note = Seed: LNVIVHSATGFKQSSKALQRPVASD
LNVIVHSATGLKQMSIALNRPVASD

SEQ ID NO: 5762 - protein, 25 aa, synthetic construct
  source 1..25: note = Seed: LNVIVHSATGFKQSSKALQRPVASD
LNVIVHSATGLKQMSIALPRPVASD

SEQ ID NO: 5763 - protein, 25 aa, synthetic construct
  source 1..25: note = Seed: LNVIVHSATGFKQSSKALQRPVASD
LNVIVHSATGLKQMSIALQRPVASD

SEQ ID NO: 5764 - protein, 25 aa, synthetic construct
  source 1..25: note = Seed: LNVIVHSATGFKQSSKALQRPVASD
LNVIVHSATGLKQMSIALRRPVASD

SEQ ID NO: 5765 - protein, 25 aa, synthetic construct
  source 1..25: note = Seed: LNVIVHSATGFKQSSKALQRPVASD
LNVIVHSATGLKQMSIALSRPVASD

SEQ ID NO: 5766 - protein, 25 aa, synthetic construct
  source 1..25: note = Seed: LNVIVHSATGFKQSSKALQRPVASD
LNVIVHSATGLKQMSIALTRPVASD

SEQ ID NO: 5767 - protein, 25 aa, synthetic construct
  source 1..25: note = Seed: LNVIVHSATGFKQSSKALQRPVASD
LNVIVHSATGLKQMSIALVRPVASD

SEQ ID NO: 5768 - protein, 25 aa, synthetic construct
  source 1..25: note = Seed: LNVIVHSATGFKQSSKALQRPVASD
LNVIVHSATGLKQMSKALARPVASD

SEQ ID NO: 5769 - protein, 25 aa, synthetic construct
  source 1..25: note = Seed: LNVIVHSATGFKQSSKALQRPVASD
LNVIVHSATGLKQMSKALCRPVASD

SEQ ID NO: 5770 - protein, 25 aa, synthetic construct
  source 1..25: note = Seed: LNVIVHSATGFKQSSKALQRPVASD
LNVIVHSATGLKQMSKALFRPVASD

SEQ ID NO: 5771 - protein, 25 aa, synthetic construct
  source 1..25: note = Seed: LNVIVHSATGFKQSSKALQRPVASD
LNVIVHSATGLKQMSKALGRPVASD

SEQ ID NO: 5772 - protein, 25 aa, synthetic construct
  source 1..25: note = Seed: LNVIVHSATGFKQSSKALQRPVASD
LNVIVHSATGLKQMSKALHRPVASD

SEQ ID NO: 5773 - protein, 25 aa, synthetic construct
  source 1..25: note = Seed: LNVIVHSATGFKQSSKALQRPVASD
LNVIVHSATGLKQMSKALIRPVASD

SEQ ID NO: 5774 - protein, 25 aa, synthetic construct
  source 1..25: note = Seed: LNVIVHSATGFKQSSKALQRPVASD
LNVIVHSATGLKQMSKALKRPVASD

SEQ ID NO: 5775 - protein, 25 aa, synthetic construct
  source 1..25: note = Seed: LNVIVHSATGFKQSSKALQRPVASD
LNVIVHSATGLKQMSKALLRPVASD

SEQ ID NO: 5776 - protein, 25 aa, synthetic construct
  source 1..25: note = Seed: LNVIVHSATGFKQSSKALQRPVASD
LNVIVHSATGLKQMSKALMRPVASD

SEQ ID NO: 5777 - protein, 25 aa, synthetic construct
  source 1..25: note = Seed: LNVIVHSATGFKQSSKALQRPVASD
LNVIVHSATGLKQMSKALNRPVASD

SEQ ID NO: 5778 - protein, 25 aa, synthetic construct
  source 1..25: note = Seed: LNVIVHSATGFKQSSKALQRPVASD
LNVIVHSATGLKQMSKALPRPVASD

SEQ ID NO: 5779 - protein, 25 aa, synthetic construct
  source 1..25: note = Seed: LNVIVHSATGFKQSSKALQRPVASD
LNVIVHSATGLKQMSKALQRPVASD

SEQ ID NO: 5780 - protein, 25 aa, synthetic construct
  source 1..25: note = Seed: LNVIVHSATGFKQSSKALQRPVASD
LNVIVHSATGLKQMSKALRRPVASD

SEQ ID NO: 5781 - protein, 25 aa, synthetic construct
  source 1..25: note = Seed: LNVIVHSATGFKQSSKALQRPVASD
LNVIVHSATGLKQMSKALSRPVASD

SEQ ID NO: 5782 - protein, 25 aa, synthetic construct
  source 1..25: note = Seed: LNVIVHSATGFKQSSKALQRPVASD
LNVIVHSATGLKQMSKALTRPVASD

SEQ ID NO: 5783 - protein, 25 aa, synthetic construct
  source 1..25: note = Seed: LNVIVHSATGFKQSSKALQRPVASD
LNVIVHSATGLKQMSKALVRPVASD

SEQ ID NO: 5784 - protein, 25 aa, synthetic construct
  source 1..25: note = Seed: LNVIVHSATGFKQSSKALQRPVASD
LNVIVHSATGLKQMSKALWRPVASD

SEQ ID NO: 5785 - protein, 25 aa, synthetic construct
  source 1..25: note = Seed: LNVIVHSATGFKQSSKALQRPVASD
LNVIVHSATGLKQMSKALYRPVASD

SEQ ID NO: 5786 - protein, 25 aa, synthetic construct
  source 1..25: note = Seed: LNVIVHSATGFKQSSKALQRPVASD
LNVIVHSATGLKQMSLALARPVASD

SEQ ID NO: 5787 - protein, 25 aa, synthetic construct
  source 1..25: note = Seed: LNVIVHSATGFKQSSKALQRPVASD
LNVIVHSATGLKQMSLALGRPVASD

SEQ ID NO: 5788 - protein, 25 aa, synthetic construct
  source 1..25: note = Seed: LNVIVHSATGFKQSSKALQRPVASD
LNVIVHSATGLKQMSLALHRPVASD

SEQ ID NO: 5789 - protein, 25 aa, synthetic construct
  source 1..25: note = Seed: LNVIVHSATGFKQSSKALQRPVASD
LNVIVHSATGLKQMSLALIRPVASD

SEQ ID NO: 5790 - protein, 25 aa, synthetic construct
  source 1..25: note = Seed: LNVIVHSATGFKQSSKALQRPVASD
LNVIVHSATGLKQMSLALLRPVASD

SEQ ID NO: 5791 - protein, 25 aa, synthetic construct
  source 1..25: note = Seed: LNVIVHSATGFKQSSKALQRPVASD
LNVIVHSATGLKQMSLALMRPVASD

SEQ ID NO: 5792 - protein, 25 aa, synthetic construct
  source 1..25: note = Seed: LNVIVHSATGFKQSSKALQRPVASD
LNVIVHSATGLKQMSLALNRPVASD

SEQ ID NO: 5793 - protein, 25 aa, synthetic construct
  source 1..25: note = Seed: LNVIVHSATGFKQSSKALQRPVASD
LNVIVHSATGLKQMSLALQRPVASD

SEQ ID NO: 5794 - protein, 25 aa, synthetic construct
  source 1..25: note = Seed: LNVIVHSATGFKQSSKALQRPVASD
LNVIVHSATGLKQMSLALRRPVASD

SEQ ID NO: 5795 - protein, 25 aa, synthetic construct
  source 1..25: note = Seed: LNVIVHSATGFKQSSKALQRPVASD
LNVIVHSATGLKQMSLALSRPVASD

SEQ ID NO: 5796 - protein, 25 aa, synthetic construct
  source 1..25: note = Seed: LNVIVHSATGFKQSSKALQRPVASD
LNVIVHSATGLKQMSLALTRPVASD

SEQ ID NO: 5797 - protein, 25 aa, synthetic construct
  source 1..25: note = Seed: LNVIVHSATGFKQSSKALQRPVASD
LNVIVHSATGLKQMSLALVRPVASD

SEQ ID NO: 5798 - protein, 25 aa, synthetic construct
  source 1..25: note = Seed: LNVIVHSATGFKQSSKALQRPVASD
LNVIVHSATGLKQMSMALARPVASD

SEQ ID NO: 5799 - protein, 25 aa, synthetic construct
  source 1..25: note = Seed: LNVIVHSATGFKQSSKALQRPVASD
LNVIVHSATGLKQMSMALGRPVASD

SEQ ID NO: 5800 - protein, 25 aa, synthetic construct
  source 1..25: note = Seed: LNVIVHSATGFKQSSKALQRPVASD
LNVIVHSATGLKQMSMALHRPVASD

SEQ ID NO: 5801 - protein, 25 aa, synthetic construct
  source 1..25: note = Seed: LNVIVHSATGFKQSSKALQRPVASD
LNVIVHSATGLKQMSMALIRPVASD

SEQ ID NO: 5802 - protein, 25 aa, synthetic construct
  source 1..25: note = Seed: LNVIVHSATGFKQSSKALQRPVASD
LNVIVHSATGLKQMSMALLRPVASD

SEQ ID NO: 5803 - protein, 25 aa, synthetic construct
  source 1..25: note = Seed: LNVIVHSATGFKQSSKALQRPVASD
LNVIVHSATGLKQMSMALMRPVASD

SEQ ID NO: 5804 - protein, 25 aa, synthetic construct
  source 1..25: note = Seed: LNVIVHSATGFKQSSKALQRPVASD
LNVIVHSATGLKQMSMALNRPVASD

SEQ ID NO: 5805 - protein, 25 aa, synthetic construct
  source 1..25: note = Seed: LNVIVHSATGFKQSSKALQRPVASD
LNVIVHSATGLKQMSMALRRPVASD

SEQ ID NO: 5806 - protein, 25 aa, synthetic construct
  source 1..25: note = Seed: LNVIVHSATGFKQSSKALQRPVASD
LNVIVHSATGLKQMSMALSRPVASD

SEQ ID NO: 5807 - protein, 25 aa, synthetic construct
  source 1..25: note = Seed: LNVIVHSATGFKQSSKALQRPVASD
LNVIVHSATGLKQMSMALTRPVASD

SEQ ID NO: 5808 - protein, 25 aa, synthetic construct
  source 1..25: note = Seed: LNVIVHSATGFKQSSKALQRPVASD
LNVIVHSATGLKQMSMALVRPVASD

SEQ ID NO: 5809 - protein, 25 aa, synthetic construct
  source 1..25: note = Seed: LNVIVHSATGFKQSSKALQRPVASD
LNVIVHSATGLKQMSNALARPVASD

SEQ ID NO: 5810 - protein, 25 aa, synthetic construct
  source 1..25: note = Seed: LNVIVHSATGFKQSSKALQRPVASD
LNVIVHSATGLKQMSNALCRPVASD

SEQ ID NO: 5811 - protein, 25 aa, synthetic construct
  source 1..25: note = Seed: LNVIVHSATGFKQSSKALQRPVASD
LNVIVHSATGLKQMSNALGRPVASD

SEQ ID NO: 5812 - protein, 25 aa, synthetic construct
  source 1..25: note = Seed: LNVIVHSATGFKQSSKALQRPVASD
LNVIVHSATGLKQMSNALIRPVASD

SEQ ID NO: 5813 - protein, 25 aa, synthetic construct
  source 1..25: note = Seed: LNVIVHSATGFKQSSKALQRPVASD
LNVIVHSATGLKQMSNALLRPVASD

SEQ ID NO: 5814 - protein, 25 aa, synthetic construct
  source 1..25: note = Seed: LNVIVHSATGFKQSSKALQRPVASD
LNVIVHSATGLKQMSNALMRPVASD

SEQ ID NO: 5815 - protein, 25 aa, synthetic construct
  source 1..25: note = Seed: LNVIVHSATGFKQSSKALQRPVASD
LNVIVHSATGLKQMSNALNRPVASD

SEQ ID NO: 5816 - protein, 25 aa, synthetic construct
  source 1..25: note = Seed: LNVIVHSATGFKQSSKALQRPVASD
LNVIVHSATGLKQMSNALRRPVASD

SEQ ID NO: 5817 - protein, 25 aa, synthetic construct
  source 1..25: note = Seed: LNVIVHSATGFKQSSKALQRPVASD
LNVIVHSATGLKQMSNALSRPVASD

SEQ ID NO: 5818 - protein, 25 aa, synthetic construct
  source 1..25: note = Seed: LNVIVHSATGFKQSSKALQRPVASD
LNVIVHSATGLKQMSNALTRPVASD

SEQ ID NO: 5819 - protein, 25 aa, synthetic construct
  source 1..25: note = Seed: LNVIVHSATGFKQSSKALQRPVASD
LNVIVHSATGLKQMSNALVRPVASD

SEQ ID NO: 5820 - protein, 25 aa, synthetic construct
  source 1..25: note = Seed: LNVIVHSATGFKQSSKALQRPVASD
LNVIVHSATGLKQMSPALARPVASD

SEQ ID NO: 5821 - protein, 25 aa, synthetic construct
  source 1..25: note = Seed: LNVIVHSATGFKQSSKALQRPVASD
LNVIVHSATGLKQMSPALCRPVASD

SEQ ID NO: 5822 - protein, 25 aa, synthetic construct
  source 1..25: note = Seed: LNVIVHSATGFKQSSKALQRPVASD
LNVIVHSATGLKQMSPALDRPVASD

SEQ ID NO: 5823 - protein, 25 aa, synthetic construct
  source 1..25: note = Seed: LNVIVHSATGFKQSSKALQRPVASD
LNVIVHSATGLKQMSPALERPVASD

SEQ ID NO: 5824 - protein, 25 aa, synthetic construct
  source 1..25: note = Seed: LNVIVHSATGFKQSSKALQRPVASD
LNVIVHSATGLKQMSPALFRPVASD

SEQ ID NO: 5825 - protein, 25 aa, synthetic construct
  source 1..25: note = Seed: LNVIVHSATGFKQSSKALQRPVASD
LNVIVHSATGLKQMSPALGRPVASD

SEQ ID NO: 5826 - protein, 25 aa, synthetic construct
  source 1..25: note = Seed: LNVIVHSATGFKQSSKALQRPVASD
LNVIVHSATGLKQMSPALHRPVASD

SEQ ID NO: 5827 - protein, 25 aa, synthetic construct
  source 1..25: note = Seed: LNVIVHSATGFKQSSKALQRPVASD
LNVIVHSATGLKQMSPALIRPVASD

SEQ ID NO: 5828 - protein, 25 aa, synthetic construct
  source 1..25: note = Seed: LNVIVHSATGFKQSSKALQRPVASD
LNVIVHSATGLKQMSPALKRPVASD

SEQ ID NO: 5829 - protein, 25 aa, synthetic construct
  source 1..25: note = Seed: LNVIVHSATGFKQSSKALQRPVASD
LNVIVHSATGLKQMSPALLRPVASD

SEQ ID NO: 5830 - protein, 25 aa, synthetic construct
  source 1..25: note = Seed: LNVIVHSATGFKQSSKALQRPVASD
LNVIVHSATGLKQMSPALMRPVASD

SEQ ID NO: 5831 - protein, 25 aa, synthetic construct
  source 1..25: note = Seed: LNVIVHSATGFKQSSKALQRPVASD
LNVIVHSATGLKQMSPALNRPVASD

SEQ ID NO: 5832 - protein, 25 aa, synthetic construct
  source 1..25: note = Seed: LNVIVHSATGFKQSSKALQRPVASD
LNVIVHSATGLKQMSPALPRPVASD

SEQ ID NO: 5833 - protein, 25 aa, synthetic construct
  source 1..25: note = Seed: LNVIVHSATGFKQSSKALQRPVASD
LNVIVHSATGLKQMSPALQRPVASD

SEQ ID NO: 5834 - protein, 25 aa, synthetic construct
  source 1..25: note = Seed: LNVIVHSATGFKQSSKALQRPVASD
LNVIVHSATGLKQMSPALRRPVASD

SEQ ID NO: 5835 - protein, 25 aa, synthetic construct
  source 1..25: note = Seed: LNVIVHSATGFKQSSKALQRPVASD
LNVIVHSATGLKQMSPALSRPVASD

SEQ ID NO: 5836 - protein, 25 aa, synthetic construct
  source 1..25: note = Seed: LNVIVHSATGFKQSSKALQRPVASD
LNVIVHSATGLKQMSPALTRPVASD

SEQ ID NO: 5837 - protein, 25 aa, synthetic construct
  source 1..25: note = Seed: LNVIVHSATGFKQSSKALQRPVASD
LNVIVHSATGLKQMSPALVRPVASD

SEQ ID NO: 5838 - protein, 25 aa, synthetic construct
  source 1..25: note = Seed: LNVIVHSATGFKQSSKALQRPVASD
LNVIVHSATGLKQMSQALRRPVASD

SEQ ID NO: 5839 - protein, 25 aa, synthetic construct
  source 1..25: note = Seed: LNVIVHSATGFKQSSKALQRPVASD
LNVIVHSATGLKQMSRALARPVASD

SEQ ID NO: 5840 - protein, 25 aa, synthetic construct
  source 1..25: note = Seed: LNVIVHSATGFKQSSKALQRPVASD
LNVIVHSATGLKQMSRALCRPVASD

SEQ ID NO: 5841 - protein, 25 aa, synthetic construct
  source 1..25: note = Seed: LNVIVHSATGFKQSSKALQRPVASD
LNVIVHSATGLKQMSRALDRPVASD

SEQ ID NO: 5842 - protein, 25 aa, synthetic construct
  source 1..25: note = Seed: LNVIVHSATGFKQSSKALQRPVASD
LNVIVHSATGLKQMSRALERPVASD

SEQ ID NO: 5843 - protein, 25 aa, synthetic construct
  source 1..25: note = Seed: LNVIVHSATGFKQSSKALQRPVASD
LNVIVHSATGLKQMSRALFRPVASD

SEQ ID NO: 5844 - protein, 25 aa, synthetic construct
  source 1..25: note = Seed: LNVIVHSATGFKQSSKALQRPVASD
LNVIVHSATGLKQMSRALGRPVASD

SEQ ID NO: 5845 - protein, 25 aa, synthetic construct
  source 1..25: note = Seed: LNVIVHSATGFKQSSKALQRPVASD
LNVIVHSATGLKQMSRALHRPVASD

SEQ ID NO: 5846 - protein, 25 aa, synthetic construct
  source 1..25: note = Seed: LNVIVHSATGFKQSSKALQRPVASD
LNVIVHSATGLKQMSRALIRPVASD

SEQ ID NO: 5847 - protein, 25 aa, synthetic construct
  source 1..25: note = Seed: LNVIVHSATGFKQSSKALQRPVASD
LNVIVHSATGLKQMSRALKRPVASD

SEQ ID NO: 5848 - protein, 25 aa, synthetic construct
  source 1..25: note = Seed: LNVIVHSATGFKQSSKALQRPVASD
LNVIVHSATGLKQMSRALLRPVASD

SEQ ID NO: 5849 - protein, 25 aa, synthetic construct
  source 1..25: note = Seed: LNVIVHSATGFKQSSKALQRPVASD
LNVIVHSATGLKQMSRALMRPVASD

SEQ ID NO: 5850 - protein, 25 aa, synthetic construct
  source 1..25: note = Seed: LNVIVHSATGFKQSSKALQRPVASD
LNVIVHSATGLKQMSRALNRPVASD

SEQ ID NO: 5851 - protein, 25 aa, synthetic construct
  source 1..25: note = Seed: LNVIVHSATGFKQSSKALQRPVASD
LNVIVHSATGLKQMSRALPRPVASD

SEQ ID NO: 5852 - protein, 25 aa, synthetic construct
  source 1..25: note = Seed: LNVIVHSATGFKQSSKALQRPVASD
LNVIVHSATGLKQMSRALQRPVASD

SEQ ID NO: 5853 - protein, 25 aa, synthetic construct
  source 1..25: note = Seed: LNVIVHSATGFKQSSKALQRPVASD
LNVIVHSATGLKQMSRALRRPVASD

SEQ ID NO: 5854 - protein, 25 aa, synthetic construct
  source 1..25: note = Seed: LNVIVHSATGFKQSSKALQRPVASD
LNVIVHSATGLKQMSRALSRPVASD

SEQ ID NO: 5855 - protein, 25 aa, synthetic construct
  source 1..25: note = Seed: LNVIVHSATGFKQSSKALQRPVASD
LNVIVHSATGLKQMSRALTRPVASD

SEQ ID NO: 5856 - protein, 25 aa, synthetic construct
  source 1..25: note = Seed: LNVIVHSATGFKQSSKALQRPVASD
LNVIVHSATGLKQMSRALVRPVASD

SEQ ID NO: 5857 - protein, 25 aa, synthetic construct
  source 1..25: note = Seed: LNVIVHSATGFKQSSKALQRPVASD
LNVIVHSATGLKQMSRALWRPVASD

SEQ ID NO: 5858 - protein, 25 aa, synthetic construct
  source 1..25: note = Seed: LNVIVHSATGFKQSSKALQRPVASD
LNVIVHSATGLKQMSRALYRPVASD

SEQ ID NO: 5859 - protein, 25 aa, synthetic construct
  source 1..25: note = Seed: LNVIVHSATGFKQSSKALQRPVASD
LNVIVHSATGLKQMSSALARPVASD

SEQ ID NO: 5860 - protein, 25 aa, synthetic construct
  source 1..25: note = Seed: LNVIVHSATGFKQSSKALQRPVASD
LNVIVHSATGLKQMSSALCRPVASD

SEQ ID NO: 5861 - protein, 25 aa, synthetic construct
  source 1..25: note = Seed: LNVIVHSATGFKQSSKALQRPVASD
LNVIVHSATGLKQMSSALFRPVASD

SEQ ID NO: 5862 - protein, 25 aa, synthetic construct
  source 1..25: note = Seed: LNVIVHSATGFKQSSKALQRPVASD
LNVIVHSATGLKQMSSALGRPVASD

SEQ ID NO: 5863 - protein, 25 aa, synthetic construct
  source 1..25: note = Seed: LNVIVHSATGFKQSSKALQRPVASD
LNVIVHSATGLKQMSSALHRPVASD

SEQ ID NO: 5864 - protein, 25 aa, synthetic construct
  source 1..25: note = Seed: LNVIVHSATGFKQSSKALQRPVASD
LNVIVHSATGLKQMSSALIRPVASD

SEQ ID NO: 5865 - protein, 25 aa, synthetic construct
  source 1..25: note = Seed: LNVIVHSATGFKQSSKALQRPVASD
LNVIVHSATGLKQMSSALKRPVASD

SEQ ID NO: 5866 - protein, 25 aa, synthetic construct
  source 1..25: note = Seed: LNVIVHSATGFKQSSKALQRPVASD
LNVIVHSATGLKQMSSALLRPVASD

SEQ ID NO: 5867 - protein, 25 aa, synthetic construct
  source 1..25: note = Seed: LNVIVHSATGFKQSSKALQRPVASD
LNVIVHSATGLKQMSSALMRPVASD

SEQ ID NO: 5868 - protein, 25 aa, synthetic construct
  source 1..25: note = Seed: LNVIVHSATGFKQSSKALQRPVASD
LNVIVHSATGLKQMSSALNRPVASD

SEQ ID NO: 5869 - protein, 25 aa, synthetic construct
  source 1..25: note = Seed: LNVIVHSATGFKQSSKALQRPVASD
LNVIVHSATGLKQMSSALPRPVASD

SEQ ID NO: 5870 - protein, 25 aa, synthetic construct
  source 1..25: note = Seed: LNVIVHSATGFKQSSKALQRPVASD
LNVIVHSATGLKQMSSALQRPVASD

SEQ ID NO: 5871 - protein, 25 aa, synthetic construct
  source 1..25: note = Seed: LNVIVHSATGFKQSSKALQRPVASD
LNVIVHSATGLKQMSSALRRPVASD

SEQ ID NO: 5872 - protein, 25 aa, synthetic construct
  source 1..25: note = Seed: LNVIVHSATGFKQSSKALQRPVASD
LNVIVHSATGLKQMSSALSRPVASD

SEQ ID NO: 5873 - protein, 25 aa, synthetic construct
  source 1..25: note = Seed: LNVIVHSATGFKQSSKALQRPVASD
LNVIVHSATGLKQMSSALTRPVASD

SEQ ID NO: 5874 - protein, 25 aa, synthetic construct
  source 1..25: note = Seed: LNVIVHSATGFKQSSKALQRPVASD
LNVIVHSATGLKQMSSALVRPVASD

SEQ ID NO: 5875 - protein, 25 aa, synthetic construct
  source 1..25: note = Seed: LNVIVHSATGFKQSSKALQRPVASD
LNVIVHSATGLKQMSTALARPVASD

SEQ ID NO: 5876 - protein, 25 aa, synthetic construct
  source 1..25: note = Seed: LNVIVHSATGFKQSSKALQRPVASD
LNVIVHSATGLKQMSTALCRPVASD

SEQ ID NO: 5877 - protein, 25 aa, synthetic construct
  source 1..25: note = Seed: LNVIVHSATGFKQSSKALQRPVASD
LNVIVHSATGLKQMSTALGRPVASD

SEQ ID NO: 5878 - protein, 25 aa, synthetic construct
  source 1..25: note = Seed: LNVIVHSATGFKQSSKALQRPVASD
LNVIVHSATGLKQMSTALHRPVASD

SEQ ID NO: 5879 - protein, 25 aa, synthetic construct
  source 1..25: note = Seed: LNVIVHSATGFKQSSKALQRPVASD
LNVIVHSATGLKQMSTALIRPVASD

SEQ ID NO: 5880 - protein, 25 aa, synthetic construct
  source 1..25: note = Seed: LNVIVHSATGFKQSSKALQRPVASD
LNVIVHSATGLKQMSTALKRPVASD

SEQ ID NO: 5881 - protein, 25 aa, synthetic construct
  source 1..25: note = Seed: LNVIVHSATGFKQSSKALQRPVASD
LNVIVHSATGLKQMSTALLRPVASD

SEQ ID NO: 5882 - protein, 25 aa, synthetic construct
  source 1..25: note = Seed: LNVIVHSATGFKQSSKALQRPVASD
LNVIVHSATGLKQMSTALMRPVASD

SEQ ID NO: 5883 - protein, 25 aa, synthetic construct
  source 1..25: note = Seed: LNVIVHSATGFKQSSKALQRPVASD
LNVIVHSATGLKQMSTALNRPVASD

SEQ ID NO: 5884 - protein, 25 aa, synthetic construct
  source 1..25: note = Seed: LNVIVHSATGFKQSSKALQRPVASD
LNVIVHSATGLKQMSTALPRPVASD

SEQ ID NO: 5885 - protein, 25 aa, synthetic construct
  source 1..25: note = Seed: LNVIVHSATGFKQSSKALQRPVASD
LNVIVHSATGLKQMSTALQRPVASD

SEQ ID NO: 5886 - protein, 25 aa, synthetic construct
  source 1..25: note = Seed: LNVIVHSATGFKQSSKALQRPVASD
LNVIVHSATGLKQMSTALRRPVASD

SEQ ID NO: 5887 - protein, 25 aa, synthetic construct
  source 1..25: note = Seed: LNVIVHSATGFKQSSKALQRPVASD
LNVIVHSATGLKQMSTALSRPVASD

SEQ ID NO: 5888 - protein, 25 aa, synthetic construct
  source 1..25: note = Seed: LNVIVHSATGFKQSSKALQRPVASD
LNVIVHSATGLKQMSTALTRPVASD

SEQ ID NO: 5889 - protein, 25 aa, synthetic construct
  source 1..25: note = Seed: LNVIVHSATGFKQSSKALQRPVASD
LNVIVHSATGLKQMSTALVRPVASD

SEQ ID NO: 5890 - protein, 25 aa, synthetic construct
  source 1..25: note = Seed: LNVIVHSATGFKQSSKALQRPVASD
LNVIVHSATGLKQMSVALARPVASD

SEQ ID NO: 5891 - protein, 25 aa, synthetic construct
  source 1..25: note = Seed: LNVIVHSATGFKQSSKALQRPVASD
LNVIVHSATGLKQMSVALDRPVASD

SEQ ID NO: 5892 - protein, 25 aa, synthetic construct
  source 1..25: note = Seed: LNVIVHSATGFKQSSKALQRPVASD
LNVIVHSATGLKQMSVALERPVASD

SEQ ID NO: 5893 - protein, 25 aa, synthetic construct
  source 1..25: note = Seed: LNVIVHSATGFKQSSKALQRPVASD
LNVIVHSATGLKQMSVALGRPVASD

SEQ ID NO: 5894 - protein, 25 aa, synthetic construct
  source 1..25: note = Seed: LNVIVHSATGFKQSSKALQRPVASD
LNVIVHSATGLKQMSVALHRPVASD

SEQ ID NO: 5895 - protein, 25 aa, synthetic construct
  source 1..25: note = Seed: LNVIVHSATGFKQSSKALQRPVASD
LNVIVHSATGLKQMSVALIRPVASD

SEQ ID NO: 5896 - protein, 25 aa, synthetic construct
  source 1..25: note = Seed: LNVIVHSATGFKQSSKALQRPVASD
LNVIVHSATGLKQMSVALLRPVASD

SEQ ID NO: 5897 - protein, 25 aa, synthetic construct
  source 1..25: note = Seed: LNVIVHSATGFKQSSKALQRPVASD
LNVIVHSATGLKQMSVALMRPVASD

SEQ ID NO: 5898 - protein, 25 aa, synthetic construct
  source 1..25: note = Seed: LNVIVHSATGFKQSSKALQRPVASD
LNVIVHSATGLKQMSVALNRPVASD

SEQ ID NO: 5899 - protein, 25 aa, synthetic construct
  source 1..25: note = Seed: LNVIVHSATGFKQSSKALQRPVASD
LNVIVHSATGLKQMSVALPRPVASD

SEQ ID NO: 5900 - protein, 25 aa, synthetic construct
  source 1..25: note = Seed: LNVIVHSATGFKQSSKALQRPVASD
LNVIVHSATGLKQMSVALQRPVASD

SEQ ID NO: 5901 - protein, 25 aa, synthetic construct
  source 1..25: note = Seed: LNVIVHSATGFKQSSKALQRPVASD
LNVIVHSATGLKQMSVALRRPVASD

SEQ ID NO: 5902 - protein, 25 aa, synthetic construct
  source 1..25: note = Seed: LNVIVHSATGFKQSSKALQRPVASD
LNVIVHSATGLKQMSVALSRPVASD

SEQ ID NO: 5903 - protein, 25 aa, synthetic construct
  source 1..25: note = Seed: LNVIVHSATGFKQSSKALQRPVASD
LNVIVHSATGLKQMSVALTRPVASD

SEQ ID NO: 5904 - protein, 25 aa, synthetic construct
  source 1..25: note = Seed: LNVIVHSATGFKQSSKALQRPVASD
LNVIVHSATGLKQMSVALVRPVASD

SEQ ID NO: 5905 - protein, 25 aa, synthetic construct
  source 1..25: note = Seed: LNVIVHSATGFKQSSKALQRPVASD
LNVIVHSATGLKQMSWALVRPVASD

SEQ ID NO: 5906 - protein, 25 aa, synthetic construct
  source 1..25: note = Seed: LNVIVHSATGFKQSSKALQRPVASD
LNVIVHSATGLKQNSAALARPVASD

SEQ ID NO: 5907 - protein, 25 aa, synthetic construct
  source 1..25: note = Seed: LNVIVHSATGFKQSSKALQRPVASD
LNVIVHSATGLKQNSAALFRPVASD

SEQ ID NO: 5908 - protein, 25 aa, synthetic construct
  source 1..25: note = Seed: LNVIVHSATGFKQSSKALQRPVASD
LNVIVHSATGLKQNSAALIRPVASD

SEQ ID NO: 5909 - protein, 25 aa, synthetic construct
  source 1..25: note = Seed: LNVIVHSATGFKQSSKALQRPVASD
LNVIVHSATGLKQNSAALLRPVASD

SEQ ID NO: 5910 - protein, 25 aa, synthetic construct
  source 1..25: note = Seed: LNVIVHSATGFKQSSKALQRPVASD
LNVIVHSATGLKQNSAALMRPVASD

SEQ ID NO: 5911 - protein, 25 aa, synthetic construct
  source 1..25: note = Seed: LNVIVHSATGFKQSSKALQRPVASD
LNVIVHSATGLKQNSAALNRPVASD

SEQ ID NO: 5912 - protein, 25 aa, synthetic construct
  source 1..25: note = Seed: LNVIVHSATGFKQSSKALQRPVASD
LNVIVHSATGLKQNSAALQRPVASD

SEQ ID NO: 5913 - protein, 25 aa, synthetic construct
  source 1..25: note = Seed: LNVIVHSATGFKQSSKALQRPVASD
LNVIVHSATGLKQNSAALSRPVASD

SEQ ID NO: 5914 - protein, 25 aa, synthetic construct
  source 1..25: note = Seed: LNVIVHSATGFKQSSKALQRPVASD
LNVIVHSATGLKQNSAALTRPVASD

SEQ ID NO: 5915 - protein, 25 aa, synthetic construct
  source 1..25: note = Seed: LNVIVHSATGFKQSSKALQRPVASD
LNVIVHSATGLKQNSAALVRPVASD

SEQ ID NO: 5916 - protein, 25 aa, synthetic construct
  source 1..25: note = Seed: LNVIVHSATGFKQSSKALQRPVASD
LNVIVHSATGLKQNSAALWRPVASD

SEQ ID NO: 5917 - protein, 25 aa, synthetic construct
  source 1..25: note = Seed: LNVIVHSATGFKQSSKALQRPVASD
LNVIVHSATGLKQNSAALYRPVASD

SEQ ID NO: 5918 - protein, 25 aa, synthetic construct
  source 1..25: note = Seed: LNVIVHSATGFKQSSKALQRPVASD
LNVIVHSATGLKQNSCALIRPVASD

SEQ ID NO: 5919 - protein, 25 aa, synthetic construct
  source 1..25: note = Seed: LNVIVHSATGFKQSSKALQRPVASD
LNVIVHSATGLKQNSCALVRPVASD

SEQ ID NO: 5920 - protein, 25 aa, synthetic construct
  source 1..25: note = Seed: LNVIVHSATGFKQSSKALQRPVASD
LNVIVHSATGLKQNSDALIRPVASD

SEQ ID NO: 5921 - protein, 25 aa, synthetic construct
  source 1..25: note = Seed: LNVIVHSATGFKQSSKALQRPVASD
LNVIVHSATGLKQNSDALVRPVASD

SEQ ID NO: 5922 - protein, 25 aa, synthetic construct
  source 1..25: note = Seed: LNVIVHSATGFKQSSKALQRPVASD
LNVIVHSATGLKQNSGALARPVASD

SEQ ID NO: 5923 - protein, 25 aa, synthetic construct
  source 1..25: note = Seed: LNVIVHSATGFKQSSKALQRPVASD
LNVIVHSATGLKQNSGALFRPVASD

SEQ ID NO: 5924 - protein, 25 aa, synthetic construct
  source 1..25: note = Seed: LNVIVHSATGFKQSSKALQRPVASD
LNVIVHSATGLKQNSGALIRPVASD

SEQ ID NO: 5925 - protein, 25 aa, synthetic construct
  source 1..25: note = Seed: LNVIVHSATGFKQSSKALQRPVASD
LNVIVHSATGLKQNSGALLRPVASD

SEQ ID NO: 5926 - protein, 25 aa, synthetic construct
  source 1..25: note = Seed: LNVIVHSATGFKQSSKALQRPVASD
LNVIVHSATGLKQNSGALMRPVASD

SEQ ID NO: 5927 - protein, 25 aa, synthetic construct
  source 1..25: note = Seed: LNVIVHSATGFKQSSKALQRPVASD
LNVIVHSATGLKQNSGALSRPVASD

SEQ ID NO: 5928 - protein, 25 aa, synthetic construct
  source 1..25: note = Seed: LNVIVHSATGFKQSSKALQRPVASD
LNVIVHSATGLKQNSGALTRPVASD

SEQ ID NO: 5929 - protein, 25 aa, synthetic construct
  source 1..25: note = Seed: LNVIVHSATGFKQSSKALQRPVASD
LNVIVHSATGLKQNSGALVRPVASD

SEQ ID NO: 5930 - protein, 25 aa, synthetic construct
  source 1..25: note = Seed: LNVIVHSATGFKQSSKALQRPVASD
LNVIVHSATGLKQNSGALYRPVASD

SEQ ID NO: 5931 - protein, 25 aa, synthetic construct
  source 1..25: note = Seed: LNVIVHSATGFKQSSKALQRPVASD
LNVIVHSATGLKQNSHALFRPVASD

SEQ ID NO: 5932 - protein, 25 aa, synthetic construct
  source 1..25: note = Seed: LNVIVHSATGFKQSSKALQRPVASD
LNVIVHSATGLKQNSHALIRPVASD

SEQ ID NO: 5933 - protein, 25 aa, synthetic construct
  source 1..25: note = Seed: LNVIVHSATGFKQSSKALQRPVASD
LNVIVHSATGLKQNSHALLRPVASD

SEQ ID NO: 5934 - protein, 25 aa, synthetic construct
  source 1..25: note = Seed: LNVIVHSATGFKQSSKALQRPVASD
LNVIVHSATGLKQNSHALVRPVASD

SEQ ID NO: 5935 - protein, 25 aa, synthetic construct
  source 1..25: note = Seed: LNVIVHSATGFKQSSKALQRPVASD
LNVIVHSATGLKQNSIALARPVASD

SEQ ID NO: 5936 - protein, 25 aa, synthetic construct
  source 1..25: note = Seed: LNVIVHSATGFKQSSKALQRPVASD
LNVIVHSATGLKQNSIALFRPVASD

SEQ ID NO: 5937 - protein, 25 aa, synthetic construct
  source 1..25: note = Seed: LNVIVHSATGFKQSSKALQRPVASD
LNVIVHSATGLKQNSIALIRPVASD

SEQ ID NO: 5938 - protein, 25 aa, synthetic construct
  source 1..25: note = Seed: LNVIVHSATGFKQSSKALQRPVASD
LNVIVHSATGLKQNSIALLRPVASD

SEQ ID NO: 5939 - protein, 25 aa, synthetic construct
  source 1..25: note = Seed: LNVIVHSATGFKQSSKALQRPVASD
LNVIVHSATGLKQNSIALMRPVASD

SEQ ID NO: 5940 - protein, 25 aa, synthetic construct
  source 1..25: note = Seed: LNVIVHSATGFKQSSKALQRPVASD
LNVIVHSATGLKQNSIALSRPVASD

SEQ ID NO: 5941 - protein, 25 aa, synthetic construct
  source 1..25: note = Seed: LNVIVHSATGFKQSSKALQRPVASD
LNVIVHSATGLKQNSIALTRPVASD

SEQ ID NO: 5942 - protein, 25 aa, synthetic construct
  source 1..25: note = Seed: LNVIVHSATGFKQSSKALQRPVASD
LNVIVHSATGLKQNSIALVRPVASD

SEQ ID NO: 5943 - protein, 25 aa, synthetic construct
  source 1..25: note = Seed: LNVIVHSATGFKQSSKALQRPVASD
LNVIVHSATGLKQNSIALYRPVASD

SEQ ID NO: 5944 - protein, 25 aa, synthetic construct
  source 1..25: note = Seed: LNVIVHSATGFKQSSKALQRPVASD
LNVIVHSATGLKQNSLALFRPVASD

SEQ ID NO: 5945 - protein, 25 aa, synthetic construct
  source 1..25: note = Seed: LNVIVHSATGFKQSSKALQRPVASD
LNVIVHSATGLKQNSLALIRPVASD

SEQ ID NO: 5946 - protein, 25 aa, synthetic construct
  source 1..25: note = Seed: LNVIVHSATGFKQSSKALQRPVASD
LNVIVHSATGLKQNSLALLRPVASD

SEQ ID NO: 5947 - protein, 25 aa, synthetic construct
  source 1..25: note = Seed: LNVIVHSATGFKQSSKALQRPVASD
LNVIVHSATGLKQNSLALMRPVASD

SEQ ID NO: 5948 - protein, 25 aa, synthetic construct
  source 1..25: note = Seed: LNVIVHSATGFKQSSKALQRPVASD
LNVIVHSATGLKQNSLALNRPVASD

SEQ ID NO: 5949 - protein, 25 aa, synthetic construct
  source 1..25: note = Seed: LNVIVHSATGFKQSSKALQRPVASD
LNVIVHSATGLKQNSLALVRPVASD

SEQ ID NO: 5950 - protein, 25 aa, synthetic construct
  source 1..25: note = Seed: LNVIVHSATGFKQSSKALQRPVASD
LNVIVHSATGLKQNSLALYRPVASD

SEQ ID NO: 5951 - protein, 25 aa, synthetic construct
  source 1..25: note = Seed: LNVIVHSATGFKQSSKALQRPVASD
LNVIVHSATGLKQNSMALFRPVASD

SEQ ID NO: 5952 - protein, 25 aa, synthetic construct
  source 1..25: note = Seed: LNVIVHSATGFKQSSKALQRPVASD
LNVIVHSATGLKQNSMALIRPVASD

SEQ ID NO: 5953 - protein, 25 aa, synthetic construct
  source 1..25: note = Seed: LNVIVHSATGFKQSSKALQRPVASD
LNVIVHSATGLKQNSMALLRPVASD

SEQ ID NO: 5954 - protein, 25 aa, synthetic construct
  source 1..25: note = Seed: LNVIVHSATGFKQSSKALQRPVASD
LNVIVHSATGLKQNSMALMRPVASD

SEQ ID NO: 5955 - protein, 25 aa, synthetic construct
  source 1..25: note = Seed: LNVIVHSATGFKQSSKALQRPVASD
LNVIVHSATGLKQNSMALVRPVASD

SEQ ID NO: 5956 - protein, 25 aa, synthetic construct
  source 1..25: note = Seed: LNVIVHSATGFKQSSKALQRPVASD
LNVIVHSATGLKQNSMALYRPVASD

SEQ ID NO: 5957 - protein, 25 aa, synthetic construct
  source 1..25: note = Seed: LNVIVHSATGFKQSSKALQRPVASD
LNVIVHSATGLKQNSNALARPVASD

SEQ ID NO: 5958 - protein, 25 aa, synthetic construct
  source 1..25: note = Seed: LNVIVHSATGFKQSSKALQRPVASD
LNVIVHSATGLKQNSNALFRPVASD

SEQ ID NO: 5959 - protein, 25 aa, synthetic construct
  source 1..25: note = Seed: LNVIVHSATGFKQSSKALQRPVASD
LNVIVHSATGLKQNSNALIRPVASD

SEQ ID NO: 5960 - protein, 25 aa, synthetic construct
  source 1..25: note = Seed: LNVIVHSATGFKQSSKALQRPVASD
LNVIVHSATGLKQNSNALLRPVASD

SEQ ID NO: 5961 - protein, 25 aa, synthetic construct
  source 1..25: note = Seed: LNVIVHSATGFKQSSKALQRPVASD
LNVIVHSATGLKQNSNALMRPVASD

SEQ ID NO: 5962 - protein, 25 aa, synthetic construct
  source 1..25: note = Seed: LNVIVHSATGFKQSSKALQRPVASD
LNVIVHSATGLKQNSNALSRPVASD

SEQ ID NO: 5963 - protein, 25 aa, synthetic construct
  source 1..25: note = Seed: LNVIVHSATGFKQSSKALQRPVASD
LNVIVHSATGLKQNSNALTRPVASD

SEQ ID NO: 5964 - protein, 25 aa, synthetic construct
  source 1..25: note = Seed: LNVIVHSATGFKQSSKALQRPVASD
LNVIVHSATGLKQNSNALVRPVASD

SEQ ID NO: 5965 - protein, 25 aa, synthetic construct
  source 1..25: note = Seed: LNVIVHSATGFKQSSKALQRPVASD
LNVIVHSATGLKQNSNALWRPVASD

SEQ ID NO: 5966 - protein, 25 aa, synthetic construct
  source 1..25: note = Seed: LNVIVHSATGFKQSSKALQRPVASD
LNVIVHSATGLKQNSNALYRPVASD

SEQ ID NO: 5967 - protein, 25 aa, synthetic construct
  source 1..25: note = Seed: LNVIVHSATGFKQSSKALQRPVASD
LNVIVHSATGLKQNSPALARPVASD

SEQ ID NO: 5968 - protein, 25 aa, synthetic construct
  source 1..25: note = Seed: LNVIVHSATGFKQSSKALQRPVASD
LNVIVHSATGLKQNSPALFRPVASD

SEQ ID NO: 5969 - protein, 25 aa, synthetic construct
  source 1..25: note = Seed: LNVIVHSATGFKQSSKALQRPVASD
LNVIVHSATGLKQNSPALIRPVASD

SEQ ID NO: 5970 - protein, 25 aa, synthetic construct
  source 1..25: note = Seed: LNVIVHSATGFKQSSKALQRPVASD
LNVIVHSATGLKQNSPALLRPVASD

SEQ ID NO: 5971 - protein, 25 aa, synthetic construct
  source 1..25: note = Seed: LNVIVHSATGFKQSSKALQRPVASD
LNVIVHSATGLKQNSPALMRPVASD

SEQ ID NO: 5972 - protein, 25 aa, synthetic construct
  source 1..25: note = Seed: LNVIVHSATGFKQSSKALQRPVASD
LNVIVHSATGLKQNSPALSRPVASD

SEQ ID NO: 5973 - protein, 25 aa, synthetic construct
  source 1..25: note = Seed: LNVIVHSATGFKQSSKALQRPVASD
LNVIVHSATGLKQNSPALTRPVASD

SEQ ID NO: 5974 - protein, 25 aa, synthetic construct
  source 1..25: note = Seed: LNVIVHSATGFKQSSKALQRPVASD
LNVIVHSATGLKQNSPALVRPVASD

SEQ ID NO: 5975 - protein, 25 aa, synthetic construct
  source 1..25: note = Seed: LNVIVHSATGFKQSSKALQRPVASD
LNVIVHSATGLKQNSPALWRPVASD

SEQ ID NO: 5976 - protein, 25 aa, synthetic construct
  source 1..25: note = Seed: LNVIVHSATGFKQSSKALQRPVASD
LNVIVHSATGLKQNSPALYRPVASD

SEQ ID NO: 5977 - protein, 25 aa, synthetic construct
  source 1..25: note = Seed: LNVIVHSATGFKQSSKALQRPVASD
LNVIVHSATGLKQNSQALIRPVASD

SEQ ID NO: 5978 - protein, 25 aa, synthetic construct
  source 1..25: note = Seed: LNVIVHSATGFKQSSKALQRPVASD
LNVIVHSATGLKQNSQALVRPVASD

SEQ ID NO: 5979 - protein, 25 aa, synthetic construct
  source 1..25: note = Seed: LNVIVHSATGFKQSSKALQRPVASD
LNVIVHSATGLKQNSSALARPVASD

SEQ ID NO: 5980 - protein, 25 aa, synthetic construct
  source 1..25: note = Seed: LNVIVHSATGFKQSSKALQRPVASD
LNVIVHSATGLKQNSSALFRPVASD

SEQ ID NO: 5981 - protein, 25 aa, synthetic construct
  source 1..25: note = Seed: LNVIVHSATGFKQSSKALQRPVASD
LNVIVHSATGLKQNSSALIRPVASD

SEQ ID NO: 5982 - protein, 25 aa, synthetic construct
  source 1..25: note = Seed: LNVIVHSATGFKQSSKALQRPVASD
LNVIVHSATGLKQNSSALLRPVASD

SEQ ID NO: 5983 - protein, 25 aa, synthetic construct
  source 1..25: note = Seed: LNVIVHSATGFKQSSKALQRPVASD
LNVIVHSATGLKQNSSALMRPVASD

SEQ ID NO: 5984 - protein, 25 aa, synthetic construct
  source 1..25: note = Seed: LNVIVHSATGFKQSSKALQRPVASD
LNVIVHSATGLKQNSSALSRPVASD

SEQ ID NO: 5985 - protein, 25 aa, synthetic construct
  source 1..25: note = Seed: LNVIVHSATGFKQSSKALQRPVASD
LNVIVHSATGLKQNSSALTRPVASD

SEQ ID NO: 5986 - protein, 25 aa, synthetic construct
  source 1..25: note = Seed: LNVIVHSATGFKQSSKALQRPVASD
LNVIVHSATGLKQNSSALVRPVASD

SEQ ID NO: 5987 - protein, 25 aa, synthetic construct
  source 1..25: note = Seed: LNVIVHSATGFKQSSKALQRPVASD
LNVIVHSATGLKQNSSALWRPVASD

SEQ ID NO: 5988 - protein, 25 aa, synthetic construct
  source 1..25: note = Seed: LNVIVHSATGFKQSSKALQRPVASD
LNVIVHSATGLKQNSSALYRPVASD

SEQ ID NO: 5989 - protein, 25 aa, synthetic construct
  source 1..25: note = Seed: LNVIVHSATGFKQSSKALQRPVASD
LNVIVHSATGLKQNSTALARPVASD

SEQ ID NO: 5990 - protein, 25 aa, synthetic construct
  source 1..25: note = Seed: LNVIVHSATGFKQSSKALQRPVASD
LNVIVHSATGLKQNSTALFRPVASD

SEQ ID NO: 5991 - protein, 25 aa, synthetic construct
  source 1..25: note = Seed: LNVIVHSATGFKQSSKALQRPVASD
LNVIVHSATGLKQNSTALIRPVASD

SEQ ID NO: 5992 - protein, 25 aa, synthetic construct
  source 1..25: note = Seed: LNVIVHSATGFKQSSKALQRPVASD
LNVIVHSATGLKQNSTALLRPVASD

SEQ ID NO: 5993 - protein, 25 aa, synthetic construct
  source 1..25: note = Seed: LNVIVHSATGFKQSSKALQRPVASD
LNVIVHSATGLKQNSTALMRPVASD

SEQ ID NO: 5994 - protein, 25 aa, synthetic construct
  source 1..25: note = Seed: LNVIVHSATGFKQSSKALQRPVASD
LNVIVHSATGLKQNSTALVRPVASD

SEQ ID NO: 5995 - protein, 25 aa, synthetic construct
  source 1..25: note = Seed: LNVIVHSATGFKQSSKALQRPVASD
LNVIVHSATGLKQNSTALYRPVASD

SEQ ID NO: 5996 - protein, 25 aa, synthetic construct
  source 1..25: note = Seed: LNVIVHSATGFKQSSKALQRPVASD
LNVIVHSATGLKQNSVALARPVASD

SEQ ID NO: 5997 - protein, 25 aa, synthetic construct
  source 1..25: note = Seed: LNVIVHSATGFKQSSKALQRPVASD
LNVIVHSATGLKQNSVALFRPVASD

SEQ ID NO: 5998 - protein, 25 aa, synthetic construct
  source 1..25: note = Seed: LNVIVHSATGFKQSSKALQRPVASD
LNVIVHSATGLKQNSVALIRPVASD

SEQ ID NO: 5999 - protein, 25 aa, synthetic construct
  source 1..25: note = Seed: LNVIVHSATGFKQSSKALQRPVASD
LNVIVHSATGLKQNSVALLRPVASD

SEQ ID NO: 6000 - protein, 25 aa, synthetic construct
  source 1..25: note = Seed: LNVIVHSATGFKQSSKALQRPVASD
LNVIVHSATGLKQNSVALMRPVASD

SEQ ID NO: 6001 - protein, 25 aa, synthetic construct
  source 1..25: note = Seed: LNVIVHSATGFKQSSKALQRPVASD
LNVIVHSATGLKQNSVALNRPVASD

SEQ ID NO: 6002 - protein, 25 aa, synthetic construct
  source 1..25: note = Seed: LNVIVHSATGFKQSSKALQRPVASD
LNVIVHSATGLKQNSVALSRPVASD

SEQ ID NO: 6003 - protein, 25 aa, synthetic construct
  source 1..25: note = Seed: LNVIVHSATGFKQSSKALQRPVASD
LNVIVHSATGLKQNSVALTRPVASD

SEQ ID NO: 6004 - protein, 25 aa, synthetic construct
  source 1..25: note = Seed: LNVIVHSATGFKQSSKALQRPVASD
LNVIVHSATGLKQNSVALVRPVASD

SEQ ID NO: 6005 - protein, 25 aa, synthetic construct
  source 1..25: note = Seed: LNVIVHSATGFKQSSKALQRPVASD
LNVIVHSATGLKQNSVALYRPVASD

SEQ ID NO: 6006 - protein, 25 aa, synthetic construct
  source 1..25: note = Seed: LNVIVHSATGFKQSSKALQRPVASD
LNVIVHSATGLKQNSYALIRPVASD

SEQ ID NO: 6007 - protein, 25 aa, synthetic construct
  source 1..25: note = Seed: LNVIVHSATGFKQSSKALQRPVASD
LNVIVHSATGLKQNSYALVRPVASD

SEQ ID NO: 6008 - protein, 25 aa, synthetic construct
  source 1..25: note = Seed: LNVIVHSATGFKQSSKALQRPVASD
LNVIVHSATGLKQQSAALARPVASD

SEQ ID NO: 6009 - protein, 25 aa, synthetic construct
  source 1..25: note = Seed: LNVIVHSATGFKQSSKALQRPVASD
LNVIVHSATGLKQQSAALIRPVASD

SEQ ID NO: 6010 - protein, 25 aa, synthetic construct
  source 1..25: note = Seed: LNVIVHSATGFKQSSKALQRPVASD
LNVIVHSATGLKQQSAALLRPVASD

SEQ ID NO: 6011 - protein, 25 aa, synthetic construct
  source 1..25: note = Seed: LNVIVHSATGFKQSSKALQRPVASD
LNVIVHSATGLKQQSAALMRPVASD

SEQ ID NO: 6012 - protein, 25 aa, synthetic construct
  source 1..25: note = Seed: LNVIVHSATGFKQSSKALQRPVASD
LNVIVHSATGLKQQSAALNRPVASD

SEQ ID NO: 6013 - protein, 25 aa, synthetic construct
  source 1..25: note = Seed: LNVIVHSATGFKQSSKALQRPVASD
LNVIVHSATGLKQQSAALSRPVASD

SEQ ID NO: 6014 - protein, 25 aa, synthetic construct
  source 1..25: note = Seed: LNVIVHSATGFKQSSKALQRPVASD
LNVIVHSATGLKQQSAALTRPVASD

SEQ ID NO: 6015 - protein, 25 aa, synthetic construct
  source 1..25: note = Seed: LNVIVHSATGFKQSSKALQRPVASD
LNVIVHSATGLKQQSAALVRPVASD

SEQ ID NO: 6016 - protein, 25 aa, synthetic construct
  source 1..25: note = Seed: LNVIVHSATGFKQSSKALQRPVASD
LNVIVHSATGLKQQSGALARPVASD

SEQ ID NO: 6017 - protein, 25 aa, synthetic construct
  source 1..25: note = Seed: LNVIVHSATGFKQSSKALQRPVASD
LNVIVHSATGLKQQSGALIRPVASD

SEQ ID NO: 6018 - protein, 25 aa, synthetic construct
  source 1..25: note = Seed: LNVIVHSATGFKQSSKALQRPVASD
LNVIVHSATGLKQQSGALLRPVASD

SEQ ID NO: 6019 - protein, 25 aa, synthetic construct
  source 1..25: note = Seed: LNVIVHSATGFKQSSKALQRPVASD
LNVIVHSATGLKQQSGALMRPVASD

SEQ ID NO: 6020 - protein, 25 aa, synthetic construct
  source 1..25: note = Seed: LNVIVHSATGFKQSSKALQRPVASD
LNVIVHSATGLKQQSGALSRPVASD

SEQ ID NO: 6021 - protein, 25 aa, synthetic construct
  source 1..25: note = Seed: LNVIVHSATGFKQSSKALQRPVASD
LNVIVHSATGLKQQSGALTRPVASD

SEQ ID NO: 6022 - protein, 25 aa, synthetic construct
  source 1..25: note = Seed: LNVIVHSATGFKQSSKALQRPVASD
LNVIVHSATGLKQQSGALVRPVASD

SEQ ID NO: 6023 - protein, 25 aa, synthetic construct
  source 1..25: note = Seed: LNVIVHSATGFKQSSKALQRPVASD
LNVIVHSATGLKQQSIALARPVASD

SEQ ID NO: 6024 - protein, 25 aa, synthetic construct
  source 1..25: note = Seed: LNVIVHSATGFKQSSKALQRPVASD
LNVIVHSATGLKQQSIALSRPVASD

SEQ ID NO: 6025 - protein, 25 aa, synthetic construct
  source 1..25: note = Seed: LNVIVHSATGFKQSSKALQRPVASD
LNVIVHSATGLKQQSIALVRPVASD

SEQ ID NO: 6026 - protein, 25 aa, synthetic construct
  source 1..25: note = Seed: LNVIVHSATGFKQSSKALQRPVASD
LNVIVHSATGLKQQSKALARPVASD

SEQ ID NO: 6027 - protein, 25 aa, synthetic construct
  source 1..25: note = Seed: LNVIVHSATGFKQSSKALQRPVASD
LNVIVHSATGLKQQSKALSRPVASD

SEQ ID NO: 6028 - protein, 25 aa, synthetic construct
  source 1..25: note = Seed: LNVIVHSATGFKQSSKALQRPVASD
LNVIVHSATGLKQQSLALARPVASD

SEQ ID NO: 6029 - protein, 25 aa, synthetic construct
  source 1..25: note = Seed: LNVIVHSATGFKQSSKALQRPVASD
LNVIVHSATGLKQQSLALVRPVASD

SEQ ID NO: 6030 - protein, 25 aa, synthetic construct
  source 1..25: note = Seed: LNVIVHSATGFKQSSKALQRPVASD
LNVIVHSATGLKQQSMALARPVASD

SEQ ID NO: 6031 - protein, 25 aa, synthetic construct
  source 1..25: note = Seed: LNVIVHSATGFKQSSKALQRPVASD
LNVIVHSATGLKQQSNALARPVASD

SEQ ID NO: 6032 - protein, 25 aa, synthetic construct
  source 1..25: note = Seed: LNVIVHSATGFKQSSKALQRPVASD
LNVIVHSATGLKQQSNALLRPVASD

SEQ ID NO: 6033 - protein, 25 aa, synthetic construct
  source 1..25: note = Seed: LNVIVHSATGFKQSSKALQRPVASD
LNVIVHSATGLKQQSNALVRPVASD

SEQ ID NO: 6034 - protein, 25 aa, synthetic construct
  source 1..25: note = Seed: LNVIVHSATGFKQSSKALQRPVASD
LNVIVHSATGLKQQSPALARPVASD

SEQ ID NO: 6035 - protein, 25 aa, synthetic construct
  source 1..25: note = Seed: LNVIVHSATGFKQSSKALQRPVASD
LNVIVHSATGLKQQSPALIRPVASD

SEQ ID NO: 6036 - protein, 25 aa, synthetic construct
  source 1..25: note = Seed: LNVIVHSATGFKQSSKALQRPVASD
LNVIVHSATGLKQQSPALLRPVASD

SEQ ID NO: 6037 - protein, 25 aa, synthetic construct
  source 1..25: note = Seed: LNVIVHSATGFKQSSKALQRPVASD
LNVIVHSATGLKQQSPALVRPVASD

SEQ ID NO: 6038 - protein, 25 aa, synthetic construct
  source 1..25: note = Seed: LNVIVHSATGFKQSSKALQRPVASD
LNVIVHSATGLKQQSRALARPVASD

SEQ ID NO: 6039 - protein, 25 aa, synthetic construct
  source 1..25: note = Seed: LNVIVHSATGFKQSSKALQRPVASD
LNVIVHSATGLKQQSRALGRPVASD

SEQ ID NO: 6040 - protein, 25 aa, synthetic construct
  source 1..25: note = Seed: LNVIVHSATGFKQSSKALQRPVASD
LNVIVHSATGLKQQSRALHRPVASD

SEQ ID NO: 6041 - protein, 25 aa, synthetic construct
  source 1..25: note = Seed: LNVIVHSATGFKQSSKALQRPVASD
LNVIVHSATGLKQQSRALKRPVASD

SEQ ID NO: 6042 - protein, 25 aa, synthetic construct
  source 1..25: note = Seed: LNVIVHSATGFKQSSKALQRPVASD
LNVIVHSATGLKQQSRALQRPVASD

SEQ ID NO: 6043 - protein, 25 aa, synthetic construct
  source 1..25: note = Seed: LNVIVHSATGFKQSSKALQRPVASD
LNVIVHSATGLKQQSRALRRPVASD

SEQ ID NO: 6044 - protein, 25 aa, synthetic construct
  source 1..25: note = Seed: LNVIVHSATGFKQSSKALQRPVASD
LNVIVHSATGLKQQSRALSRPVASD

SEQ ID NO: 6045 - protein, 25 aa, synthetic construct
  source 1..25: note = Seed: LNVIVHSATGFKQSSKALQRPVASD
LNVIVHSATGLKQQSRALTRPVASD

SEQ ID NO: 6046 - protein, 25 aa, synthetic construct
  source 1..25: note = Seed: LNVIVHSATGFKQSSKALQRPVASD
LNVIVHSATGLKQQSRALYRPVASD

SEQ ID NO: 6047 - protein, 25 aa, synthetic construct
  source 1..25: note = Seed: LNVIVHSATGFKQSSKALQRPVASD
LNVIVHSATGLKQQSSALARPVASD

SEQ ID NO: 6048 - protein, 25 aa, synthetic construct
  source 1..25: note = Seed: LNVIVHSATGFKQSSKALQRPVASD
LNVIVHSATGLKQQSSALIRPVASD

SEQ ID NO: 6049 - protein, 25 aa, synthetic construct
  source 1..25: note = Seed: LNVIVHSATGFKQSSKALQRPVASD
LNVIVHSATGLKQQSSALLRPVASD

SEQ ID NO: 6050 - protein, 25 aa, synthetic construct
  source 1..25: note = Seed: LNVIVHSATGFKQSSKALQRPVASD
LNVIVHSATGLKQQSSALSRPVASD

SEQ ID NO: 6051 - protein, 25 aa, synthetic construct
  source 1..25: note = Seed: LNVIVHSATGFKQSSKALQRPVASD
LNVIVHSATGLKQQSSALTRPVASD

SEQ ID NO: 6052 - protein, 25 aa, synthetic construct
  source 1..25: note = Seed: LNVIVHSATGFKQSSKALQRPVASD
LNVIVHSATGLKQQSSALVRPVASD

SEQ ID NO: 6053 - protein, 25 aa, synthetic construct
  source 1..25: note = Seed: LNVIVHSATGFKQSSKALQRPVASD
LNVIVHSATGLKQQSTALARPVASD

SEQ ID NO: 6054 - protein, 25 aa, synthetic construct
  source 1..25: note = Seed: LNVIVHSATGFKQSSKALQRPVASD
LNVIVHSATGLKQQSVALARPVASD

SEQ ID NO: 6055 - protein, 25 aa, synthetic construct
  source 1..25: note = Seed: LNVIVHSATGFKQSSKALQRPVASD
LNVIVHSATGLKQQSVALLRPVASD

SEQ ID NO: 6056 - protein, 25 aa, synthetic construct
  source 1..25: note = Seed: LNVIVHSATGFKQSSKALQRPVASD
LNVIVHSATGLKQQSVALMRPVASD

SEQ ID NO: 6057 - protein, 25 aa, synthetic construct
  source 1..25: note = Seed: LNVIVHSATGFKQSSKALQRPVASD
LNVIVHSATGLKQQSVALSRPVASD

SEQ ID NO: 6058 - protein, 25 aa, synthetic construct
  source 1..25: note = Seed: LNVIVHSATGFKQSSKALQRPVASD
LNVIVHSATGLKQRSIALRRPVASD

SEQ ID NO: 6059 - protein, 25 aa, synthetic construct
  source 1..25: note = Seed: LNVIVHSATGFKQSSKALQRPVASD
LNVIVHSATGLKQRSKALFRPVASD

SEQ ID NO: 6060 - protein, 25 aa, synthetic construct
  source 1..25: note = Seed: LNVIVHSATGFKQSSKALQRPVASD
LNVIVHSATGLKQRSKALRRPVASD

SEQ ID NO: 6061 - protein, 25 aa, synthetic construct
  source 1..25: note = Seed: LNVIVHSATGFKQSSKALQRPVASD
LNVIVHSATGLKQRSKALYRPVASD

SEQ ID NO: 6062 - protein, 25 aa, synthetic construct
  source 1..25: note = Seed: LNVIVHSATGFKQSSKALQRPVASD
LNVIVHSATGLKQRSRALARPVASD

SEQ ID NO: 6063 - protein, 25 aa, synthetic construct
  source 1..25: note = Seed: LNVIVHSATGFKQSSKALQRPVASD
LNVIVHSATGLKQRSRALFRPVASD

SEQ ID NO: 6064 - protein, 25 aa, synthetic construct
  source 1..25: note = Seed: LNVIVHSATGFKQSSKALQRPVASD
LNVIVHSATGLKQRSRALHRPVASD

SEQ ID NO: 6065 - protein, 25 aa, synthetic construct
  source 1..25: note = Seed: LNVIVHSATGFKQSSKALQRPVASD
LNVIVHSATGLKQRSRALIRPVASD

SEQ ID NO: 6066 - protein, 25 aa, synthetic construct
  source 1..25: note = Seed: LNVIVHSATGFKQSSKALQRPVASD
LNVIVHSATGLKQRSRALKRPVASD

SEQ ID NO: 6067 - protein, 25 aa, synthetic construct
  source 1..25: note = Seed: LNVIVHSATGFKQSSKALQRPVASD
LNVIVHSATGLKQRSRALLRPVASD

SEQ ID NO: 6068 - protein, 25 aa, synthetic construct
  source 1..25: note = Seed: LNVIVHSATGFKQSSKALQRPVASD
LNVIVHSATGLKQRSRALMRPVASD

SEQ ID NO: 6069 - protein, 25 aa, synthetic construct
  source 1..25: note = Seed: LNVIVHSATGFKQSSKALQRPVASD
LNVIVHSATGLKQRSRALRRPVASD

SEQ ID NO: 6070 - protein, 25 aa, synthetic construct
  source 1..25: note = Seed: LNVIVHSATGFKQSSKALQRPVASD
LNVIVHSATGLKQRSRALSRPVASD

SEQ ID NO: 6071 - protein, 25 aa, synthetic construct
  source 1..25: note = Seed: LNVIVHSATGFKQSSKALQRPVASD
LNVIVHSATGLKQRSRALVRPVASD

SEQ ID NO: 6072 - protein, 25 aa, synthetic construct
  source 1..25: note = Seed: LNVIVHSATGFKQSSKALQRPVASD
LNVIVHSATGLKQRSRALYRPVASD

SEQ ID NO: 6073 - protein, 25 aa, synthetic construct
  source 1..25: note = Seed: LNVIVHSATGFKQSSKALQRPVASD
LNVIVHSATGLKQRSVALRRPVASD

SEQ ID NO: 6074 - protein, 25 aa, synthetic construct
  source 1..25: note = Seed: LNVIVHSATGFKQSSKALQRPVASD
LNVIVHSATGLKQSSAALARPVASD

SEQ ID NO: 6075 - protein, 25 aa, synthetic construct
  source 1..25: note = Seed: LNVIVHSATGFKQSSKALQRPVASD
LNVIVHSATGLKQSSAALFRPVASD

SEQ ID NO: 6076 - protein, 25 aa, synthetic construct
  source 1..25: note = Seed: LNVIVHSATGFKQSSKALQRPVASD
LNVIVHSATGLKQSSAALIRPVASD

SEQ ID NO: 6077 - protein, 25 aa, synthetic construct
  source 1..25: note = Seed: LNVIVHSATGFKQSSKALQRPVASD
LNVIVHSATGLKQSSAALLRPVASD

SEQ ID NO: 6078 - protein, 25 aa, synthetic construct
  source 1..25: note = Seed: LNVIVHSATGFKQSSKALQRPVASD
LNVIVHSATGLKQSSAALMRPVASD

SEQ ID NO: 6079 - protein, 25 aa, synthetic construct
  source 1..25: note = Seed: LNVIVHSATGFKQSSKALQRPVASD
LNVIVHSATGLKQSSAALVRPVASD

SEQ ID NO: 6080 - protein, 25 aa, synthetic construct
  source 1..25: note = Seed: LNVIVHSATGFKQSSKALQRPVASD
LNVIVHSATGLKQSSAALYRPVASD

SEQ ID NO: 6081 - protein, 25 aa, synthetic construct
  source 1..25: note = Seed: LNVIVHSATGFKQSSKALQRPVASD
LNVIVHSATGLKQSSFALIRPVASD

SEQ ID NO: 6082 - protein, 25 aa, synthetic construct
  source 1..25: note = Seed: LNVIVHSATGFKQSSKALQRPVASD
LNVIVHSATGLKQSSFALLRPVASD

SEQ ID NO: 6083 - protein, 25 aa, synthetic construct
  source 1..25: note = Seed: LNVIVHSATGFKQSSKALQRPVASD
LNVIVHSATGLKQSSFALVRPVASD

SEQ ID NO: 6084 - protein, 25 aa, synthetic construct
  source 1..25: note = Seed: LNVIVHSATGFKQSSKALQRPVASD
LNVIVHSATGLKQSSGALARPVASD

SEQ ID NO: 6085 - protein, 25 aa, synthetic construct
  source 1..25: note = Seed: LNVIVHSATGFKQSSKALQRPVASD
LNVIVHSATGLKQSSGALIRPVASD

SEQ ID NO: 6086 - protein, 25 aa, synthetic construct
  source 1..25: note = Seed: LNVIVHSATGFKQSSKALQRPVASD
LNVIVHSATGLKQSSGALLRPVASD

SEQ ID NO: 6087 - protein, 25 aa, synthetic construct
  source 1..25: note = Seed: LNVIVHSATGFKQSSKALQRPVASD
LNVIVHSATGLKQSSGALVRPVASD

SEQ ID NO: 6088 - protein, 25 aa, synthetic construct
  source 1..25: note = Seed: LNVIVHSATGFKQSSKALQRPVASD
LNVIVHSATGLKQSSIALARPVASD

SEQ ID NO: 6089 - protein, 25 aa, synthetic construct
  source 1..25: note = Seed: LNVIVHSATGFKQSSKALQRPVASD
LNVIVHSATGLKQSSKALARPVASD

SEQ ID NO: 6090 - protein, 25 aa, synthetic construct
  source 1..25: note = Seed: LNVIVHSATGFKQSSKALQRPVASD
LNVIVHSATGLKQSSKALRRPVASD

SEQ ID NO: 6091 - protein, 25 aa, synthetic construct
  source 1..25: note = Seed: LNVIVHSATGFKQSSKALQRPVASD
LNVIVHSATGLKQSSKALSRPVASD

SEQ ID NO: 6092 - protein, 25 aa, synthetic construct
  source 1..25: note = Seed: LNVIVHSATGFKQSSKALQRPVASD
LNVIVHSATGLKQSSNALFRPVASD

SEQ ID NO: 6093 - protein, 25 aa, synthetic construct
  source 1..25: note = Seed: LNVIVHSATGFKQSSKALQRPVASD
LNVIVHSATGLKQSSNALIRPVASD

SEQ ID NO: 6094 - protein, 25 aa, synthetic construct
  source 1..25: note = Seed: LNVIVHSATGFKQSSKALQRPVASD
LNVIVHSATGLKQSSNALVRPVASD

SEQ ID NO: 6095 - protein, 25 aa, synthetic construct
  source 1..25: note = Seed: LNVIVHSATGFKQSSKALQRPVASD
LNVIVHSATGLKQSSNALYRPVASD

SEQ ID NO: 6096 - protein, 25 aa, synthetic construct
  source 1..25: note = Seed: LNVIVHSATGFKQSSKALQRPVASD
LNVIVHSATGLKQSSPALIRPVASD

SEQ ID NO: 6097 - protein, 25 aa, synthetic construct
  source 1..25: note = Seed: LNVIVHSATGFKQSSKALQRPVASD
LNVIVHSATGLKQSSPALLRPVASD

SEQ ID NO: 6098 - protein, 25 aa, synthetic construct
  source 1..25: note = Seed: LNVIVHSATGFKQSSKALQRPVASD
LNVIVHSATGLKQSSPALVRPVASD

SEQ ID NO: 6099 - protein, 25 aa, synthetic construct
  source 1..25: note = Seed: LNVIVHSATGFKQSSKALQRPVASD
LNVIVHSATGLKQSSRALARPVASD

SEQ ID NO: 6100 - protein, 25 aa, synthetic construct
  source 1..25: note = Seed: LNVIVHSATGFKQSSKALQRPVASD
LNVIVHSATGLKQSSRALHRPVASD

SEQ ID NO: 6101 - protein, 25 aa, synthetic construct
  source 1..25: note = Seed: LNVIVHSATGFKQSSKALQRPVASD
LNVIVHSATGLKQSSRALKRPVASD

SEQ ID NO: 6102 - protein, 25 aa, synthetic construct
  source 1..25: note = Seed: LNVIVHSATGFKQSSKALQRPVASD
LNVIVHSATGLKQSSRALQRPVASD

SEQ ID NO: 6103 - protein, 25 aa, synthetic construct
  source 1..25: note = Seed: LNVIVHSATGFKQSSKALQRPVASD
LNVIVHSATGLKQSSRALRRPVASD

SEQ ID NO: 6104 - protein, 25 aa, synthetic construct
  source 1..25: note = Seed: LNVIVHSATGFKQSSKALQRPVASD
LNVIVHSATGLKQSSRALSRPVASD

SEQ ID NO: 6105 - protein, 25 aa, synthetic construct
  source 1..25: note = Seed: LNVIVHSATGFKQSSKALQRPVASD
LNVIVHSATGLKQSSRALYRPVASD

SEQ ID NO: 6106 - protein, 25 aa, synthetic construct
  source 1..25: note = Seed: LNVIVHSATGFKQSSKALQRPVASD
LNVIVHSATGLKQSSSALFRPVASD

SEQ ID NO: 6107 - protein, 25 aa, synthetic construct
  source 1..25: note = Seed: LNVIVHSATGFKQSSKALQRPVASD
LNVIVHSATGLKQSSSALIRPVASD

SEQ ID NO: 6108 - protein, 25 aa, synthetic construct
  source 1..25: note = Seed: LNVIVHSATGFKQSSKALQRPVASD
LNVIVHSATGLKQSSSALLRPVASD

SEQ ID NO: 6109 - protein, 25 aa, synthetic construct
  source 1..25: note = Seed: LNVIVHSATGFKQSSKALQRPVASD
LNVIVHSATGLKQSSSALMRPVASD

SEQ ID NO: 6110 - protein, 25 aa, synthetic construct
  source 1..25: note = Seed: LNVIVHSATGFKQSSKALQRPVASD
LNVIVHSATGLKQSSSALVRPVASD

SEQ ID NO: 6111 - protein, 25 aa, synthetic construct
  source 1..25: note = Seed: LNVIVHSATGFKQSSKALQRPVASD
LNVIVHSATGLKQSSTALIRPVASD

SEQ ID NO: 6112 - protein, 25 aa, synthetic construct
  source 1..25: note = Seed: LNVIVHSATGFKQSSKALQRPVASD
LNVIVHSATGLKQSSTALVRPVASD

SEQ ID NO: 6113 - protein, 25 aa, synthetic construct
  source 1..25: note = Seed: LNVIVHSATGFKQSSKALQRPVASD
LNVIVHSATGLKQSSVALIRPVASD

SEQ ID NO: 6114 - protein, 25 aa, synthetic construct
  source 1..25: note = Seed: LNVIVHSATGFKQSSKALQRPVASD
LNVIVHSATGLKQTSAALARPVASD

SEQ ID NO: 6115 - protein, 25 aa, synthetic construct
  source 1..25: note = Seed: LNVIVHSATGFKQSSKALQRPVASD
LNVIVHSATGLKQTSAALFRPVASD

SEQ ID NO: 6116 - protein, 25 aa, synthetic construct
  source 1..25: note = Seed: LNVIVHSATGFKQSSKALQRPVASD
LNVIVHSATGLKQTSAALIRPVASD

SEQ ID NO: 6117 - protein, 25 aa, synthetic construct
  source 1..25: note = Seed: LNVIVHSATGFKQSSKALQRPVASD
LNVIVHSATGLKQTSAALLRPVASD

SEQ ID NO: 6118 - protein, 25 aa, synthetic construct
  source 1..25: note = Seed: LNVIVHSATGFKQSSKALQRPVASD
LNVIVHSATGLKQTSAALMRPVASD

SEQ ID NO: 6119 - protein, 25 aa, synthetic construct
  source 1..25: note = Seed: LNVIVHSATGFKQSSKALQRPVASD
LNVIVHSATGLKQTSAALVRPVASD

SEQ ID NO: 6120 - protein, 25 aa, synthetic construct
  source 1..25: note = Seed: LNVIVHSATGFKQSSKALQRPVASD
LNVIVHSATGLKQTSFALFRPVASD

SEQ ID NO: 6121 - protein, 25 aa, synthetic construct
  source 1..25: note = Seed: LNVIVHSATGFKQSSKALQRPVASD
LNVIVHSATGLKQTSFALIRPVASD

SEQ ID NO: 6122 - protein, 25 aa, synthetic construct
  source 1..25: note = Seed: LNVIVHSATGFKQSSKALQRPVASD
LNVIVHSATGLKQTSFALLRPVASD

SEQ ID NO: 6123 - protein, 25 aa, synthetic construct
  source 1..25: note = Seed: LNVIVHSATGFKQSSKALQRPVASD
LNVIVHSATGLKQTSFALVRPVASD

SEQ ID NO: 6124 - protein, 25 aa, synthetic construct
  source 1..25: note = Seed: LNVIVHSATGFKQSSKALQRPVASD
LNVIVHSATGLKQTSGALFRPVASD

SEQ ID NO: 6125 - protein, 25 aa, synthetic construct
  source 1..25: note = Seed: LNVIVHSATGFKQSSKALQRPVASD
LNVIVHSATGLKQTSGALIRPVASD

SEQ ID NO: 6126 - protein, 25 aa, synthetic construct
  source 1..25: note = Seed: LNVIVHSATGFKQSSKALQRPVASD
LNVIVHSATGLKQTSGALLRPVASD

SEQ ID NO: 6127 - protein, 25 aa, synthetic construct
  source 1..25: note = Seed: LNVIVHSATGFKQSSKALQRPVASD
LNVIVHSATGLKQTSGALMRPVASD

SEQ ID NO: 6128 - protein, 25 aa, synthetic construct
  source 1..25: note = Seed: LNVIVHSATGFKQSSKALQRPVASD
LNVIVHSATGLKQTSGALVRPVASD

SEQ ID NO: 6129 - protein, 25 aa, synthetic construct
  source 1..25: note = Seed: LNVIVHSATGFKQSSKALQRPVASD
LNVIVHSATGLKQTSKALARPVASD

SEQ ID NO: 6130 - protein, 25 aa, synthetic construct
  source 1..25: note = Seed: LNVIVHSATGFKQSSKALQRPVASD
LNVIVHSATGLKQTSKALSRPVASD

SEQ ID NO: 6131 - protein, 25 aa, synthetic construct
  source 1..25: note = Seed: LNVIVHSATGFKQSSKALQRPVASD
LNVIVHSATGLKQTSNALIRPVASD

SEQ ID NO: 6132 - protein, 25 aa, synthetic construct
  source 1..25: note = Seed: LNVIVHSATGFKQSSKALQRPVASD
LNVIVHSATGLKQTSNALVRPVASD

SEQ ID NO: 6133 - protein, 25 aa, synthetic construct
  source 1..25: note = Seed: LNVIVHSATGFKQSSKALQRPVASD
LNVIVHSATGLKQTSPALFRPVASD

SEQ ID NO: 6134 - protein, 25 aa, synthetic construct
  source 1..25: note = Seed: LNVIVHSATGFKQSSKALQRPVASD
LNVIVHSATGLKQTSPALIRPVASD

SEQ ID NO: 6135 - protein, 25 aa, synthetic construct
  source 1..25: note = Seed: LNVIVHSATGFKQSSKALQRPVASD
LNVIVHSATGLKQTSPALLRPVASD

SEQ ID NO: 6136 - protein, 25 aa, synthetic construct
  source 1..25: note = Seed: LNVIVHSATGFKQSSKALQRPVASD
LNVIVHSATGLKQTSPALVRPVASD

SEQ ID NO: 6137 - protein, 25 aa, synthetic construct
  source 1..25: note = Seed: LNVIVHSATGFKQSSKALQRPVASD
LNVIVHSATGLKQTSRALARPVASD

SEQ ID NO: 6138 - protein, 25 aa, synthetic construct
  source 1..25: note = Seed: LNVIVHSATGFKQSSKALQRPVASD
LNVIVHSATGLKQTSRALGRPVASD

SEQ ID NO: 6139 - protein, 25 aa, synthetic construct
  source 1..25: note = Seed: LNVIVHSATGFKQSSKALQRPVASD
LNVIVHSATGLKQTSRALHRPVASD

SEQ ID NO: 6140 - protein, 25 aa, synthetic construct
  source 1..25: note = Seed: LNVIVHSATGFKQSSKALQRPVASD
LNVIVHSATGLKQTSRALKRPVASD

SEQ ID NO: 6141 - protein, 25 aa, synthetic construct
  source 1..25: note = Seed: LNVIVHSATGFKQSSKALQRPVASD
LNVIVHSATGLKQTSRALQRPVASD

SEQ ID NO: 6142 - protein, 25 aa, synthetic construct
  source 1..25: note = Seed: LNVIVHSATGFKQSSKALQRPVASD
LNVIVHSATGLKQTSRALRRPVASD

SEQ ID NO: 6143 - protein, 25 aa, synthetic construct
  source 1..25: note = Seed: LNVIVHSATGFKQSSKALQRPVASD
LNVIVHSATGLKQTSRALSRPVASD

SEQ ID NO: 6144 - protein, 25 aa, synthetic construct
  source 1..25: note = Seed: LNVIVHSATGFKQSSKALQRPVASD
LNVIVHSATGLKQTSSALARPVASD

SEQ ID NO: 6145 - protein, 25 aa, synthetic construct
  source 1..25: note = Seed: LNVIVHSATGFKQSSKALQRPVASD
LNVIVHSATGLKQTSSALFRPVASD

SEQ ID NO: 6146 - protein, 25 aa, synthetic construct
  source 1..25: note = Seed: LNVIVHSATGFKQSSKALQRPVASD
LNVIVHSATGLKQTSSALIRPVASD

SEQ ID NO: 6147 - protein, 25 aa, synthetic construct
  source 1..25: note = Seed: LNVIVHSATGFKQSSKALQRPVASD
LNVIVHSATGLKQTSSALLRPVASD

SEQ ID NO: 6148 - protein, 25 aa, synthetic construct
  source 1..25: note = Seed: LNVIVHSATGFKQSSKALQRPVASD
LNVIVHSATGLKQTSSALMRPVASD

SEQ ID NO: 6149 - protein, 25 aa, synthetic construct
  source 1..25: note = Seed: LNVIVHSATGFKQSSKALQRPVASD
LNVIVHSATGLKQTSSALVRPVASD

SEQ ID NO: 6150 - protein, 25 aa, synthetic construct
  source 1..25: note = Seed: LNVIVHSATGFKQSSKALQRPVASD
LNVIVHSATGLKQTSSALYRPVASD

SEQ ID NO: 6151 - protein, 25 aa, synthetic construct
  source 1..25: note = Seed: LNVIVHSATGFKQSSKALQRPVASD
LNVIVHSATGLKQTSTALIRPVASD

SEQ ID NO: 6152 - protein, 25 aa, synthetic construct
  source 1..25: note = Seed: LNVIVHSATGFKQSSKALQRPVASD
LNVIVHSATGLKQTSTALLRPVASD

SEQ ID NO: 6153 - protein, 25 aa, synthetic construct
  source 1..25: note = Seed: LNVIVHSATGFKQSSKALQRPVASD
LNVIVHSATGLKQTSTALVRPVASD

SEQ ID NO: 6154 - protein, 25 aa, synthetic construct
  source 1..25: note = Seed: LNVIVHSATGFKQSSKALQRPVASD
LNVIVHSATGLKQTSVALIRPVASD

SEQ ID NO: 6155 - protein, 25 aa, synthetic construct
  source 1..25: note = Seed: LNVIVHSATGFKQSSKALQRPVASD
LNVIVHSATGLKQTSVALVRPVASD

SEQ ID NO: 6156 - protein, 25 aa, synthetic construct
  source 1..25: note = Seed: LNVIVHSATGFKQSSKALQRPVASD
LNVIVHSATGLKQVSAALARPVASD

SEQ ID NO: 6157 - protein, 25 aa, synthetic construct
  source 1..25: note = Seed: LNVIVHSATGFKQSSKALQRPVASD
LNVIVHSATGLKQVSAALGRPVASD

SEQ ID NO: 6158 - protein, 25 aa, synthetic construct
  source 1..25: note = Seed: LNVIVHSATGFKQSSKALQRPVASD
LNVIVHSATGLKQVSAALIRPVASD

SEQ ID NO: 6159 - protein, 25 aa, synthetic construct
  source 1..25: note = Seed: LNVIVHSATGFKQSSKALQRPVASD
LNVIVHSATGLKQVSAALLRPVASD

SEQ ID NO: 6160 - protein, 25 aa, synthetic construct
  source 1..25: note = Seed: LNVIVHSATGFKQSSKALQRPVASD
LNVIVHSATGLKQVSAALMRPVASD

SEQ ID NO: 6161 - protein, 25 aa, synthetic construct
  source 1..25: note = Seed: LNVIVHSATGFKQSSKALQRPVASD
LNVIVHSATGLKQVSAALNRPVASD

SEQ ID NO: 6162 - protein, 25 aa, synthetic construct
  source 1..25: note = Seed: LNVIVHSATGFKQSSKALQRPVASD
LNVIVHSATGLKQVSAALSRPVASD

SEQ ID NO: 6163 - protein, 25 aa, synthetic construct
  source 1..25: note = Seed: LNVIVHSATGFKQSSKALQRPVASD
LNVIVHSATGLKQVSAALTRPVASD

SEQ ID NO: 6164 - protein, 25 aa, synthetic construct
  source 1..25: note = Seed: LNVIVHSATGFKQSSKALQRPVASD
LNVIVHSATGLKQVSAALVRPVASD

SEQ ID NO: 6165 - protein, 25 aa, synthetic construct
  source 1..25: note = Seed: LNVIVHSATGFKQSSKALQRPVASD
LNVIVHSATGLKQVSFALIRPVASD

SEQ ID NO: 6166 - protein, 25 aa, synthetic construct
  source 1..25: note = Seed: LNVIVHSATGFKQSSKALQRPVASD
LNVIVHSATGLKQVSFALLRPVASD

SEQ ID NO: 6167 - protein, 25 aa, synthetic construct
  source 1..25: note = Seed: LNVIVHSATGFKQSSKALQRPVASD
LNVIVHSATGLKQVSFALMRPVASD

SEQ ID NO: 6168 - protein, 25 aa, synthetic construct
  source 1..25: note = Seed: LNVIVHSATGFKQSSKALQRPVASD
LNVIVHSATGLKQVSFALVRPVASD

SEQ ID NO: 6169 - protein, 25 aa, synthetic construct
  source 1..25: note = Seed: LNVIVHSATGFKQSSKALQRPVASD
LNVIVHSATGLKQVSGALARPVASD

SEQ ID NO: 6170 - protein, 25 aa, synthetic construct
  source 1..25: note = Seed: LNVIVHSATGFKQSSKALQRPVASD
LNVIVHSATGLKQVSGALIRPVASD

SEQ ID NO: 6171 - protein, 25 aa, synthetic construct
  source 1..25: note = Seed: LNVIVHSATGFKQSSKALQRPVASD
LNVIVHSATGLKQVSGALLRPVASD

SEQ ID NO: 6172 - protein, 25 aa, synthetic construct
  source 1..25: note = Seed: LNVIVHSATGFKQSSKALQRPVASD
LNVIVHSATGLKQVSGALMRPVASD

SEQ ID NO: 6173 - protein, 25 aa, synthetic construct
  source 1..25: note = Seed: LNVIVHSATGFKQSSKALQRPVASD
LNVIVHSATGLKQVSGALSRPVASD

SEQ ID NO: 6174 - protein, 25 aa, synthetic construct
  source 1..25: note = Seed: LNVIVHSATGFKQSSKALQRPVASD
LNVIVHSATGLKQVSGALTRPVASD

SEQ ID NO: 6175 - protein, 25 aa, synthetic construct
  source 1..25: note = Seed: LNVIVHSATGFKQSSKALQRPVASD
LNVIVHSATGLKQVSGALVRPVASD

SEQ ID NO: 6176 - protein, 25 aa, synthetic construct
  source 1..25: note = Seed: LNVIVHSATGFKQSSKALQRPVASD
LNVIVHSATGLKQVSHALKRPVASD

SEQ ID NO: 6177 - protein, 25 aa, synthetic construct
  source 1..25: note = Seed: LNVIVHSATGFKQSSKALQRPVASD
LNVIVHSATGLKQVSHALRRPVASD

SEQ ID NO: 6178 - protein, 25 aa, synthetic construct
  source 1..25: note = Seed: LNVIVHSATGFKQSSKALQRPVASD
LNVIVHSATGLKQVSIALARPVASD

SEQ ID NO: 6179 - protein, 25 aa, synthetic construct
  source 1..25: note = Seed: LNVIVHSATGFKQSSKALQRPVASD
LNVIVHSATGLKQVSIALNRPVASD

SEQ ID NO: 6180 - protein, 25 aa, synthetic construct
  source 1..25: note = Seed: LNVIVHSATGFKQSSKALQRPVASD
LNVIVHSATGLKQVSIALRRPVASD

SEQ ID NO: 6181 - protein, 25 aa, synthetic construct
  source 1..25: note = Seed: LNVIVHSATGFKQSSKALQRPVASD
LNVIVHSATGLKQVSIALSRPVASD

SEQ ID NO: 6182 - protein, 25 aa, synthetic construct
  source 1..25: note = Seed: LNVIVHSATGFKQSSKALQRPVASD
LNVIVHSATGLKQVSIALTRPVASD

SEQ ID NO: 6183 - protein, 25 aa, synthetic construct
  source 1..25: note = Seed: LNVIVHSATGFKQSSKALQRPVASD
LNVIVHSATGLKQVSIALVRPVASD

SEQ ID NO: 6184 - protein, 25 aa, synthetic construct
  source 1..25: note = Seed: LNVIVHSATGFKQSSKALQRPVASD
LNVIVHSATGLKQVSKALARPVASD

SEQ ID NO: 6185 - protein, 25 aa, synthetic construct
  source 1..25: note = Seed: LNVIVHSATGFKQSSKALQRPVASD
LNVIVHSATGLKQVSKALGRPVASD

SEQ ID NO: 6186 - protein, 25 aa, synthetic construct
  source 1..25: note = Seed: LNVIVHSATGFKQSSKALQRPVASD
LNVIVHSATGLKQVSKALHRPVASD

SEQ ID NO: 6187 - protein, 25 aa, synthetic construct
  source 1..25: note = Seed: LNVIVHSATGFKQSSKALQRPVASD
LNVIVHSATGLKQVSKALIRPVASD

SEQ ID NO: 6188 - protein, 25 aa, synthetic construct
  source 1..25: note = Seed: LNVIVHSATGFKQSSKALQRPVASD
LNVIVHSATGLKQVSKALKRPVASD

SEQ ID NO: 6189 - protein, 25 aa, synthetic construct
  source 1..25: note = Seed: LNVIVHSATGFKQSSKALQRPVASD
LNVIVHSATGLKQVSKALLRPVASD

SEQ ID NO: 6190 - protein, 25 aa, synthetic construct
  source 1..25: note = Seed: LNVIVHSATGFKQSSKALQRPVASD
LNVIVHSATGLKQVSKALMRPVASD

SEQ ID NO: 6191 - protein, 25 aa, synthetic construct
  source 1..25: note = Seed: LNVIVHSATGFKQSSKALQRPVASD
LNVIVHSATGLKQVSKALNRPVASD

SEQ ID NO: 6192 - protein, 25 aa, synthetic construct
  source 1..25: note = Seed: LNVIVHSATGFKQSSKALQRPVASD
LNVIVHSATGLKQVSKALQRPVASD

SEQ ID NO: 6193 - protein, 25 aa, synthetic construct
  source 1..25: note = Seed: LNVIVHSATGFKQSSKALQRPVASD
LNVIVHSATGLKQVSKALRRPVASD

SEQ ID NO: 6194 - protein, 25 aa, synthetic construct
  source 1..25: note = Seed: LNVIVHSATGFKQSSKALQRPVASD
LNVIVHSATGLKQVSKALSRPVASD

SEQ ID NO: 6195 - protein, 25 aa, synthetic construct
  source 1..25: note = Seed: LNVIVHSATGFKQSSKALQRPVASD
LNVIVHSATGLKQVSKALTRPVASD

SEQ ID NO: 6196 - protein, 25 aa, synthetic construct
  source 1..25: note = Seed: LNVIVHSATGFKQSSKALQRPVASD
LNVIVHSATGLKQVSKALVRPVASD

SEQ ID NO: 6197 - protein, 25 aa, synthetic construct
  source 1..25: note = Seed: LNVIVHSATGFKQSSKALQRPVASD
LNVIVHSATGLKQVSKALYRPVASD

SEQ ID NO: 6198 - protein, 25 aa, synthetic construct
  source 1..25: note = Seed: LNVIVHSATGFKQSSKALQRPVASD
LNVIVHSATGLKQVSLALLRPVASD

SEQ ID NO: 6199 - protein, 25 aa, synthetic construct
  source 1..25: note = Seed: LNVIVHSATGFKQSSKALQRPVASD
LNVIVHSATGLKQVSLALSRPVASD

SEQ ID NO: 6200 - protein, 25 aa, synthetic construct
  source 1..25: note = Seed: LNVIVHSATGFKQSSKALQRPVASD
LNVIVHSATGLKQVSMALNRPVASD

SEQ ID NO: 6201 - protein, 25 aa, synthetic construct
  source 1..25: note = Seed: LNVIVHSATGFKQSSKALQRPVASD
LNVIVHSATGLKQVSNALARPVASD

SEQ ID NO: 6202 - protein, 25 aa, synthetic construct
  source 1..25: note = Seed: LNVIVHSATGFKQSSKALQRPVASD
LNVIVHSATGLKQVSNALRRPVASD

SEQ ID NO: 6203 - protein, 25 aa, synthetic construct
  source 1..25: note = Seed: LNVIVHSATGFKQSSKALQRPVASD
LNVIVHSATGLKQVSNALVRPVASD

SEQ ID NO: 6204 - protein, 25 aa, synthetic construct
  source 1..25: note = Seed: LNVIVHSATGFKQSSKALQRPVASD
LNVIVHSATGLKQVSPALARPVASD

SEQ ID NO: 6205 - protein, 25 aa, synthetic construct
  source 1..25: note = Seed: LNVIVHSATGFKQSSKALQRPVASD
LNVIVHSATGLKQVSPALIRPVASD

SEQ ID NO: 6206 - protein, 25 aa, synthetic construct
  source 1..25: note = Seed: LNVIVHSATGFKQSSKALQRPVASD
LNVIVHSATGLKQVSPALLRPVASD

SEQ ID NO: 6207 - protein, 25 aa, synthetic construct
  source 1..25: note = Seed: LNVIVHSATGFKQSSKALQRPVASD
LNVIVHSATGLKQVSPALNRPVASD

SEQ ID NO: 6208 - protein, 25 aa, synthetic construct
  source 1..25: note = Seed: LNVIVHSATGFKQSSKALQRPVASD
LNVIVHSATGLKQVSPALSRPVASD

SEQ ID NO: 6209 - protein, 25 aa, synthetic construct
  source 1..25: note = Seed: LNVIVHSATGFKQSSKALQRPVASD
LNVIVHSATGLKQVSPALTRPVASD

SEQ ID NO: 6210 - protein, 25 aa, synthetic construct
  source 1..25: note = Seed: LNVIVHSATGFKQSSKALQRPVASD
LNVIVHSATGLKQVSPALVRPVASD

SEQ ID NO: 6211 - protein, 25 aa, synthetic construct
  source 1..25: note = Seed: LNVIVHSATGFKQSSKALQRPVASD
LNVIVHSATGLKQVSRALARPVASD

SEQ ID NO: 6212 - protein, 25 aa, synthetic construct
  source 1..25: note = Seed: LNVIVHSATGFKQSSKALQRPVASD
LNVIVHSATGLKQVSRALFRPVASD

SEQ ID NO: 6213 - protein, 25 aa, synthetic construct
  source 1..25: note = Seed: LNVIVHSATGFKQSSKALQRPVASD
LNVIVHSATGLKQVSRALGRPVASD

SEQ ID NO: 6214 - protein, 25 aa, synthetic construct
  source 1..25: note = Seed: LNVIVHSATGFKQSSKALQRPVASD
LNVIVHSATGLKQVSRALHRPVASD

SEQ ID NO: 6215 - protein, 25 aa, synthetic construct
  source 1..25: note = Seed: LNVIVHSATGFKQSSKALQRPVASD
LNVIVHSATGLKQVSRALIRPVASD

SEQ ID NO: 6216 - protein, 25 aa, synthetic construct
  source 1..25: note = Seed: LNVIVHSATGFKQSSKALQRPVASD
LNVIVHSATGLKQVSRALKRPVASD

SEQ ID NO: 6217 - protein, 25 aa, synthetic construct
  source 1..25: note = Seed: LNVIVHSATGFKQSSKALQRPVASD
LNVIVHSATGLKQVSRALLRPVASD

SEQ ID NO: 6218 - protein, 25 aa, synthetic construct
  source 1..25: note = Seed: LNVIVHSATGFKQSSKALQRPVASD
LNVIVHSATGLKQVSRALMRPVASD

SEQ ID NO: 6219 - protein, 25 aa, synthetic construct
  source 1..25: note = Seed: LNVIVHSATGFKQSSKALQRPVASD
LNVIVHSATGLKQVSRALNRPVASD

SEQ ID NO: 6220 - protein, 25 aa, synthetic construct
  source 1..25: note = Seed: LNVIVHSATGFKQSSKALQRPVASD
LNVIVHSATGLKQVSRALPRPVASD

SEQ ID NO: 6221 - protein, 25 aa, synthetic construct
  source 1..25: note = Seed: LNVIVHSATGFKQSSKALQRPVASD
LNVIVHSATGLKQVSRALQRPVASD

SEQ ID NO: 6222 - protein, 25 aa, synthetic construct
  source 1..25: note = Seed: LNVIVHSATGFKQSSKALQRPVASD
LNVIVHSATGLKQVSRALRRPVASD

SEQ ID NO: 6223 - protein, 25 aa, synthetic construct
  source 1..25: note = Seed: LNVIVHSATGFKQSSKALQRPVASD
LNVIVHSATGLKQVSRALSRPVASD

SEQ ID NO: 6224 - protein, 25 aa, synthetic construct
  source 1..25: note = Seed: LNVIVHSATGFKQSSKALQRPVASD
LNVIVHSATGLKQVSRALTRPVASD

SEQ ID NO: 6225 - protein, 25 aa, synthetic construct
  source 1..25: note = Seed: LNVIVHSATGFKQSSKALQRPVASD
LNVIVHSATGLKQVSRALVRPVASD

SEQ ID NO: 6226 - protein, 25 aa, synthetic construct
  source 1..25: note = Seed: LNVIVHSATGFKQSSKALQRPVASD
LNVIVHSATGLKQVSRALYRPVASD

SEQ ID NO: 6227 - protein, 25 aa, synthetic construct
  source 1..25: note = Seed: LNVIVHSATGFKQSSKALQRPVASD
LNVIVHSATGLKQVSSALARPVASD

SEQ ID NO: 6228 - protein, 25 aa, synthetic construct
  source 1..25: note = Seed: LNVIVHSATGFKQSSKALQRPVASD
LNVIVHSATGLKQVSSALFRPVASD

SEQ ID NO: 6229 - protein, 25 aa, synthetic construct
  source 1..25: note = Seed: LNVIVHSATGFKQSSKALQRPVASD
LNVIVHSATGLKQVSSALGRPVASD

SEQ ID NO: 6230 - protein, 25 aa, synthetic construct
  source 1..25: note = Seed: LNVIVHSATGFKQSSKALQRPVASD
LNVIVHSATGLKQVSSALIRPVASD

SEQ ID NO: 6231 - protein, 25 aa, synthetic construct
  source 1..25: note = Seed: LNVIVHSATGFKQSSKALQRPVASD
LNVIVHSATGLKQVSSALLRPVASD

SEQ ID NO: 6232 - protein, 25 aa, synthetic construct
  source 1..25: note = Seed: LNVIVHSATGFKQSSKALQRPVASD
LNVIVHSATGLKQVSSALMRPVASD

SEQ ID NO: 6233 - protein, 25 aa, synthetic construct
  source 1..25: note = Seed: LNVIVHSATGFKQSSKALQRPVASD
LNVIVHSATGLKQVSSALNRPVASD

SEQ ID NO: 6234 - protein, 25 aa, synthetic construct
  source 1..25: note = Seed: LNVIVHSATGFKQSSKALQRPVASD
LNVIVHSATGLKQVSSALRRPVASD

SEQ ID NO: 6235 - protein, 25 aa, synthetic construct
  source 1..25: note = Seed: LNVIVHSATGFKQSSKALQRPVASD
LNVIVHSATGLKQVSSALSRPVASD

SEQ ID NO: 6236 - protein, 25 aa, synthetic construct
  source 1..25: note = Seed: LNVIVHSATGFKQSSKALQRPVASD
LNVIVHSATGLKQVSSALTRPVASD

SEQ ID NO: 6237 - protein, 25 aa, synthetic construct
  source 1..25: note = Seed: LNVIVHSATGFKQSSKALQRPVASD
LNVIVHSATGLKQVSSALVRPVASD

SEQ ID NO: 6238 - protein, 25 aa, synthetic construct
  source 1..25: note = Seed: LNVIVHSATGFKQSSKALQRPVASD
LNVIVHSATGLKQVSTALARPVASD

SEQ ID NO: 6239 - protein, 25 aa, synthetic construct
  source 1..25: note = Seed: LNVIVHSATGFKQSSKALQRPVASD
LNVIVHSATGLKQVSTALIRPVASD

SEQ ID NO: 6240 - protein, 25 aa, synthetic construct
  source 1..25: note = Seed: LNVIVHSATGFKQSSKALQRPVASD
LNVIVHSATGLKQVSTALNRPVASD

SEQ ID NO: 6241 - protein, 25 aa, synthetic construct
  source 1..25: note = Seed: LNVIVHSATGFKQSSKALQRPVASD
LNVIVHSATGLKQVSTALRRPVASD

SEQ ID NO: 6242 - protein, 25 aa, synthetic construct
  source 1..25: note = Seed: LNVIVHSATGFKQSSKALQRPVASD
LNVIVHSATGLKQVSTALSRPVASD

SEQ ID NO: 6243 - protein, 25 aa, synthetic construct
  source 1..25: note = Seed: LNVIVHSATGFKQSSKALQRPVASD
LNVIVHSATGLKQVSTALVRPVASD

SEQ ID NO: 6244 - protein, 25 aa, synthetic construct
  source 1..25: note = Seed: LNVIVHSATGFKQSSKALQRPVASD
LNVIVHSATGLKQVSVALARPVASD

SEQ ID NO: 6245 - protein, 25 aa, synthetic construct
  source 1..25: note = Seed: LNVIVHSATGFKQSSKALQRPVASD
LNVIVHSATGLKQVSVALIRPVASD

SEQ ID NO: 6246 - protein, 25 aa, synthetic construct
  source 1..25: note = Seed: LNVIVHSATGFKQSSKALQRPVASD
LNVIVHSATGLKQVSVALNRPVASD

SEQ ID NO: 6247 - protein, 25 aa, synthetic construct
  source 1..25: note = Seed: LNVIVHSATGFKQSSKALQRPVASD
LNVIVHSATGLKQVSVALRRPVASD

SEQ ID NO: 6248 - protein, 25 aa, synthetic construct
  source 1..25: note = Seed: LNVIVHSATGFKQSSKALQRPVASD
LNVIVHSATGLKQVSVALSRPVASD

SEQ ID NO: 6249 - protein, 25 aa, synthetic construct
  source 1..25: note = Seed: LNVIVHSATGFKQSSKALQRPVASD
LNVIVHSATGLKQVSVALTRPVASD

SEQ ID NO: 6250 - protein, 25 aa, synthetic construct
  source 1..25: note = Seed: LNVIVHSATGFKQSSKALQRPVASD
LNVIVHSATGLKQVSVALVRPVASD

SEQ ID NO: 6251 - protein, 25 aa, synthetic construct
  source 1..25: note = Seed: LNVIVHSATGFKQSSKALQRPVASD
LNVIVHSATGLKQVSYALMRPVASD

SEQ ID NO: 6252 - protein, 25 aa, synthetic construct
  source 1..25: note = Seed: LNVIVHSATGFKQSSKALQRPVASD
LNVIVHSATGLKQWSAALIRPVASD

SEQ ID NO: 6253 - protein, 25 aa, synthetic construct
  source 1..25: note = Seed: LNVIVHSATGFKQSSKALQRPVASD
LNVIVHSATGLKQWSAALLRPVASD

SEQ ID NO: 6254 - protein, 25 aa, synthetic construct
  source 1..25: note = Seed: LNVIVHSATGFKQSSKALQRPVASD
LNVIVHSATGLKQWSAALRRPVASD

SEQ ID NO: 6255 - protein, 25 aa, synthetic construct
  source 1..25: note = Seed: LNVIVHSATGFKQSSKALQRPVASD
LNVIVHSATGLKQWSAALVRPVASD

SEQ ID NO: 6256 - protein, 25 aa, synthetic construct
  source 1..25: note = Seed: LNVIVHSATGFKQSSKALQRPVASD
LNVIVHSATGLKQWSFALIRPVASD

SEQ ID NO: 6257 - protein, 25 aa, synthetic construct
  source 1..25: note = Seed: LNVIVHSATGFKQSSKALQRPVASD
LNVIVHSATGLKQWSFALLRPVASD

SEQ ID NO: 6258 - protein, 25 aa, synthetic construct
  source 1..25: note = Seed: LNVIVHSATGFKQSSKALQRPVASD
LNVIVHSATGLKQWSHALRRPVASD

SEQ ID NO: 6259 - protein, 25 aa, synthetic construct
  source 1..25: note = Seed: LNVIVHSATGFKQSSKALQRPVASD
LNVIVHSATGLKQWSIALKRPVASD

SEQ ID NO: 6260 - protein, 25 aa, synthetic construct
  source 1..25: note = Seed: LNVIVHSATGFKQSSKALQRPVASD
LNVIVHSATGLKQWSIALRRPVASD

SEQ ID NO: 6261 - protein, 25 aa, synthetic construct
  source 1..25: note = Seed: LNVIVHSATGFKQSSKALQRPVASD
LNVIVHSATGLKQWSKALARPVASD

SEQ ID NO: 6262 - protein, 25 aa, synthetic construct
  source 1..25: note = Seed: LNVIVHSATGFKQSSKALQRPVASD
LNVIVHSATGLKQWSKALFRPVASD

SEQ ID NO: 6263 - protein, 25 aa, synthetic construct
  source 1..25: note = Seed: LNVIVHSATGFKQSSKALQRPVASD
LNVIVHSATGLKQWSKALHRPVASD

SEQ ID NO: 6264 - protein, 25 aa, synthetic construct
  source 1..25: note = Seed: LNVIVHSATGFKQSSKALQRPVASD
LNVIVHSATGLKQWSKALIRPVASD

SEQ ID NO: 6265 - protein, 25 aa, synthetic construct
  source 1..25: note = Seed: LNVIVHSATGFKQSSKALQRPVASD
LNVIVHSATGLKQWSKALKRPVASD

SEQ ID NO: 6266 - protein, 25 aa, synthetic construct
  source 1..25: note = Seed: LNVIVHSATGFKQSSKALQRPVASD
LNVIVHSATGLKQWSKALLRPVASD

SEQ ID NO: 6267 - protein, 25 aa, synthetic construct
  source 1..25: note = Seed: LNVIVHSATGFKQSSKALQRPVASD
LNVIVHSATGLKQWSKALMRPVASD

SEQ ID NO: 6268 - protein, 25 aa, synthetic construct
  source 1..25: note = Seed: LNVIVHSATGFKQSSKALQRPVASD
LNVIVHSATGLKQWSKALRRPVASD

SEQ ID NO: 6269 - protein, 25 aa, synthetic construct
  source 1..25: note = Seed: LNVIVHSATGFKQSSKALQRPVASD
LNVIVHSATGLKQWSKALSRPVASD

SEQ ID NO: 6270 - protein, 25 aa, synthetic construct
  source 1..25: note = Seed: LNVIVHSATGFKQSSKALQRPVASD
LNVIVHSATGLKQWSKALVRPVASD

SEQ ID NO: 6271 - protein, 25 aa, synthetic construct
  source 1..25: note = Seed: LNVIVHSATGFKQSSKALQRPVASD
LNVIVHSATGLKQWSKALYRPVASD

SEQ ID NO: 6272 - protein, 25 aa, synthetic construct
  source 1..25: note = Seed: LNVIVHSATGFKQSSKALQRPVASD
LNVIVHSATGLKQWSLALLRPVASD

SEQ ID NO: 6273 - protein, 25 aa, synthetic construct
  source 1..25: note = Seed: LNVIVHSATGFKQSSKALQRPVASD
LNVIVHSATGLKQWSLALRRPVASD

SEQ ID NO: 6274 - protein, 25 aa, synthetic construct
  source 1..25: note = Seed: LNVIVHSATGFKQSSKALQRPVASD
LNVIVHSATGLKQWSMALRRPVASD

SEQ ID NO: 6275 - protein, 25 aa, synthetic construct
  source 1..25: note = Seed: LNVIVHSATGFKQSSKALQRPVASD
LNVIVHSATGLKQWSPALRRPVASD

SEQ ID NO: 6276 - protein, 25 aa, synthetic construct
  source 1..25: note = Seed: LNVIVHSATGFKQSSKALQRPVASD
LNVIVHSATGLKQWSPALVRPVASD

SEQ ID NO: 6277 - protein, 25 aa, synthetic construct
  source 1..25: note = Seed: LNVIVHSATGFKQSSKALQRPVASD
LNVIVHSATGLKQWSRALARPVASD

SEQ ID NO: 6278 - protein, 25 aa, synthetic construct
  source 1..25: note = Seed: LNVIVHSATGFKQSSKALQRPVASD
LNVIVHSATGLKQWSRALFRPVASD

SEQ ID NO: 6279 - protein, 25 aa, synthetic construct
  source 1..25: note = Seed: LNVIVHSATGFKQSSKALQRPVASD
LNVIVHSATGLKQWSRALGRPVASD

SEQ ID NO: 6280 - protein, 25 aa, synthetic construct
  source 1..25: note = Seed: LNVIVHSATGFKQSSKALQRPVASD
LNVIVHSATGLKQWSRALHRPVASD

SEQ ID NO: 6281 - protein, 25 aa, synthetic construct
  source 1..25: note = Seed: LNVIVHSATGFKQSSKALQRPVASD
LNVIVHSATGLKQWSRALIRPVASD

SEQ ID NO: 6282 - protein, 25 aa, synthetic construct
  source 1..25: note = Seed: LNVIVHSATGFKQSSKALQRPVASD
LNVIVHSATGLKQWSRALKRPVASD

SEQ ID NO: 6283 - protein, 25 aa, synthetic construct
  source 1..25: note = Seed: LNVIVHSATGFKQSSKALQRPVASD
LNVIVHSATGLKQWSRALLRPVASD

SEQ ID NO: 6284 - protein, 25 aa, synthetic construct
  source 1..25: note = Seed: LNVIVHSATGFKQSSKALQRPVASD
LNVIVHSATGLKQWSRALMRPVASD

SEQ ID NO: 6285 - protein, 25 aa, synthetic construct
  source 1..25: note = Seed: LNVIVHSATGFKQSSKALQRPVASD
LNVIVHSATGLKQWSRALQRPVASD

SEQ ID NO: 6286 - protein, 25 aa, synthetic construct
  source 1..25: note = Seed: LNVIVHSATGFKQSSKALQRPVASD
LNVIVHSATGLKQWSRALRRPVASD

SEQ ID NO: 6287 - protein, 25 aa, synthetic construct
  source 1..25: note = Seed: LNVIVHSATGFKQSSKALQRPVASD
LNVIVHSATGLKQWSRALSRPVASD

SEQ ID NO: 6288 - protein, 25 aa, synthetic construct
  source 1..25: note = Seed: LNVIVHSATGFKQSSKALQRPVASD
LNVIVHSATGLKQWSRALTRPVASD

SEQ ID NO: 6289 - protein, 25 aa, synthetic construct
  source 1..25: note = Seed: LNVIVHSATGFKQSSKALQRPVASD
LNVIVHSATGLKQWSRALVRPVASD

SEQ ID NO: 6290 - protein, 25 aa, synthetic construct
  source 1..25: note = Seed: LNVIVHSATGFKQSSKALQRPVASD
LNVIVHSATGLKQWSRALYRPVASD

SEQ ID NO: 6291 - protein, 25 aa, synthetic construct
  source 1..25: note = Seed: LNVIVHSATGFKQSSKALQRPVASD
LNVIVHSATGLKQWSSALIRPVASD

SEQ ID NO: 6292 - protein, 25 aa, synthetic construct
  source 1..25: note = Seed: LNVIVHSATGFKQSSKALQRPVASD
LNVIVHSATGLKQWSSALRRPVASD

SEQ ID NO: 6293 - protein, 25 aa, synthetic construct
  source 1..25: note = Seed: LNVIVHSATGFKQSSKALQRPVASD
LNVIVHSATGLKQWSSALVRPVASD

SEQ ID NO: 6294 - protein, 25 aa, synthetic construct
  source 1..25: note = Seed: LNVIVHSATGFKQSSKALQRPVASD
LNVIVHSATGLKQWSTALRRPVASD

SEQ ID NO: 6295 - protein, 25 aa, synthetic construct
  source 1..25: note = Seed: LNVIVHSATGFKQSSKALQRPVASD
LNVIVHSATGLKQWSVALRRPVASD

SEQ ID NO: 6296 - protein, 25 aa, synthetic construct
  source 1..25: note = Seed: LNVIVHSATGFKQSSKALQRPVASD
LNVIVHSATGLKQYSAALARPVASD

SEQ ID NO: 6297 - protein, 25 aa, synthetic construct
  source 1..25: note = Seed: LNVIVHSATGFKQSSKALQRPVASD
LNVIVHSATGLKQYSAALGRPVASD

SEQ ID NO: 6298 - protein, 25 aa, synthetic construct
  source 1..25: note = Seed: LNVIVHSATGFKQSSKALQRPVASD
LNVIVHSATGLKQYSAALLRPVASD

SEQ ID NO: 6299 - protein, 25 aa, synthetic construct
  source 1..25: note = Seed: LNVIVHSATGFKQSSKALQRPVASD
LNVIVHSATGLKQYSAALRRPVASD

SEQ ID NO: 6300 - protein, 25 aa, synthetic construct
  source 1..25: note = Seed: LNVIVHSATGFKQSSKALQRPVASD
LNVIVHSATGLKQYSAALVRPVASD

SEQ ID NO: 6301 - protein, 25 aa, synthetic construct
  source 1..25: note = Seed: LNVIVHSATGFKQSSKALQRPVASD
LNVIVHSATGLKQYSGALIRPVASD

SEQ ID NO: 6302 - protein, 25 aa, synthetic construct
  source 1..25: note = Seed: LNVIVHSATGFKQSSKALQRPVASD
LNVIVHSATGLKQYSGALSRPVASD

SEQ ID NO: 6303 - protein, 25 aa, synthetic construct
  source 1..25: note = Seed: LNVIVHSATGFKQSSKALQRPVASD
LNVIVHSATGLKQYSHALRRPVASD

SEQ ID NO: 6304 - protein, 25 aa, synthetic construct
  source 1..25: note = Seed: LNVIVHSATGFKQSSKALQRPVASD
LNVIVHSATGLKQYSIALRRPVASD

SEQ ID NO: 6305 - protein, 25 aa, synthetic construct
  source 1..25: note = Seed: LNVIVHSATGFKQSSKALQRPVASD
LNVIVHSATGLKQYSKALARPVASD

SEQ ID NO: 6306 - protein, 25 aa, synthetic construct
  source 1..25: note = Seed: LNVIVHSATGFKQSSKALQRPVASD
LNVIVHSATGLKQYSKALHRPVASD

SEQ ID NO: 6307 - protein, 25 aa, synthetic construct
  source 1..25: note = Seed: LNVIVHSATGFKQSSKALQRPVASD
LNVIVHSATGLKQYSKALKRPVASD

SEQ ID NO: 6308 - protein, 25 aa, synthetic construct
  source 1..25: note = Seed: LNVIVHSATGFKQSSKALQRPVASD
LNVIVHSATGLKQYSKALRRPVASD

SEQ ID NO: 6309 - protein, 25 aa, synthetic construct
  source 1..25: note = Seed: LNVIVHSATGFKQSSKALQRPVASD
LNVIVHSATGLKQYSKALSRPVASD

SEQ ID NO: 6310 - protein, 25 aa, synthetic construct
  source 1..25: note = Seed: LNVIVHSATGFKQSSKALQRPVASD
LNVIVHSATGLKQYSLALRRPVASD

SEQ ID NO: 6311 - protein, 25 aa, synthetic construct
  source 1..25: note = Seed: LNVIVHSATGFKQSSKALQRPVASD
LNVIVHSATGLKQYSMALRRPVASD

SEQ ID NO: 6312 - protein, 25 aa, synthetic construct
  source 1..25: note = Seed: LNVIVHSATGFKQSSKALQRPVASD
LNVIVHSATGLKQYSRALARPVASD

SEQ ID NO: 6313 - protein, 25 aa, synthetic construct
  source 1..25: note = Seed: LNVIVHSATGFKQSSKALQRPVASD
LNVIVHSATGLKQYSRALHRPVASD

SEQ ID NO: 6314 - protein, 25 aa, synthetic construct
  source 1..25: note = Seed: LNVIVHSATGFKQSSKALQRPVASD
LNVIVHSATGLKQYSRALKRPVASD

SEQ ID NO: 6315 - protein, 25 aa, synthetic construct
  source 1..25: note = Seed: LNVIVHSATGFKQSSKALQRPVASD
LNVIVHSATGLKQYSRALRRPVASD

SEQ ID NO: 6316 - protein, 25 aa, synthetic construct
  source 1..25: note = Seed: LNVIVHSATGFKQSSKALQRPVASD
LNVIVHSATGLKQYSRALSRPVASD

SEQ ID NO: 6317 - protein, 25 aa, synthetic construct
  source 1..25: note = Seed: LNVIVHSATGFKQSSKALQRPVASD
LNVIVHSATGLKQYSRALYRPVASD

SEQ ID NO: 6318 - protein, 25 aa, synthetic construct
  source 1..25: note = Seed: LNVIVHSATGFKQSSKALQRPVASD
LNVIVHSATGLKQYSSALARPVASD

SEQ ID NO: 6319 - protein, 25 aa, synthetic construct
  source 1..25: note = Seed: LNVIVHSATGFKQSSKALQRPVASD
LNVIVHSATGLKQYSSALTRPVASD

SEQ ID NO: 6320 - protein, 25 aa, synthetic construct
  source 1..25: note = Seed: LNVIVHSATGFKQSSKALQRPVASD
LNVIVHSATGLKQYSSALVRPVASD

SEQ ID NO: 6321 - protein, 25 aa, synthetic construct
  source 1..25: note = Seed: LNVIVHSATGFKQSSKALQRPVASD
LNVIVHSATGLKQYSTALARPVASD

SEQ ID NO: 6322 - protein, 25 aa, synthetic construct
  source 1..25: note = Seed: LNVIVHSATGFKQSSKALQRPVASD
LNVIVHSATGLKQYSVALRRPVASD

SEQ ID NO: 6323 - protein, 25 aa, synthetic construct
  source 1..25: note = Seed: LNVIVHSATGFKQSSKALQRPVASD
LNVIVHSATGMKQASAALARPVASD

SEQ ID NO: 6324 - protein, 25 aa, synthetic construct
  source 1..25: note = Seed: LNVIVHSATGFKQSSKALQRPVASD
LNVIVHSATGMKQASAALIRPVASD

SEQ ID NO: 6325 - protein, 25 aa, synthetic construct
  source 1..25: note = Seed: LNVIVHSATGFKQSSKALQRPVASD
LNVIVHSATGMKQASAALLRPVASD

SEQ ID NO: 6326 - protein, 25 aa, synthetic construct
  source 1..25: note = Seed: LNVIVHSATGFKQSSKALQRPVASD
LNVIVHSATGMKQASAALMRPVASD

SEQ ID NO: 6327 - protein, 25 aa, synthetic construct
  source 1..25: note = Seed: LNVIVHSATGFKQSSKALQRPVASD
LNVIVHSATGMKQASAALNRPVASD

SEQ ID NO: 6328 - protein, 25 aa, synthetic construct
  source 1..25: note = Seed: LNVIVHSATGFKQSSKALQRPVASD
LNVIVHSATGMKQASAALSRPVASD

SEQ ID NO: 6329 - protein, 25 aa, synthetic construct
  source 1..25: note = Seed: LNVIVHSATGFKQSSKALQRPVASD
LNVIVHSATGMKQASAALTRPVASD

SEQ ID NO: 6330 - protein, 25 aa, synthetic construct
  source 1..25: note = Seed: LNVIVHSATGFKQSSKALQRPVASD
LNVIVHSATGMKQASAALVRPVASD

SEQ ID NO: 6331 - protein, 25 aa, synthetic construct
  source 1..25: note = Seed: LNVIVHSATGFKQSSKALQRPVASD
LNVIVHSATGMKQASGALARPVASD

SEQ ID NO: 6332 - protein, 25 aa, synthetic construct
  source 1..25: note = Seed: LNVIVHSATGFKQSSKALQRPVASD
LNVIVHSATGMKQASGALIRPVASD

SEQ ID NO: 6333 - protein, 25 aa, synthetic construct
  source 1..25: note = Seed: LNVIVHSATGFKQSSKALQRPVASD
LNVIVHSATGMKQASGALLRPVASD

SEQ ID NO: 6334 - protein, 25 aa, synthetic construct
  source 1..25: note = Seed: LNVIVHSATGFKQSSKALQRPVASD
LNVIVHSATGMKQASGALMRPVASD

SEQ ID NO: 6335 - protein, 25 aa, synthetic construct
  source 1..25: note = Seed: LNVIVHSATGFKQSSKALQRPVASD
LNVIVHSATGMKQASGALVRPVASD

SEQ ID NO: 6336 - protein, 25 aa, synthetic construct
  source 1..25: note = Seed: LNVIVHSATGFKQSSKALQRPVASD
LNVIVHSATGMKQASIALARPVASD

SEQ ID NO: 6337 - protein, 25 aa, synthetic construct
  source 1..25: note = Seed: LNVIVHSATGFKQSSKALQRPVASD
LNVIVHSATGMKQASIALNRPVASD

SEQ ID NO: 6338 - protein, 25 aa, synthetic construct
  source 1..25: note = Seed: LNVIVHSATGFKQSSKALQRPVASD
LNVIVHSATGMKQASIALQRPVASD

SEQ ID NO: 6339 - protein, 25 aa, synthetic construct
  source 1..25: note = Seed: LNVIVHSATGFKQSSKALQRPVASD
LNVIVHSATGMKQASIALSRPVASD

SEQ ID NO: 6340 - protein, 25 aa, synthetic construct
  source 1..25: note = Seed: LNVIVHSATGFKQSSKALQRPVASD
LNVIVHSATGMKQASIALTRPVASD

SEQ ID NO: 6341 - protein, 25 aa, synthetic construct
  source 1..25: note = Seed: LNVIVHSATGFKQSSKALQRPVASD
LNVIVHSATGMKQASIALVRPVASD

SEQ ID NO: 6342 - protein, 25 aa, synthetic construct
  source 1..25: note = Seed: LNVIVHSATGFKQSSKALQRPVASD
LNVIVHSATGMKQASKALARPVASD

SEQ ID NO: 6343 - protein, 25 aa, synthetic construct
  source 1..25: note = Seed: LNVIVHSATGFKQSSKALQRPVASD
LNVIVHSATGMKQASKALHRPVASD

SEQ ID NO: 6344 - protein, 25 aa, synthetic construct
  source 1..25: note = Seed: LNVIVHSATGFKQSSKALQRPVASD
LNVIVHSATGMKQASKALKRPVASD

SEQ ID NO: 6345 - protein, 25 aa, synthetic construct
  source 1..25: note = Seed: LNVIVHSATGFKQSSKALQRPVASD
LNVIVHSATGMKQASKALQRPVASD

SEQ ID NO: 6346 - protein, 25 aa, synthetic construct
  source 1..25: note = Seed: LNVIVHSATGFKQSSKALQRPVASD
LNVIVHSATGMKQASKALRRPVASD

SEQ ID NO: 6347 - protein, 25 aa, synthetic construct
  source 1..25: note = Seed: LNVIVHSATGFKQSSKALQRPVASD
LNVIVHSATGMKQASKALSRPVASD

SEQ ID NO: 6348 - protein, 25 aa, synthetic construct
  source 1..25: note = Seed: LNVIVHSATGFKQSSKALQRPVASD
LNVIVHSATGMKQASLALARPVASD

SEQ ID NO: 6349 - protein, 25 aa, synthetic construct
  source 1..25: note = Seed: LNVIVHSATGFKQSSKALQRPVASD
LNVIVHSATGMKQASLALSRPVASD

SEQ ID NO: 6350 - protein, 25 aa, synthetic construct
  source 1..25: note = Seed: LNVIVHSATGFKQSSKALQRPVASD
LNVIVHSATGMKQASMALARPVASD

SEQ ID NO: 6351 - protein, 25 aa, synthetic construct
  source 1..25: note = Seed: LNVIVHSATGFKQSSKALQRPVASD
LNVIVHSATGMKQASPALARPVASD

SEQ ID NO: 6352 - protein, 25 aa, synthetic construct
  source 1..25: note = Seed: LNVIVHSATGFKQSSKALQRPVASD
LNVIVHSATGMKQASPALIRPVASD

SEQ ID NO: 6353 - protein, 25 aa, synthetic construct
  source 1..25: note = Seed: LNVIVHSATGFKQSSKALQRPVASD
LNVIVHSATGMKQASPALLRPVASD

SEQ ID NO: 6354 - protein, 25 aa, synthetic construct
  source 1..25: note = Seed: LNVIVHSATGFKQSSKALQRPVASD
LNVIVHSATGMKQASPALNRPVASD

SEQ ID NO: 6355 - protein, 25 aa, synthetic construct
  source 1..25: note = Seed: LNVIVHSATGFKQSSKALQRPVASD
LNVIVHSATGMKQASPALSRPVASD

SEQ ID NO: 6356 - protein, 25 aa, synthetic construct
  source 1..25: note = Seed: LNVIVHSATGFKQSSKALQRPVASD
LNVIVHSATGMKQASPALVRPVASD

SEQ ID NO: 6357 - protein, 25 aa, synthetic construct
  source 1..25: note = Seed: LNVIVHSATGFKQSSKALQRPVASD
LNVIVHSATGMKQASRALARPVASD

SEQ ID NO: 6358 - protein, 25 aa, synthetic construct
  source 1..25: note = Seed: LNVIVHSATGFKQSSKALQRPVASD
LNVIVHSATGMKQASRALGRPVASD

SEQ ID NO: 6359 - protein, 25 aa, synthetic construct
  source 1..25: note = Seed: LNVIVHSATGFKQSSKALQRPVASD
LNVIVHSATGMKQASRALHRPVASD

SEQ ID NO: 6360 - protein, 25 aa, synthetic construct
  source 1..25: note = Seed: LNVIVHSATGFKQSSKALQRPVASD
LNVIVHSATGMKQASRALKRPVASD

SEQ ID NO: 6361 - protein, 25 aa, synthetic construct
  source 1..25: note = Seed: LNVIVHSATGFKQSSKALQRPVASD
LNVIVHSATGMKQASRALMRPVASD

SEQ ID NO: 6362 - protein, 25 aa, synthetic construct
  source 1..25: note = Seed: LNVIVHSATGFKQSSKALQRPVASD
LNVIVHSATGMKQASRALQRPVASD

SEQ ID NO: 6363 - protein, 25 aa, synthetic construct
  source 1..25: note = Seed: LNVIVHSATGFKQSSKALQRPVASD
LNVIVHSATGMKQASRALRRPVASD

SEQ ID NO: 6364 - protein, 25 aa, synthetic construct
  source 1..25: note = Seed: LNVIVHSATGFKQSSKALQRPVASD
LNVIVHSATGMKQASRALSRPVASD

SEQ ID NO: 6365 - protein, 25 aa, synthetic construct
  source 1..25: note = Seed: LNVIVHSATGFKQSSKALQRPVASD
LNVIVHSATGMKQASRALTRPVASD

SEQ ID NO: 6366 - protein, 25 aa, synthetic construct
  source 1..25: note = Seed: LNVIVHSATGFKQSSKALQRPVASD
LNVIVHSATGMKQASRALVRPVASD

SEQ ID NO: 6367 - protein, 25 aa, synthetic construct
  source 1..25: note = Seed: LNVIVHSATGFKQSSKALQRPVASD
LNVIVHSATGMKQASRALYRPVASD

SEQ ID NO: 6368 - protein, 25 aa, synthetic construct
  source 1..25: note = Seed: LNVIVHSATGFKQSSKALQRPVASD
LNVIVHSATGMKQASSALARPVASD

SEQ ID NO: 6369 - protein, 25 aa, synthetic construct
  source 1..25: note = Seed: LNVIVHSATGFKQSSKALQRPVASD
LNVIVHSATGMKQASSALIRPVASD

SEQ ID NO: 6370 - protein, 25 aa, synthetic construct
  source 1..25: note = Seed: LNVIVHSATGFKQSSKALQRPVASD
LNVIVHSATGMKQASSALLRPVASD

SEQ ID NO: 6371 - protein, 25 aa, synthetic construct
  source 1..25: note = Seed: LNVIVHSATGFKQSSKALQRPVASD
LNVIVHSATGMKQASSALNRPVASD

SEQ ID NO: 6372 - protein, 25 aa, synthetic construct
  source 1..25: note = Seed: LNVIVHSATGFKQSSKALQRPVASD
LNVIVHSATGMKQASSALVRPVASD

SEQ ID NO: 6373 - protein, 25 aa, synthetic construct
  source 1..25: note = Seed: LNVIVHSATGFKQSSKALQRPVASD
LNVIVHSATGMKQASTALARPVASD

SEQ ID NO: 6374 - protein, 25 aa, synthetic construct
  source 1..25: note = Seed: LNVIVHSATGFKQSSKALQRPVASD
LNVIVHSATGMKQASTALNRPVASD

SEQ ID NO: 6375 - protein, 25 aa, synthetic construct
  source 1..25: note = Seed: LNVIVHSATGFKQSSKALQRPVASD
LNVIVHSATGMKQASVALARPVASD

SEQ ID NO: 6376 - protein, 25 aa, synthetic construct
  source 1..25: note = Seed: LNVIVHSATGFKQSSKALQRPVASD
LNVIVHSATGMKQASVALIRPVASD

SEQ ID NO: 6377 - protein, 25 aa, synthetic construct
  source 1..25: note = Seed: LNVIVHSATGFKQSSKALQRPVASD
LNVIVHSATGMKQASVALMRPVASD

SEQ ID NO: 6378 - protein, 25 aa, synthetic construct
  source 1..25: note = Seed: LNVIVHSATGFKQSSKALQRPVASD
LNVIVHSATGMKQASVALNRPVASD

SEQ ID NO: 6379 - protein, 25 aa, synthetic construct
  source 1..25: note = Seed: LNVIVHSATGFKQSSKALQRPVASD
LNVIVHSATGMKQASVALSRPVASD

SEQ ID NO: 6380 - protein, 25 aa, synthetic construct
  source 1..25: note = Seed: LNVIVHSATGFKQSSKALQRPVASD
LNVIVHSATGMKQCSAALARPVASD

SEQ ID NO: 6381 - protein, 25 aa, synthetic construct
  source 1..25: note = Seed: LNVIVHSATGFKQSSKALQRPVASD
LNVIVHSATGMKQESAALLRPVASD

SEQ ID NO: 6382 - protein, 25 aa, synthetic construct
  source 1..25: note = Seed: LNVIVHSATGFKQSSKALQRPVASD
LNVIVHSATGMKQESAALVRPVASD

SEQ ID NO: 6383 - protein, 25 aa, synthetic construct
  source 1..25: note = Seed: LNVIVHSATGFKQSSKALQRPVASD
LNVIVHSATGMKQESIALARPVASD

SEQ ID NO: 6384 - protein, 25 aa, synthetic construct
  source 1..25: note = Seed: LNVIVHSATGFKQSSKALQRPVASD
LNVIVHSATGMKQESLALARPVASD

SEQ ID NO: 6385 - protein, 25 aa, synthetic construct
  source 1..25: note = Seed: LNVIVHSATGFKQSSKALQRPVASD
LNVIVHSATGMKQESVALMRPVASD

SEQ ID NO: 6386 - protein, 25 aa, synthetic construct
  source 1..25: note = Seed: LNVIVHSATGFKQSSKALQRPVASD
LNVIVHSATGMKQFSAALIRPVASD

SEQ ID NO: 6387 - protein, 25 aa, synthetic construct
  source 1..25: note = Seed: LNVIVHSATGFKQSSKALQRPVASD
LNVIVHSATGMKQFSAALLRPVASD

SEQ ID NO: 6388 - protein, 25 aa, synthetic construct
  source 1..25: note = Seed: LNVIVHSATGFKQSSKALQRPVASD
LNVIVHSATGMKQFSAALMRPVASD

SEQ ID NO: 6389 - protein, 25 aa, synthetic construct
  source 1..25: note = Seed: LNVIVHSATGFKQSSKALQRPVASD
LNVIVHSATGMKQFSAALQRPVASD

SEQ ID NO: 6390 - protein, 25 aa, synthetic construct
  source 1..25: note = Seed: LNVIVHSATGFKQSSKALQRPVASD
LNVIVHSATGMKQFSAALRRPVASD

SEQ ID NO: 6391 - protein, 25 aa, synthetic construct
  source 1..25: note = Seed: LNVIVHSATGFKQSSKALQRPVASD
LNVIVHSATGMKQFSFALVRPVASD

SEQ ID NO: 6392 - protein, 25 aa, synthetic construct
  source 1..25: note = Seed: LNVIVHSATGFKQSSKALQRPVASD
LNVIVHSATGMKQFSGALIRPVASD

SEQ ID NO: 6393 - protein, 25 aa, synthetic construct
  source 1..25: note = Seed: LNVIVHSATGFKQSSKALQRPVASD
LNVIVHSATGMKQFSGALLRPVASD

SEQ ID NO: 6394 - protein, 25 aa, synthetic construct
  source 1..25: note = Seed: LNVIVHSATGFKQSSKALQRPVASD
LNVIVHSATGMKQFSGALVRPVASD

SEQ ID NO: 6395 - protein, 25 aa, synthetic construct
  source 1..25: note = Seed: LNVIVHSATGFKQSSKALQRPVASD
LNVIVHSATGMKQFSHALKRPVASD

SEQ ID NO: 6396 - protein, 25 aa, synthetic construct
  source 1..25: note = Seed: LNVIVHSATGFKQSSKALQRPVASD
LNVIVHSATGMKQFSHALRRPVASD

SEQ ID NO: 6397 - protein, 25 aa, synthetic construct
  source 1..25: note = Seed: LNVIVHSATGFKQSSKALQRPVASD
LNVIVHSATGMKQFSKALARPVASD

SEQ ID NO: 6398 - protein, 25 aa, synthetic construct
  source 1..25: note = Seed: LNVIVHSATGFKQSSKALQRPVASD
LNVIVHSATGMKQFSKALFRPVASD

SEQ ID NO: 6399 - protein, 25 aa, synthetic construct
  source 1..25: note = Seed: LNVIVHSATGFKQSSKALQRPVASD
LNVIVHSATGMKQFSKALGRPVASD

SEQ ID NO: 6400 - protein, 25 aa, synthetic construct
  source 1..25: note = Seed: LNVIVHSATGFKQSSKALQRPVASD
LNVIVHSATGMKQFSKALHRPVASD

SEQ ID NO: 6401 - protein, 25 aa, synthetic construct
  source 1..25: note = Seed: LNVIVHSATGFKQSSKALQRPVASD
LNVIVHSATGMKQFSKALIRPVASD

SEQ ID NO: 6402 - protein, 25 aa, synthetic construct
  source 1..25: note = Seed: LNVIVHSATGFKQSSKALQRPVASD
LNVIVHSATGMKQFSKALKRPVASD

SEQ ID NO: 6403 - protein, 25 aa, synthetic construct
  source 1..25: note = Seed: LNVIVHSATGFKQSSKALQRPVASD
LNVIVHSATGMKQFSKALLRPVASD

SEQ ID NO: 6404 - protein, 25 aa, synthetic construct
  source 1..25: note = Seed: LNVIVHSATGFKQSSKALQRPVASD
LNVIVHSATGMKQFSKALMRPVASD

SEQ ID NO: 6405 - protein, 25 aa, synthetic construct
  source 1..25: note = Seed: LNVIVHSATGFKQSSKALQRPVASD
LNVIVHSATGMKQFSKALQRPVASD

SEQ ID NO: 6406 - protein, 25 aa, synthetic construct
  source 1..25: note = Seed: LNVIVHSATGFKQSSKALQRPVASD
LNVIVHSATGMKQFSKALRRPVASD

SEQ ID NO: 6407 - protein, 25 aa, synthetic construct
  source 1..25: note = Seed: LNVIVHSATGFKQSSKALQRPVASD
LNVIVHSATGMKQFSKALSRPVASD

SEQ ID NO: 6408 - protein, 25 aa, synthetic construct
  source 1..25: note = Seed: LNVIVHSATGFKQSSKALQRPVASD
LNVIVHSATGMKQFSKALTRPVASD

SEQ ID NO: 6409 - protein, 25 aa, synthetic construct
  source 1..25: note = Seed: LNVIVHSATGFKQSSKALQRPVASD
LNVIVHSATGMKQFSKALVRPVASD

SEQ ID NO: 6410 - protein, 25 aa, synthetic construct
  source 1..25: note = Seed: LNVIVHSATGFKQSSKALQRPVASD
LNVIVHSATGMKQFSKALYRPVASD

SEQ ID NO: 6411 - protein, 25 aa, synthetic construct
  source 1..25: note = Seed: LNVIVHSATGFKQSSKALQRPVASD
LNVIVHSATGMKQFSLALVRPVASD

SEQ ID NO: 6412 - protein, 25 aa, synthetic construct
  source 1..25: note = Seed: LNVIVHSATGFKQSSKALQRPVASD
LNVIVHSATGMKQFSNALARPVASD

SEQ ID NO: 6413 - protein, 25 aa, synthetic construct
  source 1..25: note = Seed: LNVIVHSATGFKQSSKALQRPVASD
LNVIVHSATGMKQFSNALRRPVASD

SEQ ID NO: 6414 - protein, 25 aa, synthetic construct
  source 1..25: note = Seed: LNVIVHSATGFKQSSKALQRPVASD
LNVIVHSATGMKQFSPALGRPVASD

SEQ ID NO: 6415 - protein, 25 aa, synthetic construct
  source 1..25: note = Seed: LNVIVHSATGFKQSSKALQRPVASD
LNVIVHSATGMKQFSPALIRPVASD

SEQ ID NO: 6416 - protein, 25 aa, synthetic construct
  source 1..25: note = Seed: LNVIVHSATGFKQSSKALQRPVASD
LNVIVHSATGMKQFSPALLRPVASD

SEQ ID NO: 6417 - protein, 25 aa, synthetic construct
  source 1..25: note = Seed: LNVIVHSATGFKQSSKALQRPVASD
LNVIVHSATGMKQFSPALMRPVASD

SEQ ID NO: 6418 - protein, 25 aa, synthetic construct
  source 1..25: note = Seed: LNVIVHSATGFKQSSKALQRPVASD
LNVIVHSATGMKQFSPALNRPVASD

SEQ ID NO: 6419 - protein, 25 aa, synthetic construct
  source 1..25: note = Seed: LNVIVHSATGFKQSSKALQRPVASD
LNVIVHSATGMKQFSPALRRPVASD

SEQ ID NO: 6420 - protein, 25 aa, synthetic construct
  source 1..25: note = Seed: LNVIVHSATGFKQSSKALQRPVASD
LNVIVHSATGMKQFSRALARPVASD

SEQ ID NO: 6421 - protein, 25 aa, synthetic construct
  source 1..25: note = Seed: LNVIVHSATGFKQSSKALQRPVASD
LNVIVHSATGMKQFSRALFRPVASD

SEQ ID NO: 6422 - protein, 25 aa, synthetic construct
  source 1..25: note = Seed: LNVIVHSATGFKQSSKALQRPVASD
LNVIVHSATGMKQFSRALGRPVASD

SEQ ID NO: 6423 - protein, 25 aa, synthetic construct
  source 1..25: note = Seed: LNVIVHSATGFKQSSKALQRPVASD
LNVIVHSATGMKQFSRALHRPVASD

SEQ ID NO: 6424 - protein, 25 aa, synthetic construct
  source 1..25: note = Seed: LNVIVHSATGFKQSSKALQRPVASD
LNVIVHSATGMKQFSRALIRPVASD

SEQ ID NO: 6425 - protein, 25 aa, synthetic construct
  source 1..25: note = Seed: LNVIVHSATGFKQSSKALQRPVASD
LNVIVHSATGMKQFSRALKRPVASD

SEQ ID NO: 6426 - protein, 25 aa, synthetic construct
  source 1..25: note = Seed: LNVIVHSATGFKQSSKALQRPVASD
LNVIVHSATGMKQFSRALLRPVASD

SEQ ID NO: 6427 - protein, 25 aa, synthetic construct
  source 1..25: note = Seed: LNVIVHSATGFKQSSKALQRPVASD
LNVIVHSATGMKQFSRALMRPVASD

SEQ ID NO: 6428 - protein, 25 aa, synthetic construct
  source 1..25: note = Seed: LNVIVHSATGFKQSSKALQRPVASD
LNVIVHSATGMKQFSRALNRPVASD

SEQ ID NO: 6429 - protein, 25 aa, synthetic construct
  source 1..25: note = Seed: LNVIVHSATGFKQSSKALQRPVASD
LNVIVHSATGMKQFSRALQRPVASD

SEQ ID NO: 6430 - protein, 25 aa, synthetic construct
  source 1..25: note = Seed: LNVIVHSATGFKQSSKALQRPVASD
LNVIVHSATGMKQFSRALRRPVASD

SEQ ID NO: 6431 - protein, 25 aa, synthetic construct
  source 1..25: note = Seed: LNVIVHSATGFKQSSKALQRPVASD
LNVIVHSATGMKQFSRALSRPVASD

SEQ ID NO: 6432 - protein, 25 aa, synthetic construct
  source 1..25: note = Seed: LNVIVHSATGFKQSSKALQRPVASD
LNVIVHSATGMKQFSRALTRPVASD

SEQ ID NO: 6433 - protein, 25 aa, synthetic construct
  source 1..25: note = Seed: LNVIVHSATGFKQSSKALQRPVASD
LNVIVHSATGMKQFSRALVRPVASD

SEQ ID NO: 6434 - protein, 25 aa, synthetic construct
  source 1..25: note = Seed: LNVIVHSATGFKQSSKALQRPVASD
LNVIVHSATGMKQFSRALYRPVASD

SEQ ID NO: 6435 - protein, 25 aa, synthetic construct
  source 1..25: note = Seed: LNVIVHSATGFKQSSKALQRPVASD
LNVIVHSATGMKQFSSALARPVASD

SEQ ID NO: 6436 - protein, 25 aa, synthetic construct
  source 1..25: note = Seed: LNVIVHSATGFKQSSKALQRPVASD
LNVIVHSATGMKQFSSALIRPVASD

SEQ ID NO: 6437 - protein, 25 aa, synthetic construct
  source 1..25: note = Seed: LNVIVHSATGFKQSSKALQRPVASD
LNVIVHSATGMKQFSSALLRPVASD

SEQ ID NO: 6438 - protein, 25 aa, synthetic construct
  source 1..25: note = Seed: LNVIVHSATGFKQSSKALQRPVASD
LNVIVHSATGMKQFSSALMRPVASD

SEQ ID NO: 6439 - protein, 25 aa, synthetic construct
  source 1..25: note = Seed: LNVIVHSATGFKQSSKALQRPVASD
LNVIVHSATGMKQFSSALRRPVASD

SEQ ID NO: 6440 - protein, 25 aa, synthetic construct
  source 1..25: note = Seed: LNVIVHSATGFKQSSKALQRPVASD
LNVIVHSATGMKQFSSALVRPVASD

SEQ ID NO: 6441 - protein, 25 aa, synthetic construct
  source 1..25: note = Seed: LNVIVHSATGFKQSSKALQRPVASD
LNVIVHSATGMKQFSTALMRPVASD

SEQ ID NO: 6442 - protein, 25 aa, synthetic construct
  source 1..25: note = Seed: LNVIVHSATGFKQSSKALQRPVASD
LNVIVHSATGMKQFSTALRRPVASD

SEQ ID NO: 6443 - protein, 25 aa, synthetic construct
  source 1..25: note = Seed: LNVIVHSATGFKQSSKALQRPVASD
LNVIVHSATGMKQFSVALHRPVASD

SEQ ID NO: 6444 - protein, 25 aa, synthetic construct
  source 1..25: note = Seed: LNVIVHSATGFKQSSKALQRPVASD
LNVIVHSATGMKQFSVALQRPVASD

SEQ ID NO: 6445 - protein, 25 aa, synthetic construct
  source 1..25: note = Seed: LNVIVHSATGFKQSSKALQRPVASD
LNVIVHSATGMKQFSVALRRPVASD

SEQ ID NO: 6446 - protein, 25 aa, synthetic construct
  source 1..25: note = Seed: LNVIVHSATGFKQSSKALQRPVASD
LNVIVHSATGMKQGSAALIRPVASD

SEQ ID NO: 6447 - protein, 25 aa, synthetic construct
  source 1..25: note = Seed: LNVIVHSATGFKQSSKALQRPVASD
LNVIVHSATGMKQGSAALLRPVASD

SEQ ID NO: 6448 - protein, 25 aa, synthetic construct
  source 1..25: note = Seed: LNVIVHSATGFKQSSKALQRPVASD
LNVIVHSATGMKQHSAALRRPVASD

SEQ ID NO: 6449 - protein, 25 aa, synthetic construct
  source 1..25: note = Seed: LNVIVHSATGFKQSSKALQRPVASD
LNVIVHSATGMKQHSIALRRPVASD

SEQ ID NO: 6450 - protein, 25 aa, synthetic construct
  source 1..25: note = Seed: LNVIVHSATGFKQSSKALQRPVASD
LNVIVHSATGMKQHSKALRRPVASD

SEQ ID NO: 6451 - protein, 25 aa, synthetic construct
  source 1..25: note = Seed: LNVIVHSATGFKQSSKALQRPVASD
LNVIVHSATGMKQHSRALFRPVASD

SEQ ID NO: 6452 - protein, 25 aa, synthetic construct
  source 1..25: note = Seed: LNVIVHSATGFKQSSKALQRPVASD
LNVIVHSATGMKQHSRALRRPVASD

SEQ ID NO: 6453 - protein, 25 aa, synthetic construct
  source 1..25: note = Seed: LNVIVHSATGFKQSSKALQRPVASD
LNVIVHSATGMKQHSRALYRPVASD

SEQ ID NO: 6454 - protein, 25 aa, synthetic construct
  source 1..25: note = Seed: LNVIVHSATGFKQSSKALQRPVASD
LNVIVHSATGMKQHSVALRRPVASD

SEQ ID NO: 6455 - protein, 25 aa, synthetic construct
  source 1..25: note = Seed: LNVIVHSATGFKQSSKALQRPVASD
LNVIVHSATGMKQISAALARPVASD

SEQ ID NO: 6456 - protein, 25 aa, synthetic construct
  source 1..25: note = Seed: LNVIVHSATGFKQSSKALQRPVASD
LNVIVHSATGMKQISAALGRPVASD

SEQ ID NO: 6457 - protein, 25 aa, synthetic construct
  source 1..25: note = Seed: LNVIVHSATGFKQSSKALQRPVASD
LNVIVHSATGMKQISAALIRPVASD

SEQ ID NO: 6458 - protein, 25 aa, synthetic construct
  source 1..25: note = Seed: LNVIVHSATGFKQSSKALQRPVASD
LNVIVHSATGMKQISAALLRPVASD

SEQ ID NO: 6459 - protein, 25 aa, synthetic construct
  source 1..25: note = Seed: LNVIVHSATGFKQSSKALQRPVASD
LNVIVHSATGMKQISAALMRPVASD

SEQ ID NO: 6460 - protein, 25 aa, synthetic construct
  source 1..25: note = Seed: LNVIVHSATGFKQSSKALQRPVASD
LNVIVHSATGMKQISAALNRPVASD

SEQ ID NO: 6461 - protein, 25 aa, synthetic construct
  source 1..25: note = Seed: LNVIVHSATGFKQSSKALQRPVASD
LNVIVHSATGMKQISAALRRPVASD

SEQ ID NO: 6462 - protein, 25 aa, synthetic construct
  source 1..25: note = Seed: LNVIVHSATGFKQSSKALQRPVASD
LNVIVHSATGMKQISAALSRPVASD

SEQ ID NO: 6463 - protein, 25 aa, synthetic construct
  source 1..25: note = Seed: LNVIVHSATGFKQSSKALQRPVASD
LNVIVHSATGMKQISAALTRPVASD

SEQ ID NO: 6464 - protein, 25 aa, synthetic construct
  source 1..25: note = Seed: LNVIVHSATGFKQSSKALQRPVASD
LNVIVHSATGMKQISAALVRPVASD

SEQ ID NO: 6465 - protein, 25 aa, synthetic construct
  source 1..25: note = Seed: LNVIVHSATGFKQSSKALQRPVASD
LNVIVHSATGMKQISFALMRPVASD

SEQ ID NO: 6466 - protein, 25 aa, synthetic construct
  source 1..25: note = Seed: LNVIVHSATGFKQSSKALQRPVASD
LNVIVHSATGMKQISFALVRPVASD

SEQ ID NO: 6467 - protein, 25 aa, synthetic construct
  source 1..25: note = Seed: LNVIVHSATGFKQSSKALQRPVASD
LNVIVHSATGMKQISGALARPVASD

SEQ ID NO: 6468 - protein, 25 aa, synthetic construct
  source 1..25: note = Seed: LNVIVHSATGFKQSSKALQRPVASD
LNVIVHSATGMKQISGALGRPVASD

SEQ ID NO: 6469 - protein, 25 aa, synthetic construct
  source 1..25: note = Seed: LNVIVHSATGFKQSSKALQRPVASD
LNVIVHSATGMKQISGALIRPVASD

SEQ ID NO: 6470 - protein, 25 aa, synthetic construct
  source 1..25: note = Seed: LNVIVHSATGFKQSSKALQRPVASD
LNVIVHSATGMKQISGALLRPVASD

SEQ ID NO: 6471 - protein, 25 aa, synthetic construct
  source 1..25: note = Seed: LNVIVHSATGFKQSSKALQRPVASD
LNVIVHSATGMKQISGALMRPVASD

SEQ ID NO: 6472 - protein, 25 aa, synthetic construct
  source 1..25: note = Seed: LNVIVHSATGFKQSSKALQRPVASD
LNVIVHSATGMKQISGALNRPVASD

SEQ ID NO: 6473 - protein, 25 aa, synthetic construct
  source 1..25: note = Seed: LNVIVHSATGFKQSSKALQRPVASD
LNVIVHSATGMKQISGALSRPVASD

SEQ ID NO: 6474 - protein, 25 aa, synthetic construct
  source 1..25: note = Seed: LNVIVHSATGFKQSSKALQRPVASD
LNVIVHSATGMKQISGALTRPVASD

SEQ ID NO: 6475 - protein, 25 aa, synthetic construct
  source 1..25: note = Seed: LNVIVHSATGFKQSSKALQRPVASD
LNVIVHSATGMKQISGALVRPVASD

SEQ ID NO: 6476 - protein, 25 aa, synthetic construct
  source 1..25: note = Seed: LNVIVHSATGFKQSSKALQRPVASD
LNVIVHSATGMKQISIALARPVASD

SEQ ID NO: 6477 - protein, 25 aa, synthetic construct
  source 1..25: note = Seed: LNVIVHSATGFKQSSKALQRPVASD
LNVIVHSATGMKQISIALGRPVASD

SEQ ID NO: 6478 - protein, 25 aa, synthetic construct
  source 1..25: note = Seed: LNVIVHSATGFKQSSKALQRPVASD
LNVIVHSATGMKQISIALNRPVASD

SEQ ID NO: 6479 - protein, 25 aa, synthetic construct
  source 1..25: note = Seed: LNVIVHSATGFKQSSKALQRPVASD
LNVIVHSATGMKQISIALQRPVASD

SEQ ID NO: 6480 - protein, 25 aa, synthetic construct
  source 1..25: note = Seed: LNVIVHSATGFKQSSKALQRPVASD
LNVIVHSATGMKQISIALSRPVASD

SEQ ID NO: 6481 - protein, 25 aa, synthetic construct
  source 1..25: note = Seed: LNVIVHSATGFKQSSKALQRPVASD
LNVIVHSATGMKQISIALVRPVASD

SEQ ID NO: 6482 - protein, 25 aa, synthetic construct
  source 1..25: note = Seed: LNVIVHSATGFKQSSKALQRPVASD
LNVIVHSATGMKQISKALARPVASD

SEQ ID NO: 6483 - protein, 25 aa, synthetic construct
  source 1..25: note = Seed: LNVIVHSATGFKQSSKALQRPVASD
LNVIVHSATGMKQISKALFRPVASD

SEQ ID NO: 6484 - protein, 25 aa, synthetic construct
  source 1..25: note = Seed: LNVIVHSATGFKQSSKALQRPVASD
LNVIVHSATGMKQISKALGRPVASD

SEQ ID NO: 6485 - protein, 25 aa, synthetic construct
  source 1..25: note = Seed: LNVIVHSATGFKQSSKALQRPVASD
LNVIVHSATGMKQISKALHRPVASD

SEQ ID NO: 6486 - protein, 25 aa, synthetic construct
  source 1..25: note = Seed: LNVIVHSATGFKQSSKALQRPVASD
LNVIVHSATGMKQISKALIRPVASD

SEQ ID NO: 6487 - protein, 25 aa, synthetic construct
  source 1..25: note = Seed: LNVIVHSATGFKQSSKALQRPVASD
LNVIVHSATGMKQISKALKRPVASD

SEQ ID NO: 6488 - protein, 25 aa, synthetic construct
  source 1..25: note = Seed: LNVIVHSATGFKQSSKALQRPVASD
LNVIVHSATGMKQISKALLRPVASD

SEQ ID NO: 6489 - protein, 25 aa, synthetic construct
  source 1..25: note = Seed: LNVIVHSATGFKQSSKALQRPVASD
LNVIVHSATGMKQISKALMRPVASD

SEQ ID NO: 6490 - protein, 25 aa, synthetic construct
  source 1..25: note = Seed: LNVIVHSATGFKQSSKALQRPVASD
LNVIVHSATGMKQISKALNRPVASD

SEQ ID NO: 6491 - protein, 25 aa, synthetic construct
  source 1..25: note = Seed: LNVIVHSATGFKQSSKALQRPVASD
LNVIVHSATGMKQISKALPRPVASD

SEQ ID NO: 6492 - protein, 25 aa, synthetic construct
  source 1..25: note = Seed: LNVIVHSATGFKQSSKALQRPVASD
LNVIVHSATGMKQISKALQRPVASD

SEQ ID NO: 6493 - protein, 25 aa, synthetic construct
  source 1..25: note = Seed: LNVIVHSATGFKQSSKALQRPVASD
LNVIVHSATGMKQISKALRRPVASD

SEQ ID NO: 6494 - protein, 25 aa, synthetic construct
  source 1..25: note = Seed: LNVIVHSATGFKQSSKALQRPVASD
LNVIVHSATGMKQISKALSRPVASD

SEQ ID NO: 6495 - protein, 25 aa, synthetic construct
  source 1..25: note = Seed: LNVIVHSATGFKQSSKALQRPVASD
LNVIVHSATGMKQISKALTRPVASD

SEQ ID NO: 6496 - protein, 25 aa, synthetic construct
  source 1..25: note = Seed: LNVIVHSATGFKQSSKALQRPVASD
LNVIVHSATGMKQISKALVRPVASD

SEQ ID NO: 6497 - protein, 25 aa, synthetic construct
  source 1..25: note = Seed: LNVIVHSATGFKQSSKALQRPVASD
LNVIVHSATGMKQISKALYRPVASD

SEQ ID NO: 6498 - protein, 25 aa, synthetic construct
  source 1..25: note = Seed: LNVIVHSATGFKQSSKALQRPVASD
LNVIVHSATGMKQISLALGRPVASD

SEQ ID NO: 6499 - protein, 25 aa, synthetic construct
  source 1..25: note = Seed: LNVIVHSATGFKQSSKALQRPVASD
LNVIVHSATGMKQISLALMRPVASD

SEQ ID NO: 6500 - protein, 25 aa, synthetic construct
  source 1..25: note = Seed: LNVIVHSATGFKQSSKALQRPVASD
LNVIVHSATGMKQISLALNRPVASD

SEQ ID NO: 6501 - protein, 25 aa, synthetic construct
  source 1..25: note = Seed: LNVIVHSATGFKQSSKALQRPVASD
LNVIVHSATGMKQISLALSRPVASD

SEQ ID NO: 6502 - protein, 25 aa, synthetic construct
  source 1..25: note = Seed: LNVIVHSATGFKQSSKALQRPVASD
LNVIVHSATGMKQISMALNRPVASD

SEQ ID NO: 6503 - protein, 25 aa, synthetic construct
  source 1..25: note = Seed: LNVIVHSATGFKQSSKALQRPVASD
LNVIVHSATGMKQISNALARPVASD

SEQ ID NO: 6504 - protein, 25 aa, synthetic construct
  source 1..25: note = Seed: LNVIVHSATGFKQSSKALQRPVASD
LNVIVHSATGMKQISNALIRPVASD

SEQ ID NO: 6505 - protein, 25 aa, synthetic construct
  source 1..25: note = Seed: LNVIVHSATGFKQSSKALQRPVASD
LNVIVHSATGMKQISNALVRPVASD

SEQ ID NO: 6506 - protein, 25 aa, synthetic construct
  source 1..25: note = Seed: LNVIVHSATGFKQSSKALQRPVASD
LNVIVHSATGMKQISPALARPVASD

SEQ ID NO: 6507 - protein, 25 aa, synthetic construct
  source 1..25: note = Seed: LNVIVHSATGFKQSSKALQRPVASD
LNVIVHSATGMKQISPALIRPVASD

SEQ ID NO: 6508 - protein, 25 aa, synthetic construct
  source 1..25: note = Seed: LNVIVHSATGFKQSSKALQRPVASD
LNVIVHSATGMKQISPALLRPVASD

SEQ ID NO: 6509 - protein, 25 aa, synthetic construct
  source 1..25: note = Seed: LNVIVHSATGFKQSSKALQRPVASD
LNVIVHSATGMKQISPALMRPVASD

SEQ ID NO: 6510 - protein, 25 aa, synthetic construct
  source 1..25: note = Seed: LNVIVHSATGFKQSSKALQRPVASD
LNVIVHSATGMKQISPALNRPVASD

SEQ ID NO: 6511 - protein, 25 aa, synthetic construct
  source 1..25: note = Seed: LNVIVHSATGFKQSSKALQRPVASD
LNVIVHSATGMKQISPALSRPVASD

SEQ ID NO: 6512 - protein, 25 aa, synthetic construct
  source 1..25: note = Seed: LNVIVHSATGFKQSSKALQRPVASD
LNVIVHSATGMKQISPALTRPVASD

SEQ ID NO: 6513 - protein, 25 aa, synthetic construct
  source 1..25: note = Seed: LNVIVHSATGFKQSSKALQRPVASD
LNVIVHSATGMKQISPALVRPVASD

SEQ ID NO: 6514 - protein, 25 aa, synthetic construct
  source 1..25: note = Seed: LNVIVHSATGFKQSSKALQRPVASD
LNVIVHSATGMKQISRALARPVASD

SEQ ID NO: 6515 - protein, 25 aa, synthetic construct
  source 1..25: note = Seed: LNVIVHSATGFKQSSKALQRPVASD
LNVIVHSATGMKQISRALFRPVASD

SEQ ID NO: 6516 - protein, 25 aa, synthetic construct
  source 1..25: note = Seed: LNVIVHSATGFKQSSKALQRPVASD
LNVIVHSATGMKQISRALGRPVASD

SEQ ID NO: 6517 - protein, 25 aa, synthetic construct
  source 1..25: note = Seed: LNVIVHSATGFKQSSKALQRPVASD
LNVIVHSATGMKQISRALHRPVASD

SEQ ID NO: 6518 - protein, 25 aa, synthetic construct
  source 1..25: note = Seed: LNVIVHSATGFKQSSKALQRPVASD
LNVIVHSATGMKQISRALIRPVASD

SEQ ID NO: 6519 - protein, 25 aa, synthetic construct
  source 1..25: note = Seed: LNVIVHSATGFKQSSKALQRPVASD
LNVIVHSATGMKQISRALKRPVASD

SEQ ID NO: 6520 - protein, 25 aa, synthetic construct
  source 1..25: note = Seed: LNVIVHSATGFKQSSKALQRPVASD
LNVIVHSATGMKQISRALLRPVASD

SEQ ID NO: 6521 - protein, 25 aa, synthetic construct
  source 1..25: note = Seed: LNVIVHSATGFKQSSKALQRPVASD
LNVIVHSATGMKQISRALMRPVASD

SEQ ID NO: 6522 - protein, 25 aa, synthetic construct
  source 1..25: note = Seed: LNVIVHSATGFKQSSKALQRPVASD
LNVIVHSATGMKQISRALNRPVASD

SEQ ID NO: 6523 - protein, 25 aa, synthetic construct
  source 1..25: note = Seed: LNVIVHSATGFKQSSKALQRPVASD
LNVIVHSATGMKQISRALPRPVASD

SEQ ID NO: 6524 - protein, 25 aa, synthetic construct
  source 1..25: note = Seed: LNVIVHSATGFKQSSKALQRPVASD
LNVIVHSATGMKQISRALQRPVASD

SEQ ID NO: 6525 - protein, 25 aa, synthetic construct
  source 1..25: note = Seed: LNVIVHSATGFKQSSKALQRPVASD
LNVIVHSATGMKQISRALRRPVASD

SEQ ID NO: 6526 - protein, 25 aa, synthetic construct
  source 1..25: note = Seed: LNVIVHSATGFKQSSKALQRPVASD
LNVIVHSATGMKQISRALSRPVASD

SEQ ID NO: 6527 - protein, 25 aa, synthetic construct
  source 1..25: note = Seed: LNVIVHSATGFKQSSKALQRPVASD
LNVIVHSATGMKQISRALTRPVASD

SEQ ID NO: 6528 - protein, 25 aa, synthetic construct
  source 1..25: note = Seed: LNVIVHSATGFKQSSKALQRPVASD
LNVIVHSATGMKQISRALVRPVASD

SEQ ID NO: 6529 - protein, 25 aa, synthetic construct
  source 1..25: note = Seed: LNVIVHSATGFKQSSKALQRPVASD
LNVIVHSATGMKQISRALYRPVASD

SEQ ID NO: 6530 - protein, 25 aa, synthetic construct
  source 1..25: note = Seed: LNVIVHSATGFKQSSKALQRPVASD
LNVIVHSATGMKQISSALARPVASD

SEQ ID NO: 6531 - protein, 25 aa, synthetic construct
  source 1..25: note = Seed: LNVIVHSATGFKQSSKALQRPVASD
LNVIVHSATGMKQISSALIRPVASD

SEQ ID NO: 6532 - protein, 25 aa, synthetic construct
  source 1..25: note = Seed: LNVIVHSATGFKQSSKALQRPVASD
LNVIVHSATGMKQISSALLRPVASD

SEQ ID NO: 6533 - protein, 25 aa, synthetic construct
  source 1..25: note = Seed: LNVIVHSATGFKQSSKALQRPVASD
LNVIVHSATGMKQISSALMRPVASD

SEQ ID NO: 6534 - protein, 25 aa, synthetic construct
  source 1..25: note = Seed: LNVIVHSATGFKQSSKALQRPVASD
LNVIVHSATGMKQISSALNRPVASD

SEQ ID NO: 6535 - protein, 25 aa, synthetic construct
  source 1..25: note = Seed: LNVIVHSATGFKQSSKALQRPVASD
LNVIVHSATGMKQISSALSRPVASD

SEQ ID NO: 6536 - protein, 25 aa, synthetic construct
  source 1..25: note = Seed: LNVIVHSATGFKQSSKALQRPVASD
LNVIVHSATGMKQISSALTRPVASD

SEQ ID NO: 6537 - protein, 25 aa, synthetic construct
  source 1..25: note = Seed: LNVIVHSATGFKQSSKALQRPVASD
LNVIVHSATGMKQISSALVRPVASD

SEQ ID NO: 6538 - protein, 25 aa, synthetic construct
  source 1..25: note = Seed: LNVIVHSATGFKQSSKALQRPVASD
LNVIVHSATGMKQISTALARPVASD

SEQ ID NO: 6539 - protein, 25 aa, synthetic construct
  source 1..25: note = Seed: LNVIVHSATGFKQSSKALQRPVASD
LNVIVHSATGMKQISTALIRPVASD

SEQ ID NO: 6540 - protein, 25 aa, synthetic construct
  source 1..25: note = Seed: LNVIVHSATGFKQSSKALQRPVASD
LNVIVHSATGMKQISTALMRPVASD

SEQ ID NO: 6541 - protein, 25 aa, synthetic construct
  source 1..25: note = Seed: LNVIVHSATGFKQSSKALQRPVASD
LNVIVHSATGMKQISTALNRPVASD

SEQ ID NO: 6542 - protein, 25 aa, synthetic construct
  source 1..25: note = Seed: LNVIVHSATGFKQSSKALQRPVASD
LNVIVHSATGMKQISTALRRPVASD

SEQ ID NO: 6543 - protein, 25 aa, synthetic construct
  source 1..25: note = Seed: LNVIVHSATGFKQSSKALQRPVASD
LNVIVHSATGMKQISTALSRPVASD

SEQ ID NO: 6544 - protein, 25 aa, synthetic construct
  source 1..25: note = Seed: LNVIVHSATGFKQSSKALQRPVASD
LNVIVHSATGMKQISTALTRPVASD

SEQ ID NO: 6545 - protein, 25 aa, synthetic construct
  source 1..25: note = Seed: LNVIVHSATGFKQSSKALQRPVASD
LNVIVHSATGMKQISTALVRPVASD

SEQ ID NO: 6546 - protein, 25 aa, synthetic construct
  source 1..25: note = Seed: LNVIVHSATGFKQSSKALQRPVASD
LNVIVHSATGMKQISVALARPVASD

SEQ ID NO: 6547 - protein, 25 aa, synthetic construct
  source 1..25: note = Seed: LNVIVHSATGFKQSSKALQRPVASD
LNVIVHSATGMKQISVALGRPVASD

SEQ ID NO: 6548 - protein, 25 aa, synthetic construct
  source 1..25: note = Seed: LNVIVHSATGFKQSSKALQRPVASD
LNVIVHSATGMKQISVALIRPVASD

SEQ ID NO: 6549 - protein, 25 aa, synthetic construct
  source 1..25: note = Seed: LNVIVHSATGFKQSSKALQRPVASD
LNVIVHSATGMKQISVALLRPVASD

SEQ ID NO: 6550 - protein, 25 aa, synthetic construct
  source 1..25: note = Seed: LNVIVHSATGFKQSSKALQRPVASD
LNVIVHSATGMKQISVALMRPVASD

SEQ ID NO: 6551 - protein, 25 aa, synthetic construct
  source 1..25: note = Seed: LNVIVHSATGFKQSSKALQRPVASD
LNVIVHSATGMKQISVALNRPVASD

SEQ ID NO: 6552 - protein, 25 aa, synthetic construct
  source 1..25: note = Seed: LNVIVHSATGFKQSSKALQRPVASD
LNVIVHSATGMKQISVALSRPVASD

SEQ ID NO: 6553 - protein, 25 aa, synthetic construct
  source 1..25: note = Seed: LNVIVHSATGFKQSSKALQRPVASD
LNVIVHSATGMKQISVALTRPVASD

SEQ ID NO: 6554 - protein, 25 aa, synthetic construct
  source 1..25: note = Seed: LNVIVHSATGFKQSSKALQRPVASD
LNVIVHSATGMKQISVALVRPVASD

SEQ ID NO: 6555 - protein, 25 aa, synthetic construct
  source 1..25: note = Seed: LNVIVHSATGFKQSSKALQRPVASD
LNVIVHSATGMKQKSRALRRPVASD

SEQ ID NO: 6556 - protein, 25 aa, synthetic construct
  source 1..25: note = Seed: LNVIVHSATGFKQSSKALQRPVASD
LNVIVHSATGMKQLSAALARPVASD

SEQ ID NO: 6557 - protein, 25 aa, synthetic construct
  source 1..25: note = Seed: LNVIVHSATGFKQSSKALQRPVASD
LNVIVHSATGMKQLSAALCRPVASD

SEQ ID NO: 6558 - protein, 25 aa, synthetic construct
  source 1..25: note = Seed: LNVIVHSATGFKQSSKALQRPVASD
LNVIVHSATGMKQLSAALFRPVASD

SEQ ID NO: 6559 - protein, 25 aa, synthetic construct
  source 1..25: note = Seed: LNVIVHSATGFKQSSKALQRPVASD
LNVIVHSATGMKQLSAALGRPVASD

SEQ ID NO: 6560 - protein, 25 aa, synthetic construct
  source 1..25: note = Seed: LNVIVHSATGFKQSSKALQRPVASD
LNVIVHSATGMKQLSAALHRPVASD

SEQ ID NO: 6561 - protein, 25 aa, synthetic construct
  source 1..25: note = Seed: LNVIVHSATGFKQSSKALQRPVASD
LNVIVHSATGMKQLSAALIRPVASD

SEQ ID NO: 6562 - protein, 25 aa, synthetic construct
  source 1..25: note = Seed: LNVIVHSATGFKQSSKALQRPVASD
LNVIVHSATGMKQLSAALLRPVASD

SEQ ID NO: 6563 - protein, 25 aa, synthetic construct
  source 1..25: note = Seed: LNVIVHSATGFKQSSKALQRPVASD
LNVIVHSATGMKQLSAALMRPVASD

SEQ ID NO: 6564 - protein, 25 aa, synthetic construct
  source 1..25: note = Seed: LNVIVHSATGFKQSSKALQRPVASD
LNVIVHSATGMKQLSAALNRPVASD

SEQ ID NO: 6565 - protein, 25 aa, synthetic construct
  source 1..25: note = Seed: LNVIVHSATGFKQSSKALQRPVASD
LNVIVHSATGMKQLSAALPRPVASD

SEQ ID NO: 6566 - protein, 25 aa, synthetic construct
  source 1..25: note = Seed: LNVIVHSATGFKQSSKALQRPVASD
LNVIVHSATGMKQLSAALQRPVASD

SEQ ID NO: 6567 - protein, 25 aa, synthetic construct
  source 1..25: note = Seed: LNVIVHSATGFKQSSKALQRPVASD
LNVIVHSATGMKQLSAALSRPVASD

SEQ ID NO: 6568 - protein, 25 aa, synthetic construct
  source 1..25: note = Seed: LNVIVHSATGFKQSSKALQRPVASD
LNVIVHSATGMKQLSAALTRPVASD

SEQ ID NO: 6569 - protein, 25 aa, synthetic construct
  source 1..25: note = Seed: LNVIVHSATGFKQSSKALQRPVASD
LNVIVHSATGMKQLSAALVRPVASD

SEQ ID NO: 6570 - protein, 25 aa, synthetic construct
  source 1..25: note = Seed: LNVIVHSATGFKQSSKALQRPVASD
LNVIVHSATGMKQLSFALVRPVASD

SEQ ID NO: 6571 - protein, 25 aa, synthetic construct
  source 1..25: note = Seed: LNVIVHSATGFKQSSKALQRPVASD
LNVIVHSATGMKQLSGALARPVASD

SEQ ID NO: 6572 - protein, 25 aa, synthetic construct
  source 1..25: note = Seed: LNVIVHSATGFKQSSKALQRPVASD
LNVIVHSATGMKQLSGALCRPVASD

SEQ ID NO: 6573 - protein, 25 aa, synthetic construct
  source 1..25: note = Seed: LNVIVHSATGFKQSSKALQRPVASD
LNVIVHSATGMKQLSGALGRPVASD

SEQ ID NO: 6574 - protein, 25 aa, synthetic construct
  source 1..25: note = Seed: LNVIVHSATGFKQSSKALQRPVASD
LNVIVHSATGMKQLSGALIRPVASD

SEQ ID NO: 6575 - protein, 25 aa, synthetic construct
  source 1..25: note = Seed: LNVIVHSATGFKQSSKALQRPVASD
LNVIVHSATGMKQLSGALLRPVASD

SEQ ID NO: 6576 - protein, 25 aa, synthetic construct
  source 1..25: note = Seed: LNVIVHSATGFKQSSKALQRPVASD
LNVIVHSATGMKQLSGALMRPVASD

SEQ ID NO: 6577 - protein, 25 aa, synthetic construct
  source 1..25: note = Seed: LNVIVHSATGFKQSSKALQRPVASD
LNVIVHSATGMKQLSGALNRPVASD

SEQ ID NO: 6578 - protein, 25 aa, synthetic construct
  source 1..25: note = Seed: LNVIVHSATGFKQSSKALQRPVASD
LNVIVHSATGMKQLSGALPRPVASD

SEQ ID NO: 6579 - protein, 25 aa, synthetic construct
  source 1..25: note = Seed: LNVIVHSATGFKQSSKALQRPVASD
LNVIVHSATGMKQLSGALSRPVASD

SEQ ID NO: 6580 - protein, 25 aa, synthetic construct
  source 1..25: note = Seed: LNVIVHSATGFKQSSKALQRPVASD
LNVIVHSATGMKQLSGALTRPVASD

SEQ ID NO: 6581 - protein, 25 aa, synthetic construct
  source 1..25: note = Seed: LNVIVHSATGFKQSSKALQRPVASD
LNVIVHSATGMKQLSGALVRPVASD

SEQ ID NO: 6582 - protein, 25 aa, synthetic construct
  source 1..25: note = Seed: LNVIVHSATGFKQSSKALQRPVASD
LNVIVHSATGMKQLSHALARPVASD

SEQ ID NO: 6583 - protein, 25 aa, synthetic construct
  source 1..25: note = Seed: LNVIVHSATGFKQSSKALQRPVASD
LNVIVHSATGMKQLSHALIRPVASD

SEQ ID NO: 6584 - protein, 25 aa, synthetic construct
  source 1..25: note = Seed: LNVIVHSATGFKQSSKALQRPVASD
LNVIVHSATGMKQLSHALKRPVASD

SEQ ID NO: 6585 - protein, 25 aa, synthetic construct
  source 1..25: note = Seed: LNVIVHSATGFKQSSKALQRPVASD
LNVIVHSATGMKQLSHALRRPVASD

SEQ ID NO: 6586 - protein, 25 aa, synthetic construct
  source 1..25: note = Seed: LNVIVHSATGFKQSSKALQRPVASD
LNVIVHSATGMKQLSHALVRPVASD

SEQ ID NO: 6587 - protein, 25 aa, synthetic construct
  source 1..25: note = Seed: LNVIVHSATGFKQSSKALQRPVASD
LNVIVHSATGMKQLSIALARPVASD

SEQ ID NO: 6588 - protein, 25 aa, synthetic construct
  source 1..25: note = Seed: LNVIVHSATGFKQSSKALQRPVASD
LNVIVHSATGMKQLSIALGRPVASD

SEQ ID NO: 6589 - protein, 25 aa, synthetic construct
  source 1..25: note = Seed: LNVIVHSATGFKQSSKALQRPVASD
LNVIVHSATGMKQLSIALHRPVASD

SEQ ID NO: 6590 - protein, 25 aa, synthetic construct
  source 1..25: note = Seed: LNVIVHSATGFKQSSKALQRPVASD
LNVIVHSATGMKQLSIALIRPVASD

SEQ ID NO: 6591 - protein, 25 aa, synthetic construct
  source 1..25: note = Seed: LNVIVHSATGFKQSSKALQRPVASD
LNVIVHSATGMKQLSIALLRPVASD

SEQ ID NO: 6592 - protein, 25 aa, synthetic construct
  source 1..25: note = Seed: LNVIVHSATGFKQSSKALQRPVASD
LNVIVHSATGMKQLSIALMRPVASD

SEQ ID NO: 6593 - protein, 25 aa, synthetic construct
  source 1..25: note = Seed: LNVIVHSATGFKQSSKALQRPVASD
LNVIVHSATGMKQLSIALNRPVASD

SEQ ID NO: 6594 - protein, 25 aa, synthetic construct
  source 1..25: note = Seed: LNVIVHSATGFKQSSKALQRPVASD
LNVIVHSATGMKQLSIALQRPVASD

SEQ ID NO: 6595 - protein, 25 aa, synthetic construct
  source 1..25: note = Seed: LNVIVHSATGFKQSSKALQRPVASD
LNVIVHSATGMKQLSIALRRPVASD

SEQ ID NO: 6596 - protein, 25 aa, synthetic construct
  source 1..25: note = Seed: LNVIVHSATGFKQSSKALQRPVASD
LNVIVHSATGMKQLSIALSRPVASD

SEQ ID NO: 6597 - protein, 25 aa, synthetic construct
  source 1..25: note = Seed: LNVIVHSATGFKQSSKALQRPVASD
LNVIVHSATGMKQLSIALTRPVASD

SEQ ID NO: 6598 - protein, 25 aa, synthetic construct
  source 1..25: note = Seed: LNVIVHSATGFKQSSKALQRPVASD
LNVIVHSATGMKQLSIALVRPVASD

SEQ ID NO: 6599 - protein, 25 aa, synthetic construct
  source 1..25: note = Seed: LNVIVHSATGFKQSSKALQRPVASD
LNVIVHSATGMKQLSKALARPVASD

SEQ ID NO: 6600 - protein, 25 aa, synthetic construct
  source 1..25: note = Seed: LNVIVHSATGFKQSSKALQRPVASD
LNVIVHSATGMKQLSKALGRPVASD

SEQ ID NO: 6601 - protein, 25 aa, synthetic construct
  source 1..25: note = Seed: LNVIVHSATGFKQSSKALQRPVASD
LNVIVHSATGMKQLSKALHRPVASD

SEQ ID NO: 6602 - protein, 25 aa, synthetic construct
  source 1..25: note = Seed: LNVIVHSATGFKQSSKALQRPVASD
LNVIVHSATGMKQLSKALIRPVASD

SEQ ID NO: 6603 - protein, 25 aa, synthetic construct
  source 1..25: note = Seed: LNVIVHSATGFKQSSKALQRPVASD
LNVIVHSATGMKQLSKALKRPVASD

SEQ ID NO: 6604 - protein, 25 aa, synthetic construct
  source 1..25: note = Seed: LNVIVHSATGFKQSSKALQRPVASD
LNVIVHSATGMKQLSKALLRPVASD

SEQ ID NO: 6605 - protein, 25 aa, synthetic construct
  source 1..25: note = Seed: LNVIVHSATGFKQSSKALQRPVASD
LNVIVHSATGMKQLSKALMRPVASD

SEQ ID NO: 6606 - protein, 25 aa, synthetic construct
  source 1..25: note = Seed: LNVIVHSATGFKQSSKALQRPVASD
LNVIVHSATGMKQLSKALNRPVASD

SEQ ID NO: 6607 - protein, 25 aa, synthetic construct
  source 1..25: note = Seed: LNVIVHSATGFKQSSKALQRPVASD
LNVIVHSATGMKQLSKALPRPVASD

SEQ ID NO: 6608 - protein, 25 aa, synthetic construct
  source 1..25: note = Seed: LNVIVHSATGFKQSSKALQRPVASD
LNVIVHSATGMKQLSKALQRPVASD

SEQ ID NO: 6609 - protein, 25 aa, synthetic construct
  source 1..25: note = Seed: LNVIVHSATGFKQSSKALQRPVASD
LNVIVHSATGMKQLSKALRRPVASD

SEQ ID NO: 6610 - protein, 25 aa, synthetic construct
  source 1..25: note = Seed: LNVIVHSATGFKQSSKALQRPVASD
LNVIVHSATGMKQLSKALSRPVASD

SEQ ID NO: 6611 - protein, 25 aa, synthetic construct
  source 1..25: note = Seed: LNVIVHSATGFKQSSKALQRPVASD
LNVIVHSATGMKQLSKALTRPVASD

SEQ ID NO: 6612 - protein, 25 aa, synthetic construct
  source 1..25: note = Seed: LNVIVHSATGFKQSSKALQRPVASD
LNVIVHSATGMKQLSKALVRPVASD

SEQ ID NO: 6613 - protein, 25 aa, synthetic construct
  source 1..25: note = Seed: LNVIVHSATGFKQSSKALQRPVASD
LNVIVHSATGMKQLSKALYRPVASD

SEQ ID NO: 6614 - protein, 25 aa, synthetic construct
  source 1..25: note = Seed: LNVIVHSATGFKQSSKALQRPVASD
LNVIVHSATGMKQLSLALARPVASD

SEQ ID NO: 6615 - protein, 25 aa, synthetic construct
  source 1..25: note = Seed: LNVIVHSATGFKQSSKALQRPVASD
LNVIVHSATGMKQLSLALGRPVASD

SEQ ID NO: 6616 - protein, 25 aa, synthetic construct
  source 1..25: note = Seed: LNVIVHSATGFKQSSKALQRPVASD
LNVIVHSATGMKQLSLALIRPVASD

SEQ ID NO: 6617 - protein, 25 aa, synthetic construct
  source 1..25: note = Seed: LNVIVHSATGFKQSSKALQRPVASD
LNVIVHSATGMKQLSLALLRPVASD

SEQ ID NO: 6618 - protein, 25 aa, synthetic construct
  source 1..25: note = Seed: LNVIVHSATGFKQSSKALQRPVASD
LNVIVHSATGMKQLSLALMRPVASD

SEQ ID NO: 6619 - protein, 25 aa, synthetic construct
  source 1..25: note = Seed: LNVIVHSATGFKQSSKALQRPVASD
LNVIVHSATGMKQLSLALNRPVASD

SEQ ID NO: 6620 - protein, 25 aa, synthetic construct
  source 1..25: note = Seed: LNVIVHSATGFKQSSKALQRPVASD
LNVIVHSATGMKQLSLALQRPVASD

SEQ ID NO: 6621 - protein, 25 aa, synthetic construct
  source 1..25: note = Seed: LNVIVHSATGFKQSSKALQRPVASD
LNVIVHSATGMKQLSLALSRPVASD

SEQ ID NO: 6622 - protein, 25 aa, synthetic construct
  source 1..25: note = Seed: LNVIVHSATGFKQSSKALQRPVASD
LNVIVHSATGMKQLSLALTRPVASD

SEQ ID NO: 6623 - protein, 25 aa, synthetic construct
  source 1..25: note = Seed: LNVIVHSATGFKQSSKALQRPVASD
LNVIVHSATGMKQLSLALVRPVASD

SEQ ID NO: 6624 - protein, 25 aa, synthetic construct
  source 1..25: note = Seed: LNVIVHSATGFKQSSKALQRPVASD
LNVIVHSATGMKQLSMALGRPVASD

SEQ ID NO: 6625 - protein, 25 aa, synthetic construct
  source 1..25: note = Seed: LNVIVHSATGFKQSSKALQRPVASD
LNVIVHSATGMKQLSMALLRPVASD

SEQ ID NO: 6626 - protein, 25 aa, synthetic construct
  source 1..25: note = Seed: LNVIVHSATGFKQSSKALQRPVASD
LNVIVHSATGMKQLSMALMRPVASD

SEQ ID NO: 6627 - protein, 25 aa, synthetic construct
  source 1..25: note = Seed: LNVIVHSATGFKQSSKALQRPVASD
LNVIVHSATGMKQLSMALNRPVASD

SEQ ID NO: 6628 - protein, 25 aa, synthetic construct
  source 1..25: note = Seed: LNVIVHSATGFKQSSKALQRPVASD
LNVIVHSATGMKQLSMALSRPVASD

SEQ ID NO: 6629 - protein, 25 aa, synthetic construct
  source 1..25: note = Seed: LNVIVHSATGFKQSSKALQRPVASD
LNVIVHSATGMKQLSNALARPVASD

SEQ ID NO: 6630 - protein, 25 aa, synthetic construct
  source 1..25: note = Seed: LNVIVHSATGFKQSSKALQRPVASD
LNVIVHSATGMKQLSNALGRPVASD

SEQ ID NO: 6631 - protein, 25 aa, synthetic construct
  source 1..25: note = Seed: LNVIVHSATGFKQSSKALQRPVASD
LNVIVHSATGMKQLSNALIRPVASD

SEQ ID NO: 6632 - protein, 25 aa, synthetic construct
  source 1..25: note = Seed: LNVIVHSATGFKQSSKALQRPVASD
LNVIVHSATGMKQLSNALLRPVASD

SEQ ID NO: 6633 - protein, 25 aa, synthetic construct
  source 1..25: note = Seed: LNVIVHSATGFKQSSKALQRPVASD
LNVIVHSATGMKQLSNALMRPVASD

SEQ ID NO: 6634 - protein, 25 aa, synthetic construct
  source 1..25: note = Seed: LNVIVHSATGFKQSSKALQRPVASD
LNVIVHSATGMKQLSNALNRPVASD

SEQ ID NO: 6635 - protein, 25 aa, synthetic construct
  source 1..25: note = Seed: LNVIVHSATGFKQSSKALQRPVASD
LNVIVHSATGMKQLSNALSRPVASD

SEQ ID NO: 6636 - protein, 25 aa, synthetic construct
  source 1..25: note = Seed: LNVIVHSATGFKQSSKALQRPVASD
LNVIVHSATGMKQLSNALTRPVASD

SEQ ID NO: 6637 - protein, 25 aa, synthetic construct
  source 1..25: note = Seed: LNVIVHSATGFKQSSKALQRPVASD
LNVIVHSATGMKQLSNALVRPVASD

SEQ ID NO: 6638 - protein, 25 aa, synthetic construct
  source 1..25: note = Seed: LNVIVHSATGFKQSSKALQRPVASD
LNVIVHSATGMKQLSPALARPVASD

SEQ ID NO: 6639 - protein, 25 aa, synthetic construct
  source 1..25: note = Seed: LNVIVHSATGFKQSSKALQRPVASD
LNVIVHSATGMKQLSPALCRPVASD

SEQ ID NO: 6640 - protein, 25 aa, synthetic construct
  source 1..25: note = Seed: LNVIVHSATGFKQSSKALQRPVASD
LNVIVHSATGMKQLSPALGRPVASD

SEQ ID NO: 6641 - protein, 25 aa, synthetic construct
  source 1..25: note = Seed: LNVIVHSATGFKQSSKALQRPVASD
LNVIVHSATGMKQLSPALHRPVASD

SEQ ID NO: 6642 - protein, 25 aa, synthetic construct
  source 1..25: note = Seed: LNVIVHSATGFKQSSKALQRPVASD
LNVIVHSATGMKQLSPALIRPVASD

SEQ ID NO: 6643 - protein, 25 aa, synthetic construct
  source 1..25: note = Seed: LNVIVHSATGFKQSSKALQRPVASD
LNVIVHSATGMKQLSPALLRPVASD

SEQ ID NO: 6644 - protein, 25 aa, synthetic construct
  source 1..25: note = Seed: LNVIVHSATGFKQSSKALQRPVASD
LNVIVHSATGMKQLSPALMRPVASD

SEQ ID NO: 6645 - protein, 25 aa, synthetic construct
  source 1..25: note = Seed: LNVIVHSATGFKQSSKALQRPVASD
LNVIVHSATGMKQLSPALNRPVASD

SEQ ID NO: 6646 - protein, 25 aa, synthetic construct
  source 1..25: note = Seed: LNVIVHSATGFKQSSKALQRPVASD
LNVIVHSATGMKQLSPALQRPVASD

SEQ ID NO: 6647 - protein, 25 aa, synthetic construct
  source 1..25: note = Seed: LNVIVHSATGFKQSSKALQRPVASD
LNVIVHSATGMKQLSPALSRPVASD

SEQ ID NO: 6648 - protein, 25 aa, synthetic construct
  source 1..25: note = Seed: LNVIVHSATGFKQSSKALQRPVASD
LNVIVHSATGMKQLSPALTRPVASD

SEQ ID NO: 6649 - protein, 25 aa, synthetic construct
  source 1..25: note = Seed: LNVIVHSATGFKQSSKALQRPVASD
LNVIVHSATGMKQLSPALVRPVASD

SEQ ID NO: 6650 - protein, 25 aa, synthetic construct
  source 1..25: note = Seed: LNVIVHSATGFKQSSKALQRPVASD
LNVIVHSATGMKQLSRALARPVASD

SEQ ID NO: 6651 - protein, 25 aa, synthetic construct
  source 1..25: note = Seed: LNVIVHSATGFKQSSKALQRPVASD
LNVIVHSATGMKQLSRALCRPVASD

SEQ ID NO: 6652 - protein, 25 aa, synthetic construct
  source 1..25: note = Seed: LNVIVHSATGFKQSSKALQRPVASD
LNVIVHSATGMKQLSRALFRPVASD

SEQ ID NO: 6653 - protein, 25 aa, synthetic construct
  source 1..25: note = Seed: LNVIVHSATGFKQSSKALQRPVASD
LNVIVHSATGMKQLSRALGRPVASD

SEQ ID NO: 6654 - protein, 25 aa, synthetic construct
  source 1..25: note = Seed: LNVIVHSATGFKQSSKALQRPVASD
LNVIVHSATGMKQLSRALHRPVASD

SEQ ID NO: 6655 - protein, 25 aa, synthetic construct
  source 1..25: note = Seed: LNVIVHSATGFKQSSKALQRPVASD
LNVIVHSATGMKQLSRALIRPVASD

SEQ ID NO: 6656 - protein, 25 aa, synthetic construct
  source 1..25: note = Seed: LNVIVHSATGFKQSSKALQRPVASD
LNVIVHSATGMKQLSRALKRPVASD

SEQ ID NO: 6657 - protein, 25 aa, synthetic construct
  source 1..25: note = Seed: LNVIVHSATGFKQSSKALQRPVASD
LNVIVHSATGMKQLSRALLRPVASD

SEQ ID NO: 6658 - protein, 25 aa, synthetic construct
  source 1..25: note = Seed: LNVIVHSATGFKQSSKALQRPVASD
LNVIVHSATGMKQLSRALMRPVASD

SEQ ID NO: 6659 - protein, 25 aa, synthetic construct
  source 1..25: note = Seed: LNVIVHSATGFKQSSKALQRPVASD
LNVIVHSATGMKQLSRALNRPVASD

SEQ ID NO: 6660 - protein, 25 aa, synthetic construct
  source 1..25: note = Seed: LNVIVHSATGFKQSSKALQRPVASD
LNVIVHSATGMKQLSRALPRPVASD

SEQ ID NO: 6661 - protein, 25 aa, synthetic construct
  source 1..25: note = Seed: LNVIVHSATGFKQSSKALQRPVASD
LNVIVHSATGMKQLSRALQRPVASD

SEQ ID NO: 6662 - protein, 25 aa, synthetic construct
  source 1..25: note = Seed: LNVIVHSATGFKQSSKALQRPVASD
LNVIVHSATGMKQLSRALRRPVASD

SEQ ID NO: 6663 - protein, 25 aa, synthetic construct
  source 1..25: note = Seed: LNVIVHSATGFKQSSKALQRPVASD
LNVIVHSATGMKQLSRALSRPVASD

SEQ ID NO: 6664 - protein, 25 aa, synthetic construct
  source 1..25: note = Seed: LNVIVHSATGFKQSSKALQRPVASD
LNVIVHSATGMKQLSRALTRPVASD

SEQ ID NO: 6665 - protein, 25 aa, synthetic construct
  source 1..25: note = Seed: LNVIVHSATGFKQSSKALQRPVASD
LNVIVHSATGMKQLSRALVRPVASD

SEQ ID NO: 6666 - protein, 25 aa, synthetic construct
  source 1..25: note = Seed: LNVIVHSATGFKQSSKALQRPVASD
LNVIVHSATGMKQLSRALWRPVASD

SEQ ID NO: 6667 - protein, 25 aa, synthetic construct
  source 1..25: note = Seed: LNVIVHSATGFKQSSKALQRPVASD
LNVIVHSATGMKQLSRALYRPVASD

SEQ ID NO: 6668 - protein, 25 aa, synthetic construct
  source 1..25: note = Seed: LNVIVHSATGFKQSSKALQRPVASD
LNVIVHSATGMKQLSSALARPVASD

SEQ ID NO: 6669 - protein, 25 aa, synthetic construct
  source 1..25: note = Seed: LNVIVHSATGFKQSSKALQRPVASD
LNVIVHSATGMKQLSSALCRPVASD

SEQ ID NO: 6670 - protein, 25 aa, synthetic construct
  source 1..25: note = Seed: LNVIVHSATGFKQSSKALQRPVASD
LNVIVHSATGMKQLSSALGRPVASD

SEQ ID NO: 6671 - protein, 25 aa, synthetic construct
  source 1..25: note = Seed: LNVIVHSATGFKQSSKALQRPVASD
LNVIVHSATGMKQLSSALIRPVASD

SEQ ID NO: 6672 - protein, 25 aa, synthetic construct
  source 1..25: note = Seed: LNVIVHSATGFKQSSKALQRPVASD
LNVIVHSATGMKQLSSALLRPVASD

SEQ ID NO: 6673 - protein, 25 aa, synthetic construct
  source 1..25: note = Seed: LNVIVHSATGFKQSSKALQRPVASD
LNVIVHSATGMKQLSSALMRPVASD

SEQ ID NO: 6674 - protein, 25 aa, synthetic construct
  source 1..25: note = Seed: LNVIVHSATGFKQSSKALQRPVASD
LNVIVHSATGMKQLSSALNRPVASD

SEQ ID NO: 6675 - protein, 25 aa, synthetic construct
  source 1..25: note = Seed: LNVIVHSATGFKQSSKALQRPVASD
LNVIVHSATGMKQLSSALPRPVASD

SEQ ID NO: 6676 - protein, 25 aa, synthetic construct
  source 1..25: note = Seed: LNVIVHSATGFKQSSKALQRPVASD
LNVIVHSATGMKQLSSALSRPVASD

SEQ ID NO: 6677 - protein, 25 aa, synthetic construct
  source 1..25: note = Seed: LNVIVHSATGFKQSSKALQRPVASD
LNVIVHSATGMKQLSSALTRPVASD

SEQ ID NO: 6678 - protein, 25 aa, synthetic construct
  source 1..25: note = Seed: LNVIVHSATGFKQSSKALQRPVASD
LNVIVHSATGMKQLSSALVRPVASD

SEQ ID NO: 6679 - protein, 25 aa, synthetic construct
  source 1..25: note = Seed: LNVIVHSATGFKQSSKALQRPVASD
LNVIVHSATGMKQLSTALARPVASD

SEQ ID NO: 6680 - protein, 25 aa, synthetic construct
  source 1..25: note = Seed: LNVIVHSATGFKQSSKALQRPVASD
LNVIVHSATGMKQLSTALGRPVASD

SEQ ID NO: 6681 - protein, 25 aa, synthetic construct
  source 1..25: note = Seed: LNVIVHSATGFKQSSKALQRPVASD
LNVIVHSATGMKQLSTALIRPVASD

SEQ ID NO: 6682 - protein, 25 aa, synthetic construct
  source 1..25: note = Seed: LNVIVHSATGFKQSSKALQRPVASD
LNVIVHSATGMKQLSTALLRPVASD

SEQ ID NO: 6683 - protein, 25 aa, synthetic construct
  source 1..25: note = Seed: LNVIVHSATGFKQSSKALQRPVASD
LNVIVHSATGMKQLSTALMRPVASD

SEQ ID NO: 6684 - protein, 25 aa, synthetic construct
  source 1..25: note = Seed: LNVIVHSATGFKQSSKALQRPVASD
LNVIVHSATGMKQLSTALNRPVASD

SEQ ID NO: 6685 - protein, 25 aa, synthetic construct
  source 1..25: note = Seed: LNVIVHSATGFKQSSKALQRPVASD
LNVIVHSATGMKQLSTALSRPVASD

SEQ ID NO: 6686 - protein, 25 aa, synthetic construct
  source 1..25: note = Seed: LNVIVHSATGFKQSSKALQRPVASD
LNVIVHSATGMKQLSTALTRPVASD

SEQ ID NO: 6687 - protein, 25 aa, synthetic construct
  source 1..25: note = Seed: LNVIVHSATGFKQSSKALQRPVASD
LNVIVHSATGMKQLSTALVRPVASD

SEQ ID NO: 6688 - protein, 25 aa, synthetic construct
  source 1..25: note = Seed: LNVIVHSATGFKQSSKALQRPVASD
LNVIVHSATGMKQLSVALARPVASD

SEQ ID NO: 6689 - protein, 25 aa, synthetic construct
  source 1..25: note = Seed: LNVIVHSATGFKQSSKALQRPVASD
LNVIVHSATGMKQLSVALGRPVASD

SEQ ID NO: 6690 - protein, 25 aa, synthetic construct
  source 1..25: note = Seed: LNVIVHSATGFKQSSKALQRPVASD
LNVIVHSATGMKQLSVALHRPVASD

SEQ ID NO: 6691 - protein, 25 aa, synthetic construct
  source 1..25: note = Seed: LNVIVHSATGFKQSSKALQRPVASD
LNVIVHSATGMKQLSVALIRPVASD

SEQ ID NO: 6692 - protein, 25 aa, synthetic construct
  source 1..25: note = Seed: LNVIVHSATGFKQSSKALQRPVASD
LNVIVHSATGMKQLSVALLRPVASD

SEQ ID NO: 6693 - protein, 25 aa, synthetic construct
  source 1..25: note = Seed: LNVIVHSATGFKQSSKALQRPVASD
LNVIVHSATGMKQLSVALMRPVASD

SEQ ID NO: 6694 - protein, 25 aa, synthetic construct
  source 1..25: note = Seed: LNVIVHSATGFKQSSKALQRPVASD
LNVIVHSATGMKQLSVALNRPVASD

SEQ ID NO: 6695 - protein, 25 aa, synthetic construct
  source 1..25: note = Seed: LNVIVHSATGFKQSSKALQRPVASD
LNVIVHSATGMKQLSVALPRPVASD

SEQ ID NO: 6696 - protein, 25 aa, synthetic construct
  source 1..25: note = Seed: LNVIVHSATGFKQSSKALQRPVASD
LNVIVHSATGMKQLSVALQRPVASD

SEQ ID NO: 6697 - protein, 25 aa, synthetic construct
  source 1..25: note = Seed: LNVIVHSATGFKQSSKALQRPVASD
LNVIVHSATGMKQLSVALRRPVASD

SEQ ID NO: 6698 - protein, 25 aa, synthetic construct
  source 1..25: note = Seed: LNVIVHSATGFKQSSKALQRPVASD
LNVIVHSATGMKQLSVALSRPVASD

SEQ ID NO: 6699 - protein, 25 aa, synthetic construct
  source 1..25: note = Seed: LNVIVHSATGFKQSSKALQRPVASD
LNVIVHSATGMKQLSVALTRPVASD

SEQ ID NO: 6700 - protein, 25 aa, synthetic construct
  source 1..25: note = Seed: LNVIVHSATGFKQSSKALQRPVASD
LNVIVHSATGMKQLSVALVRPVASD

SEQ ID NO: 6701 - protein, 25 aa, synthetic construct
  source 1..25: note = Seed: LNVIVHSATGFKQSSKALQRPVASD
LNVIVHSATGMKQMSAALARPVASD

SEQ ID NO: 6702 - protein, 25 aa, synthetic construct
  source 1..25: note = Seed: LNVIVHSATGFKQSSKALQRPVASD
LNVIVHSATGMKQMSAALCRPVASD

SEQ ID NO: 6703 - protein, 25 aa, synthetic construct
  source 1..25: note = Seed: LNVIVHSATGFKQSSKALQRPVASD
LNVIVHSATGMKQMSAALDRPVASD

SEQ ID NO: 6704 - protein, 25 aa, synthetic construct
  source 1..25: note = Seed: LNVIVHSATGFKQSSKALQRPVASD
LNVIVHSATGMKQMSAALFRPVASD

SEQ ID NO: 6705 - protein, 25 aa, synthetic construct
  source 1..25: note = Seed: LNVIVHSATGFKQSSKALQRPVASD
LNVIVHSATGMKQMSAALGRPVASD

SEQ ID NO: 6706 - protein, 25 aa, synthetic construct
  source 1..25: note = Seed: LNVIVHSATGFKQSSKALQRPVASD
LNVIVHSATGMKQMSAALHRPVASD

SEQ ID NO: 6707 - protein, 25 aa, synthetic construct
  source 1..25: note = Seed: LNVIVHSATGFKQSSKALQRPVASD
LNVIVHSATGMKQMSAALIRPVASD

SEQ ID NO: 6708 - protein, 25 aa, synthetic construct
  source 1..25: note = Seed: LNVIVHSATGFKQSSKALQRPVASD
LNVIVHSATGMKQMSAALLRPVASD

SEQ ID NO: 6709 - protein, 25 aa, synthetic construct
  source 1..25: note = Seed: LNVIVHSATGFKQSSKALQRPVASD
LNVIVHSATGMKQMSAALMRPVASD

SEQ ID NO: 6710 - protein, 25 aa, synthetic construct
  source 1..25: note = Seed: LNVIVHSATGFKQSSKALQRPVASD
LNVIVHSATGMKQMSAALNRPVASD

SEQ ID NO: 6711 - protein, 25 aa, synthetic construct
  source 1..25: note = Seed: LNVIVHSATGFKQSSKALQRPVASD
LNVIVHSATGMKQMSAALPRPVASD

SEQ ID NO: 6712 - protein, 25 aa, synthetic construct
  source 1..25: note = Seed: LNVIVHSATGFKQSSKALQRPVASD
LNVIVHSATGMKQMSAALQRPVASD

SEQ ID NO: 6713 - protein, 25 aa, synthetic construct
  source 1..25: note = Seed: LNVIVHSATGFKQSSKALQRPVASD
LNVIVHSATGMKQMSAALRRPVASD

SEQ ID NO: 6714 - protein, 25 aa, synthetic construct
  source 1..25: note = Seed: LNVIVHSATGFKQSSKALQRPVASD
LNVIVHSATGMKQMSAALSRPVASD

SEQ ID NO: 6715 - protein, 25 aa, synthetic construct
  source 1..25: note = Seed: LNVIVHSATGFKQSSKALQRPVASD
LNVIVHSATGMKQMSAALTRPVASD

SEQ ID NO: 6716 - protein, 25 aa, synthetic construct
  source 1..25: note = Seed: LNVIVHSATGFKQSSKALQRPVASD
LNVIVHSATGMKQMSAALVRPVASD

SEQ ID NO: 6717 - protein, 25 aa, synthetic construct
  source 1..25: note = Seed: LNVIVHSATGFKQSSKALQRPVASD
LNVIVHSATGMKQMSFALMRPVASD

SEQ ID NO: 6718 - protein, 25 aa, synthetic construct
  source 1..25: note = Seed: LNVIVHSATGFKQSSKALQRPVASD
LNVIVHSATGMKQMSFALVRPVASD

SEQ ID NO: 6719 - protein, 25 aa, synthetic construct
  source 1..25: note = Seed: LNVIVHSATGFKQSSKALQRPVASD
LNVIVHSATGMKQMSGALARPVASD

SEQ ID NO: 6720 - protein, 25 aa, synthetic construct
  source 1..25: note = Seed: LNVIVHSATGFKQSSKALQRPVASD
LNVIVHSATGMKQMSGALCRPVASD

SEQ ID NO: 6721 - protein, 25 aa, synthetic construct
  source 1..25: note = Seed: LNVIVHSATGFKQSSKALQRPVASD
LNVIVHSATGMKQMSGALGRPVASD

SEQ ID NO: 6722 - protein, 25 aa, synthetic construct
  source 1..25: note = Seed: LNVIVHSATGFKQSSKALQRPVASD
LNVIVHSATGMKQMSGALIRPVASD

SEQ ID NO: 6723 - protein, 25 aa, synthetic construct
  source 1..25: note = Seed: LNVIVHSATGFKQSSKALQRPVASD
LNVIVHSATGMKQMSGALLRPVASD

SEQ ID NO: 6724 - protein, 25 aa, synthetic construct
  source 1..25: note = Seed: LNVIVHSATGFKQSSKALQRPVASD
LNVIVHSATGMKQMSGALMRPVASD

SEQ ID NO: 6725 - protein, 25 aa, synthetic construct
  source 1..25: note = Seed: LNVIVHSATGFKQSSKALQRPVASD
LNVIVHSATGMKQMSGALNRPVASD

SEQ ID NO: 6726 - protein, 25 aa, synthetic construct
  source 1..25: note = Seed: LNVIVHSATGFKQSSKALQRPVASD
LNVIVHSATGMKQMSGALSRPVASD

SEQ ID NO: 6727 - protein, 25 aa, synthetic construct
  source 1..25: note = Seed: LNVIVHSATGFKQSSKALQRPVASD
LNVIVHSATGMKQMSGALTRPVASD

SEQ ID NO: 6728 - protein, 25 aa, synthetic construct
  source 1..25: note = Seed: LNVIVHSATGFKQSSKALQRPVASD
LNVIVHSATGMKQMSGALVRPVASD

SEQ ID NO: 6729 - protein, 25 aa, synthetic construct
  source 1..25: note = Seed: LNVIVHSATGFKQSSKALQRPVASD
LNVIVHSATGMKQMSHALARPVASD

SEQ ID NO: 6730 - protein, 25 aa, synthetic construct
  source 1..25: note = Seed: LNVIVHSATGFKQSSKALQRPVASD
LNVIVHSATGMKQMSHALKRPVASD

SEQ ID NO: 6731 - protein, 25 aa, synthetic construct
  source 1..25: note = Seed: LNVIVHSATGFKQSSKALQRPVASD
LNVIVHSATGMKQMSHALRRPVASD

SEQ ID NO: 6732 - protein, 25 aa, synthetic construct
  source 1..25: note = Seed: LNVIVHSATGFKQSSKALQRPVASD
LNVIVHSATGMKQMSHALSRPVASD

SEQ ID NO: 6733 - protein, 25 aa, synthetic construct
  source 1..25: note = Seed: LNVIVHSATGFKQSSKALQRPVASD
LNVIVHSATGMKQMSHALVRPVASD

SEQ ID NO: 6734 - protein, 25 aa, synthetic construct
  source 1..25: note = Seed: LNVIVHSATGFKQSSKALQRPVASD
LNVIVHSATGMKQMSIALARPVASD

SEQ ID NO: 6735 - protein, 25 aa, synthetic construct
  source 1..25: note = Seed: LNVIVHSATGFKQSSKALQRPVASD
LNVIVHSATGMKQMSIALERPVASD

SEQ ID NO: 6736 - protein, 25 aa, synthetic construct
  source 1..25: note = Seed: LNVIVHSATGFKQSSKALQRPVASD
LNVIVHSATGMKQMSIALGRPVASD

SEQ ID NO: 6737 - protein, 25 aa, synthetic construct
  source 1..25: note = Seed: LNVIVHSATGFKQSSKALQRPVASD
LNVIVHSATGMKQMSIALHRPVASD

SEQ ID NO: 6738 - protein, 25 aa, synthetic construct
  source 1..25: note = Seed: LNVIVHSATGFKQSSKALQRPVASD
LNVIVHSATGMKQMSIALIRPVASD

SEQ ID NO: 6739 - protein, 25 aa, synthetic construct
  source 1..25: note = Seed: LNVIVHSATGFKQSSKALQRPVASD
LNVIVHSATGMKQMSIALLRPVASD

SEQ ID NO: 6740 - protein, 25 aa, synthetic construct
  source 1..25: note = Seed: LNVIVHSATGFKQSSKALQRPVASD
LNVIVHSATGMKQMSIALMRPVASD

SEQ ID NO: 6741 - protein, 25 aa, synthetic construct
  source 1..25: note = Seed: LNVIVHSATGFKQSSKALQRPVASD
LNVIVHSATGMKQMSIALNRPVASD

SEQ ID NO: 6742 - protein, 25 aa, synthetic construct
  source 1..25: note = Seed: LNVIVHSATGFKQSSKALQRPVASD
LNVIVHSATGMKQMSIALPRPVASD

SEQ ID NO: 6743 - protein, 25 aa, synthetic construct
  source 1..25: note = Seed: LNVIVHSATGFKQSSKALQRPVASD
LNVIVHSATGMKQMSIALQRPVASD

SEQ ID NO: 6744 - protein, 25 aa, synthetic construct
  source 1..25: note = Seed: LNVIVHSATGFKQSSKALQRPVASD
LNVIVHSATGMKQMSIALRRPVASD

SEQ ID NO: 6745 - protein, 25 aa, synthetic construct
  source 1..25: note = Seed: LNVIVHSATGFKQSSKALQRPVASD
LNVIVHSATGMKQMSIALSRPVASD

SEQ ID NO: 6746 - protein, 25 aa, synthetic construct
  source 1..25: note = Seed: LNVIVHSATGFKQSSKALQRPVASD
LNVIVHSATGMKQMSIALTRPVASD

SEQ ID NO: 6747 - protein, 25 aa, synthetic construct
  source 1..25: note = Seed: LNVIVHSATGFKQSSKALQRPVASD
LNVIVHSATGMKQMSIALVRPVASD

SEQ ID NO: 6748 - protein, 25 aa, synthetic construct
  source 1..25: note = Seed: LNVIVHSATGFKQSSKALQRPVASD
LNVIVHSATGMKQMSKALARPVASD

SEQ ID NO: 6749 - protein, 25 aa, synthetic construct
  source 1..25: note = Seed: LNVIVHSATGFKQSSKALQRPVASD
LNVIVHSATGMKQMSKALCRPVASD

SEQ ID NO: 6750 - protein, 25 aa, synthetic construct
  source 1..25: note = Seed: LNVIVHSATGFKQSSKALQRPVASD
LNVIVHSATGMKQMSKALFRPVASD

SEQ ID NO: 6751 - protein, 25 aa, synthetic construct
  source 1..25: note = Seed: LNVIVHSATGFKQSSKALQRPVASD
LNVIVHSATGMKQMSKALGRPVASD

SEQ ID NO: 6752 - protein, 25 aa, synthetic construct
  source 1..25: note = Seed: LNVIVHSATGFKQSSKALQRPVASD
LNVIVHSATGMKQMSKALHRPVASD

SEQ ID NO: 6753 - protein, 25 aa, synthetic construct
  source 1..25: note = Seed: LNVIVHSATGFKQSSKALQRPVASD
LNVIVHSATGMKQMSKALIRPVASD

SEQ ID NO: 6754 - protein, 25 aa, synthetic construct
  source 1..25: note = Seed: LNVIVHSATGFKQSSKALQRPVASD
LNVIVHSATGMKQMSKALKRPVASD

SEQ ID NO: 6755 - protein, 25 aa, synthetic construct
  source 1..25: note = Seed: LNVIVHSATGFKQSSKALQRPVASD
LNVIVHSATGMKQMSKALLRPVASD

SEQ ID NO: 6756 - protein, 25 aa, synthetic construct
  source 1..25: note = Seed: LNVIVHSATGFKQSSKALQRPVASD
LNVIVHSATGMKQMSKALMRPVASD

SEQ ID NO: 6757 - protein, 25 aa, synthetic construct
  source 1..25: note = Seed: LNVIVHSATGFKQSSKALQRPVASD
LNVIVHSATGMKQMSKALNRPVASD

SEQ ID NO: 6758 - protein, 25 aa, synthetic construct
  source 1..25: note = Seed: LNVIVHSATGFKQSSKALQRPVASD
LNVIVHSATGMKQMSKALPRPVASD

SEQ ID NO: 6759 - protein, 25 aa, synthetic construct
  source 1..25: note = Seed: LNVIVHSATGFKQSSKALQRPVASD
LNVIVHSATGMKQMSKALQRPVASD

SEQ ID NO: 6760 - protein, 25 aa, synthetic construct
  source 1..25: note = Seed: LNVIVHSATGFKQSSKALQRPVASD
LNVIVHSATGMKQMSKALRRPVASD

SEQ ID NO: 6761 - protein, 25 aa, synthetic construct
  source 1..25: note = Seed: LNVIVHSATGFKQSSKALQRPVASD
LNVIVHSATGMKQMSKALSRPVASD

SEQ ID NO: 6762 - protein, 25 aa, synthetic construct
  source 1..25: note = Seed: LNVIVHSATGFKQSSKALQRPVASD
LNVIVHSATGMKQMSKALTRPVASD

SEQ ID NO: 6763 - protein, 25 aa, synthetic construct
  source 1..25: note = Seed: LNVIVHSATGFKQSSKALQRPVASD
LNVIVHSATGMKQMSKALVRPVASD

SEQ ID NO: 6764 - protein, 25 aa, synthetic construct
  source 1..25: note = Seed: LNVIVHSATGFKQSSKALQRPVASD
LNVIVHSATGMKQMSKALWRPVASD

SEQ ID NO: 6765 - protein, 25 aa, synthetic construct
  source 1..25: note = Seed: LNVIVHSATGFKQSSKALQRPVASD
LNVIVHSATGMKQMSKALYRPVASD

SEQ ID NO: 6766 - protein, 25 aa, synthetic construct
  source 1..25: note = Seed: LNVIVHSATGFKQSSKALQRPVASD
LNVIVHSATGMKQMSLALARPVASD

SEQ ID NO: 6767 - protein, 25 aa, synthetic construct
  source 1..25: note = Seed: LNVIVHSATGFKQSSKALQRPVASD
LNVIVHSATGMKQMSLALGRPVASD

SEQ ID NO: 6768 - protein, 25 aa, synthetic construct
  source 1..25: note = Seed: LNVIVHSATGFKQSSKALQRPVASD
LNVIVHSATGMKQMSLALHRPVASD

SEQ ID NO: 6769 - protein, 25 aa, synthetic construct
  source 1..25: note = Seed: LNVIVHSATGFKQSSKALQRPVASD
LNVIVHSATGMKQMSLALIRPVASD

SEQ ID NO: 6770 - protein, 25 aa, synthetic construct
  source 1..25: note = Seed: LNVIVHSATGFKQSSKALQRPVASD
LNVIVHSATGMKQMSLALMRPVASD

SEQ ID NO: 6771 - protein, 25 aa, synthetic construct
  source 1..25: note = Seed: LNVIVHSATGFKQSSKALQRPVASD
LNVIVHSATGMKQMSLALNRPVASD

SEQ ID NO: 6772 - protein, 25 aa, synthetic construct
  source 1..25: note = Seed: LNVIVHSATGFKQSSKALQRPVASD
LNVIVHSATGMKQMSLALQRPVASD

SEQ ID NO: 6773 - protein, 25 aa, synthetic construct
  source 1..25: note = Seed: LNVIVHSATGFKQSSKALQRPVASD
LNVIVHSATGMKQMSLALSRPVASD

SEQ ID NO: 6774 - protein, 25 aa, synthetic construct
  source 1..25: note = Seed: LNVIVHSATGFKQSSKALQRPVASD
LNVIVHSATGMKQMSLALTRPVASD

SEQ ID NO: 6775 - protein, 25 aa, synthetic construct
  source 1..25: note = Seed: LNVIVHSATGFKQSSKALQRPVASD
LNVIVHSATGMKQMSLALVRPVASD

SEQ ID NO: 6776 - protein, 25 aa, synthetic construct
  source 1..25: note = Seed: LNVIVHSATGFKQSSKALQRPVASD
LNVIVHSATGMKQMSMALARPVASD

SEQ ID NO: 6777 - protein, 25 aa, synthetic construct
  source 1..25: note = Seed: LNVIVHSATGFKQSSKALQRPVASD
LNVIVHSATGMKQMSMALGRPVASD

SEQ ID NO: 6778 - protein, 25 aa, synthetic construct
  source 1..25: note = Seed: LNVIVHSATGFKQSSKALQRPVASD
LNVIVHSATGMKQMSMALIRPVASD

SEQ ID NO: 6779 - protein, 25 aa, synthetic construct
  source 1..25: note = Seed: LNVIVHSATGFKQSSKALQRPVASD
LNVIVHSATGMKQMSMALLRPVASD

SEQ ID NO: 6780 - protein, 25 aa, synthetic construct
  source 1..25: note = Seed: LNVIVHSATGFKQSSKALQRPVASD
LNVIVHSATGMKQMSMALMRPVASD

SEQ ID NO: 6781 - protein, 25 aa, synthetic construct
  source 1..25: note = Seed: LNVIVHSATGFKQSSKALQRPVASD
LNVIVHSATGMKQMSMALNRPVASD

SEQ ID NO: 6782 - protein, 25 aa, synthetic construct
  source 1..25: note = Seed: LNVIVHSATGFKQSSKALQRPVASD
LNVIVHSATGMKQMSMALSRPVASD

SEQ ID NO: 6783 - protein, 25 aa, synthetic construct
  source 1..25: note = Seed: LNVIVHSATGFKQSSKALQRPVASD
LNVIVHSATGMKQMSNALARPVASD

SEQ ID NO: 6784 - protein, 25 aa, synthetic construct
  source 1..25: note = Seed: LNVIVHSATGFKQSSKALQRPVASD
LNVIVHSATGMKQMSNALIRPVASD

SEQ ID NO: 6785 - protein, 25 aa, synthetic construct
  source 1..25: note = Seed: LNVIVHSATGFKQSSKALQRPVASD
LNVIVHSATGMKQMSNALLRPVASD

SEQ ID NO: 6786 - protein, 25 aa, synthetic construct
  source 1..25: note = Seed: LNVIVHSATGFKQSSKALQRPVASD
LNVIVHSATGMKQMSNALMRPVASD

SEQ ID NO: 6787 - protein, 25 aa, synthetic construct
  source 1..25: note = Seed: LNVIVHSATGFKQSSKALQRPVASD
LNVIVHSATGMKQMSNALNRPVASD

SEQ ID NO: 6788 - protein, 25 aa, synthetic construct
  source 1..25: note = Seed: LNVIVHSATGFKQSSKALQRPVASD
LNVIVHSATGMKQMSNALSRPVASD

SEQ ID NO: 6789 - protein, 25 aa, synthetic construct
  source 1..25: note = Seed: LNVIVHSATGFKQSSKALQRPVASD
LNVIVHSATGMKQMSNALTRPVASD

SEQ ID NO: 6790 - protein, 25 aa, synthetic construct
  source 1..25: note = Seed: LNVIVHSATGFKQSSKALQRPVASD
LNVIVHSATGMKQMSNALVRPVASD

SEQ ID NO: 6791 - protein, 25 aa, synthetic construct
  source 1..25: note = Seed: LNVIVHSATGFKQSSKALQRPVASD
LNVIVHSATGMKQMSPALARPVASD

SEQ ID NO: 6792 - protein, 25 aa, synthetic construct
  source 1..25: note = Seed: LNVIVHSATGFKQSSKALQRPVASD
LNVIVHSATGMKQMSPALGRPVASD

SEQ ID NO: 6793 - protein, 25 aa, synthetic construct
  source 1..25: note = Seed: LNVIVHSATGFKQSSKALQRPVASD
LNVIVHSATGMKQMSPALHRPVASD

SEQ ID NO: 6794 - protein, 25 aa, synthetic construct
  source 1..25: note = Seed: LNVIVHSATGFKQSSKALQRPVASD
LNVIVHSATGMKQMSPALIRPVASD

SEQ ID NO: 6795 - protein, 25 aa, synthetic construct
  source 1..25: note = Seed: LNVIVHSATGFKQSSKALQRPVASD
LNVIVHSATGMKQMSPALLRPVASD

SEQ ID NO: 6796 - protein, 25 aa, synthetic construct
  source 1..25: note = Seed: LNVIVHSATGFKQSSKALQRPVASD
LNVIVHSATGMKQMSPALMRPVASD

SEQ ID NO: 6797 - protein, 25 aa, synthetic construct
  source 1..25: note = Seed: LNVIVHSATGFKQSSKALQRPVASD
LNVIVHSATGMKQMSPALNRPVASD

SEQ ID NO: 6798 - protein, 25 aa, synthetic construct
  source 1..25: note = Seed: LNVIVHSATGFKQSSKALQRPVASD
LNVIVHSATGMKQMSPALQRPVASD

SEQ ID NO: 6799 - protein, 25 aa, synthetic construct
  source 1..25: note = Seed: LNVIVHSATGFKQSSKALQRPVASD
LNVIVHSATGMKQMSPALSRPVASD

SEQ ID NO: 6800 - protein, 25 aa, synthetic construct
  source 1..25: note = Seed: LNVIVHSATGFKQSSKALQRPVASD
LNVIVHSATGMKQMSPALTRPVASD

SEQ ID NO: 6801 - protein, 25 aa, synthetic construct
  source 1..25: note = Seed: LNVIVHSATGFKQSSKALQRPVASD
LNVIVHSATGMKQMSPALVRPVASD

SEQ ID NO: 6802 - protein, 25 aa, synthetic construct
  source 1..25: note = Seed: LNVIVHSATGFKQSSKALQRPVASD
LNVIVHSATGMKQMSRALARPVASD

SEQ ID NO: 6803 - protein, 25 aa, synthetic construct
  source 1..25: note = Seed: LNVIVHSATGFKQSSKALQRPVASD
LNVIVHSATGMKQMSRALCRPVASD

SEQ ID NO: 6804 - protein, 25 aa, synthetic construct
  source 1..25: note = Seed: LNVIVHSATGFKQSSKALQRPVASD
LNVIVHSATGMKQMSRALERPVASD

SEQ ID NO: 6805 - protein, 25 aa, synthetic construct
  source 1..25: note = Seed: LNVIVHSATGFKQSSKALQRPVASD
LNVIVHSATGMKQMSRALFRPVASD

SEQ ID NO: 6806 - protein, 25 aa, synthetic construct
  source 1..25: note = Seed: LNVIVHSATGFKQSSKALQRPVASD
LNVIVHSATGMKQMSRALGRPVASD

SEQ ID NO: 6807 - protein, 25 aa, synthetic construct
  source 1..25: note = Seed: LNVIVHSATGFKQSSKALQRPVASD
LNVIVHSATGMKQMSRALHRPVASD

SEQ ID NO: 6808 - protein, 25 aa, synthetic construct
  source 1..25: note = Seed: LNVIVHSATGFKQSSKALQRPVASD
LNVIVHSATGMKQMSRALIRPVASD

SEQ ID NO: 6809 - protein, 25 aa, synthetic construct
  source 1..25: note = Seed: LNVIVHSATGFKQSSKALQRPVASD
LNVIVHSATGMKQMSRALKRPVASD

SEQ ID NO: 6810 - protein, 25 aa, synthetic construct
  source 1..25: note = Seed: LNVIVHSATGFKQSSKALQRPVASD
LNVIVHSATGMKQMSRALLRPVASD

SEQ ID NO: 6811 - protein, 25 aa, synthetic construct
  source 1..25: note = Seed: LNVIVHSATGFKQSSKALQRPVASD
LNVIVHSATGMKQMSRALMRPVASD

SEQ ID NO: 6812 - protein, 25 aa, synthetic construct
  source 1..25: note = Seed: LNVIVHSATGFKQSSKALQRPVASD
LNVIVHSATGMKQMSRALNRPVASD

SEQ ID NO: 6813 - protein, 25 aa, synthetic construct
  source 1..25: note = Seed: LNVIVHSATGFKQSSKALQRPVASD
LNVIVHSATGMKQMSRALPRPVASD

SEQ ID NO: 6814 - protein, 25 aa, synthetic construct
  source 1..25: note = Seed: LNVIVHSATGFKQSSKALQRPVASD
LNVIVHSATGMKQMSRALQRPVASD

SEQ ID NO: 6815 - protein, 25 aa, synthetic construct
  source 1..25: note = Seed: LNVIVHSATGFKQSSKALQRPVASD
LNVIVHSATGMKQMSRALRRPVASD

SEQ ID NO: 6816 - protein, 25 aa, synthetic construct
  source 1..25: note = Seed: LNVIVHSATGFKQSSKALQRPVASD
LNVIVHSATGMKQMSRALSRPVASD

SEQ ID NO: 6817 - protein, 25 aa, synthetic construct
  source 1..25: note = Seed: LNVIVHSATGFKQSSKALQRPVASD
LNVIVHSATGMKQMSRALTRPVASD

SEQ ID NO: 6818 - protein, 25 aa, synthetic construct
  source 1..25: note = Seed: LNVIVHSATGFKQSSKALQRPVASD
LNVIVHSATGMKQMSRALVRPVASD

SEQ ID NO: 6819 - protein, 25 aa, synthetic construct
  source 1..25: note = Seed: LNVIVHSATGFKQSSKALQRPVASD
LNVIVHSATGMKQMSRALWRPVASD

SEQ ID NO: 6820 - protein, 25 aa, synthetic construct
  source 1..25: note = Seed: LNVIVHSATGFKQSSKALQRPVASD
LNVIVHSATGMKQMSRALYRPVASD

SEQ ID NO: 6821 - protein, 25 aa, synthetic construct
  source 1..25: note = Seed: LNVIVHSATGFKQSSKALQRPVASD
LNVIVHSATGMKQMSSALARPVASD

SEQ ID NO: 6822 - protein, 25 aa, synthetic construct
  source 1..25: note = Seed: LNVIVHSATGFKQSSKALQRPVASD
LNVIVHSATGMKQMSSALCRPVASD

SEQ ID NO: 6823 - protein, 25 aa, synthetic construct
  source 1..25: note = Seed: LNVIVHSATGFKQSSKALQRPVASD
LNVIVHSATGMKQMSSALGRPVASD

SEQ ID NO: 6824 - protein, 25 aa, synthetic construct
  source 1..25: note = Seed: LNVIVHSATGFKQSSKALQRPVASD
LNVIVHSATGMKQMSSALHRPVASD

SEQ ID NO: 6825 - protein, 25 aa, synthetic construct
  source 1..25: note = Seed: LNVIVHSATGFKQSSKALQRPVASD
LNVIVHSATGMKQMSSALIRPVASD

SEQ ID NO: 6826 - protein, 25 aa, synthetic construct
  source 1..25: note = Seed: LNVIVHSATGFKQSSKALQRPVASD
LNVIVHSATGMKQMSSALLRPVASD

SEQ ID NO: 6827 - protein, 25 aa, synthetic construct
  source 1..25: note = Seed: LNVIVHSATGFKQSSKALQRPVASD
LNVIVHSATGMKQMSSALMRPVASD

SEQ ID NO: 6828 - protein, 25 aa, synthetic construct
  source 1..25: note = Seed: LNVIVHSATGFKQSSKALQRPVASD
LNVIVHSATGMKQMSSALNRPVASD

SEQ ID NO: 6829 - protein, 25 aa, synthetic construct
  source 1..25: note = Seed: LNVIVHSATGFKQSSKALQRPVASD
LNVIVHSATGMKQMSSALRRPVASD

SEQ ID NO: 6830 - protein, 25 aa, synthetic construct
  source 1..25: note = Seed: LNVIVHSATGFKQSSKALQRPVASD
LNVIVHSATGMKQMSSALSRPVASD

SEQ ID NO: 6831 - protein, 25 aa, synthetic construct
  source 1..25: note = Seed: LNVIVHSATGFKQSSKALQRPVASD
LNVIVHSATGMKQMSSALTRPVASD

SEQ ID NO: 6832 - protein, 25 aa, synthetic construct
  source 1..25: note = Seed: LNVIVHSATGFKQSSKALQRPVASD
LNVIVHSATGMKQMSSALVRPVASD

SEQ ID NO: 6833 - protein, 25 aa, synthetic construct
  source 1..25: note = Seed: LNVIVHSATGFKQSSKALQRPVASD
LNVIVHSATGMKQMSTALARPVASD

SEQ ID NO: 6834 - protein, 25 aa, synthetic construct
  source 1..25: note = Seed: LNVIVHSATGFKQSSKALQRPVASD
LNVIVHSATGMKQMSTALGRPVASD

SEQ ID NO: 6835 - protein, 25 aa, synthetic construct
  source 1..25: note = Seed: LNVIVHSATGFKQSSKALQRPVASD
LNVIVHSATGMKQMSTALHRPVASD

SEQ ID NO: 6836 - protein, 25 aa, synthetic construct
  source 1..25: note = Seed: LNVIVHSATGFKQSSKALQRPVASD
LNVIVHSATGMKQMSTALIRPVASD

SEQ ID NO: 6837 - protein, 25 aa, synthetic construct
  source 1..25: note = Seed: LNVIVHSATGFKQSSKALQRPVASD
LNVIVHSATGMKQMSTALKRPVASD

SEQ ID NO: 6838 - protein, 25 aa, synthetic construct
  source 1..25: note = Seed: LNVIVHSATGFKQSSKALQRPVASD
LNVIVHSATGMKQMSTALLRPVASD

SEQ ID NO: 6839 - protein, 25 aa, synthetic construct
  source 1..25: note = Seed: LNVIVHSATGFKQSSKALQRPVASD
LNVIVHSATGMKQMSTALMRPVASD

SEQ ID NO: 6840 - protein, 25 aa, synthetic construct
  source 1..25: note = Seed: LNVIVHSATGFKQSSKALQRPVASD
LNVIVHSATGMKQMSTALNRPVASD

SEQ ID NO: 6841 - protein, 25 aa, synthetic construct
  source 1..25: note = Seed: LNVIVHSATGFKQSSKALQRPVASD
LNVIVHSATGMKQMSTALQRPVASD

SEQ ID NO: 6842 - protein, 25 aa, synthetic construct
  source 1..25: note = Seed: LNVIVHSATGFKQSSKALQRPVASD
LNVIVHSATGMKQMSTALRRPVASD

SEQ ID NO: 6843 - protein, 25 aa, synthetic construct
  source 1..25: note = Seed: LNVIVHSATGFKQSSKALQRPVASD
LNVIVHSATGMKQMSTALSRPVASD

SEQ ID NO: 6844 - protein, 25 aa, synthetic construct
  source 1..25: note = Seed: LNVIVHSATGFKQSSKALQRPVASD
LNVIVHSATGMKQMSTALTRPVASD

SEQ ID NO: 6845 - protein, 25 aa, synthetic construct
  source 1..25: note = Seed: LNVIVHSATGFKQSSKALQRPVASD
LNVIVHSATGMKQMSTALVRPVASD

SEQ ID NO: 6846 - protein, 25 aa, synthetic construct
  source 1..25: note = Seed: LNVIVHSATGFKQSSKALQRPVASD
LNVIVHSATGMKQMSVALARPVASD

SEQ ID NO: 6847 - protein, 25 aa, synthetic construct
  source 1..25: note = Seed: LNVIVHSATGFKQSSKALQRPVASD
LNVIVHSATGMKQMSVALGRPVASD

SEQ ID NO: 6848 - protein, 25 aa, synthetic construct
  source 1..25: note = Seed: LNVIVHSATGFKQSSKALQRPVASD
LNVIVHSATGMKQMSVALHRPVASD

SEQ ID NO: 6849 - protein, 25 aa, synthetic construct
  source 1..25: note = Seed: LNVIVHSATGFKQSSKALQRPVASD
LNVIVHSATGMKQMSVALIRPVASD

SEQ ID NO: 6850 - protein, 25 aa, synthetic construct
  source 1..25: note = Seed: LNVIVHSATGFKQSSKALQRPVASD
LNVIVHSATGMKQMSVALLRPVASD

SEQ ID NO: 6851 - protein, 25 aa, synthetic construct
  source 1..25: note = Seed: LNVIVHSATGFKQSSKALQRPVASD
LNVIVHSATGMKQMSVALMRPVASD

SEQ ID NO: 6852 - protein, 25 aa, synthetic construct
  source 1..25: note = Seed: LNVIVHSATGFKQSSKALQRPVASD
LNVIVHSATGMKQMSVALNRPVASD

SEQ ID NO: 6853 - protein, 25 aa, synthetic construct
  source 1..25: note = Seed: LNVIVHSATGFKQSSKALQRPVASD
LNVIVHSATGMKQMSVALPRPVASD

SEQ ID NO: 6854 - protein, 25 aa, synthetic construct
  source 1..25: note = Seed: LNVIVHSATGFKQSSKALQRPVASD
LNVIVHSATGMKQMSVALQRPVASD

SEQ ID NO: 6855 - protein, 25 aa, synthetic construct
  source 1..25: note = Seed: LNVIVHSATGFKQSSKALQRPVASD
LNVIVHSATGMKQMSVALRRPVASD

SEQ ID NO: 6856 - protein, 25 aa, synthetic construct
  source 1..25: note = Seed: LNVIVHSATGFKQSSKALQRPVASD
LNVIVHSATGMKQMSVALSRPVASD

SEQ ID NO: 6857 - protein, 25 aa, synthetic construct
  source 1..25: note = Seed: LNVIVHSATGFKQSSKALQRPVASD
LNVIVHSATGMKQMSVALTRPVASD

SEQ ID NO: 6858 - protein, 25 aa, synthetic construct
  source 1..25: note = Seed: LNVIVHSATGFKQSSKALQRPVASD
LNVIVHSATGMKQMSVALVRPVASD

SEQ ID NO: 6859 - protein, 25 aa, synthetic construct
  source 1..25: note = Seed: LNVIVHSATGFKQSSKALQRPVASD
LNVIVHSATGMKQNSAALARPVASD

SEQ ID NO: 6860 - protein, 25 aa, synthetic construct
  source 1..25: note = Seed: LNVIVHSATGFKQSSKALQRPVASD
LNVIVHSATGMKQNSAALFRPVASD

SEQ ID NO: 6861 - protein, 25 aa, synthetic construct
  source 1..25: note = Seed: LNVIVHSATGFKQSSKALQRPVASD
LNVIVHSATGMKQNSAALIRPVASD

SEQ ID NO: 6862 - protein, 25 aa, synthetic construct
  source 1..25: note = Seed: LNVIVHSATGFKQSSKALQRPVASD
LNVIVHSATGMKQNSAALLRPVASD

SEQ ID NO: 6863 - protein, 25 aa, synthetic construct
  source 1..25: note = Seed: LNVIVHSATGFKQSSKALQRPVASD
LNVIVHSATGMKQNSAALMRPVASD

SEQ ID NO: 6864 - protein, 25 aa, synthetic construct
  source 1..25: note = Seed: LNVIVHSATGFKQSSKALQRPVASD
LNVIVHSATGMKQNSAALVRPVASD

SEQ ID NO: 6865 - protein, 25 aa, synthetic construct
  source 1..25: note = Seed: LNVIVHSATGFKQSSKALQRPVASD
LNVIVHSATGMKQNSAALYRPVASD

SEQ ID NO: 6866 - protein, 25 aa, synthetic construct
  source 1..25: note = Seed: LNVIVHSATGFKQSSKALQRPVASD
LNVIVHSATGMKQNSGALFRPVASD

SEQ ID NO: 6867 - protein, 25 aa, synthetic construct
  source 1..25: note = Seed: LNVIVHSATGFKQSSKALQRPVASD
LNVIVHSATGMKQNSGALIRPVASD

SEQ ID NO: 6868 - protein, 25 aa, synthetic construct
  source 1..25: note = Seed: LNVIVHSATGFKQSSKALQRPVASD
LNVIVHSATGMKQNSGALLRPVASD

SEQ ID NO: 6869 - protein, 25 aa, synthetic construct
  source 1..25: note = Seed: LNVIVHSATGFKQSSKALQRPVASD
LNVIVHSATGMKQNSGALVRPVASD

SEQ ID NO: 6870 - protein, 25 aa, synthetic construct
  source 1..25: note = Seed: LNVIVHSATGFKQSSKALQRPVASD
LNVIVHSATGMKQNSGALYRPVASD

SEQ ID NO: 6871 - protein, 25 aa, synthetic construct
  source 1..25: note = Seed: LNVIVHSATGFKQSSKALQRPVASD
LNVIVHSATGMKQNSIALFRPVASD

SEQ ID NO: 6872 - protein, 25 aa, synthetic construct
  source 1..25: note = Seed: LNVIVHSATGFKQSSKALQRPVASD
LNVIVHSATGMKQNSIALIRPVASD

SEQ ID NO: 6873 - protein, 25 aa, synthetic construct
  source 1..25: note = Seed: LNVIVHSATGFKQSSKALQRPVASD
LNVIVHSATGMKQNSIALLRPVASD

SEQ ID NO: 6874 - protein, 25 aa, synthetic construct
  source 1..25: note = Seed: LNVIVHSATGFKQSSKALQRPVASD
LNVIVHSATGMKQNSIALMRPVASD

SEQ ID NO: 6875 - protein, 25 aa, synthetic construct
  source 1..25: note = Seed: LNVIVHSATGFKQSSKALQRPVASD
LNVIVHSATGMKQNSIALVRPVASD

SEQ ID NO: 6876 - protein, 25 aa, synthetic construct
  source 1..25: note = Seed: LNVIVHSATGFKQSSKALQRPVASD
LNVIVHSATGMKQNSIALYRPVASD

SEQ ID NO: 6877 - protein, 25 aa, synthetic construct
  source 1..25: note = Seed: LNVIVHSATGFKQSSKALQRPVASD
LNVIVHSATGMKQNSLALIRPVASD

SEQ ID NO: 6878 - protein, 25 aa, synthetic construct
  source 1..25: note = Seed: LNVIVHSATGFKQSSKALQRPVASD
LNVIVHSATGMKQNSLALVRPVASD

SEQ ID NO: 6879 - protein, 25 aa, synthetic construct
  source 1..25: note = Seed: LNVIVHSATGFKQSSKALQRPVASD
LNVIVHSATGMKQNSMALIRPVASD

SEQ ID NO: 6880 - protein, 25 aa, synthetic construct
  source 1..25: note = Seed: LNVIVHSATGFKQSSKALQRPVASD
LNVIVHSATGMKQNSMALVRPVASD

SEQ ID NO: 6881 - protein, 25 aa, synthetic construct
  source 1..25: note = Seed: LNVIVHSATGFKQSSKALQRPVASD
LNVIVHSATGMKQNSNALFRPVASD

SEQ ID NO: 6882 - protein, 25 aa, synthetic construct
  source 1..25: note = Seed: LNVIVHSATGFKQSSKALQRPVASD
LNVIVHSATGMKQNSNALIRPVASD

SEQ ID NO: 6883 - protein, 25 aa, synthetic construct
  source 1..25: note = Seed: LNVIVHSATGFKQSSKALQRPVASD
LNVIVHSATGMKQNSNALLRPVASD

SEQ ID NO: 6884 - protein, 25 aa, synthetic construct
  source 1..25: note = Seed: LNVIVHSATGFKQSSKALQRPVASD
LNVIVHSATGMKQNSNALMRPVASD

SEQ ID NO: 6885 - protein, 25 aa, synthetic construct
  source 1..25: note = Seed: LNVIVHSATGFKQSSKALQRPVASD
LNVIVHSATGMKQNSNALVRPVASD

SEQ ID NO: 6886 - protein, 25 aa, synthetic construct
  source 1..25: note = Seed: LNVIVHSATGFKQSSKALQRPVASD
LNVIVHSATGMKQNSNALYRPVASD

SEQ ID NO: 6887 - protein, 25 aa, synthetic construct
  source 1..25: note = Seed: LNVIVHSATGFKQSSKALQRPVASD
LNVIVHSATGMKQNSPALFRPVASD

SEQ ID NO: 6888 - protein, 25 aa, synthetic construct
  source 1..25: note = Seed: LNVIVHSATGFKQSSKALQRPVASD
LNVIVHSATGMKQNSPALIRPVASD

SEQ ID NO: 6889 - protein, 25 aa, synthetic construct
  source 1..25: note = Seed: LNVIVHSATGFKQSSKALQRPVASD
LNVIVHSATGMKQNSPALLRPVASD

SEQ ID NO: 6890 - protein, 25 aa, synthetic construct
  source 1..25: note = Seed: LNVIVHSATGFKQSSKALQRPVASD
LNVIVHSATGMKQNSPALMRPVASD

SEQ ID NO: 6891 - protein, 25 aa, synthetic construct
  source 1..25: note = Seed: LNVIVHSATGFKQSSKALQRPVASD
LNVIVHSATGMKQNSPALVRPVASD

SEQ ID NO: 6892 - protein, 25 aa, synthetic construct
  source 1..25: note = Seed: LNVIVHSATGFKQSSKALQRPVASD
LNVIVHSATGMKQNSPALYRPVASD

SEQ ID NO: 6893 - protein, 25 aa, synthetic construct
  source 1..25: note = Seed: LNVIVHSATGFKQSSKALQRPVASD
LNVIVHSATGMKQNSSALFRPVASD

SEQ ID NO: 6894 - protein, 25 aa, synthetic construct
  source 1..25: note = Seed: LNVIVHSATGFKQSSKALQRPVASD
LNVIVHSATGMKQNSSALIRPVASD

SEQ ID NO: 6895 - protein, 25 aa, synthetic construct
  source 1..25: note = Seed: LNVIVHSATGFKQSSKALQRPVASD
LNVIVHSATGMKQNSSALLRPVASD

SEQ ID NO: 6896 - protein, 25 aa, synthetic construct
  source 1..25: note = Seed: LNVIVHSATGFKQSSKALQRPVASD
LNVIVHSATGMKQNSSALMRPVASD

SEQ ID NO: 6897 - protein, 25 aa, synthetic construct
  source 1..25: note = Seed: LNVIVHSATGFKQSSKALQRPVASD
LNVIVHSATGMKQNSSALVRPVASD

SEQ ID NO: 6898 - protein, 25 aa, synthetic construct
  source 1..25: note = Seed: LNVIVHSATGFKQSSKALQRPVASD
LNVIVHSATGMKQNSSALYRPVASD

SEQ ID NO: 6899 - protein, 25 aa, synthetic construct
  source 1..25: note = Seed: LNVIVHSATGFKQSSKALQRPVASD
LNVIVHSATGMKQNSTALFRPVASD

SEQ ID NO: 6900 - protein, 25 aa, synthetic construct
  source 1..25: note = Seed: LNVIVHSATGFKQSSKALQRPVASD
LNVIVHSATGMKQNSTALIRPVASD

SEQ ID NO: 6901 - protein, 25 aa, synthetic construct
  source 1..25: note = Seed: LNVIVHSATGFKQSSKALQRPVASD
LNVIVHSATGMKQNSTALLRPVASD

SEQ ID NO: 6902 - protein, 25 aa, synthetic construct
  source 1..25: note = Seed: LNVIVHSATGFKQSSKALQRPVASD
LNVIVHSATGMKQNSTALVRPVASD

SEQ ID NO: 6903 - protein, 25 aa, synthetic construct
  source 1..25: note = Seed: LNVIVHSATGFKQSSKALQRPVASD
LNVIVHSATGMKQNSTALYRPVASD

SEQ ID NO: 6904 - protein, 25 aa, synthetic construct
  source 1..25: note = Seed: LNVIVHSATGFKQSSKALQRPVASD
LNVIVHSATGMKQNSVALFRPVASD

SEQ ID NO: 6905 - protein, 25 aa, synthetic construct
  source 1..25: note = Seed: LNVIVHSATGFKQSSKALQRPVASD
LNVIVHSATGMKQNSVALIRPVASD

SEQ ID NO: 6906 - protein, 25 aa, synthetic construct
  source 1..25: note = Seed: LNVIVHSATGFKQSSKALQRPVASD
LNVIVHSATGMKQNSVALLRPVASD

SEQ ID NO: 6907 - protein, 25 aa, synthetic construct
  source 1..25: note = Seed: LNVIVHSATGFKQSSKALQRPVASD
LNVIVHSATGMKQNSVALMRPVASD

SEQ ID NO: 6908 - protein, 25 aa, synthetic construct
  source 1..25: note = Seed: LNVIVHSATGFKQSSKALQRPVASD
LNVIVHSATGMKQNSVALVRPVASD

SEQ ID NO: 6909 - protein, 25 aa, synthetic construct
  source 1..25: note = Seed: LNVIVHSATGFKQSSKALQRPVASD
LNVIVHSATGMKQNSVALYRPVASD

SEQ ID NO: 6910 - protein, 25 aa, synthetic construct
  source 1..25: note = Seed: LNVIVHSATGFKQSSKALQRPVASD
LNVIVHSATGMKQQSAALARPVASD

SEQ ID NO: 6911 - protein, 25 aa, synthetic construct
  source 1..25: note = Seed: LNVIVHSATGFKQSSKALQRPVASD
LNVIVHSATGMKQQSAALIRPVASD

SEQ ID NO: 6912 - protein, 25 aa, synthetic construct
  source 1..25: note = Seed: LNVIVHSATGFKQSSKALQRPVASD
LNVIVHSATGMKQQSAALLRPVASD

SEQ ID NO: 6913 - protein, 25 aa, synthetic construct
  source 1..25: note = Seed: LNVIVHSATGFKQSSKALQRPVASD
LNVIVHSATGMKQQSAALSRPVASD

SEQ ID NO: 6914 - protein, 25 aa, synthetic construct
  source 1..25: note = Seed: LNVIVHSATGFKQSSKALQRPVASD
LNVIVHSATGMKQQSAALVRPVASD

SEQ ID NO: 6915 - protein, 25 aa, synthetic construct
  source 1..25: note = Seed: LNVIVHSATGFKQSSKALQRPVASD
LNVIVHSATGMKQQSGALARPVASD

SEQ ID NO: 6916 - protein, 25 aa, synthetic construct
  source 1..25: note = Seed: LNVIVHSATGFKQSSKALQRPVASD
LNVIVHSATGMKQQSGALIRPVASD

SEQ ID NO: 6917 - protein, 25 aa, synthetic construct
  source 1..25: note = Seed: LNVIVHSATGFKQSSKALQRPVASD
LNVIVHSATGMKQQSGALLRPVASD

SEQ ID NO: 6918 - protein, 25 aa, synthetic construct
  source 1..25: note = Seed: LNVIVHSATGFKQSSKALQRPVASD
LNVIVHSATGMKQQSGALVRPVASD

SEQ ID NO: 6919 - protein, 25 aa, synthetic construct
  source 1..25: note = Seed: LNVIVHSATGFKQSSKALQRPVASD
LNVIVHSATGMKQQSIALARPVASD

SEQ ID NO: 6920 - protein, 25 aa, synthetic construct
  source 1..25: note = Seed: LNVIVHSATGFKQSSKALQRPVASD
LNVIVHSATGMKQQSIALSRPVASD

SEQ ID NO: 6921 - protein, 25 aa, synthetic construct
  source 1..25: note = Seed: LNVIVHSATGFKQSSKALQRPVASD
LNVIVHSATGMKQQSIALVRPVASD

SEQ ID NO: 6922 - protein, 25 aa, synthetic construct
  source 1..25: note = Seed: LNVIVHSATGFKQSSKALQRPVASD
LNVIVHSATGMKQQSLALARPVASD

SEQ ID NO: 6923 - protein, 25 aa, synthetic construct
  source 1..25: note = Seed: LNVIVHSATGFKQSSKALQRPVASD
LNVIVHSATGMKQQSLALVRPVASD

SEQ ID NO: 6924 - protein, 25 aa, synthetic construct
  source 1..25: note = Seed: LNVIVHSATGFKQSSKALQRPVASD
LNVIVHSATGMKQQSRALARPVASD

SEQ ID NO: 6925 - protein, 25 aa, synthetic construct
  source 1..25: note = Seed: LNVIVHSATGFKQSSKALQRPVASD
LNVIVHSATGMKQQSRALSRPVASD

SEQ ID NO: 6926 - protein, 25 aa, synthetic construct
  source 1..25: note = Seed: LNVIVHSATGFKQSSKALQRPVASD
LNVIVHSATGMKQQSSALARPVASD

SEQ ID NO: 6927 - protein, 25 aa, synthetic construct
  source 1..25: note = Seed: LNVIVHSATGFKQSSKALQRPVASD
LNVIVHSATGMKQQSSALIRPVASD

SEQ ID NO: 6928 - protein, 25 aa, synthetic construct
  source 1..25: note = Seed: LNVIVHSATGFKQSSKALQRPVASD
LNVIVHSATGMKQQSSALLRPVASD

SEQ ID NO: 6929 - protein, 25 aa, synthetic construct
  source 1..25: note = Seed: LNVIVHSATGFKQSSKALQRPVASD
LNVIVHSATGMKQQSSALVRPVASD

SEQ ID NO: 6930 - protein, 25 aa, synthetic construct
  source 1..25: note = Seed: LNVIVHSATGFKQSSKALQRPVASD
LNVIVHSATGMKQQSVALARPVASD

SEQ ID NO: 6931 - protein, 25 aa, synthetic construct
  source 1..25: note = Seed: LNVIVHSATGFKQSSKALQRPVASD
LNVIVHSATGMKQQSVALLRPVASD

SEQ ID NO: 6932 - protein, 25 aa, synthetic construct
  source 1..25: note = Seed: LNVIVHSATGFKQSSKALQRPVASD
LNVIVHSATGMKQQSVALMRPVASD

SEQ ID NO: 6933 - protein, 25 aa, synthetic construct
  source 1..25: note = Seed: LNVIVHSATGFKQSSKALQRPVASD
LNVIVHSATGMKQQSVALSRPVASD

SEQ ID NO: 6934 - protein, 25 aa, synthetic construct
  source 1..25: note = Seed: LNVIVHSATGFKQSSKALQRPVASD
LNVIVHSATGMKQRSIALRRPVASD

SEQ ID NO: 6935 - protein, 25 aa, synthetic construct
  source 1..25: note = Seed: LNVIVHSATGFKQSSKALQRPVASD
LNVIVHSATGMKQRSRALFRPVASD

SEQ ID NO: 6936 - protein, 25 aa, synthetic construct
  source 1..25: note = Seed: LNVIVHSATGFKQSSKALQRPVASD
LNVIVHSATGMKQRSRALRRPVASD

SEQ ID NO: 6937 - protein, 25 aa, synthetic construct
  source 1..25: note = Seed: LNVIVHSATGFKQSSKALQRPVASD
LNVIVHSATGMKQRSRALYRPVASD

SEQ ID NO: 6938 - protein, 25 aa, synthetic construct
  source 1..25: note = Seed: LNVIVHSATGFKQSSKALQRPVASD
LNVIVHSATGMKQSSAALARPVASD

SEQ ID NO: 6939 - protein, 25 aa, synthetic construct
  source 1..25: note = Seed: LNVIVHSATGFKQSSKALQRPVASD
LNVIVHSATGMKQSSAALFRPVASD

SEQ ID NO: 6940 - protein, 25 aa, synthetic construct
  source 1..25: note = Seed: LNVIVHSATGFKQSSKALQRPVASD
LNVIVHSATGMKQSSAALIRPVASD

SEQ ID NO: 6941 - protein, 25 aa, synthetic construct
  source 1..25: note = Seed: LNVIVHSATGFKQSSKALQRPVASD
LNVIVHSATGMKQSSAALLRPVASD

SEQ ID NO: 6942 - protein, 25 aa, synthetic construct
  source 1..25: note = Seed: LNVIVHSATGFKQSSKALQRPVASD
LNVIVHSATGMKQSSAALVRPVASD

SEQ ID NO: 6943 - protein, 25 aa, synthetic construct
  source 1..25: note = Seed: LNVIVHSATGFKQSSKALQRPVASD
LNVIVHSATGMKQSSGALIRPVASD

SEQ ID NO: 6944 - protein, 25 aa, synthetic construct
  source 1..25: note = Seed: LNVIVHSATGFKQSSKALQRPVASD
LNVIVHSATGMKQSSPALIRPVASD

SEQ ID NO: 6945 - protein, 25 aa, synthetic construct
  source 1..25: note = Seed: LNVIVHSATGFKQSSKALQRPVASD
LNVIVHSATGMKQSSRALRRPVASD

SEQ ID NO: 6946 - protein, 25 aa, synthetic construct
  source 1..25: note = Seed: LNVIVHSATGFKQSSKALQRPVASD
LNVIVHSATGMKQSSRALSRPVASD

SEQ ID NO: 6947 - protein, 25 aa, synthetic construct
  source 1..25: note = Seed: LNVIVHSATGFKQSSKALQRPVASD
LNVIVHSATGMKQSSSALFRPVASD

SEQ ID NO: 6948 - protein, 25 aa, synthetic construct
  source 1..25: note = Seed: LNVIVHSATGFKQSSKALQRPVASD
LNVIVHSATGMKQSSSALIRPVASD

SEQ ID NO: 6949 - protein, 25 aa, synthetic construct
  source 1..25: note = Seed: LNVIVHSATGFKQSSKALQRPVASD
LNVIVHSATGMKQSSSALLRPVASD

SEQ ID NO: 6950 - protein, 25 aa, synthetic construct
  source 1..25: note = Seed: LNVIVHSATGFKQSSKALQRPVASD
LNVIVHSATGMKQSSSALMRPVASD

SEQ ID NO: 6951 - protein, 25 aa, synthetic construct
  source 1..25: note = Seed: LNVIVHSATGFKQSSKALQRPVASD
LNVIVHSATGMKQSSSALVRPVASD

SEQ ID NO: 6952 - protein, 25 aa, synthetic construct
  source 1..25: note = Seed: LNVIVHSATGFKQSSKALQRPVASD
LNVIVHSATGMKQSSTALIRPVASD

SEQ ID NO: 6953 - protein, 25 aa, synthetic construct
  source 1..25: note = Seed: LNVIVHSATGFKQSSKALQRPVASD
LNVIVHSATGMKQTSAALFRPVASD

SEQ ID NO: 6954 - protein, 25 aa, synthetic construct
  source 1..25: note = Seed: LNVIVHSATGFKQSSKALQRPVASD
LNVIVHSATGMKQTSAALIRPVASD

SEQ ID NO: 6955 - protein, 25 aa, synthetic construct
  source 1..25: note = Seed: LNVIVHSATGFKQSSKALQRPVASD
LNVIVHSATGMKQTSAALLRPVASD

SEQ ID NO: 6956 - protein, 25 aa, synthetic construct
  source 1..25: note = Seed: LNVIVHSATGFKQSSKALQRPVASD
LNVIVHSATGMKQTSAALMRPVASD

SEQ ID NO: 6957 - protein, 25 aa, synthetic construct
  source 1..25: note = Seed: LNVIVHSATGFKQSSKALQRPVASD
LNVIVHSATGMKQTSAALVRPVASD

SEQ ID NO: 6958 - protein, 25 aa, synthetic construct
  source 1..25: note = Seed: LNVIVHSATGFKQSSKALQRPVASD
LNVIVHSATGMKQTSGALIRPVASD

SEQ ID NO: 6959 - protein, 25 aa, synthetic construct
  source 1..25: note = Seed: LNVIVHSATGFKQSSKALQRPVASD
LNVIVHSATGMKQTSGALLRPVASD

SEQ ID NO: 6960 - protein, 25 aa, synthetic construct
  source 1..25: note = Seed: LNVIVHSATGFKQSSKALQRPVASD
LNVIVHSATGMKQTSGALVRPVASD

SEQ ID NO: 6961 - protein, 25 aa, synthetic construct
  source 1..25: note = Seed: LNVIVHSATGFKQSSKALQRPVASD
LNVIVHSATGMKQTSPALIRPVASD

SEQ ID NO: 6962 - protein, 25 aa, synthetic construct
  source 1..25: note = Seed: LNVIVHSATGFKQSSKALQRPVASD
LNVIVHSATGMKQTSPALLRPVASD

SEQ ID NO: 6963 - protein, 25 aa, synthetic construct
  source 1..25: note = Seed: LNVIVHSATGFKQSSKALQRPVASD
LNVIVHSATGMKQTSPALVRPVASD

SEQ ID NO: 6964 - protein, 25 aa, synthetic construct
  source 1..25: note = Seed: LNVIVHSATGFKQSSKALQRPVASD
LNVIVHSATGMKQTSRALARPVASD

SEQ ID NO: 6965 - protein, 25 aa, synthetic construct
  source 1..25: note = Seed: LNVIVHSATGFKQSSKALQRPVASD
LNVIVHSATGMKQTSRALRRPVASD

SEQ ID NO: 6966 - protein, 25 aa, synthetic construct
  source 1..25: note = Seed: LNVIVHSATGFKQSSKALQRPVASD
LNVIVHSATGMKQTSRALSRPVASD

SEQ ID NO: 6967 - protein, 25 aa, synthetic construct
  source 1..25: note = Seed: LNVIVHSATGFKQSSKALQRPVASD
LNVIVHSATGMKQTSSALFRPVASD

SEQ ID NO: 6968 - protein, 25 aa, synthetic construct
  source 1..25: note = Seed: LNVIVHSATGFKQSSKALQRPVASD
LNVIVHSATGMKQTSSALIRPVASD

SEQ ID NO: 6969 - protein, 25 aa, synthetic construct
  source 1..25: note = Seed: LNVIVHSATGFKQSSKALQRPVASD
LNVIVHSATGMKQTSSALLRPVASD

SEQ ID NO: 6970 - protein, 25 aa, synthetic construct
  source 1..25: note = Seed: LNVIVHSATGFKQSSKALQRPVASD
LNVIVHSATGMKQTSSALMRPVASD

SEQ ID NO: 6971 - protein, 25 aa, synthetic construct
  source 1..25: note = Seed: LNVIVHSATGFKQSSKALQRPVASD
LNVIVHSATGMKQTSSALVRPVASD

SEQ ID NO: 6972 - protein, 25 aa, synthetic construct
  source 1..25: note = Seed: LNVIVHSATGFKQSSKALQRPVASD
LNVIVHSATGMKQTSTALIRPVASD

SEQ ID NO: 6973 - protein, 25 aa, synthetic construct
  source 1..25: note = Seed: LNVIVHSATGFKQSSKALQRPVASD
LNVIVHSATGMKQTSTALLRPVASD

SEQ ID NO: 6974 - protein, 25 aa, synthetic construct
  source 1..25: note = Seed: LNVIVHSATGFKQSSKALQRPVASD
LNVIVHSATGMKQTSTALVRPVASD

SEQ ID NO: 6975 - protein, 25 aa, synthetic construct
  source 1..25: note = Seed: LNVIVHSATGFKQSSKALQRPVASD
LNVIVHSATGMKQTSVALIRPVASD

SEQ ID NO: 6976 - protein, 25 aa, synthetic construct
  source 1..25: note = Seed: LNVIVHSATGFKQSSKALQRPVASD
LNVIVHSATGMKQVSAALARPVASD

SEQ ID NO: 6977 - protein, 25 aa, synthetic construct
  source 1..25: note = Seed: LNVIVHSATGFKQSSKALQRPVASD
LNVIVHSATGMKQVSAALIRPVASD

SEQ ID NO: 6978 - protein, 25 aa, synthetic construct
  source 1..25: note = Seed: LNVIVHSATGFKQSSKALQRPVASD
LNVIVHSATGMKQVSAALLRPVASD

SEQ ID NO: 6979 - protein, 25 aa, synthetic construct
  source 1..25: note = Seed: LNVIVHSATGFKQSSKALQRPVASD
LNVIVHSATGMKQVSAALNRPVASD

SEQ ID NO: 6980 - protein, 25 aa, synthetic construct
  source 1..25: note = Seed: LNVIVHSATGFKQSSKALQRPVASD
LNVIVHSATGMKQVSAALSRPVASD

SEQ ID NO: 6981 - protein, 25 aa, synthetic construct
  source 1..25: note = Seed: LNVIVHSATGFKQSSKALQRPVASD
LNVIVHSATGMKQVSAALTRPVASD

SEQ ID NO: 6982 - protein, 25 aa, synthetic construct
  source 1..25: note = Seed: LNVIVHSATGFKQSSKALQRPVASD
LNVIVHSATGMKQVSAALVRPVASD

SEQ ID NO: 6983 - protein, 25 aa, synthetic construct
  source 1..25: note = Seed: LNVIVHSATGFKQSSKALQRPVASD
LNVIVHSATGMKQVSFALIRPVASD

SEQ ID NO: 6984 - protein, 25 aa, synthetic construct
  source 1..25: note = Seed: LNVIVHSATGFKQSSKALQRPVASD
LNVIVHSATGMKQVSFALLRPVASD

SEQ ID NO: 6985 - protein, 25 aa, synthetic construct
  source 1..25: note = Seed: LNVIVHSATGFKQSSKALQRPVASD
LNVIVHSATGMKQVSFALMRPVASD

SEQ ID NO: 6986 - protein, 25 aa, synthetic construct
  source 1..25: note = Seed: LNVIVHSATGFKQSSKALQRPVASD
LNVIVHSATGMKQVSGALARPVASD

SEQ ID NO: 6987 - protein, 25 aa, synthetic construct
  source 1..25: note = Seed: LNVIVHSATGFKQSSKALQRPVASD
LNVIVHSATGMKQVSGALIRPVASD

SEQ ID NO: 6988 - protein, 25 aa, synthetic construct
  source 1..25: note = Seed: LNVIVHSATGFKQSSKALQRPVASD
LNVIVHSATGMKQVSGALLRPVASD

SEQ ID NO: 6989 - protein, 25 aa, synthetic construct
  source 1..25: note = Seed: LNVIVHSATGFKQSSKALQRPVASD
LNVIVHSATGMKQVSGALVRPVASD

SEQ ID NO: 6990 - protein, 25 aa, synthetic construct
  source 1..25: note = Seed: LNVIVHSATGFKQSSKALQRPVASD
LNVIVHSATGMKQVSHALRRPVASD

SEQ ID NO: 6991 - protein, 25 aa, synthetic construct
  source 1..25: note = Seed: LNVIVHSATGFKQSSKALQRPVASD
LNVIVHSATGMKQVSIALARPVASD

SEQ ID NO: 6992 - protein, 25 aa, synthetic construct
  source 1..25: note = Seed: LNVIVHSATGFKQSSKALQRPVASD
LNVIVHSATGMKQVSIALNRPVASD

SEQ ID NO: 6993 - protein, 25 aa, synthetic construct
  source 1..25: note = Seed: LNVIVHSATGFKQSSKALQRPVASD
LNVIVHSATGMKQVSIALSRPVASD

SEQ ID NO: 6994 - protein, 25 aa, synthetic construct
  source 1..25: note = Seed: LNVIVHSATGFKQSSKALQRPVASD
LNVIVHSATGMKQVSIALTRPVASD

SEQ ID NO: 6995 - protein, 25 aa, synthetic construct
  source 1..25: note = Seed: LNVIVHSATGFKQSSKALQRPVASD
LNVIVHSATGMKQVSKALARPVASD

SEQ ID NO: 6996 - protein, 25 aa, synthetic construct
  source 1..25: note = Seed: LNVIVHSATGFKQSSKALQRPVASD
LNVIVHSATGMKQVSKALGRPVASD

SEQ ID NO: 6997 - protein, 25 aa, synthetic construct
  source 1..25: note = Seed: LNVIVHSATGFKQSSKALQRPVASD
LNVIVHSATGMKQVSKALHRPVASD

SEQ ID NO: 6998 - protein, 25 aa, synthetic construct
  source 1..25: note = Seed: LNVIVHSATGFKQSSKALQRPVASD
LNVIVHSATGMKQVSKALIRPVASD

SEQ ID NO: 6999 - protein, 25 aa, synthetic construct
  source 1..25: note = Seed: LNVIVHSATGFKQSSKALQRPVASD
LNVIVHSATGMKQVSKALKRPVASD

SEQ ID NO: 7000 - protein, 25 aa, synthetic construct
  source 1..25: note = Seed: LNVIVHSATGFKQSSKALQRPVASD
LNVIVHSATGMKQVSKALMRPVASD

SEQ ID NO: 7001 - protein, 25 aa, synthetic construct
  source 1..25: note = Seed: LNVIVHSATGFKQSSKALQRPVASD
LNVIVHSATGMKQVSKALQRPVASD

SEQ ID NO: 7002 - protein, 25 aa, synthetic construct
  source 1..25: note = Seed: LNVIVHSATGFKQSSKALQRPVASD
LNVIVHSATGMKQVSKALRRPVASD

SEQ ID NO: 7003 - protein, 25 aa, synthetic construct
  source 1..25: note = Seed: LNVIVHSATGFKQSSKALQRPVASD
LNVIVHSATGMKQVSKALSRPVASD

SEQ ID NO: 7004 - protein, 25 aa, synthetic construct
  source 1..25: note = Seed: LNVIVHSATGFKQSSKALQRPVASD
LNVIVHSATGMKQVSKALTRPVASD

SEQ ID NO: 7005 - protein, 25 aa, synthetic construct
  source 1..25: note = Seed: LNVIVHSATGFKQSSKALQRPVASD
LNVIVHSATGMKQVSKALVRPVASD

SEQ ID NO: 7006 - protein, 25 aa, synthetic construct
  source 1..25: note = Seed: LNVIVHSATGFKQSSKALQRPVASD
LNVIVHSATGMKQVSKALYRPVASD

SEQ ID NO: 7007 - protein, 25 aa, synthetic construct
  source 1..25: note = Seed: LNVIVHSATGFKQSSKALQRPVASD
LNVIVHSATGMKQVSLALLRPVASD

SEQ ID NO: 7008 - protein, 25 aa, synthetic construct
  source 1..25: note = Seed: LNVIVHSATGFKQSSKALQRPVASD
LNVIVHSATGMKQVSLALSRPVASD

SEQ ID NO: 7009 - protein, 25 aa, synthetic construct
  source 1..25: note = Seed: LNVIVHSATGFKQSSKALQRPVASD
LNVIVHSATGMKQVSMALNRPVASD

SEQ ID NO: 7010 - protein, 25 aa, synthetic construct
  source 1..25: note = Seed: LNVIVHSATGFKQSSKALQRPVASD
LNVIVHSATGMKQVSPALARPVASD

SEQ ID NO: 7011 - protein, 25 aa, synthetic construct
  source 1..25: note = Seed: LNVIVHSATGFKQSSKALQRPVASD
LNVIVHSATGMKQVSPALIRPVASD

SEQ ID NO: 7012 - protein, 25 aa, synthetic construct
  source 1..25: note = Seed: LNVIVHSATGFKQSSKALQRPVASD
LNVIVHSATGMKQVSPALNRPVASD

SEQ ID NO: 7013 - protein, 25 aa, synthetic construct
  source 1..25: note = Seed: LNVIVHSATGFKQSSKALQRPVASD
LNVIVHSATGMKQVSPALSRPVASD

SEQ ID NO: 7014 - protein, 25 aa, synthetic construct
  source 1..25: note = Seed: LNVIVHSATGFKQSSKALQRPVASD
LNVIVHSATGMKQVSPALVRPVASD

SEQ ID NO: 7015 - protein, 25 aa, synthetic construct
  source 1..25: note = Seed: LNVIVHSATGFKQSSKALQRPVASD
LNVIVHSATGMKQVSRALARPVASD

SEQ ID NO: 7016 - protein, 25 aa, synthetic construct
  source 1..25: note = Seed: LNVIVHSATGFKQSSKALQRPVASD
LNVIVHSATGMKQVSRALGRPVASD

SEQ ID NO: 7017 - protein, 25 aa, synthetic construct
  source 1..25: note = Seed: LNVIVHSATGFKQSSKALQRPVASD
LNVIVHSATGMKQVSRALHRPVASD

SEQ ID NO: 7018 - protein, 25 aa, synthetic construct
  source 1..25: note = Seed: LNVIVHSATGFKQSSKALQRPVASD
LNVIVHSATGMKQVSRALIRPVASD

SEQ ID NO: 7019 - protein, 25 aa, synthetic construct
  source 1..25: note = Seed: LNVIVHSATGFKQSSKALQRPVASD
LNVIVHSATGMKQVSRALKRPVASD

SEQ ID NO: 7020 - protein, 25 aa, synthetic construct
  source 1..25: note = Seed: LNVIVHSATGFKQSSKALQRPVASD
LNVIVHSATGMKQVSRALLRPVASD

SEQ ID NO: 7021 - protein, 25 aa, synthetic construct
  source 1..25: note = Seed: LNVIVHSATGFKQSSKALQRPVASD
LNVIVHSATGMKQVSRALMRPVASD

SEQ ID NO: 7022 - protein, 25 aa, synthetic construct
  source 1..25: note = Seed: LNVIVHSATGFKQSSKALQRPVASD
LNVIVHSATGMKQVSRALNRPVASD

SEQ ID NO: 7023 - protein, 25 aa, synthetic construct
  source 1..25: note = Seed: LNVIVHSATGFKQSSKALQRPVASD
LNVIVHSATGMKQVSRALQRPVASD

SEQ ID NO: 7024 - protein, 25 aa, synthetic construct
  source 1..25: note = Seed: LNVIVHSATGFKQSSKALQRPVASD
LNVIVHSATGMKQVSRALRRPVASD

SEQ ID NO: 7025 - protein, 25 aa, synthetic construct
  source 1..25: note = Seed: LNVIVHSATGFKQSSKALQRPVASD
LNVIVHSATGMKQVSRALSRPVASD

SEQ ID NO: 7026 - protein, 25 aa, synthetic construct
  source 1..25: note = Seed: LNVIVHSATGFKQSSKALQRPVASD
LNVIVHSATGMKQVSRALTRPVASD

SEQ ID NO: 7027 - protein, 25 aa, synthetic construct
  source 1..25: note = Seed: LNVIVHSATGFKQSSKALQRPVASD
LNVIVHSATGMKQVSRALVRPVASD

SEQ ID NO: 7028 - protein, 25 aa, synthetic construct
  source 1..25: note = Seed: LNVIVHSATGFKQSSKALQRPVASD
LNVIVHSATGMKQVSRALYRPVASD

SEQ ID NO: 7029 - protein, 25 aa, synthetic construct
  source 1..25: note = Seed: LNVIVHSATGFKQSSKALQRPVASD
LNVIVHSATGMKQVSSALARPVASD

SEQ ID NO: 7030 - protein, 25 aa, synthetic construct
  source 1..25: note = Seed: LNVIVHSATGFKQSSKALQRPVASD
LNVIVHSATGMKQVSSALIRPVASD

SEQ ID NO: 7031 - protein, 25 aa, synthetic construct
  source 1..25: note = Seed: LNVIVHSATGFKQSSKALQRPVASD
LNVIVHSATGMKQVSSALLRPVASD

SEQ ID NO: 7032 - protein, 25 aa, synthetic construct
  source 1..25: note = Seed: LNVIVHSATGFKQSSKALQRPVASD
LNVIVHSATGMKQVSSALNRPVASD

SEQ ID NO: 7033 - protein, 25 aa, synthetic construct
  source 1..25: note = Seed: LNVIVHSATGFKQSSKALQRPVASD
LNVIVHSATGMKQVSSALSRPVASD

SEQ ID NO: 7034 - protein, 25 aa, synthetic construct
  source 1..25: note = Seed: LNVIVHSATGFKQSSKALQRPVASD
LNVIVHSATGMKQVSSALVRPVASD

SEQ ID NO: 7035 - protein, 25 aa, synthetic construct
  source 1..25: note = Seed: LNVIVHSATGFKQSSKALQRPVASD
LNVIVHSATGMKQVSTALARPVASD

SEQ ID NO: 7036 - protein, 25 aa, synthetic construct
  source 1..25: note = Seed: LNVIVHSATGFKQSSKALQRPVASD
LNVIVHSATGMKQVSTALNRPVASD

SEQ ID NO: 7037 - protein, 25 aa, synthetic construct
  source 1..25: note = Seed: LNVIVHSATGFKQSSKALQRPVASD
LNVIVHSATGMKQVSTALSRPVASD

SEQ ID NO: 7038 - protein, 25 aa, synthetic construct
  source 1..25: note = Seed: LNVIVHSATGFKQSSKALQRPVASD
LNVIVHSATGMKQVSVALARPVASD

SEQ ID NO: 7039 - protein, 25 aa, synthetic construct
  source 1..25: note = Seed: LNVIVHSATGFKQSSKALQRPVASD
LNVIVHSATGMKQVSVALIRPVASD

SEQ ID NO: 7040 - protein, 25 aa, synthetic construct
  source 1..25: note = Seed: LNVIVHSATGFKQSSKALQRPVASD
LNVIVHSATGMKQVSVALNRPVASD

SEQ ID NO: 7041 - protein, 25 aa, synthetic construct
  source 1..25: note = Seed: LNVIVHSATGFKQSSKALQRPVASD
LNVIVHSATGMKQVSVALSRPVASD

SEQ ID NO: 7042 - protein, 25 aa, synthetic construct
  source 1..25: note = Seed: LNVIVHSATGFKQSSKALQRPVASD
LNVIVHSATGMKQVSVALVRPVASD

SEQ ID NO: 7043 - protein, 25 aa, synthetic construct
  source 1..25: note = Seed: LNVIVHSATGFKQSSKALQRPVASD
LNVIVHSATGMKQWSAALIRPVASD

SEQ ID NO: 7044 - protein, 25 aa, synthetic construct
  source 1..25: note = Seed: LNVIVHSATGFKQSSKALQRPVASD
LNVIVHSATGMKQWSAALMRPVASD

SEQ ID NO: 7045 - protein, 25 aa, synthetic construct
  source 1..25: note = Seed: LNVIVHSATGFKQSSKALQRPVASD
LNVIVHSATGMKQWSAALRRPVASD

SEQ ID NO: 7046 - protein, 25 aa, synthetic construct
  source 1..25: note = Seed: LNVIVHSATGFKQSSKALQRPVASD
LNVIVHSATGMKQWSHALRRPVASD

SEQ ID NO: 7047 - protein, 25 aa, synthetic construct
  source 1..25: note = Seed: LNVIVHSATGFKQSSKALQRPVASD
LNVIVHSATGMKQWSIALRRPVASD

SEQ ID NO: 7048 - protein, 25 aa, synthetic construct
  source 1..25: note = Seed: LNVIVHSATGFKQSSKALQRPVASD
LNVIVHSATGMKQWSKALARPVASD

SEQ ID NO: 7049 - protein, 25 aa, synthetic construct
  source 1..25: note = Seed: LNVIVHSATGFKQSSKALQRPVASD
LNVIVHSATGMKQWSKALFRPVASD

SEQ ID NO: 7050 - protein, 25 aa, synthetic construct
  source 1..25: note = Seed: LNVIVHSATGFKQSSKALQRPVASD
LNVIVHSATGMKQWSKALKRPVASD

SEQ ID NO: 7051 - protein, 25 aa, synthetic construct
  source 1..25: note = Seed: LNVIVHSATGFKQSSKALQRPVASD
LNVIVHSATGMKQWSKALRRPVASD

SEQ ID NO: 7052 - protein, 25 aa, synthetic construct
  source 1..25: note = Seed: LNVIVHSATGFKQSSKALQRPVASD
LNVIVHSATGMKQWSKALSRPVASD

SEQ ID NO: 7053 - protein, 25 aa, synthetic construct
  source 1..25: note = Seed: LNVIVHSATGFKQSSKALQRPVASD
LNVIVHSATGMKQWSKALYRPVASD

SEQ ID NO: 7054 - protein, 25 aa, synthetic construct
  source 1..25: note = Seed: LNVIVHSATGFKQSSKALQRPVASD
LNVIVHSATGMKQWSLALRRPVASD

SEQ ID NO: 7055 - protein, 25 aa, synthetic construct
  source 1..25: note = Seed: LNVIVHSATGFKQSSKALQRPVASD
LNVIVHSATGMKQWSMALRRPVASD

SEQ ID NO: 7056 - protein, 25 aa, synthetic construct
  source 1..25: note = Seed: LNVIVHSATGFKQSSKALQRPVASD
LNVIVHSATGMKQWSRALARPVASD

SEQ ID NO: 7057 - protein, 25 aa, synthetic construct
  source 1..25: note = Seed: LNVIVHSATGFKQSSKALQRPVASD
LNVIVHSATGMKQWSRALFRPVASD

SEQ ID NO: 7058 - protein, 25 aa, synthetic construct
  source 1..25: note = Seed: LNVIVHSATGFKQSSKALQRPVASD
LNVIVHSATGMKQWSRALHRPVASD

SEQ ID NO: 7059 - protein, 25 aa, synthetic construct
  source 1..25: note = Seed: LNVIVHSATGFKQSSKALQRPVASD
LNVIVHSATGMKQWSRALIRPVASD

SEQ ID NO: 7060 - protein, 25 aa, synthetic construct
  source 1..25: note = Seed: LNVIVHSATGFKQSSKALQRPVASD
LNVIVHSATGMKQWSRALKRPVASD

SEQ ID NO: 7061 - protein, 25 aa, synthetic construct
  source 1..25: note = Seed: LNVIVHSATGFKQSSKALQRPVASD
LNVIVHSATGMKQWSRALLRPVASD

SEQ ID NO: 7062 - protein, 25 aa, synthetic construct
  source 1..25: note = Seed: LNVIVHSATGFKQSSKALQRPVASD
LNVIVHSATGMKQWSRALMRPVASD

SEQ ID NO: 7063 - protein, 25 aa, synthetic construct
  source 1..25: note = Seed: LNVIVHSATGFKQSSKALQRPVASD
LNVIVHSATGMKQWSRALRRPVASD

SEQ ID NO: 7064 - protein, 25 aa, synthetic construct
  source 1..25: note = Seed: LNVIVHSATGFKQSSKALQRPVASD
LNVIVHSATGMKQWSRALSRPVASD

SEQ ID NO: 7065 - protein, 25 aa, synthetic construct
  source 1..25: note = Seed: LNVIVHSATGFKQSSKALQRPVASD
LNVIVHSATGMKQWSRALVRPVASD

SEQ ID NO: 7066 - protein, 25 aa, synthetic construct
  source 1..25: note = Seed: LNVIVHSATGFKQSSKALQRPVASD
LNVIVHSATGMKQWSRALYRPVASD

SEQ ID NO: 7067 - protein, 25 aa, synthetic construct
  source 1..25: note = Seed: LNVIVHSATGFKQSSKALQRPVASD
LNVIVHSATGMKQWSTALRRPVASD

SEQ ID NO: 7068 - protein, 25 aa, synthetic construct
  source 1..25: note = Seed: LNVIVHSATGFKQSSKALQRPVASD
LNVIVHSATGMKQWSVALRRPVASD

SEQ ID NO: 7069 - protein, 25 aa, synthetic construct
  source 1..25: note = Seed: LNVIVHSATGFKQSSKALQRPVASD
LNVIVHSATGMKQYSAALLRPVASD

SEQ ID NO: 7070 - protein, 25 aa, synthetic construct
  source 1..25: note = Seed: LNVIVHSATGFKQSSKALQRPVASD
LNVIVHSATGMKQYSIALRRPVASD

SEQ ID NO: 7071 - protein, 25 aa, synthetic construct
  source 1..25: note = Seed: LNVIVHSATGFKQSSKALQRPVASD
LNVIVHSATGMKQYSKALKRPVASD

SEQ ID NO: 7072 - protein, 25 aa, synthetic construct
  source 1..25: note = Seed: LNVIVHSATGFKQSSKALQRPVASD
LNVIVHSATGMKQYSKALRRPVASD

SEQ ID NO: 7073 - protein, 25 aa, synthetic construct
  source 1..25: note = Seed: LNVIVHSATGFKQSSKALQRPVASD
LNVIVHSATGMKQYSLALRRPVASD

SEQ ID NO: 7074 - protein, 25 aa, synthetic construct
  source 1..25: note = Seed: LNVIVHSATGFKQSSKALQRPVASD
LNVIVHSATGMKQYSMALRRPVASD

SEQ ID NO: 7075 - protein, 25 aa, synthetic construct
  source 1..25: note = Seed: LNVIVHSATGFKQSSKALQRPVASD
LNVIVHSATGMKQYSRALARPVASD

SEQ ID NO: 7076 - protein, 25 aa, synthetic construct
  source 1..25: note = Seed: LNVIVHSATGFKQSSKALQRPVASD
LNVIVHSATGMKQYSRALHRPVASD

SEQ ID NO: 7077 - protein, 25 aa, synthetic construct
  source 1..25: note = Seed: LNVIVHSATGFKQSSKALQRPVASD
LNVIVHSATGMKQYSRALKRPVASD

SEQ ID NO: 7078 - protein, 25 aa, synthetic construct
  source 1..25: note = Seed: LNVIVHSATGFKQSSKALQRPVASD
LNVIVHSATGMKQYSRALRRPVASD

SEQ ID NO: 7079 - protein, 25 aa, synthetic construct
  source 1..25: note = Seed: LNVIVHSATGFKQSSKALQRPVASD
LNVIVHSATGMKQYSRALSRPVASD

SEQ ID NO: 7080 - protein, 25 aa, synthetic construct
  source 1..25: note = Seed: LNVIVHSATGFKQSSKALQRPVASD
LNVIVHSATGMKQYSSALARPVASD

SEQ ID NO: 7081 - protein, 25 aa, synthetic construct
  source 1..25: note = Seed: LNVIVHSATGFKQSSKALQRPVASD
LNVIVHSATGMKQYSVALRRPVASD

SEQ ID NO: 7082 - protein, 25 aa, synthetic construct
  source 1..25: note = Seed: LNVIVHSATGFKQSSKALQRPVASD
LNVIVHSATGNKQLSAALIRPVASD

SEQ ID NO: 7083 - protein, 25 aa, synthetic construct
  source 1..25: note = Seed: LNVIVHSATGFKQSSKALQRPVASD
LNVIVHSATGNKQLSGALVRPVASD

SEQ ID NO: 7084 - protein, 25 aa, synthetic construct
  source 1..25: note = Seed: LNVIVHSATGFKQSSKALQRPVASD
LNVIVHSATGPKQLSAALVRPVASD

SEQ ID NO: 7085 - protein, 25 aa, synthetic construct
  source 1..25: note = Seed: LNVIVHSATGFKQSSKALQRPVASD
LNVIVHSATGQKQLSAALIRPVASD

SEQ ID NO: 7086 - protein, 25 aa, synthetic construct
  source 1..25: note = Seed: LNVIVHSATGFKQSSKALQRPVASD
LNVIVHSATGQKQLSAALVRPVASD

SEQ ID NO: 7087 - protein, 25 aa, synthetic construct
  source 1..25: note = Seed: LNVIVHSATGFKQSSKALQRPVASD
LNVIVHSATGQKQLSGALVRPVASD

SEQ ID NO: 7088 - protein, 25 aa, synthetic construct
  source 1..25: note = Seed: LNVIVHSATGFKQSSKALQRPVASD
LNVIVHSATGQKQLSSALVRPVASD

SEQ ID NO: 7089 - protein, 25 aa, synthetic construct
  source 1..25: note = Seed: LNVIVHSATGFKQSSKALQRPVASD
LNVIVHSATGQKQMSAALARPVASD

SEQ ID NO: 7090 - protein, 25 aa, synthetic construct
  source 1..25: note = Seed: LNVIVHSATGFKQSSKALQRPVASD
LNVIVHSATGQKQMSAALIRPVASD

SEQ ID NO: 7091 - protein, 25 aa, synthetic construct
  source 1..25: note = Seed: LNVIVHSATGFKQSSKALQRPVASD
LNVIVHSATGQKQMSAALVRPVASD

SEQ ID NO: 7092 - protein, 25 aa, synthetic construct
  source 1..25: note = Seed: LNVIVHSATGFKQSSKALQRPVASD
LNVIVHSATGRKQASIALARPVASD

SEQ ID NO: 7093 - protein, 25 aa, synthetic construct
  source 1..25: note = Seed: LNVIVHSATGFKQSSKALQRPVASD
LNVIVHSATGRKQFSIALARPVASD

SEQ ID NO: 7094 - protein, 25 aa, synthetic construct
  source 1..25: note = Seed: LNVIVHSATGFKQSSKALQRPVASD
LNVIVHSATGRKQFSIALMRPVASD

SEQ ID NO: 7095 - protein, 25 aa, synthetic construct
  source 1..25: note = Seed: LNVIVHSATGFKQSSKALQRPVASD
LNVIVHSATGRKQFSLALARPVASD

SEQ ID NO: 7096 - protein, 25 aa, synthetic construct
  source 1..25: note = Seed: LNVIVHSATGFKQSSKALQRPVASD
LNVIVHSATGRKQFSLALIRPVASD

SEQ ID NO: 7097 - protein, 25 aa, synthetic construct
  source 1..25: note = Seed: LNVIVHSATGFKQSSKALQRPVASD
LNVIVHSATGRKQFSLALMRPVASD

SEQ ID NO: 7098 - protein, 25 aa, synthetic construct
  source 1..25: note = Seed: LNVIVHSATGFKQSSKALQRPVASD
LNVIVHSATGRKQFSLALVRPVASD

SEQ ID NO: 7099 - protein, 25 aa, synthetic construct
  source 1..25: note = Seed: LNVIVHSATGFKQSSKALQRPVASD
LNVIVHSATGRKQFSMALARPVASD

SEQ ID NO: 7100 - protein, 25 aa, synthetic construct
  source 1..25: note = Seed: LNVIVHSATGFKQSSKALQRPVASD
LNVIVHSATGRKQFSMALIRPVASD

SEQ ID NO: 7101 - protein, 25 aa, synthetic construct
  source 1..25: note = Seed: LNVIVHSATGFKQSSKALQRPVASD
LNVIVHSATGRKQFSMALMRPVASD

SEQ ID NO: 7102 - protein, 25 aa, synthetic construct
  source 1..25: note = Seed: LNVIVHSATGFKQSSKALQRPVASD
LNVIVHSATGRKQISAALARPVASD

SEQ ID NO: 7103 - protein, 25 aa, synthetic construct
  source 1..25: note = Seed: LNVIVHSATGFKQSSKALQRPVASD
LNVIVHSATGRKQISFALVRPVASD

SEQ ID NO: 7104 - protein, 25 aa, synthetic construct
  source 1..25: note = Seed: LNVIVHSATGFKQSSKALQRPVASD
LNVIVHSATGRKQISIALARPVASD

SEQ ID NO: 7105 - protein, 25 aa, synthetic construct
  source 1..25: note = Seed: LNVIVHSATGFKQSSKALQRPVASD
LNVIVHSATGRKQLSIALARPVASD

SEQ ID NO: 7106 - protein, 25 aa, synthetic construct
  source 1..25: note = Seed: LNVIVHSATGFKQSSKALQRPVASD
LNVIVHSATGRKQLSRALSRPVASD

SEQ ID NO: 7107 - protein, 25 aa, synthetic construct
  source 1..25: note = Seed: LNVIVHSATGFKQSSKALQRPVASD
LNVIVHSATGRKQMSFALVRPVASD

SEQ ID NO: 7108 - protein, 25 aa, synthetic construct
  source 1..25: note = Seed: LNVIVHSATGFKQSSKALQRPVASD
LNVIVHSATGRKQMSIALARPVASD

SEQ ID NO: 7109 - protein, 25 aa, synthetic construct
  source 1..25: note = Seed: LNVIVHSATGFKQSSKALQRPVASD
LNVIVHSATGRKQVSFALIRPVASD

SEQ ID NO: 7110 - protein, 25 aa, synthetic construct
  source 1..25: note = Seed: LNVIVHSATGFKQSSKALQRPVASD
LNVIVHSATGRKQVSFALVRPVASD

SEQ ID NO: 7111 - protein, 25 aa, synthetic construct
  source 1..25: note = Seed: LNVIVHSATGFKQSSKALQRPVASD
LNVIVHSATGRKQVSIALARPVASD

SEQ ID NO: 7112 - protein, 25 aa, synthetic construct
  source 1..25: note = Seed: LNVIVHSATGFKQSSKALQRPVASD
LNVIVHSATGRKQWSFALMRPVASD

SEQ ID NO: 7113 - protein, 25 aa, synthetic construct
  source 1..25: note = Seed: LNVIVHSATGFKQSSKALQRPVASD
LNVIVHSATGRKQWSLALMRPVASD

SEQ ID NO: 7114 - protein, 25 aa, synthetic construct
  source 1..25: note = Seed: LNVIVHSATGFKQSSKALQRPVASD
LNVIVHSATGSKQLSAALIRPVASD

SEQ ID NO: 7115 - protein, 25 aa, synthetic construct
  source 1..25: note = Seed: LNVIVHSATGFKQSSKALQRPVASD
LNVIVHSATGSKQLSGALVRPVASD

SEQ ID NO: 7116 - protein, 25 aa, synthetic construct
  source 1..25: note = Seed: LNVIVHSATGFKQSSKALQRPVASD
LNVIVHSATGTKQFSRALRRPVASD

SEQ ID NO: 7117 - protein, 25 aa, synthetic construct
  source 1..25: note = Seed: LNVIVHSATGFKQSSKALQRPVASD
LNVIVHSATGTKQLSAALIRPVASD

SEQ ID NO: 7118 - protein, 25 aa, synthetic construct
  source 1..25: note = Seed: LNVIVHSATGFKQSSKALQRPVASD
LNVIVHSATGTKQLSAALVRPVASD

SEQ ID NO: 7119 - protein, 25 aa, synthetic construct
  source 1..25: note = Seed: LNVIVHSATGFKQSSKALQRPVASD
LNVIVHSATGTKQLSGALIRPVASD

SEQ ID NO: 7120 - protein, 25 aa, synthetic construct
  source 1..25: note = Seed: LNVIVHSATGFKQSSKALQRPVASD
LNVIVHSATGTKQLSGALVRPVASD

SEQ ID NO: 7121 - protein, 25 aa, synthetic construct
  source 1..25: note = Seed: LNVIVHSATGFKQSSKALQRPVASD
LNVIVHSATGTKQMSAALVRPVASD

SEQ ID NO: 7122 - protein, 25 aa, synthetic construct
  source 1..25: note = Seed: LNVIVHSATGFKQSSKALQRPVASD
LNVIVHSATGVKQASAALARPVASD

SEQ ID NO: 7123 - protein, 25 aa, synthetic construct
  source 1..25: note = Seed: LNVIVHSATGFKQSSKALQRPVASD
LNVIVHSATGVKQASAALIRPVASD

SEQ ID NO: 7124 - protein, 25 aa, synthetic construct
  source 1..25: note = Seed: LNVIVHSATGFKQSSKALQRPVASD
LNVIVHSATGVKQASAALLRPVASD

SEQ ID NO: 7125 - protein, 25 aa, synthetic construct
  source 1..25: note = Seed: LNVIVHSATGFKQSSKALQRPVASD
LNVIVHSATGVKQASAALMRPVASD

SEQ ID NO: 7126 - protein, 25 aa, synthetic construct
  source 1..25: note = Seed: LNVIVHSATGFKQSSKALQRPVASD
LNVIVHSATGVKQASAALNRPVASD

SEQ ID NO: 7127 - protein, 25 aa, synthetic construct
  source 1..25: note = Seed: LNVIVHSATGFKQSSKALQRPVASD
LNVIVHSATGVKQASAALSRPVASD

SEQ ID NO: 7128 - protein, 25 aa, synthetic construct
  source 1..25: note = Seed: LNVIVHSATGFKQSSKALQRPVASD
LNVIVHSATGVKQASAALTRPVASD

SEQ ID NO: 7129 - protein, 25 aa, synthetic construct
  source 1..25: note = Seed: LNVIVHSATGFKQSSKALQRPVASD
LNVIVHSATGVKQASAALVRPVASD

SEQ ID NO: 7130 - protein, 25 aa, synthetic construct
  source 1..25: note = Seed: LNVIVHSATGFKQSSKALQRPVASD
LNVIVHSATGVKQASGALARPVASD

SEQ ID NO: 7131 - protein, 25 aa, synthetic construct
  source 1..25: note = Seed: LNVIVHSATGFKQSSKALQRPVASD
LNVIVHSATGVKQASGALIRPVASD

SEQ ID NO: 7132 - protein, 25 aa, synthetic construct
  source 1..25: note = Seed: LNVIVHSATGFKQSSKALQRPVASD
LNVIVHSATGVKQASGALLRPVASD

SEQ ID NO: 7133 - protein, 25 aa, synthetic construct
  source 1..25: note = Seed: LNVIVHSATGFKQSSKALQRPVASD
LNVIVHSATGVKQASGALMRPVASD

SEQ ID NO: 7134 - protein, 25 aa, synthetic construct
  source 1..25: note = Seed: LNVIVHSATGFKQSSKALQRPVASD
LNVIVHSATGVKQASGALVRPVASD

SEQ ID NO: 7135 - protein, 25 aa, synthetic construct
  source 1..25: note = Seed: LNVIVHSATGFKQSSKALQRPVASD
LNVIVHSATGVKQASIALARPVASD

SEQ ID NO: 7136 - protein, 25 aa, synthetic construct
  source 1..25: note = Seed: LNVIVHSATGFKQSSKALQRPVASD
LNVIVHSATGVKQASIALSRPVASD

SEQ ID NO: 7137 - protein, 25 aa, synthetic construct
  source 1..25: note = Seed: LNVIVHSATGFKQSSKALQRPVASD
LNVIVHSATGVKQASKALARPVASD

SEQ ID NO: 7138 - protein, 25 aa, synthetic construct
  source 1..25: note = Seed: LNVIVHSATGFKQSSKALQRPVASD
LNVIVHSATGVKQASKALRRPVASD

SEQ ID NO: 7139 - protein, 25 aa, synthetic construct
  source 1..25: note = Seed: LNVIVHSATGFKQSSKALQRPVASD
LNVIVHSATGVKQASKALSRPVASD

SEQ ID NO: 7140 - protein, 25 aa, synthetic construct
  source 1..25: note = Seed: LNVIVHSATGFKQSSKALQRPVASD
LNVIVHSATGVKQASLALARPVASD

SEQ ID NO: 7141 - protein, 25 aa, synthetic construct
  source 1..25: note = Seed: LNVIVHSATGFKQSSKALQRPVASD
LNVIVHSATGVKQASPALARPVASD

SEQ ID NO: 7142 - protein, 25 aa, synthetic construct
  source 1..25: note = Seed: LNVIVHSATGFKQSSKALQRPVASD
LNVIVHSATGVKQASPALIRPVASD

SEQ ID NO: 7143 - protein, 25 aa, synthetic construct
  source 1..25: note = Seed: LNVIVHSATGFKQSSKALQRPVASD
LNVIVHSATGVKQASPALLRPVASD

SEQ ID NO: 7144 - protein, 25 aa, synthetic construct
  source 1..25: note = Seed: LNVIVHSATGFKQSSKALQRPVASD
LNVIVHSATGVKQASPALVRPVASD

SEQ ID NO: 7145 - protein, 25 aa, synthetic construct
  source 1..25: note = Seed: LNVIVHSATGFKQSSKALQRPVASD
LNVIVHSATGVKQASRALARPVASD

SEQ ID NO: 7146 - protein, 25 aa, synthetic construct
  source 1..25: note = Seed: LNVIVHSATGFKQSSKALQRPVASD
LNVIVHSATGVKQASRALGRPVASD

SEQ ID NO: 7147 - protein, 25 aa, synthetic construct
  source 1..25: note = Seed: LNVIVHSATGFKQSSKALQRPVASD
LNVIVHSATGVKQASRALHRPVASD

SEQ ID NO: 7148 - protein, 25 aa, synthetic construct
  source 1..25: note = Seed: LNVIVHSATGFKQSSKALQRPVASD
LNVIVHSATGVKQASRALKRPVASD

SEQ ID NO: 7149 - protein, 25 aa, synthetic construct
  source 1..25: note = Seed: LNVIVHSATGFKQSSKALQRPVASD
LNVIVHSATGVKQASRALQRPVASD

SEQ ID NO: 7150 - protein, 25 aa, synthetic construct
  source 1..25: note = Seed: LNVIVHSATGFKQSSKALQRPVASD
LNVIVHSATGVKQASRALRRPVASD

SEQ ID NO: 7151 - protein, 25 aa, synthetic construct
  source 1..25: note = Seed: LNVIVHSATGFKQSSKALQRPVASD
LNVIVHSATGVKQASRALSRPVASD

SEQ ID NO: 7152 - protein, 25 aa, synthetic construct
  source 1..25: note = Seed: LNVIVHSATGFKQSSKALQRPVASD
LNVIVHSATGVKQASRALTRPVASD

SEQ ID NO: 7153 - protein, 25 aa, synthetic construct
  source 1..25: note = Seed: LNVIVHSATGFKQSSKALQRPVASD
LNVIVHSATGVKQASRALYRPVASD

SEQ ID NO: 7154 - protein, 25 aa, synthetic construct
  source 1..25: note = Seed: LNVIVHSATGFKQSSKALQRPVASD
LNVIVHSATGVKQASSALARPVASD

SEQ ID NO: 7155 - protein, 25 aa, synthetic construct
  source 1..25: note = Seed: LNVIVHSATGFKQSSKALQRPVASD
LNVIVHSATGVKQASSALIRPVASD

SEQ ID NO: 7156 - protein, 25 aa, synthetic construct
  source 1..25: note = Seed: LNVIVHSATGFKQSSKALQRPVASD
LNVIVHSATGVKQASSALLRPVASD

SEQ ID NO: 7157 - protein, 25 aa, synthetic construct
  source 1..25: note = Seed: LNVIVHSATGFKQSSKALQRPVASD
LNVIVHSATGVKQASSALVRPVASD

SEQ ID NO: 7158 - protein, 25 aa, synthetic construct
  source 1..25: note = Seed: LNVIVHSATGFKQSSKALQRPVASD
LNVIVHSATGVKQASVALARPVASD

SEQ ID NO: 7159 - protein, 25 aa, synthetic construct
  source 1..25: note = Seed: LNVIVHSATGFKQSSKALQRPVASD
LNVIVHSATGVKQASVALMRPVASD

SEQ ID NO: 7160 - protein, 25 aa, synthetic construct
  source 1..25: note = Seed: LNVIVHSATGFKQSSKALQRPVASD
LNVIVHSATGVKQASVALSRPVASD

SEQ ID NO: 7161 - protein, 25 aa, synthetic construct
  source 1..25: note = Seed: LNVIVHSATGFKQSSKALQRPVASD
LNVIVHSATGVKQCSAALARPVASD

SEQ ID NO: 7162 - protein, 25 aa, synthetic construct
  source 1..25: note = Seed: LNVIVHSATGFKQSSKALQRPVASD
LNVIVHSATGVKQESAALLRPVASD

SEQ ID NO: 7163 - protein, 25 aa, synthetic construct
  source 1..25: note = Seed: LNVIVHSATGFKQSSKALQRPVASD
LNVIVHSATGVKQESAALVRPVASD

SEQ ID NO: 7164 - protein, 25 aa, synthetic construct
  source 1..25: note = Seed: LNVIVHSATGFKQSSKALQRPVASD
LNVIVHSATGVKQESIALARPVASD

SEQ ID NO: 7165 - protein, 25 aa, synthetic construct
  source 1..25: note = Seed: LNVIVHSATGFKQSSKALQRPVASD
LNVIVHSATGVKQFSAALIRPVASD

SEQ ID NO: 7166 - protein, 25 aa, synthetic construct
  source 1..25: note = Seed: LNVIVHSATGFKQSSKALQRPVASD
LNVIVHSATGVKQFSAALLRPVASD

SEQ ID NO: 7167 - protein, 25 aa, synthetic construct
  source 1..25: note = Seed: LNVIVHSATGFKQSSKALQRPVASD
LNVIVHSATGVKQFSAALMRPVASD

SEQ ID NO: 7168 - protein, 25 aa, synthetic construct
  source 1..25: note = Seed: LNVIVHSATGFKQSSKALQRPVASD
LNVIVHSATGVKQFSAALRRPVASD

SEQ ID NO: 7169 - protein, 25 aa, synthetic construct
  source 1..25: note = Seed: LNVIVHSATGFKQSSKALQRPVASD
LNVIVHSATGVKQFSAALVRPVASD

SEQ ID NO: 7170 - protein, 25 aa, synthetic construct
  source 1..25: note = Seed: LNVIVHSATGFKQSSKALQRPVASD
LNVIVHSATGVKQFSGALARPVASD

SEQ ID NO: 7171 - protein, 25 aa, synthetic construct
  source 1..25: note = Seed: LNVIVHSATGFKQSSKALQRPVASD
LNVIVHSATGVKQFSGALIRPVASD

SEQ ID NO: 7172 - protein, 25 aa, synthetic construct
  source 1..25: note = Seed: LNVIVHSATGFKQSSKALQRPVASD
LNVIVHSATGVKQFSGALLRPVASD

SEQ ID NO: 7173 - protein, 25 aa, synthetic construct
  source 1..25: note = Seed: LNVIVHSATGFKQSSKALQRPVASD
LNVIVHSATGVKQFSGALMRPVASD

SEQ ID NO: 7174 - protein, 25 aa, synthetic construct
  source 1..25: note = Seed: LNVIVHSATGFKQSSKALQRPVASD
LNVIVHSATGVKQFSGALVRPVASD

SEQ ID NO: 7175 - protein, 25 aa, synthetic construct
  source 1..25: note = Seed: LNVIVHSATGFKQSSKALQRPVASD
LNVIVHSATGVKQFSHALKRPVASD

SEQ ID NO: 7176 - protein, 25 aa, synthetic construct
  source 1..25: note = Seed: LNVIVHSATGFKQSSKALQRPVASD
LNVIVHSATGVKQFSHALRRPVASD

SEQ ID NO: 7177 - protein, 25 aa, synthetic construct
  source 1..25: note = Seed: LNVIVHSATGFKQSSKALQRPVASD
LNVIVHSATGVKQFSIALRRPVASD

SEQ ID NO: 7178 - protein, 25 aa, synthetic construct
  source 1..25: note = Seed: LNVIVHSATGFKQSSKALQRPVASD
LNVIVHSATGVKQFSKALARPVASD

SEQ ID NO: 7179 - protein, 25 aa, synthetic construct
  source 1..25: note = Seed: LNVIVHSATGFKQSSKALQRPVASD
LNVIVHSATGVKQFSKALGRPVASD

SEQ ID NO: 7180 - protein, 25 aa, synthetic construct
  source 1..25: note = Seed: LNVIVHSATGFKQSSKALQRPVASD
LNVIVHSATGVKQFSKALHRPVASD

SEQ ID NO: 7181 - protein, 25 aa, synthetic construct
  source 1..25: note = Seed: LNVIVHSATGFKQSSKALQRPVASD
LNVIVHSATGVKQFSKALKRPVASD

SEQ ID NO: 7182 - protein, 25 aa, synthetic construct
  source 1..25: note = Seed: LNVIVHSATGFKQSSKALQRPVASD
LNVIVHSATGVKQFSKALMRPVASD

SEQ ID NO: 7183 - protein, 25 aa, synthetic construct
  source 1..25: note = Seed: LNVIVHSATGFKQSSKALQRPVASD
LNVIVHSATGVKQFSKALQRPVASD

SEQ ID NO: 7184 - protein, 25 aa, synthetic construct
  source 1..25: note = Seed: LNVIVHSATGFKQSSKALQRPVASD
LNVIVHSATGVKQFSKALRRPVASD

SEQ ID NO: 7185 - protein, 25 aa, synthetic construct
  source 1..25: note = Seed: LNVIVHSATGFKQSSKALQRPVASD
LNVIVHSATGVKQFSKALSRPVASD

SEQ ID NO: 7186 - protein, 25 aa, synthetic construct
  source 1..25: note = Seed: LNVIVHSATGFKQSSKALQRPVASD
LNVIVHSATGVKQFSKALTRPVASD

SEQ ID NO: 7187 - protein, 25 aa, synthetic construct
  source 1..25: note = Seed: LNVIVHSATGFKQSSKALQRPVASD
LNVIVHSATGVKQFSKALYRPVASD

SEQ ID NO: 7188 - protein, 25 aa, synthetic construct
  source 1..25: note = Seed: LNVIVHSATGFKQSSKALQRPVASD
LNVIVHSATGVKQFSLALRRPVASD

SEQ ID NO: 7189 - protein, 25 aa, synthetic construct
  source 1..25: note = Seed: LNVIVHSATGFKQSSKALQRPVASD
LNVIVHSATGVKQFSNALARPVASD

SEQ ID NO: 7190 - protein, 25 aa, synthetic construct
  source 1..25: note = Seed: LNVIVHSATGFKQSSKALQRPVASD
LNVIVHSATGVKQFSNALIRPVASD

SEQ ID NO: 7191 - protein, 25 aa, synthetic construct
  source 1..25: note = Seed: LNVIVHSATGFKQSSKALQRPVASD
LNVIVHSATGVKQFSPALIRPVASD

SEQ ID NO: 7192 - protein, 25 aa, synthetic construct
  source 1..25: note = Seed: LNVIVHSATGFKQSSKALQRPVASD
LNVIVHSATGVKQFSPALLRPVASD

SEQ ID NO: 7193 - protein, 25 aa, synthetic construct
  source 1..25: note = Seed: LNVIVHSATGFKQSSKALQRPVASD
LNVIVHSATGVKQFSPALMRPVASD

SEQ ID NO: 7194 - protein, 25 aa, synthetic construct
  source 1..25: note = Seed: LNVIVHSATGFKQSSKALQRPVASD
LNVIVHSATGVKQFSPALNRPVASD

SEQ ID NO: 7195 - protein, 25 aa, synthetic construct
  source 1..25: note = Seed: LNVIVHSATGFKQSSKALQRPVASD
LNVIVHSATGVKQFSPALRRPVASD

SEQ ID NO: 7196 - protein, 25 aa, synthetic construct
  source 1..25: note = Seed: LNVIVHSATGFKQSSKALQRPVASD
LNVIVHSATGVKQFSRALARPVASD

SEQ ID NO: 7197 - protein, 25 aa, synthetic construct
  source 1..25: note = Seed: LNVIVHSATGFKQSSKALQRPVASD
LNVIVHSATGVKQFSRALGRPVASD

SEQ ID NO: 7198 - protein, 25 aa, synthetic construct
  source 1..25: note = Seed: LNVIVHSATGFKQSSKALQRPVASD
LNVIVHSATGVKQFSRALHRPVASD

SEQ ID NO: 7199 - protein, 25 aa, synthetic construct
  source 1..25: note = Seed: LNVIVHSATGFKQSSKALQRPVASD
LNVIVHSATGVKQFSRALIRPVASD

SEQ ID NO: 7200 - protein, 25 aa, synthetic construct
  source 1..25: note = Seed: LNVIVHSATGFKQSSKALQRPVASD
LNVIVHSATGVKQFSRALKRPVASD

SEQ ID NO: 7201 - protein, 25 aa, synthetic construct
  source 1..25: note = Seed: LNVIVHSATGFKQSSKALQRPVASD
LNVIVHSATGVKQFSRALLRPVASD

SEQ ID NO: 7202 - protein, 25 aa, synthetic construct
  source 1..25: note = Seed: LNVIVHSATGFKQSSKALQRPVASD
LNVIVHSATGVKQFSRALMRPVASD

SEQ ID NO: 7203 - protein, 25 aa, synthetic construct
  source 1..25: note = Seed: LNVIVHSATGFKQSSKALQRPVASD
LNVIVHSATGVKQFSRALQRPVASD

SEQ ID NO: 7204 - protein, 25 aa, synthetic construct
  source 1..25: note = Seed: LNVIVHSATGFKQSSKALQRPVASD
LNVIVHSATGVKQFSRALRRPVASD

SEQ ID NO: 7205 - protein, 25 aa, synthetic construct
  source 1..25: note = Seed: LNVIVHSATGFKQSSKALQRPVASD
LNVIVHSATGVKQFSRALSRPVASD

SEQ ID NO: 7206 - protein, 25 aa, synthetic construct
  source 1..25: note = Seed: LNVIVHSATGFKQSSKALQRPVASD
LNVIVHSATGVKQFSRALTRPVASD

SEQ ID NO: 7207 - protein, 25 aa, synthetic construct
  source 1..25: note = Seed: LNVIVHSATGFKQSSKALQRPVASD
LNVIVHSATGVKQFSRALVRPVASD

SEQ ID NO: 7208 - protein, 25 aa, synthetic construct
  source 1..25: note = Seed: LNVIVHSATGFKQSSKALQRPVASD
LNVIVHSATGVKQFSRALYRPVASD

SEQ ID NO: 7209 - protein, 25 aa, synthetic construct
  source 1..25: note = Seed: LNVIVHSATGFKQSSKALQRPVASD
LNVIVHSATGVKQFSSALARPVASD

SEQ ID NO: 7210 - protein, 25 aa, synthetic construct
  source 1..25: note = Seed: LNVIVHSATGFKQSSKALQRPVASD
LNVIVHSATGVKQFSSALGRPVASD

SEQ ID NO: 7211 - protein, 25 aa, synthetic construct
  source 1..25: note = Seed: LNVIVHSATGFKQSSKALQRPVASD
LNVIVHSATGVKQFSSALIRPVASD

SEQ ID NO: 7212 - protein, 25 aa, synthetic construct
  source 1..25: note = Seed: LNVIVHSATGFKQSSKALQRPVASD
LNVIVHSATGVKQFSSALLRPVASD

SEQ ID NO: 7213 - protein, 25 aa, synthetic construct
  source 1..25: note = Seed: LNVIVHSATGFKQSSKALQRPVASD
LNVIVHSATGVKQFSSALMRPVASD

SEQ ID NO: 7214 - protein, 25 aa, synthetic construct
  source 1..25: note = Seed: LNVIVHSATGFKQSSKALQRPVASD
LNVIVHSATGVKQFSSALRRPVASD

SEQ ID NO: 7215 - protein, 25 aa, synthetic construct
  source 1..25: note = Seed: LNVIVHSATGFKQSSKALQRPVASD
LNVIVHSATGVKQFSSALTRPVASD

SEQ ID NO: 7216 - protein, 25 aa, synthetic construct
  source 1..25: note = Seed: LNVIVHSATGFKQSSKALQRPVASD
LNVIVHSATGVKQFSSALVRPVASD

SEQ ID NO: 7217 - protein, 25 aa, synthetic construct
  source 1..25: note = Seed: LNVIVHSATGFKQSSKALQRPVASD
LNVIVHSATGVKQFSTALLRPVASD

SEQ ID NO: 7218 - protein, 25 aa, synthetic construct
  source 1..25: note = Seed: LNVIVHSATGFKQSSKALQRPVASD
LNVIVHSATGVKQFSTALRRPVASD

SEQ ID NO: 7219 - protein, 25 aa, synthetic construct
  source 1..25: note = Seed: LNVIVHSATGFKQSSKALQRPVASD
LNVIVHSATGVKQFSVALHRPVASD

SEQ ID NO: 7220 - protein, 25 aa, synthetic construct
  source 1..25: note = Seed: LNVIVHSATGFKQSSKALQRPVASD
LNVIVHSATGVKQFSVALQRPVASD

SEQ ID NO: 7221 - protein, 25 aa, synthetic construct
  source 1..25: note = Seed: LNVIVHSATGFKQSSKALQRPVASD
LNVIVHSATGVKQFSVALRRPVASD

SEQ ID NO: 7222 - protein, 25 aa, synthetic construct
  source 1..25: note = Seed: LNVIVHSATGFKQSSKALQRPVASD
LNVIVHSATGVKQGSAALLRPVASD

SEQ ID NO: 7223 - protein, 25 aa, synthetic construct
  source 1..25: note = Seed: LNVIVHSATGFKQSSKALQRPVASD
LNVIVHSATGVKQHSAALRRPVASD

SEQ ID NO: 7224 - protein, 25 aa, synthetic construct
  source 1..25: note = Seed: LNVIVHSATGFKQSSKALQRPVASD
LNVIVHSATGVKQHSIALRRPVASD

SEQ ID NO: 7225 - protein, 25 aa, synthetic construct
  source 1..25: note = Seed: LNVIVHSATGFKQSSKALQRPVASD
LNVIVHSATGVKQHSKALRRPVASD

SEQ ID NO: 7226 - protein, 25 aa, synthetic construct
  source 1..25: note = Seed: LNVIVHSATGFKQSSKALQRPVASD
LNVIVHSATGVKQHSRALFRPVASD

SEQ ID NO: 7227 - protein, 25 aa, synthetic construct
  source 1..25: note = Seed: LNVIVHSATGFKQSSKALQRPVASD
LNVIVHSATGVKQHSRALIRPVASD

SEQ ID NO: 7228 - protein, 25 aa, synthetic construct
  source 1..25: note = Seed: LNVIVHSATGFKQSSKALQRPVASD
LNVIVHSATGVKQHSRALKRPVASD

SEQ ID NO: 7229 - protein, 25 aa, synthetic construct
  source 1..25: note = Seed: LNVIVHSATGFKQSSKALQRPVASD
LNVIVHSATGVKQHSRALLRPVASD

SEQ ID NO: 7230 - protein, 25 aa, synthetic construct
  source 1..25: note = Seed: LNVIVHSATGFKQSSKALQRPVASD
LNVIVHSATGVKQHSRALMRPVASD

SEQ ID NO: 7231 - protein, 25 aa, synthetic construct
  source 1..25: note = Seed: LNVIVHSATGFKQSSKALQRPVASD
LNVIVHSATGVKQHSRALRRPVASD

SEQ ID NO: 7232 - protein, 25 aa, synthetic construct
  source 1..25: note = Seed: LNVIVHSATGFKQSSKALQRPVASD
LNVIVHSATGVKQHSRALVRPVASD

SEQ ID NO: 7233 - protein, 25 aa, synthetic construct
  source 1..25: note = Seed: LNVIVHSATGFKQSSKALQRPVASD
LNVIVHSATGVKQHSRALYRPVASD

SEQ ID NO: 7234 - protein, 25 aa, synthetic construct
  source 1..25: note = Seed: LNVIVHSATGFKQSSKALQRPVASD
LNVIVHSATGVKQHSVALRRPVASD

SEQ ID NO: 7235 - protein, 25 aa, synthetic construct
  source 1..25: note = Seed: LNVIVHSATGFKQSSKALQRPVASD
LNVIVHSATGVKQISAALARPVASD

SEQ ID NO: 7236 - protein, 25 aa, synthetic construct
  source 1..25: note = Seed: LNVIVHSATGFKQSSKALQRPVASD
LNVIVHSATGVKQISAALGRPVASD

SEQ ID NO: 7237 - protein, 25 aa, synthetic construct
  source 1..25: note = Seed: LNVIVHSATGFKQSSKALQRPVASD
LNVIVHSATGVKQISAALIRPVASD

SEQ ID NO: 7238 - protein, 25 aa, synthetic construct
  source 1..25: note = Seed: LNVIVHSATGFKQSSKALQRPVASD
LNVIVHSATGVKQISAALLRPVASD

SEQ ID NO: 7239 - protein, 25 aa, synthetic construct
  source 1..25: note = Seed: LNVIVHSATGFKQSSKALQRPVASD
LNVIVHSATGVKQISAALMRPVASD

SEQ ID NO: 7240 - protein, 25 aa, synthetic construct
  source 1..25: note = Seed: LNVIVHSATGFKQSSKALQRPVASD
LNVIVHSATGVKQISAALNRPVASD

SEQ ID NO: 7241 - protein, 25 aa, synthetic construct
  source 1..25: note = Seed: LNVIVHSATGFKQSSKALQRPVASD
LNVIVHSATGVKQISAALRRPVASD

SEQ ID NO: 7242 - protein, 25 aa, synthetic construct
  source 1..25: note = Seed: LNVIVHSATGFKQSSKALQRPVASD
LNVIVHSATGVKQISAALSRPVASD

SEQ ID NO: 7243 - protein, 25 aa, synthetic construct
  source 1..25: note = Seed: LNVIVHSATGFKQSSKALQRPVASD
LNVIVHSATGVKQISAALTRPVASD

SEQ ID NO: 7244 - protein, 25 aa, synthetic construct
  source 1..25: note = Seed: LNVIVHSATGFKQSSKALQRPVASD
LNVIVHSATGVKQISAALVRPVASD

SEQ ID NO: 7245 - protein, 25 aa, synthetic construct
  source 1..25: note = Seed: LNVIVHSATGFKQSSKALQRPVASD
LNVIVHSATGVKQISFALVRPVASD

SEQ ID NO: 7246 - protein, 25 aa, synthetic construct
  source 1..25: note = Seed: LNVIVHSATGFKQSSKALQRPVASD
LNVIVHSATGVKQISGALARPVASD

SEQ ID NO: 7247 - protein, 25 aa, synthetic construct
  source 1..25: note = Seed: LNVIVHSATGFKQSSKALQRPVASD
LNVIVHSATGVKQISGALGRPVASD

SEQ ID NO: 7248 - protein, 25 aa, synthetic construct
  source 1..25: note = Seed: LNVIVHSATGFKQSSKALQRPVASD
LNVIVHSATGVKQISGALIRPVASD

SEQ ID NO: 7249 - protein, 25 aa, synthetic construct
  source 1..25: note = Seed: LNVIVHSATGFKQSSKALQRPVASD
LNVIVHSATGVKQISGALLRPVASD

SEQ ID NO: 7250 - protein, 25 aa, synthetic construct
  source 1..25: note = Seed: LNVIVHSATGFKQSSKALQRPVASD
LNVIVHSATGVKQISGALMRPVASD

SEQ ID NO: 7251 - protein, 25 aa, synthetic construct
  source 1..25: note = Seed: LNVIVHSATGFKQSSKALQRPVASD
LNVIVHSATGVKQISGALSRPVASD

SEQ ID NO: 7252 - protein, 25 aa, synthetic construct
  source 1..25: note = Seed: LNVIVHSATGFKQSSKALQRPVASD
LNVIVHSATGVKQISGALTRPVASD

SEQ ID NO: 7253 - protein, 25 aa, synthetic construct
  source 1..25: note = Seed: LNVIVHSATGFKQSSKALQRPVASD
LNVIVHSATGVKQISGALVRPVASD

SEQ ID NO: 7254 - protein, 25 aa, synthetic construct
  source 1..25: note = Seed: LNVIVHSATGFKQSSKALQRPVASD
LNVIVHSATGVKQISHALARPVASD

SEQ ID NO: 7255 - protein, 25 aa, synthetic construct
  source 1..25: note = Seed: LNVIVHSATGFKQSSKALQRPVASD
LNVIVHSATGVKQISHALRRPVASD

SEQ ID NO: 7256 - protein, 25 aa, synthetic construct
  source 1..25: note = Seed: LNVIVHSATGFKQSSKALQRPVASD
LNVIVHSATGVKQISIALGRPVASD

SEQ ID NO: 7257 - protein, 25 aa, synthetic construct
  source 1..25: note = Seed: LNVIVHSATGFKQSSKALQRPVASD
LNVIVHSATGVKQISIALNRPVASD

SEQ ID NO: 7258 - protein, 25 aa, synthetic construct
  source 1..25: note = Seed: LNVIVHSATGFKQSSKALQRPVASD
LNVIVHSATGVKQISIALSRPVASD

SEQ ID NO: 7259 - protein, 25 aa, synthetic construct
  source 1..25: note = Seed: LNVIVHSATGFKQSSKALQRPVASD
LNVIVHSATGVKQISKALARPVASD

SEQ ID NO: 7260 - protein, 25 aa, synthetic construct
  source 1..25: note = Seed: LNVIVHSATGFKQSSKALQRPVASD
LNVIVHSATGVKQISKALFRPVASD

SEQ ID NO: 7261 - protein, 25 aa, synthetic construct
  source 1..25: note = Seed: LNVIVHSATGFKQSSKALQRPVASD
LNVIVHSATGVKQISKALGRPVASD

SEQ ID NO: 7262 - protein, 25 aa, synthetic construct
  source 1..25: note = Seed: LNVIVHSATGFKQSSKALQRPVASD
LNVIVHSATGVKQISKALHRPVASD

SEQ ID NO: 7263 - protein, 25 aa, synthetic construct
  source 1..25: note = Seed: LNVIVHSATGFKQSSKALQRPVASD
LNVIVHSATGVKQISKALIRPVASD

SEQ ID NO: 7264 - protein, 25 aa, synthetic construct
  source 1..25: note = Seed: LNVIVHSATGFKQSSKALQRPVASD
LNVIVHSATGVKQISKALKRPVASD

SEQ ID NO: 7265 - protein, 25 aa, synthetic construct
  source 1..25: note = Seed: LNVIVHSATGFKQSSKALQRPVASD
LNVIVHSATGVKQISKALLRPVASD

SEQ ID NO: 7266 - protein, 25 aa, synthetic construct
  source 1..25: note = Seed: LNVIVHSATGFKQSSKALQRPVASD
LNVIVHSATGVKQISKALMRPVASD

SEQ ID NO: 7267 - protein, 25 aa, synthetic construct
  source 1..25: note = Seed: LNVIVHSATGFKQSSKALQRPVASD
LNVIVHSATGVKQISKALNRPVASD

SEQ ID NO: 7268 - protein, 25 aa, synthetic construct
  source 1..25: note = Seed: LNVIVHSATGFKQSSKALQRPVASD
LNVIVHSATGVKQISKALPRPVASD

SEQ ID NO: 7269 - protein, 25 aa, synthetic construct
  source 1..25: note = Seed: LNVIVHSATGFKQSSKALQRPVASD
LNVIVHSATGVKQISKALQRPVASD

SEQ ID NO: 7270 - protein, 25 aa, synthetic construct
  source 1..25: note = Seed: LNVIVHSATGFKQSSKALQRPVASD
LNVIVHSATGVKQISKALRRPVASD

SEQ ID NO: 7271 - protein, 25 aa, synthetic construct
  source 1..25: note = Seed: LNVIVHSATGFKQSSKALQRPVASD
LNVIVHSATGVKQISKALSRPVASD

SEQ ID NO: 7272 - protein, 25 aa, synthetic construct
  source 1..25: note = Seed: LNVIVHSATGFKQSSKALQRPVASD
LNVIVHSATGVKQISKALTRPVASD

SEQ ID NO: 7273 - protein, 25 aa, synthetic construct
  source 1..25: note = Seed: LNVIVHSATGFKQSSKALQRPVASD
LNVIVHSATGVKQISKALVRPVASD

SEQ ID NO: 7274 - protein, 25 aa, synthetic construct
  source 1..25: note = Seed: LNVIVHSATGFKQSSKALQRPVASD
LNVIVHSATGVKQISKALYRPVASD

SEQ ID NO: 7275 - protein, 25 aa, synthetic construct
  source 1..25: note = Seed: LNVIVHSATGFKQSSKALQRPVASD
LNVIVHSATGVKQISLALNRPVASD

SEQ ID NO: 7276 - protein, 25 aa, synthetic construct
  source 1..25: note = Seed: LNVIVHSATGFKQSSKALQRPVASD
LNVIVHSATGVKQISNALARPVASD

SEQ ID NO: 7277 - protein, 25 aa, synthetic construct
  source 1..25: note = Seed: LNVIVHSATGFKQSSKALQRPVASD
LNVIVHSATGVKQISNALIRPVASD

SEQ ID NO: 7278 - protein, 25 aa, synthetic construct
  source 1..25: note = Seed: LNVIVHSATGFKQSSKALQRPVASD
LNVIVHSATGVKQISNALVRPVASD

SEQ ID NO: 7279 - protein, 25 aa, synthetic construct
  source 1..25: note = Seed: LNVIVHSATGFKQSSKALQRPVASD
LNVIVHSATGVKQISPALARPVASD

SEQ ID NO: 7280 - protein, 25 aa, synthetic construct
  source 1..25: note = Seed: LNVIVHSATGFKQSSKALQRPVASD
LNVIVHSATGVKQISPALIRPVASD

SEQ ID NO: 7281 - protein, 25 aa, synthetic construct
  source 1..25: note = Seed: LNVIVHSATGFKQSSKALQRPVASD
LNVIVHSATGVKQISPALLRPVASD

SEQ ID NO: 7282 - protein, 25 aa, synthetic construct
  source 1..25: note = Seed: LNVIVHSATGFKQSSKALQRPVASD
LNVIVHSATGVKQISPALNRPVASD

SEQ ID NO: 7283 - protein, 25 aa, synthetic construct
  source 1..25: note = Seed: LNVIVHSATGFKQSSKALQRPVASD
LNVIVHSATGVKQISPALSRPVASD

SEQ ID NO: 7284 - protein, 25 aa, synthetic construct
  source 1..25: note = Seed: LNVIVHSATGFKQSSKALQRPVASD
LNVIVHSATGVKQISPALTRPVASD

SEQ ID NO: 7285 - protein, 25 aa, synthetic construct
  source 1..25: note = Seed: LNVIVHSATGFKQSSKALQRPVASD
LNVIVHSATGVKQISPALVRPVASD

SEQ ID NO: 7286 - protein, 25 aa, synthetic construct
  source 1..25: note = Seed: LNVIVHSATGFKQSSKALQRPVASD
LNVIVHSATGVKQISRALARPVASD

SEQ ID NO: 7287 - protein, 25 aa, synthetic construct
  source 1..25: note = Seed: LNVIVHSATGFKQSSKALQRPVASD
LNVIVHSATGVKQISRALFRPVASD

SEQ ID NO: 7288 - protein, 25 aa, synthetic construct
  source 1..25: note = Seed: LNVIVHSATGFKQSSKALQRPVASD
LNVIVHSATGVKQISRALGRPVASD

SEQ ID NO: 7289 - protein, 25 aa, synthetic construct
  source 1..25: note = Seed: LNVIVHSATGFKQSSKALQRPVASD
LNVIVHSATGVKQISRALHRPVASD

SEQ ID NO: 7290 - protein, 25 aa, synthetic construct
  source 1..25: note = Seed: LNVIVHSATGFKQSSKALQRPVASD
LNVIVHSATGVKQISRALIRPVASD

SEQ ID NO: 7291 - protein, 25 aa, synthetic construct
  source 1..25: note = Seed: LNVIVHSATGFKQSSKALQRPVASD
LNVIVHSATGVKQISRALKRPVASD

SEQ ID NO: 7292 - protein, 25 aa, synthetic construct
  source 1..25: note = Seed: LNVIVHSATGFKQSSKALQRPVASD
LNVIVHSATGVKQISRALLRPVASD

SEQ ID NO: 7293 - protein, 25 aa, synthetic construct
  source 1..25: note = Seed: LNVIVHSATGFKQSSKALQRPVASD
LNVIVHSATGVKQISRALMRPVASD

SEQ ID NO: 7294 - protein, 25 aa, synthetic construct
  source 1..25: note = Seed: LNVIVHSATGFKQSSKALQRPVASD
LNVIVHSATGVKQISRALNRPVASD

SEQ ID NO: 7295 - protein, 25 aa, synthetic construct
  source 1..25: note = Seed: LNVIVHSATGFKQSSKALQRPVASD
LNVIVHSATGVKQISRALPRPVASD

SEQ ID NO: 7296 - protein, 25 aa, synthetic construct
  source 1..25: note = Seed: LNVIVHSATGFKQSSKALQRPVASD
LNVIVHSATGVKQISRALQRPVASD

SEQ ID NO: 7297 - protein, 25 aa, synthetic construct
  source 1..25: note = Seed: LNVIVHSATGFKQSSKALQRPVASD
LNVIVHSATGVKQISRALRRPVASD

SEQ ID NO: 7298 - protein, 25 aa, synthetic construct
  source 1..25: note = Seed: LNVIVHSATGFKQSSKALQRPVASD
LNVIVHSATGVKQISRALSRPVASD

SEQ ID NO: 7299 - protein, 25 aa, synthetic construct
  source 1..25: note = Seed: LNVIVHSATGFKQSSKALQRPVASD
LNVIVHSATGVKQISRALTRPVASD

SEQ ID NO: 7300 - protein, 25 aa, synthetic construct
  source 1..25: note = Seed: LNVIVHSATGFKQSSKALQRPVASD
LNVIVHSATGVKQISRALVRPVASD

SEQ ID NO: 7301 - protein, 25 aa, synthetic construct
  source 1..25: note = Seed: LNVIVHSATGFKQSSKALQRPVASD
LNVIVHSATGVKQISRALYRPVASD

SEQ ID NO: 7302 - protein, 25 aa, synthetic construct
  source 1..25: note = Seed: LNVIVHSATGFKQSSKALQRPVASD
LNVIVHSATGVKQISSALARPVASD

SEQ ID NO: 7303 - protein, 25 aa, synthetic construct
  source 1..25: note = Seed: LNVIVHSATGFKQSSKALQRPVASD
LNVIVHSATGVKQISSALIRPVASD

SEQ ID NO: 7304 - protein, 25 aa, synthetic construct
  source 1..25: note = Seed: LNVIVHSATGFKQSSKALQRPVASD
LNVIVHSATGVKQISSALLRPVASD

SEQ ID NO: 7305 - protein, 25 aa, synthetic construct
  source 1..25: note = Seed: LNVIVHSATGFKQSSKALQRPVASD
LNVIVHSATGVKQISSALMRPVASD

SEQ ID NO: 7306 - protein, 25 aa, synthetic construct
  source 1..25: note = Seed: LNVIVHSATGFKQSSKALQRPVASD
LNVIVHSATGVKQISSALNRPVASD

SEQ ID NO: 7307 - protein, 25 aa, synthetic construct
  source 1..25: note = Seed: LNVIVHSATGFKQSSKALQRPVASD
LNVIVHSATGVKQISSALRRPVASD

SEQ ID NO: 7308 - protein, 25 aa, synthetic construct
  source 1..25: note = Seed: LNVIVHSATGFKQSSKALQRPVASD
LNVIVHSATGVKQISSALSRPVASD

SEQ ID NO: 7309 - protein, 25 aa, synthetic construct
  source 1..25: note = Seed: LNVIVHSATGFKQSSKALQRPVASD
LNVIVHSATGVKQISSALTRPVASD

SEQ ID NO: 7310 - protein, 25 aa, synthetic construct
  source 1..25: note = Seed: LNVIVHSATGFKQSSKALQRPVASD
LNVIVHSATGVKQISSALVRPVASD

SEQ ID NO: 7311 - protein, 25 aa, synthetic construct
  source 1..25: note = Seed: LNVIVHSATGFKQSSKALQRPVASD
LNVIVHSATGVKQISTALARPVASD

SEQ ID NO: 7312 - protein, 25 aa, synthetic construct
  source 1..25: note = Seed: LNVIVHSATGFKQSSKALQRPVASD
LNVIVHSATGVKQISTALIRPVASD

SEQ ID NO: 7313 - protein, 25 aa, synthetic construct
  source 1..25: note = Seed: LNVIVHSATGFKQSSKALQRPVASD
LNVIVHSATGVKQISTALNRPVASD

SEQ ID NO: 7314 - protein, 25 aa, synthetic construct
  source 1..25: note = Seed: LNVIVHSATGFKQSSKALQRPVASD
LNVIVHSATGVKQISTALRRPVASD

SEQ ID NO: 7315 - protein, 25 aa, synthetic construct
  source 1..25: note = Seed: LNVIVHSATGFKQSSKALQRPVASD
LNVIVHSATGVKQISTALSRPVASD

SEQ ID NO: 7316 - protein, 25 aa, synthetic construct
  source 1..25: note = Seed: LNVIVHSATGFKQSSKALQRPVASD
LNVIVHSATGVKQISTALTRPVASD

SEQ ID NO: 7317 - protein, 25 aa, synthetic construct
  source 1..25: note = Seed: LNVIVHSATGFKQSSKALQRPVASD
LNVIVHSATGVKQISTALVRPVASD

SEQ ID NO: 7318 - protein, 25 aa, synthetic construct
  source 1..25: note = Seed: LNVIVHSATGFKQSSKALQRPVASD
LNVIVHSATGVKQISVALARPVASD

SEQ ID NO: 7319 - protein, 25 aa, synthetic construct
  source 1..25: note = Seed: LNVIVHSATGFKQSSKALQRPVASD
LNVIVHSATGVKQISVALIRPVASD

SEQ ID NO: 7320 - protein, 25 aa, synthetic construct
  source 1..25: note = Seed: LNVIVHSATGFKQSSKALQRPVASD
LNVIVHSATGVKQISVALMRPVASD

SEQ ID NO: 7321 - protein, 25 aa, synthetic construct
  source 1..25: note = Seed: LNVIVHSATGFKQSSKALQRPVASD
LNVIVHSATGVKQISVALNRPVASD

SEQ ID NO: 7322 - protein, 25 aa, synthetic construct
  source 1..25: note = Seed: LNVIVHSATGFKQSSKALQRPVASD
LNVIVHSATGVKQISVALRRPVASD

SEQ ID NO: 7323 - protein, 25 aa, synthetic construct
  source 1..25: note = Seed: LNVIVHSATGFKQSSKALQRPVASD
LNVIVHSATGVKQISVALSRPVASD

SEQ ID NO: 7324 - protein, 25 aa, synthetic construct
  source 1..25: note = Seed: LNVIVHSATGFKQSSKALQRPVASD
LNVIVHSATGVKQISVALTRPVASD

SEQ ID NO: 7325 - protein, 25 aa, synthetic construct
  source 1..25: note = Seed: LNVIVHSATGFKQSSKALQRPVASD
LNVIVHSATGVKQISVALVRPVASD

SEQ ID NO: 7326 - protein, 25 aa, synthetic construct
  source 1..25: note = Seed: LNVIVHSATGFKQSSKALQRPVASD
LNVIVHSATGVKQKSRALRRPVASD

SEQ ID NO: 7327 - protein, 25 aa, synthetic construct
  source 1..25: note = Seed: LNVIVHSATGFKQSSKALQRPVASD
LNVIVHSATGVKQLSAALARPVASD

SEQ ID NO: 7328 - protein, 25 aa, synthetic construct
  source 1..25: note = Seed: LNVIVHSATGFKQSSKALQRPVASD
LNVIVHSATGVKQLSAALCRPVASD

SEQ ID NO: 7329 - protein, 25 aa, synthetic construct
  source 1..25: note = Seed: LNVIVHSATGFKQSSKALQRPVASD
LNVIVHSATGVKQLSAALFRPVASD

SEQ ID NO: 7330 - protein, 25 aa, synthetic construct
  source 1..25: note = Seed: LNVIVHSATGFKQSSKALQRPVASD
LNVIVHSATGVKQLSAALGRPVASD

SEQ ID NO: 7331 - protein, 25 aa, synthetic construct
  source 1..25: note = Seed: LNVIVHSATGFKQSSKALQRPVASD
LNVIVHSATGVKQLSAALHRPVASD

SEQ ID NO: 7332 - protein, 25 aa, synthetic construct
  source 1..25: note = Seed: LNVIVHSATGFKQSSKALQRPVASD
LNVIVHSATGVKQLSAALIRPVASD

SEQ ID NO: 7333 - protein, 25 aa, synthetic construct
  source 1..25: note = Seed: LNVIVHSATGFKQSSKALQRPVASD
LNVIVHSATGVKQLSAALLRPVASD

SEQ ID NO: 7334 - protein, 25 aa, synthetic construct
  source 1..25: note = Seed: LNVIVHSATGFKQSSKALQRPVASD
LNVIVHSATGVKQLSAALMRPVASD

SEQ ID NO: 7335 - protein, 25 aa, synthetic construct
  source 1..25: note = Seed: LNVIVHSATGFKQSSKALQRPVASD
LNVIVHSATGVKQLSAALNRPVASD

SEQ ID NO: 7336 - protein, 25 aa, synthetic construct
  source 1..25: note = Seed: LNVIVHSATGFKQSSKALQRPVASD
LNVIVHSATGVKQLSAALPRPVASD

SEQ ID NO: 7337 - protein, 25 aa, synthetic construct
  source 1..25: note = Seed: LNVIVHSATGFKQSSKALQRPVASD
LNVIVHSATGVKQLSAALSRPVASD

SEQ ID NO: 7338 - protein, 25 aa, synthetic construct
  source 1..25: note = Seed: LNVIVHSATGFKQSSKALQRPVASD
LNVIVHSATGVKQLSAALTRPVASD

SEQ ID NO: 7339 - protein, 25 aa, synthetic construct
  source 1..25: note = Seed: LNVIVHSATGFKQSSKALQRPVASD
LNVIVHSATGVKQLSAALVRPVASD

SEQ ID NO: 7340 - protein, 25 aa, synthetic construct
  source 1..25: note = Seed: LNVIVHSATGFKQSSKALQRPVASD
LNVIVHSATGVKQLSGALARPVASD

SEQ ID NO: 7341 - protein, 25 aa, synthetic construct
  source 1..25: note = Seed: LNVIVHSATGFKQSSKALQRPVASD
LNVIVHSATGVKQLSGALCRPVASD

SEQ ID NO: 7342 - protein, 25 aa, synthetic construct
  source 1..25: note = Seed: LNVIVHSATGFKQSSKALQRPVASD
LNVIVHSATGVKQLSGALGRPVASD

SEQ ID NO: 7343 - protein, 25 aa, synthetic construct
  source 1..25: note = Seed: LNVIVHSATGFKQSSKALQRPVASD
LNVIVHSATGVKQLSGALIRPVASD

SEQ ID NO: 7344 - protein, 25 aa, synthetic construct
  source 1..25: note = Seed: LNVIVHSATGFKQSSKALQRPVASD
LNVIVHSATGVKQLSGALLRPVASD

SEQ ID NO: 7345 - protein, 25 aa, synthetic construct
  source 1..25: note = Seed: LNVIVHSATGFKQSSKALQRPVASD
LNVIVHSATGVKQLSGALMRPVASD

SEQ ID NO: 7346 - protein, 25 aa, synthetic construct
  source 1..25: note = Seed: LNVIVHSATGFKQSSKALQRPVASD
LNVIVHSATGVKQLSGALNRPVASD

SEQ ID NO: 7347 - protein, 25 aa, synthetic construct
  source 1..25: note = Seed: LNVIVHSATGFKQSSKALQRPVASD
LNVIVHSATGVKQLSGALPRPVASD

SEQ ID NO: 7348 - protein, 25 aa, synthetic construct
  source 1..25: note = Seed: LNVIVHSATGFKQSSKALQRPVASD
LNVIVHSATGVKQLSGALSRPVASD

SEQ ID NO: 7349 - protein, 25 aa, synthetic construct
  source 1..25: note = Seed: LNVIVHSATGFKQSSKALQRPVASD
LNVIVHSATGVKQLSGALTRPVASD

SEQ ID NO: 7350 - protein, 25 aa, synthetic construct
  source 1..25: note = Seed: LNVIVHSATGFKQSSKALQRPVASD
LNVIVHSATGVKQLSGALVRPVASD

SEQ ID NO: 7351 - protein, 25 aa, synthetic construct
  source 1..25: note = Seed: LNVIVHSATGFKQSSKALQRPVASD
LNVIVHSATGVKQLSHALIRPVASD

SEQ ID NO: 7352 - protein, 25 aa, synthetic construct
  source 1..25: note = Seed: LNVIVHSATGFKQSSKALQRPVASD
LNVIVHSATGVKQLSHALKRPVASD

SEQ ID NO: 7353 - protein, 25 aa, synthetic construct
  source 1..25: note = Seed: LNVIVHSATGFKQSSKALQRPVASD
LNVIVHSATGVKQLSHALRRPVASD

SEQ ID NO: 7354 - protein, 25 aa, synthetic construct
  source 1..25: note = Seed: LNVIVHSATGFKQSSKALQRPVASD
LNVIVHSATGVKQLSHALVRPVASD

SEQ ID NO: 7355 - protein, 25 aa, synthetic construct
  source 1..25: note = Seed: LNVIVHSATGFKQSSKALQRPVASD
LNVIVHSATGVKQLSIALARPVASD

SEQ ID NO: 7356 - protein, 25 aa, synthetic construct
  source 1..25: note = Seed: LNVIVHSATGFKQSSKALQRPVASD
LNVIVHSATGVKQLSIALGRPVASD

SEQ ID NO: 7357 - protein, 25 aa, synthetic construct
  source 1..25: note = Seed: LNVIVHSATGFKQSSKALQRPVASD
LNVIVHSATGVKQLSIALIRPVASD

SEQ ID NO: 7358 - protein, 25 aa, synthetic construct
  source 1..25: note = Seed: LNVIVHSATGFKQSSKALQRPVASD
LNVIVHSATGVKQLSIALLRPVASD

SEQ ID NO: 7359 - protein, 25 aa, synthetic construct
  source 1..25: note = Seed: LNVIVHSATGFKQSSKALQRPVASD
LNVIVHSATGVKQLSIALMRPVASD

SEQ ID NO: 7360 - protein, 25 aa, synthetic construct
  source 1..25: note = Seed: LNVIVHSATGFKQSSKALQRPVASD
LNVIVHSATGVKQLSIALNRPVASD

SEQ ID NO: 7361 - protein, 25 aa, synthetic construct
  source 1..25: note = Seed: LNVIVHSATGFKQSSKALQRPVASD
LNVIVHSATGVKQLSIALQRPVASD

SEQ ID NO: 7362 - protein, 25 aa, synthetic construct
  source 1..25: note = Seed: LNVIVHSATGFKQSSKALQRPVASD
LNVIVHSATGVKQLSIALRRPVASD

SEQ ID NO: 7363 - protein, 25 aa, synthetic construct
  source 1..25: note = Seed: LNVIVHSATGFKQSSKALQRPVASD
LNVIVHSATGVKQLSIALSRPVASD

SEQ ID NO: 7364 - protein, 25 aa, synthetic construct
  source 1..25: note = Seed: LNVIVHSATGFKQSSKALQRPVASD
LNVIVHSATGVKQLSIALTRPVASD

SEQ ID NO: 7365 - protein, 25 aa, synthetic construct
  source 1..25: note = Seed: LNVIVHSATGFKQSSKALQRPVASD
LNVIVHSATGVKQLSIALVRPVASD

SEQ ID NO: 7366 - protein, 25 aa, synthetic construct
  source 1..25: note = Seed: LNVIVHSATGFKQSSKALQRPVASD
LNVIVHSATGVKQLSKALARPVASD

SEQ ID NO: 7367 - protein, 25 aa, synthetic construct
  source 1..25: note = Seed: LNVIVHSATGFKQSSKALQRPVASD
LNVIVHSATGVKQLSKALGRPVASD

SEQ ID NO: 7368 - protein, 25 aa, synthetic construct
  source 1..25: note = Seed: LNVIVHSATGFKQSSKALQRPVASD
LNVIVHSATGVKQLSKALHRPVASD

SEQ ID NO: 7369 - protein, 25 aa, synthetic construct
  source 1..25: note = Seed: LNVIVHSATGFKQSSKALQRPVASD
LNVIVHSATGVKQLSKALIRPVASD

SEQ ID NO: 7370 - protein, 25 aa, synthetic construct
  source 1..25: note = Seed: LNVIVHSATGFKQSSKALQRPVASD
LNVIVHSATGVKQLSKALKRPVASD

SEQ ID NO: 7371 - protein, 25 aa, synthetic construct
  source 1..25: note = Seed: LNVIVHSATGFKQSSKALQRPVASD
LNVIVHSATGVKQLSKALLRPVASD

SEQ ID NO: 7372 - protein, 25 aa, synthetic construct
  source 1..25: note = Seed: LNVIVHSATGFKQSSKALQRPVASD
LNVIVHSATGVKQLSKALMRPVASD

SEQ ID NO: 7373 - protein, 25 aa, synthetic construct
  source 1..25: note = Seed: LNVIVHSATGFKQSSKALQRPVASD
LNVIVHSATGVKQLSKALNRPVASD

SEQ ID NO: 7374 - protein, 25 aa, synthetic construct
  source 1..25: note = Seed: LNVIVHSATGFKQSSKALQRPVASD
LNVIVHSATGVKQLSKALQRPVASD

SEQ ID NO: 7375 - protein, 25 aa, synthetic construct
  source 1..25: note = Seed: LNVIVHSATGFKQSSKALQRPVASD
LNVIVHSATGVKQLSKALRRPVASD

SEQ ID NO: 7376 - protein, 25 aa, synthetic construct
  source 1..25: note = Seed: LNVIVHSATGFKQSSKALQRPVASD
LNVIVHSATGVKQLSKALSRPVASD

SEQ ID NO: 7377 - protein, 25 aa, synthetic construct
  source 1..25: note = Seed: LNVIVHSATGFKQSSKALQRPVASD
LNVIVHSATGVKQLSKALTRPVASD

SEQ ID NO: 7378 - protein, 25 aa, synthetic construct
  source 1..25: note = Seed: LNVIVHSATGFKQSSKALQRPVASD
LNVIVHSATGVKQLSKALVRPVASD

SEQ ID NO: 7379 - protein, 25 aa, synthetic construct
  source 1..25: note = Seed: LNVIVHSATGFKQSSKALQRPVASD
LNVIVHSATGVKQLSKALYRPVASD

SEQ ID NO: 7380 - protein, 25 aa, synthetic construct
  source 1..25: note = Seed: LNVIVHSATGFKQSSKALQRPVASD
LNVIVHSATGVKQLSLALARPVASD

SEQ ID NO: 7381 - protein, 25 aa, synthetic construct
  source 1..25: note = Seed: LNVIVHSATGFKQSSKALQRPVASD
LNVIVHSATGVKQLSLALGRPVASD

SEQ ID NO: 7382 - protein, 25 aa, synthetic construct
  source 1..25: note = Seed: LNVIVHSATGFKQSSKALQRPVASD
LNVIVHSATGVKQLSLALNRPVASD

SEQ ID NO: 7383 - protein, 25 aa, synthetic construct
  source 1..25: note = Seed: LNVIVHSATGFKQSSKALQRPVASD
LNVIVHSATGVKQLSLALSRPVASD

SEQ ID NO: 7384 - protein, 25 aa, synthetic construct
  source 1..25: note = Seed: LNVIVHSATGFKQSSKALQRPVASD
LNVIVHSATGVKQLSMALGRPVASD

SEQ ID NO: 7385 - protein, 25 aa, synthetic construct
  source 1..25: note = Seed: LNVIVHSATGFKQSSKALQRPVASD
LNVIVHSATGVKQLSMALLRPVASD

SEQ ID NO: 7386 - protein, 25 aa, synthetic construct
  source 1..25: note = Seed: LNVIVHSATGFKQSSKALQRPVASD
LNVIVHSATGVKQLSMALMRPVASD

SEQ ID NO: 7387 - protein, 25 aa, synthetic construct
  source 1..25: note = Seed: LNVIVHSATGFKQSSKALQRPVASD
LNVIVHSATGVKQLSMALNRPVASD

SEQ ID NO: 7388 - protein, 25 aa, synthetic construct
  source 1..25: note = Seed: LNVIVHSATGFKQSSKALQRPVASD
LNVIVHSATGVKQLSMALSRPVASD

SEQ ID NO: 7389 - protein, 25 aa, synthetic construct
  source 1..25: note = Seed: LNVIVHSATGFKQSSKALQRPVASD
LNVIVHSATGVKQLSNALARPVASD

SEQ ID NO: 7390 - protein, 25 aa, synthetic construct
  source 1..25: note = Seed: LNVIVHSATGFKQSSKALQRPVASD
LNVIVHSATGVKQLSNALGRPVASD

SEQ ID NO: 7391 - protein, 25 aa, synthetic construct
  source 1..25: note = Seed: LNVIVHSATGFKQSSKALQRPVASD
LNVIVHSATGVKQLSNALIRPVASD

SEQ ID NO: 7392 - protein, 25 aa, synthetic construct
  source 1..25: note = Seed: LNVIVHSATGFKQSSKALQRPVASD
LNVIVHSATGVKQLSNALLRPVASD

SEQ ID NO: 7393 - protein, 25 aa, synthetic construct
  source 1..25: note = Seed: LNVIVHSATGFKQSSKALQRPVASD
LNVIVHSATGVKQLSNALMRPVASD

SEQ ID NO: 7394 - protein, 25 aa, synthetic construct
  source 1..25: note = Seed: LNVIVHSATGFKQSSKALQRPVASD
LNVIVHSATGVKQLSNALRRPVASD

SEQ ID NO: 7395 - protein, 25 aa, synthetic construct
  source 1..25: note = Seed: LNVIVHSATGFKQSSKALQRPVASD
LNVIVHSATGVKQLSNALSRPVASD

SEQ ID NO: 7396 - protein, 25 aa, synthetic construct
  source 1..25: note = Seed: LNVIVHSATGFKQSSKALQRPVASD
LNVIVHSATGVKQLSNALTRPVASD

SEQ ID NO: 7397 - protein, 25 aa, synthetic construct
  source 1..25: note = Seed: LNVIVHSATGFKQSSKALQRPVASD
LNVIVHSATGVKQLSNALVRPVASD

SEQ ID NO: 7398 - protein, 25 aa, synthetic construct
  source 1..25: note = Seed: LNVIVHSATGFKQSSKALQRPVASD
LNVIVHSATGVKQLSPALARPVASD

SEQ ID NO: 7399 - protein, 25 aa, synthetic construct
  source 1..25: note = Seed: LNVIVHSATGFKQSSKALQRPVASD
LNVIVHSATGVKQLSPALGRPVASD

SEQ ID NO: 7400 - protein, 25 aa, synthetic construct
  source 1..25: note = Seed: LNVIVHSATGFKQSSKALQRPVASD
LNVIVHSATGVKQLSPALIRPVASD

SEQ ID NO: 7401 - protein, 25 aa, synthetic construct
  source 1..25: note = Seed: LNVIVHSATGFKQSSKALQRPVASD
LNVIVHSATGVKQLSPALLRPVASD

SEQ ID NO: 7402 - protein, 25 aa, synthetic construct
  source 1..25: note = Seed: LNVIVHSATGFKQSSKALQRPVASD
LNVIVHSATGVKQLSPALMRPVASD

SEQ ID NO: 7403 - protein, 25 aa, synthetic construct
  source 1..25: note = Seed: LNVIVHSATGFKQSSKALQRPVASD
LNVIVHSATGVKQLSPALNRPVASD

SEQ ID NO: 7404 - protein, 25 aa, synthetic construct
  source 1..25: note = Seed: LNVIVHSATGFKQSSKALQRPVASD
LNVIVHSATGVKQLSPALSRPVASD

SEQ ID NO: 7405 - protein, 25 aa, synthetic construct
  source 1..25: note = Seed: LNVIVHSATGFKQSSKALQRPVASD
LNVIVHSATGVKQLSPALTRPVASD

SEQ ID NO: 7406 - protein, 25 aa, synthetic construct
  source 1..25: note = Seed: LNVIVHSATGFKQSSKALQRPVASD
LNVIVHSATGVKQLSPALVRPVASD

SEQ ID NO: 7407 - protein, 25 aa, synthetic construct
  source 1..25: note = Seed: LNVIVHSATGFKQSSKALQRPVASD
LNVIVHSATGVKQLSRALARPVASD

SEQ ID NO: 7408 - protein, 25 aa, synthetic construct
  source 1..25: note = Seed: LNVIVHSATGFKQSSKALQRPVASD
LNVIVHSATGVKQLSRALGRPVASD

SEQ ID NO: 7409 - protein, 25 aa, synthetic construct
  source 1..25: note = Seed: LNVIVHSATGFKQSSKALQRPVASD
LNVIVHSATGVKQLSRALHRPVASD

SEQ ID NO: 7410 - protein, 25 aa, synthetic construct
  source 1..25: note = Seed: LNVIVHSATGFKQSSKALQRPVASD
LNVIVHSATGVKQLSRALIRPVASD

SEQ ID NO: 7411 - protein, 25 aa, synthetic construct
  source 1..25: note = Seed: LNVIVHSATGFKQSSKALQRPVASD
LNVIVHSATGVKQLSRALKRPVASD

SEQ ID NO: 7412 - protein, 25 aa, synthetic construct
  source 1..25: note = Seed: LNVIVHSATGFKQSSKALQRPVASD
LNVIVHSATGVKQLSRALLRPVASD

SEQ ID NO: 7413 - protein, 25 aa, synthetic construct
  source 1..25: note = Seed: LNVIVHSATGFKQSSKALQRPVASD
LNVIVHSATGVKQLSRALMRPVASD

SEQ ID NO: 7414 - protein, 25 aa, synthetic construct
  source 1..25: note = Seed: LNVIVHSATGFKQSSKALQRPVASD
LNVIVHSATGVKQLSRALNRPVASD

SEQ ID NO: 7415 - protein, 25 aa, synthetic construct
  source 1..25: note = Seed: LNVIVHSATGFKQSSKALQRPVASD
LNVIVHSATGVKQLSRALPRPVASD

SEQ ID NO: 7416 - protein, 25 aa, synthetic construct
  source 1..25: note = Seed: LNVIVHSATGFKQSSKALQRPVASD
LNVIVHSATGVKQLSRALQRPVASD

SEQ ID NO: 7417 - protein, 25 aa, synthetic construct
  source 1..25: note = Seed: LNVIVHSATGFKQSSKALQRPVASD
LNVIVHSATGVKQLSRALRRPVASD

SEQ ID NO: 7418 - protein, 25 aa, synthetic construct
  source 1..25: note = Seed: LNVIVHSATGFKQSSKALQRPVASD
LNVIVHSATGVKQLSRALSRPVASD

SEQ ID NO: 7419 - protein, 25 aa, synthetic construct
  source 1..25: note = Seed: LNVIVHSATGFKQSSKALQRPVASD
LNVIVHSATGVKQLSRALTRPVASD

SEQ ID NO: 7420 - protein, 25 aa, synthetic construct
  source 1..25: note = Seed: LNVIVHSATGFKQSSKALQRPVASD
LNVIVHSATGVKQLSRALVRPVASD

SEQ ID NO: 7421 - protein, 25 aa, synthetic construct
  source 1..25: note = Seed: LNVIVHSATGFKQSSKALQRPVASD
LNVIVHSATGVKQLSRALYRPVASD

SEQ ID NO: 7422 - protein, 25 aa, synthetic construct
  source 1..25: note = Seed: LNVIVHSATGFKQSSKALQRPVASD
LNVIVHSATGVKQLSSALARPVASD

SEQ ID NO: 7423 - protein, 25 aa, synthetic construct
  source 1..25: note = Seed: LNVIVHSATGFKQSSKALQRPVASD
LNVIVHSATGVKQLSSALCRPVASD

SEQ ID NO: 7424 - protein, 25 aa, synthetic construct
  source 1..25: note = Seed: LNVIVHSATGFKQSSKALQRPVASD
LNVIVHSATGVKQLSSALGRPVASD

SEQ ID NO: 7425 - protein, 25 aa, synthetic construct
  source 1..25: note = Seed: LNVIVHSATGFKQSSKALQRPVASD
LNVIVHSATGVKQLSSALIRPVASD

SEQ ID NO: 7426 - protein, 25 aa, synthetic construct
  source 1..25: note = Seed: LNVIVHSATGFKQSSKALQRPVASD
LNVIVHSATGVKQLSSALLRPVASD

SEQ ID NO: 7427 - protein, 25 aa, synthetic construct
  source 1..25: note = Seed: LNVIVHSATGFKQSSKALQRPVASD
LNVIVHSATGVKQLSSALMRPVASD

SEQ ID NO: 7428 - protein, 25 aa, synthetic construct
  source 1..25: note = Seed: LNVIVHSATGFKQSSKALQRPVASD
LNVIVHSATGVKQLSSALNRPVASD

SEQ ID NO: 7429 - protein, 25 aa, synthetic construct
  source 1..25: note = Seed: LNVIVHSATGFKQSSKALQRPVASD
LNVIVHSATGVKQLSSALRRPVASD

SEQ ID NO: 7430 - protein, 25 aa, synthetic construct
  source 1..25: note = Seed: LNVIVHSATGFKQSSKALQRPVASD
LNVIVHSATGVKQLSSALSRPVASD

SEQ ID NO: 7431 - protein, 25 aa, synthetic construct
  source 1..25: note = Seed: LNVIVHSATGFKQSSKALQRPVASD
LNVIVHSATGVKQLSSALTRPVASD

SEQ ID NO: 7432 - protein, 25 aa, synthetic construct
  source 1..25: note = Seed: LNVIVHSATGFKQSSKALQRPVASD
LNVIVHSATGVKQLSSALVRPVASD

SEQ ID NO: 7433 - protein, 25 aa, synthetic construct
  source 1..25: note = Seed: LNVIVHSATGFKQSSKALQRPVASD
LNVIVHSATGVKQLSTALARPVASD

SEQ ID NO: 7434 - protein, 25 aa, synthetic construct
  source 1..25: note = Seed: LNVIVHSATGFKQSSKALQRPVASD
LNVIVHSATGVKQLSTALGRPVASD

SEQ ID NO: 7435 - protein, 25 aa, synthetic construct
  source 1..25: note = Seed: LNVIVHSATGFKQSSKALQRPVASD
LNVIVHSATGVKQLSTALIRPVASD

SEQ ID NO: 7436 - protein, 25 aa, synthetic construct
  source 1..25: note = Seed: LNVIVHSATGFKQSSKALQRPVASD
LNVIVHSATGVKQLSTALLRPVASD

SEQ ID NO: 7437 - protein, 25 aa, synthetic construct
  source 1..25: note = Seed: LNVIVHSATGFKQSSKALQRPVASD
LNVIVHSATGVKQLSTALMRPVASD

SEQ ID NO: 7438 - protein, 25 aa, synthetic construct
  source 1..25: note = Seed: LNVIVHSATGFKQSSKALQRPVASD
LNVIVHSATGVKQLSTALNRPVASD

SEQ ID NO: 7439 - protein, 25 aa, synthetic construct
  source 1..25: note = Seed: LNVIVHSATGFKQSSKALQRPVASD
LNVIVHSATGVKQLSTALRRPVASD

SEQ ID NO: 7440 - protein, 25 aa, synthetic construct
  source 1..25: note = Seed: LNVIVHSATGFKQSSKALQRPVASD
LNVIVHSATGVKQLSTALSRPVASD

SEQ ID NO: 7441 - protein, 25 aa, synthetic construct
  source 1..25: note = Seed: LNVIVHSATGFKQSSKALQRPVASD
LNVIVHSATGVKQLSTALTRPVASD

SEQ ID NO: 7442 - protein, 25 aa, synthetic construct
  source 1..25: note = Seed: LNVIVHSATGFKQSSKALQRPVASD
LNVIVHSATGVKQLSTALVRPVASD

SEQ ID NO: 7443 - protein, 25 aa, synthetic construct
  source 1..25: note = Seed: LNVIVHSATGFKQSSKALQRPVASD
LNVIVHSATGVKQLSVALARPVASD

SEQ ID NO: 7444 - protein, 25 aa, synthetic construct
  source 1..25: note = Seed: LNVIVHSATGFKQSSKALQRPVASD
LNVIVHSATGVKQLSVALGRPVASD

SEQ ID NO: 7445 - protein, 25 aa, synthetic construct
  source 1..25: note = Seed: LNVIVHSATGFKQSSKALQRPVASD
LNVIVHSATGVKQLSVALHRPVASD

SEQ ID NO: 7446 - protein, 25 aa, synthetic construct
  source 1..25: note = Seed: LNVIVHSATGFKQSSKALQRPVASD
LNVIVHSATGVKQLSVALIRPVASD

SEQ ID NO: 7447 - protein, 25 aa, synthetic construct
  source 1..25: note = Seed: LNVIVHSATGFKQSSKALQRPVASD
LNVIVHSATGVKQLSVALLRPVASD

SEQ ID NO: 7448 - protein, 25 aa, synthetic construct
  source 1..25: note = Seed: LNVIVHSATGFKQSSKALQRPVASD
LNVIVHSATGVKQLSVALMRPVASD

SEQ ID NO: 7449 - protein, 25 aa, synthetic construct
  source 1..25: note = Seed: LNVIVHSATGFKQSSKALQRPVASD
LNVIVHSATGVKQLSVALNRPVASD

SEQ ID NO: 7450 - protein, 25 aa, synthetic construct
  source 1..25: note = Seed: LNVIVHSATGFKQSSKALQRPVASD
LNVIVHSATGVKQLSVALRRPVASD

SEQ ID NO: 7451 - protein, 25 aa, synthetic construct
  source 1..25: note = Seed: LNVIVHSATGFKQSSKALQRPVASD
LNVIVHSATGVKQLSVALSRPVASD

SEQ ID NO: 7452 - protein, 25 aa, synthetic construct
  source 1..25: note = Seed: LNVIVHSATGFKQSSKALQRPVASD
LNVIVHSATGVKQLSVALTRPVASD

SEQ ID NO: 7453 - protein, 25 aa, synthetic construct
  source 1..25: note = Seed: LNVIVHSATGFKQSSKALQRPVASD
LNVIVHSATGVKQLSVALVRPVASD

SEQ ID NO: 7454 - protein, 25 aa, synthetic construct
  source 1..25: note = Seed: LNVIVHSATGFKQSSKALQRPVASD
LNVIVHSATGVKQMSAALARPVASD

SEQ ID NO: 7455 - protein, 25 aa, synthetic construct
  source 1..25: note = Seed: LNVIVHSATGFKQSSKALQRPVASD
LNVIVHSATGVKQMSAALCRPVASD

SEQ ID NO: 7456 - protein, 25 aa, synthetic construct
  source 1..25: note = Seed: LNVIVHSATGFKQSSKALQRPVASD
LNVIVHSATGVKQMSAALFRPVASD

SEQ ID NO: 7457 - protein, 25 aa, synthetic construct
  source 1..25: note = Seed: LNVIVHSATGFKQSSKALQRPVASD
LNVIVHSATGVKQMSAALGRPVASD

SEQ ID NO: 7458 - protein, 25 aa, synthetic construct
  source 1..25: note = Seed: LNVIVHSATGFKQSSKALQRPVASD
LNVIVHSATGVKQMSAALHRPVASD

SEQ ID NO: 7459 - protein, 25 aa, synthetic construct
  source 1..25: note = Seed: LNVIVHSATGFKQSSKALQRPVASD
LNVIVHSATGVKQMSAALIRPVASD

SEQ ID NO: 7460 - protein, 25 aa, synthetic construct
  source 1..25: note = Seed: LNVIVHSATGFKQSSKALQRPVASD
LNVIVHSATGVKQMSAALLRPVASD

SEQ ID NO: 7461 - protein, 25 aa, synthetic construct
  source 1..25: note = Seed: LNVIVHSATGFKQSSKALQRPVASD
LNVIVHSATGVKQMSAALMRPVASD

SEQ ID NO: 7462 - protein, 25 aa, synthetic construct
  source 1..25: note = Seed: LNVIVHSATGFKQSSKALQRPVASD
LNVIVHSATGVKQMSAALNRPVASD

SEQ ID NO: 7463 - protein, 25 aa, synthetic construct
  source 1..25: note = Seed: LNVIVHSATGFKQSSKALQRPVASD
LNVIVHSATGVKQMSAALPRPVASD

SEQ ID NO: 7464 - protein, 25 aa, synthetic construct
  source 1..25: note = Seed: LNVIVHSATGFKQSSKALQRPVASD
LNVIVHSATGVKQMSAALRRPVASD

SEQ ID NO: 7465 - protein, 25 aa, synthetic construct
  source 1..25: note = Seed: LNVIVHSATGFKQSSKALQRPVASD
LNVIVHSATGVKQMSAALSRPVASD

SEQ ID NO: 7466 - protein, 25 aa, synthetic construct
  source 1..25: note = Seed: LNVIVHSATGFKQSSKALQRPVASD
LNVIVHSATGVKQMSAALTRPVASD

SEQ ID NO: 7467 - protein, 25 aa, synthetic construct
  source 1..25: note = Seed: LNVIVHSATGFKQSSKALQRPVASD
LNVIVHSATGVKQMSAALVRPVASD

SEQ ID NO: 7468 - protein, 25 aa, synthetic construct
  source 1..25: note = Seed: LNVIVHSATGFKQSSKALQRPVASD
LNVIVHSATGVKQMSFALMRPVASD

SEQ ID NO: 7469 - protein, 25 aa, synthetic construct
  source 1..25: note = Seed: LNVIVHSATGFKQSSKALQRPVASD
LNVIVHSATGVKQMSGALARPVASD

SEQ ID NO: 7470 - protein, 25 aa, synthetic construct
  source 1..25: note = Seed: LNVIVHSATGFKQSSKALQRPVASD
LNVIVHSATGVKQMSGALCRPVASD

SEQ ID NO: 7471 - protein, 25 aa, synthetic construct
  source 1..25: note = Seed: LNVIVHSATGFKQSSKALQRPVASD
LNVIVHSATGVKQMSGALGRPVASD

SEQ ID NO: 7472 - protein, 25 aa, synthetic construct
  source 1..25: note = Seed: LNVIVHSATGFKQSSKALQRPVASD
LNVIVHSATGVKQMSGALIRPVASD

SEQ ID NO: 7473 - protein, 25 aa, synthetic construct
  source 1..25: note = Seed: LNVIVHSATGFKQSSKALQRPVASD
LNVIVHSATGVKQMSGALLRPVASD

SEQ ID NO: 7474 - protein, 25 aa, synthetic construct
  source 1..25: note = Seed: LNVIVHSATGFKQSSKALQRPVASD
LNVIVHSATGVKQMSGALMRPVASD

SEQ ID NO: 7475 - protein, 25 aa, synthetic construct
  source 1..25: note = Seed: LNVIVHSATGFKQSSKALQRPVASD
LNVIVHSATGVKQMSGALNRPVASD

SEQ ID NO: 7476 - protein, 25 aa, synthetic construct
  source 1..25: note = Seed: LNVIVHSATGFKQSSKALQRPVASD
LNVIVHSATGVKQMSGALSRPVASD

SEQ ID NO: 7477 - protein, 25 aa, synthetic construct
  source 1..25: note = Seed: LNVIVHSATGFKQSSKALQRPVASD
LNVIVHSATGVKQMSGALTRPVASD

SEQ ID NO: 7478 - protein, 25 aa, synthetic construct
  source 1..25: note = Seed: LNVIVHSATGFKQSSKALQRPVASD
LNVIVHSATGVKQMSGALVRPVASD

SEQ ID NO: 7479 - protein, 25 aa, synthetic construct
  source 1..25: note = Seed: LNVIVHSATGFKQSSKALQRPVASD
LNVIVHSATGVKQMSHALKRPVASD

SEQ ID NO: 7480 - protein, 25 aa, synthetic construct
  source 1..25: note = Seed: LNVIVHSATGFKQSSKALQRPVASD
LNVIVHSATGVKQMSHALRRPVASD

SEQ ID NO: 7481 - protein, 25 aa, synthetic construct
  source 1..25: note = Seed: LNVIVHSATGFKQSSKALQRPVASD
LNVIVHSATGVKQMSHALVRPVASD

SEQ ID NO: 7482 - protein, 25 aa, synthetic construct
  source 1..25: note = Seed: LNVIVHSATGFKQSSKALQRPVASD
LNVIVHSATGVKQMSIALARPVASD

SEQ ID NO: 7483 - protein, 25 aa, synthetic construct
  source 1..25: note = Seed: LNVIVHSATGFKQSSKALQRPVASD
LNVIVHSATGVKQMSIALGRPVASD

SEQ ID NO: 7484 - protein, 25 aa, synthetic construct
  source 1..25: note = Seed: LNVIVHSATGFKQSSKALQRPVASD
LNVIVHSATGVKQMSIALHRPVASD

SEQ ID NO: 7485 - protein, 25 aa, synthetic construct
  source 1..25: note = Seed: LNVIVHSATGFKQSSKALQRPVASD
LNVIVHSATGVKQMSIALIRPVASD

SEQ ID NO: 7486 - protein, 25 aa, synthetic construct
  source 1..25: note = Seed: LNVIVHSATGFKQSSKALQRPVASD
LNVIVHSATGVKQMSIALNRPVASD

SEQ ID NO: 7487 - protein, 25 aa, synthetic construct
  source 1..25: note = Seed: LNVIVHSATGFKQSSKALQRPVASD
LNVIVHSATGVKQMSIALQRPVASD

SEQ ID NO: 7488 - protein, 25 aa, synthetic construct
  source 1..25: note = Seed: LNVIVHSATGFKQSSKALQRPVASD
LNVIVHSATGVKQMSIALRRPVASD

SEQ ID NO: 7489 - protein, 25 aa, synthetic construct
  source 1..25: note = Seed: LNVIVHSATGFKQSSKALQRPVASD
LNVIVHSATGVKQMSIALSRPVASD

SEQ ID NO: 7490 - protein, 25 aa, synthetic construct
  source 1..25: note = Seed: LNVIVHSATGFKQSSKALQRPVASD
LNVIVHSATGVKQMSIALTRPVASD

SEQ ID NO: 7491 - protein, 25 aa, synthetic construct
  source 1..25: note = Seed: LNVIVHSATGFKQSSKALQRPVASD
LNVIVHSATGVKQMSIALVRPVASD

SEQ ID NO: 7492 - protein, 25 aa, synthetic construct
  source 1..25: note = Seed: LNVIVHSATGFKQSSKALQRPVASD
LNVIVHSATGVKQMSKALARPVASD

SEQ ID NO: 7493 - protein, 25 aa, synthetic construct
  source 1..25: note = Seed: LNVIVHSATGFKQSSKALQRPVASD
LNVIVHSATGVKQMSKALGRPVASD

SEQ ID NO: 7494 - protein, 25 aa, synthetic construct
  source 1..25: note = Seed: LNVIVHSATGFKQSSKALQRPVASD
LNVIVHSATGVKQMSKALHRPVASD

SEQ ID NO: 7495 - protein, 25 aa, synthetic construct
  source 1..25: note = Seed: LNVIVHSATGFKQSSKALQRPVASD
LNVIVHSATGVKQMSKALIRPVASD

SEQ ID NO: 7496 - protein, 25 aa, synthetic construct
  source 1..25: note = Seed: LNVIVHSATGFKQSSKALQRPVASD
LNVIVHSATGVKQMSKALKRPVASD

SEQ ID NO: 7497 - protein, 25 aa, synthetic construct
  source 1..25: note = Seed: LNVIVHSATGFKQSSKALQRPVASD
LNVIVHSATGVKQMSKALLRPVASD

SEQ ID NO: 7498 - protein, 25 aa, synthetic construct
  source 1..25: note = Seed: LNVIVHSATGFKQSSKALQRPVASD
LNVIVHSATGVKQMSKALMRPVASD

SEQ ID NO: 7499 - protein, 25 aa, synthetic construct
  source 1..25: note = Seed: LNVIVHSATGFKQSSKALQRPVASD
LNVIVHSATGVKQMSKALNRPVASD

SEQ ID NO: 7500 - protein, 25 aa, synthetic construct
  source 1..25: note = Seed: LNVIVHSATGFKQSSKALQRPVASD
LNVIVHSATGVKQMSKALPRPVASD

SEQ ID NO: 7501 - protein, 25 aa, synthetic construct
  source 1..25: note = Seed: LNVIVHSATGFKQSSKALQRPVASD
LNVIVHSATGVKQMSKALQRPVASD

SEQ ID NO: 7502 - protein, 25 aa, synthetic construct
  source 1..25: note = Seed: LNVIVHSATGFKQSSKALQRPVASD
LNVIVHSATGVKQMSKALRRPVASD

SEQ ID NO: 7503 - protein, 25 aa, synthetic construct
  source 1..25: note = Seed: LNVIVHSATGFKQSSKALQRPVASD
LNVIVHSATGVKQMSKALSRPVASD

SEQ ID NO: 7504 - protein, 25 aa, synthetic construct
  source 1..25: note = Seed: LNVIVHSATGFKQSSKALQRPVASD
LNVIVHSATGVKQMSKALTRPVASD

SEQ ID NO: 7505 - protein, 25 aa, synthetic construct
  source 1..25: note = Seed: LNVIVHSATGFKQSSKALQRPVASD
LNVIVHSATGVKQMSKALVRPVASD

SEQ ID NO: 7506 - protein, 25 aa, synthetic construct
  source 1..25: note = Seed: LNVIVHSATGFKQSSKALQRPVASD
LNVIVHSATGVKQMSKALYRPVASD

SEQ ID NO: 7507 - protein, 25 aa, synthetic construct
  source 1..25: note = Seed: LNVIVHSATGFKQSSKALQRPVASD
LNVIVHSATGVKQMSLALARPVASD

SEQ ID NO: 7508 - protein, 25 aa, synthetic construct
  source 1..25: note = Seed: LNVIVHSATGFKQSSKALQRPVASD
LNVIVHSATGVKQMSLALGRPVASD

SEQ ID NO: 7509 - protein, 25 aa, synthetic construct
  source 1..25: note = Seed: LNVIVHSATGFKQSSKALQRPVASD
LNVIVHSATGVKQMSLALNRPVASD

SEQ ID NO: 7510 - protein, 25 aa, synthetic construct
  source 1..25: note = Seed: LNVIVHSATGFKQSSKALQRPVASD
LNVIVHSATGVKQMSLALSRPVASD

SEQ ID NO: 7511 - protein, 25 aa, synthetic construct
  source 1..25: note = Seed: LNVIVHSATGFKQSSKALQRPVASD
LNVIVHSATGVKQMSLALTRPVASD

SEQ ID NO: 7512 - protein, 25 aa, synthetic construct
  source 1..25: note = Seed: LNVIVHSATGFKQSSKALQRPVASD
LNVIVHSATGVKQMSLALVRPVASD

SEQ ID NO: 7513 - protein, 25 aa, synthetic construct
  source 1..25: note = Seed: LNVIVHSATGFKQSSKALQRPVASD
LNVIVHSATGVKQMSMALGRPVASD

SEQ ID NO: 7514 - protein, 25 aa, synthetic construct
  source 1..25: note = Seed: LNVIVHSATGFKQSSKALQRPVASD
LNVIVHSATGVKQMSMALLRPVASD

SEQ ID NO: 7515 - protein, 25 aa, synthetic construct
  source 1..25: note = Seed: LNVIVHSATGFKQSSKALQRPVASD
LNVIVHSATGVKQMSMALMRPVASD

SEQ ID NO: 7516 - protein, 25 aa, synthetic construct
  source 1..25: note = Seed: LNVIVHSATGFKQSSKALQRPVASD
LNVIVHSATGVKQMSMALNRPVASD

SEQ ID NO: 7517 - protein, 25 aa, synthetic construct
  source 1..25: note = Seed: LNVIVHSATGFKQSSKALQRPVASD
LNVIVHSATGVKQMSMALRRPVASD

SEQ ID NO: 7518 - protein, 25 aa, synthetic construct
  source 1..25: note = Seed: LNVIVHSATGFKQSSKALQRPVASD
LNVIVHSATGVKQMSMALSRPVASD

SEQ ID NO: 7519 - protein, 25 aa, synthetic construct
  source 1..25: note = Seed: LNVIVHSATGFKQSSKALQRPVASD
LNVIVHSATGVKQMSNALARPVASD

SEQ ID NO: 7520 - protein, 25 aa, synthetic construct
  source 1..25: note = Seed: LNVIVHSATGFKQSSKALQRPVASD
LNVIVHSATGVKQMSNALIRPVASD

SEQ ID NO: 7521 - protein, 25 aa, synthetic construct
  source 1..25: note = Seed: LNVIVHSATGFKQSSKALQRPVASD
LNVIVHSATGVKQMSNALLRPVASD

SEQ ID NO: 7522 - protein, 25 aa, synthetic construct
  source 1..25: note = Seed: LNVIVHSATGFKQSSKALQRPVASD
LNVIVHSATGVKQMSNALMRPVASD

SEQ ID NO: 7523 - protein, 25 aa, synthetic construct
  source 1..25: note = Seed: LNVIVHSATGFKQSSKALQRPVASD
LNVIVHSATGVKQMSNALSRPVASD

SEQ ID NO: 7524 - protein, 25 aa, synthetic construct
  source 1..25: note = Seed: LNVIVHSATGFKQSSKALQRPVASD
LNVIVHSATGVKQMSNALTRPVASD

SEQ ID NO: 7525 - protein, 25 aa, synthetic construct
  source 1..25: note = Seed: LNVIVHSATGFKQSSKALQRPVASD
LNVIVHSATGVKQMSNALVRPVASD

SEQ ID NO: 7526 - protein, 25 aa, synthetic construct
  source 1..25: note = Seed: LNVIVHSATGFKQSSKALQRPVASD
LNVIVHSATGVKQMSPALARPVASD

SEQ ID NO: 7527 - protein, 25 aa, synthetic construct
  source 1..25: note = Seed: LNVIVHSATGFKQSSKALQRPVASD
LNVIVHSATGVKQMSPALGRPVASD

SEQ ID NO: 7528 - protein, 25 aa, synthetic construct
  source 1..25: note = Seed: LNVIVHSATGFKQSSKALQRPVASD
LNVIVHSATGVKQMSPALIRPVASD

SEQ ID NO: 7529 - protein, 25 aa, synthetic construct
  source 1..25: note = Seed: LNVIVHSATGFKQSSKALQRPVASD
LNVIVHSATGVKQMSPALLRPVASD

SEQ ID NO: 7530 - protein, 25 aa, synthetic construct
  source 1..25: note = Seed: LNVIVHSATGFKQSSKALQRPVASD
LNVIVHSATGVKQMSPALMRPVASD

SEQ ID NO: 7531 - protein, 25 aa, synthetic construct
  source 1..25: note = Seed: LNVIVHSATGFKQSSKALQRPVASD
LNVIVHSATGVKQMSPALNRPVASD

SEQ ID NO: 7532 - protein, 25 aa, synthetic construct
  source 1..25: note = Seed: LNVIVHSATGFKQSSKALQRPVASD
LNVIVHSATGVKQMSPALRRPVASD

SEQ ID NO: 7533 - protein, 25 aa, synthetic construct
  source 1..25: note = Seed: LNVIVHSATGFKQSSKALQRPVASD
LNVIVHSATGVKQMSPALSRPVASD

SEQ ID NO: 7534 - protein, 25 aa, synthetic construct
  source 1..25: note = Seed: LNVIVHSATGFKQSSKALQRPVASD
LNVIVHSATGVKQMSPALTRPVASD

SEQ ID NO: 7535 - protein, 25 aa, synthetic construct
  source 1..25: note = Seed: LNVIVHSATGFKQSSKALQRPVASD
LNVIVHSATGVKQMSPALVRPVASD

SEQ ID NO: 7536 - protein, 25 aa, synthetic construct
  source 1..25: note = Seed: LNVIVHSATGFKQSSKALQRPVASD
LNVIVHSATGVKQMSRALARPVASD

SEQ ID NO: 7537 - protein, 25 aa, synthetic construct
  source 1..25: note = Seed: LNVIVHSATGFKQSSKALQRPVASD
LNVIVHSATGVKQMSRALFRPVASD

SEQ ID NO: 7538 - protein, 25 aa, synthetic construct
  source 1..25: note = Seed: LNVIVHSATGFKQSSKALQRPVASD
LNVIVHSATGVKQMSRALGRPVASD

SEQ ID NO: 7539 - protein, 25 aa, synthetic construct
  source 1..25: note = Seed: LNVIVHSATGFKQSSKALQRPVASD
LNVIVHSATGVKQMSRALHRPVASD

SEQ ID NO: 7540 - protein, 25 aa, synthetic construct
  source 1..25: note = Seed: LNVIVHSATGFKQSSKALQRPVASD
LNVIVHSATGVKQMSRALIRPVASD

SEQ ID NO: 7541 - protein, 25 aa, synthetic construct
  source 1..25: note = Seed: LNVIVHSATGFKQSSKALQRPVASD
LNVIVHSATGVKQMSRALKRPVASD

SEQ ID NO: 7542 - protein, 25 aa, synthetic construct
  source 1..25: note = Seed: LNVIVHSATGFKQSSKALQRPVASD
LNVIVHSATGVKQMSRALLRPVASD

SEQ ID NO: 7543 - protein, 25 aa, synthetic construct
  source 1..25: note = Seed: LNVIVHSATGFKQSSKALQRPVASD
LNVIVHSATGVKQMSRALMRPVASD

SEQ ID NO: 7544 - protein, 25 aa, synthetic construct
  source 1..25: note = Seed: LNVIVHSATGFKQSSKALQRPVASD
LNVIVHSATGVKQMSRALNRPVASD

SEQ ID NO: 7545 - protein, 25 aa, synthetic construct
  source 1..25: note = Seed: LNVIVHSATGFKQSSKALQRPVASD
LNVIVHSATGVKQMSRALPRPVASD

SEQ ID NO: 7546 - protein, 25 aa, synthetic construct
  source 1..25: note = Seed: LNVIVHSATGFKQSSKALQRPVASD
LNVIVHSATGVKQMSRALQRPVASD

SEQ ID NO: 7547 - protein, 25 aa, synthetic construct
  source 1..25: note = Seed: LNVIVHSATGFKQSSKALQRPVASD
LNVIVHSATGVKQMSRALRRPVASD

SEQ ID NO: 7548 - protein, 25 aa, synthetic construct
  source 1..25: note = Seed: LNVIVHSATGFKQSSKALQRPVASD
LNVIVHSATGVKQMSRALSRPVASD

SEQ ID NO: 7549 - protein, 25 aa, synthetic construct
  source 1..25: note = Seed: LNVIVHSATGFKQSSKALQRPVASD
LNVIVHSATGVKQMSRALTRPVASD

SEQ ID NO: 7550 - protein, 25 aa, synthetic construct
  source 1..25: note = Seed: LNVIVHSATGFKQSSKALQRPVASD
LNVIVHSATGVKQMSRALVRPVASD

SEQ ID NO: 7551 - protein, 25 aa, synthetic construct
  source 1..25: note = Seed: LNVIVHSATGFKQSSKALQRPVASD
LNVIVHSATGVKQMSRALYRPVASD

SEQ ID NO: 7552 - protein, 25 aa, synthetic construct
  source 1..25: note = Seed: LNVIVHSATGFKQSSKALQRPVASD
LNVIVHSATGVKQMSSALARPVASD

SEQ ID NO: 7553 - protein, 25 aa, synthetic construct
  source 1..25: note = Seed: LNVIVHSATGFKQSSKALQRPVASD
LNVIVHSATGVKQMSSALCRPVASD

SEQ ID NO: 7554 - protein, 25 aa, synthetic construct
  source 1..25: note = Seed: LNVIVHSATGFKQSSKALQRPVASD
LNVIVHSATGVKQMSSALGRPVASD

SEQ ID NO: 7555 - protein, 25 aa, synthetic construct
  source 1..25: note = Seed: LNVIVHSATGFKQSSKALQRPVASD
LNVIVHSATGVKQMSSALIRPVASD

SEQ ID NO: 7556 - protein, 25 aa, synthetic construct
  source 1..25: note = Seed: LNVIVHSATGFKQSSKALQRPVASD
LNVIVHSATGVKQMSSALLRPVASD

SEQ ID NO: 7557 - protein, 25 aa, synthetic construct
  source 1..25: note = Seed: LNVIVHSATGFKQSSKALQRPVASD
LNVIVHSATGVKQMSSALMRPVASD

SEQ ID NO: 7558 - protein, 25 aa, synthetic construct
  source 1..25: note = Seed: LNVIVHSATGFKQSSKALQRPVASD
LNVIVHSATGVKQMSSALNRPVASD

SEQ ID NO: 7559 - protein, 25 aa, synthetic construct
  source 1..25: note = Seed: LNVIVHSATGFKQSSKALQRPVASD
LNVIVHSATGVKQMSSALRRPVASD

SEQ ID NO: 7560 - protein, 25 aa, synthetic construct
  source 1..25: note = Seed: LNVIVHSATGFKQSSKALQRPVASD
LNVIVHSATGVKQMSSALSRPVASD

SEQ ID NO: 7561 - protein, 25 aa, synthetic construct
  source 1..25: note = Seed: LNVIVHSATGFKQSSKALQRPVASD
LNVIVHSATGVKQMSSALTRPVASD

SEQ ID NO: 7562 - protein, 25 aa, synthetic construct
  source 1..25: note = Seed: LNVIVHSATGFKQSSKALQRPVASD
LNVIVHSATGVKQMSSALVRPVASD

SEQ ID NO: 7563 - protein, 25 aa, synthetic construct
  source 1..25: note = Seed: LNVIVHSATGFKQSSKALQRPVASD
LNVIVHSATGVKQMSTALARPVASD

SEQ ID NO: 7564 - protein, 25 aa, synthetic construct
  source 1..25: note = Seed: LNVIVHSATGFKQSSKALQRPVASD
LNVIVHSATGVKQMSTALGRPVASD

SEQ ID NO: 7565 - protein, 25 aa, synthetic construct
  source 1..25: note = Seed: LNVIVHSATGFKQSSKALQRPVASD
LNVIVHSATGVKQMSTALIRPVASD

SEQ ID NO: 7566 - protein, 25 aa, synthetic construct
  source 1..25: note = Seed: LNVIVHSATGFKQSSKALQRPVASD
LNVIVHSATGVKQMSTALLRPVASD

SEQ ID NO: 7567 - protein, 25 aa, synthetic construct
  source 1..25: note = Seed: LNVIVHSATGFKQSSKALQRPVASD
LNVIVHSATGVKQMSTALMRPVASD

SEQ ID NO: 7568 - protein, 25 aa, synthetic construct
  source 1..25: note = Seed: LNVIVHSATGFKQSSKALQRPVASD
LNVIVHSATGVKQMSTALNRPVASD

SEQ ID NO: 7569 - protein, 25 aa, synthetic construct
  source 1..25: note = Seed: LNVIVHSATGFKQSSKALQRPVASD
LNVIVHSATGVKQMSTALRRPVASD

SEQ ID NO: 7570 - protein, 25 aa, synthetic construct
  source 1..25: note = Seed: LNVIVHSATGFKQSSKALQRPVASD
LNVIVHSATGVKQMSTALSRPVASD

SEQ ID NO: 7571 - protein, 25 aa, synthetic construct
  source 1..25: note = Seed: LNVIVHSATGFKQSSKALQRPVASD
LNVIVHSATGVKQMSTALTRPVASD

SEQ ID NO: 7572 - protein, 25 aa, synthetic construct
  source 1..25: note = Seed: LNVIVHSATGFKQSSKALQRPVASD
LNVIVHSATGVKQMSTALVRPVASD

SEQ ID NO: 7573 - protein, 25 aa, synthetic construct
  source 1..25: note = Seed: LNVIVHSATGFKQSSKALQRPVASD
LNVIVHSATGVKQMSVALARPVASD

SEQ ID NO: 7574 - protein, 25 aa, synthetic construct
  source 1..25: note = Seed: LNVIVHSATGFKQSSKALQRPVASD
LNVIVHSATGVKQMSVALGRPVASD

SEQ ID NO: 7575 - protein, 25 aa, synthetic construct
  source 1..25: note = Seed: LNVIVHSATGFKQSSKALQRPVASD
LNVIVHSATGVKQMSVALHRPVASD

SEQ ID NO: 7576 - protein, 25 aa, synthetic construct
  source 1..25: note = Seed: LNVIVHSATGFKQSSKALQRPVASD
LNVIVHSATGVKQMSVALIRPVASD

SEQ ID NO: 7577 - protein, 25 aa, synthetic construct
  source 1..25: note = Seed: LNVIVHSATGFKQSSKALQRPVASD
LNVIVHSATGVKQMSVALLRPVASD

SEQ ID NO: 7578 - protein, 25 aa, synthetic construct
  source 1..25: note = Seed: LNVIVHSATGFKQSSKALQRPVASD
LNVIVHSATGVKQMSVALMRPVASD

SEQ ID NO: 7579 - protein, 25 aa, synthetic construct
  source 1..25: note = Seed: LNVIVHSATGFKQSSKALQRPVASD
LNVIVHSATGVKQMSVALNRPVASD

SEQ ID NO: 7580 - protein, 25 aa, synthetic construct
  source 1..25: note = Seed: LNVIVHSATGFKQSSKALQRPVASD
LNVIVHSATGVKQMSVALQRPVASD

SEQ ID NO: 7581 - protein, 25 aa, synthetic construct
  source 1..25: note = Seed: LNVIVHSATGFKQSSKALQRPVASD
LNVIVHSATGVKQMSVALRRPVASD

SEQ ID NO: 7582 - protein, 25 aa, synthetic construct
  source 1..25: note = Seed: LNVIVHSATGFKQSSKALQRPVASD
LNVIVHSATGVKQMSVALSRPVASD

SEQ ID NO: 7583 - protein, 25 aa, synthetic construct
  source 1..25: note = Seed: LNVIVHSATGFKQSSKALQRPVASD
LNVIVHSATGVKQMSVALTRPVASD

SEQ ID NO: 7584 - protein, 25 aa, synthetic construct
  source 1..25: note = Seed: LNVIVHSATGFKQSSKALQRPVASD
LNVIVHSATGVKQMSVALVRPVASD

SEQ ID NO: 7585 - protein, 25 aa, synthetic construct
  source 1..25: note = Seed: LNVIVHSATGFKQSSKALQRPVASD
LNVIVHSATGVKQNSAALARPVASD

SEQ ID NO: 7586 - protein, 25 aa, synthetic construct
  source 1..25: note = Seed: LNVIVHSATGFKQSSKALQRPVASD
LNVIVHSATGVKQNSAALFRPVASD

SEQ ID NO: 7587 - protein, 25 aa, synthetic construct
  source 1..25: note = Seed: LNVIVHSATGFKQSSKALQRPVASD
LNVIVHSATGVKQNSAALIRPVASD

SEQ ID NO: 7588 - protein, 25 aa, synthetic construct
  source 1..25: note = Seed: LNVIVHSATGFKQSSKALQRPVASD
LNVIVHSATGVKQNSAALLRPVASD

SEQ ID NO: 7589 - protein, 25 aa, synthetic construct
  source 1..25: note = Seed: LNVIVHSATGFKQSSKALQRPVASD
LNVIVHSATGVKQNSAALMRPVASD

SEQ ID NO: 7590 - protein, 25 aa, synthetic construct
  source 1..25: note = Seed: LNVIVHSATGFKQSSKALQRPVASD
LNVIVHSATGVKQNSAALSRPVASD

SEQ ID NO: 7591 - protein, 25 aa, synthetic construct
  source 1..25: note = Seed: LNVIVHSATGFKQSSKALQRPVASD
LNVIVHSATGVKQNSAALTRPVASD

SEQ ID NO: 7592 - protein, 25 aa, synthetic construct
  source 1..25: note = Seed: LNVIVHSATGFKQSSKALQRPVASD
LNVIVHSATGVKQNSAALVRPVASD

SEQ ID NO: 7593 - protein, 25 aa, synthetic construct
  source 1..25: note = Seed: LNVIVHSATGFKQSSKALQRPVASD
LNVIVHSATGVKQNSAALWRPVASD

SEQ ID NO: 7594 - protein, 25 aa, synthetic construct
  source 1..25: note = Seed: LNVIVHSATGFKQSSKALQRPVASD
LNVIVHSATGVKQNSAALYRPVASD

SEQ ID NO: 7595 - protein, 25 aa, synthetic construct
  source 1..25: note = Seed: LNVIVHSATGFKQSSKALQRPVASD
LNVIVHSATGVKQNSGALARPVASD

SEQ ID NO: 7596 - protein, 25 aa, synthetic construct
  source 1..25: note = Seed: LNVIVHSATGFKQSSKALQRPVASD
LNVIVHSATGVKQNSGALFRPVASD

SEQ ID NO: 7597 - protein, 25 aa, synthetic construct
  source 1..25: note = Seed: LNVIVHSATGFKQSSKALQRPVASD
LNVIVHSATGVKQNSGALIRPVASD

SEQ ID NO: 7598 - protein, 25 aa, synthetic construct
  source 1..25: note = Seed: LNVIVHSATGFKQSSKALQRPVASD
LNVIVHSATGVKQNSGALLRPVASD

SEQ ID NO: 7599 - protein, 25 aa, synthetic construct
  source 1..25: note = Seed: LNVIVHSATGFKQSSKALQRPVASD
LNVIVHSATGVKQNSGALMRPVASD

SEQ ID NO: 7600 - protein, 25 aa, synthetic construct
  source 1..25: note = Seed: LNVIVHSATGFKQSSKALQRPVASD
LNVIVHSATGVKQNSGALVRPVASD

SEQ ID NO: 7601 - protein, 25 aa, synthetic construct
  source 1..25: note = Seed: LNVIVHSATGFKQSSKALQRPVASD
LNVIVHSATGVKQNSGALYRPVASD

SEQ ID NO: 7602 - protein, 25 aa, synthetic construct
  source 1..25: note = Seed: LNVIVHSATGFKQSSKALQRPVASD
LNVIVHSATGVKQNSHALIRPVASD

SEQ ID NO: 7603 - protein, 25 aa, synthetic construct
  source 1..25: note = Seed: LNVIVHSATGFKQSSKALQRPVASD
LNVIVHSATGVKQNSHALVRPVASD

SEQ ID NO: 7604 - protein, 25 aa, synthetic construct
  source 1..25: note = Seed: LNVIVHSATGFKQSSKALQRPVASD
LNVIVHSATGVKQNSIALARPVASD

SEQ ID NO: 7605 - protein, 25 aa, synthetic construct
  source 1..25: note = Seed: LNVIVHSATGFKQSSKALQRPVASD
LNVIVHSATGVKQNSIALFRPVASD

SEQ ID NO: 7606 - protein, 25 aa, synthetic construct
  source 1..25: note = Seed: LNVIVHSATGFKQSSKALQRPVASD
LNVIVHSATGVKQNSIALIRPVASD

SEQ ID NO: 7607 - protein, 25 aa, synthetic construct
  source 1..25: note = Seed: LNVIVHSATGFKQSSKALQRPVASD
LNVIVHSATGVKQNSIALLRPVASD

SEQ ID NO: 7608 - protein, 25 aa, synthetic construct
  source 1..25: note = Seed: LNVIVHSATGFKQSSKALQRPVASD
LNVIVHSATGVKQNSIALMRPVASD

SEQ ID NO: 7609 - protein, 25 aa, synthetic construct
  source 1..25: note = Seed: LNVIVHSATGFKQSSKALQRPVASD
LNVIVHSATGVKQNSIALVRPVASD

SEQ ID NO: 7610 - protein, 25 aa, synthetic construct
  source 1..25: note = Seed: LNVIVHSATGFKQSSKALQRPVASD
LNVIVHSATGVKQNSIALYRPVASD

SEQ ID NO: 7611 - protein, 25 aa, synthetic construct
  source 1..25: note = Seed: LNVIVHSATGFKQSSKALQRPVASD
LNVIVHSATGVKQNSLALFRPVASD

SEQ ID NO: 7612 - protein, 25 aa, synthetic construct
  source 1..25: note = Seed: LNVIVHSATGFKQSSKALQRPVASD
LNVIVHSATGVKQNSLALIRPVASD

SEQ ID NO: 7613 - protein, 25 aa, synthetic construct
  source 1..25: note = Seed: LNVIVHSATGFKQSSKALQRPVASD
LNVIVHSATGVKQNSLALLRPVASD

SEQ ID NO: 7614 - protein, 25 aa, synthetic construct
  source 1..25: note = Seed: LNVIVHSATGFKQSSKALQRPVASD
LNVIVHSATGVKQNSLALVRPVASD

SEQ ID NO: 7615 - protein, 25 aa, synthetic construct
  source 1..25: note = Seed: LNVIVHSATGFKQSSKALQRPVASD
LNVIVHSATGVKQNSLALYRPVASD

SEQ ID NO: 7616 - protein, 25 aa, synthetic construct
  source 1..25: note = Seed: LNVIVHSATGFKQSSKALQRPVASD
LNVIVHSATGVKQNSMALIRPVASD

SEQ ID NO: 7617 - protein, 25 aa, synthetic construct
  source 1..25: note = Seed: LNVIVHSATGFKQSSKALQRPVASD
LNVIVHSATGVKQNSMALLRPVASD

SEQ ID NO: 7618 - protein, 25 aa, synthetic construct
  source 1..25: note = Seed: LNVIVHSATGFKQSSKALQRPVASD
LNVIVHSATGVKQNSMALVRPVASD

SEQ ID NO: 7619 - protein, 25 aa, synthetic construct
  source 1..25: note = Seed: LNVIVHSATGFKQSSKALQRPVASD
LNVIVHSATGVKQNSMALYRPVASD

SEQ ID NO: 7620 - protein, 25 aa, synthetic construct
  source 1..25: note = Seed: LNVIVHSATGFKQSSKALQRPVASD
LNVIVHSATGVKQNSNALARPVASD

SEQ ID NO: 7621 - protein, 25 aa, synthetic construct
  source 1..25: note = Seed: LNVIVHSATGFKQSSKALQRPVASD
LNVIVHSATGVKQNSNALFRPVASD

SEQ ID NO: 7622 - protein, 25 aa, synthetic construct
  source 1..25: note = Seed: LNVIVHSATGFKQSSKALQRPVASD
LNVIVHSATGVKQNSNALIRPVASD

SEQ ID NO: 7623 - protein, 25 aa, synthetic construct
  source 1..25: note = Seed: LNVIVHSATGFKQSSKALQRPVASD
LNVIVHSATGVKQNSNALLRPVASD

SEQ ID NO: 7624 - protein, 25 aa, synthetic construct
  source 1..25: note = Seed: LNVIVHSATGFKQSSKALQRPVASD
LNVIVHSATGVKQNSNALMRPVASD

SEQ ID NO: 7625 - protein, 25 aa, synthetic construct
  source 1..25: note = Seed: LNVIVHSATGFKQSSKALQRPVASD
LNVIVHSATGVKQNSNALVRPVASD

SEQ ID NO: 7626 - protein, 25 aa, synthetic construct
  source 1..25: note = Seed: LNVIVHSATGFKQSSKALQRPVASD
LNVIVHSATGVKQNSNALWRPVASD

SEQ ID NO: 7627 - protein, 25 aa, synthetic construct
  source 1..25: note = Seed: LNVIVHSATGFKQSSKALQRPVASD
LNVIVHSATGVKQNSNALYRPVASD

SEQ ID NO: 7628 - protein, 25 aa, synthetic construct
  source 1..25: note = Seed: LNVIVHSATGFKQSSKALQRPVASD
LNVIVHSATGVKQNSPALARPVASD

SEQ ID NO: 7629 - protein, 25 aa, synthetic construct
  source 1..25: note = Seed: LNVIVHSATGFKQSSKALQRPVASD
LNVIVHSATGVKQNSPALFRPVASD

SEQ ID NO: 7630 - protein, 25 aa, synthetic construct
  source 1..25: note = Seed: LNVIVHSATGFKQSSKALQRPVASD
LNVIVHSATGVKQNSPALIRPVASD

SEQ ID NO: 7631 - protein, 25 aa, synthetic construct
  source 1..25: note = Seed: LNVIVHSATGFKQSSKALQRPVASD
LNVIVHSATGVKQNSPALLRPVASD

SEQ ID NO: 7632 - protein, 25 aa, synthetic construct
  source 1..25: note = Seed: LNVIVHSATGFKQSSKALQRPVASD
LNVIVHSATGVKQNSPALMRPVASD

SEQ ID NO: 7633 - protein, 25 aa, synthetic construct
  source 1..25: note = Seed: LNVIVHSATGFKQSSKALQRPVASD
LNVIVHSATGVKQNSPALVRPVASD

SEQ ID NO: 7634 - protein, 25 aa, synthetic construct
  source 1..25: note = Seed: LNVIVHSATGFKQSSKALQRPVASD
LNVIVHSATGVKQNSPALYRPVASD

SEQ ID NO: 7635 - protein, 25 aa, synthetic construct
  source 1..25: note = Seed: LNVIVHSATGFKQSSKALQRPVASD
LNVIVHSATGVKQNSQALIRPVASD

SEQ ID NO: 7636 - protein, 25 aa, synthetic construct
  source 1..25: note = Seed: LNVIVHSATGFKQSSKALQRPVASD
LNVIVHSATGVKQNSQALVRPVASD

SEQ ID NO: 7637 - protein, 25 aa, synthetic construct
  source 1..25: note = Seed: LNVIVHSATGFKQSSKALQRPVASD
LNVIVHSATGVKQNSSALARPVASD

SEQ ID NO: 7638 - protein, 25 aa, synthetic construct
  source 1..25: note = Seed: LNVIVHSATGFKQSSKALQRPVASD
LNVIVHSATGVKQNSSALFRPVASD

SEQ ID NO: 7639 - protein, 25 aa, synthetic construct
  source 1..25: note = Seed: LNVIVHSATGFKQSSKALQRPVASD
LNVIVHSATGVKQNSSALIRPVASD

SEQ ID NO: 7640 - protein, 25 aa, synthetic construct
  source 1..25: note = Seed: LNVIVHSATGFKQSSKALQRPVASD
LNVIVHSATGVKQNSSALLRPVASD

SEQ ID NO: 7641 - protein, 25 aa, synthetic construct
  source 1..25: note = Seed: LNVIVHSATGFKQSSKALQRPVASD
LNVIVHSATGVKQNSSALMRPVASD

SEQ ID NO: 7642 - protein, 25 aa, synthetic construct
  source 1..25: note = Seed: LNVIVHSATGFKQSSKALQRPVASD
LNVIVHSATGVKQNSSALTRPVASD

SEQ ID NO: 7643 - protein, 25 aa, synthetic construct
  source 1..25: note = Seed: LNVIVHSATGFKQSSKALQRPVASD
LNVIVHSATGVKQNSSALVRPVASD

SEQ ID NO: 7644 - protein, 25 aa, synthetic construct
  source 1..25: note = Seed: LNVIVHSATGFKQSSKALQRPVASD
LNVIVHSATGVKQNSSALYRPVASD

SEQ ID NO: 7645 - protein, 25 aa, synthetic construct
  source 1..25: note = Seed: LNVIVHSATGFKQSSKALQRPVASD
LNVIVHSATGVKQNSTALFRPVASD

SEQ ID NO: 7646 - protein, 25 aa, synthetic construct
  source 1..25: note = Seed: LNVIVHSATGFKQSSKALQRPVASD
LNVIVHSATGVKQNSTALIRPVASD

SEQ ID NO: 7647 - protein, 25 aa, synthetic construct
  source 1..25: note = Seed: LNVIVHSATGFKQSSKALQRPVASD
LNVIVHSATGVKQNSTALLRPVASD

SEQ ID NO: 7648 - protein, 25 aa, synthetic construct
  source 1..25: note = Seed: LNVIVHSATGFKQSSKALQRPVASD
LNVIVHSATGVKQNSTALMRPVASD

SEQ ID NO: 7649 - protein, 25 aa, synthetic construct
  source 1..25: note = Seed: LNVIVHSATGFKQSSKALQRPVASD
LNVIVHSATGVKQNSTALVRPVASD

SEQ ID NO: 7650 - protein, 25 aa, synthetic construct
  source 1..25: note = Seed: LNVIVHSATGFKQSSKALQRPVASD
LNVIVHSATGVKQNSTALYRPVASD

SEQ ID NO: 7651 - protein, 25 aa, synthetic construct
  source 1..25: note = Seed: LNVIVHSATGFKQSSKALQRPVASD
LNVIVHSATGVKQNSVALFRPVASD

SEQ ID NO: 7652 - protein, 25 aa, synthetic construct
  source 1..25: note = Seed: LNVIVHSATGFKQSSKALQRPVASD
LNVIVHSATGVKQNSVALIRPVASD

SEQ ID NO: 7653 - protein, 25 aa, synthetic construct
  source 1..25: note = Seed: LNVIVHSATGFKQSSKALQRPVASD
LNVIVHSATGVKQNSVALLRPVASD

SEQ ID NO: 7654 - protein, 25 aa, synthetic construct
  source 1..25: note = Seed: LNVIVHSATGFKQSSKALQRPVASD
LNVIVHSATGVKQNSVALMRPVASD

SEQ ID NO: 7655 - protein, 25 aa, synthetic construct
  source 1..25: note = Seed: LNVIVHSATGFKQSSKALQRPVASD
LNVIVHSATGVKQNSVALVRPVASD

SEQ ID NO: 7656 - protein, 25 aa, synthetic construct
  source 1..25: note = Seed: LNVIVHSATGFKQSSKALQRPVASD
LNVIVHSATGVKQNSVALYRPVASD

SEQ ID NO: 7657 - protein, 25 aa, synthetic construct
  source 1..25: note = Seed: LNVIVHSATGFKQSSKALQRPVASD
LNVIVHSATGVKQQSAALARPVASD

SEQ ID NO: 7658 - protein, 25 aa, synthetic construct
  source 1..25: note = Seed: LNVIVHSATGFKQSSKALQRPVASD
LNVIVHSATGVKQQSAALIRPVASD

SEQ ID NO: 7659 - protein, 25 aa, synthetic construct
  source 1..25: note = Seed: LNVIVHSATGFKQSSKALQRPVASD
LNVIVHSATGVKQQSAALLRPVASD

SEQ ID NO: 7660 - protein, 25 aa, synthetic construct
  source 1..25: note = Seed: LNVIVHSATGFKQSSKALQRPVASD
LNVIVHSATGVKQQSAALMRPVASD

SEQ ID NO: 7661 - protein, 25 aa, synthetic construct
  source 1..25: note = Seed: LNVIVHSATGFKQSSKALQRPVASD
LNVIVHSATGVKQQSAALVRPVASD

SEQ ID NO: 7662 - protein, 25 aa, synthetic construct
  source 1..25: note = Seed: LNVIVHSATGFKQSSKALQRPVASD
LNVIVHSATGVKQQSGALARPVASD

SEQ ID NO: 7663 - protein, 25 aa, synthetic construct
  source 1..25: note = Seed: LNVIVHSATGFKQSSKALQRPVASD
LNVIVHSATGVKQQSGALIRPVASD

SEQ ID NO: 7664 - protein, 25 aa, synthetic construct
  source 1..25: note = Seed: LNVIVHSATGFKQSSKALQRPVASD
LNVIVHSATGVKQQSGALLRPVASD

SEQ ID NO: 7665 - protein, 25 aa, synthetic construct
  source 1..25: note = Seed: LNVIVHSATGFKQSSKALQRPVASD
LNVIVHSATGVKQQSGALVRPVASD

SEQ ID NO: 7666 - protein, 25 aa, synthetic construct
  source 1..25: note = Seed: LNVIVHSATGFKQSSKALQRPVASD
LNVIVHSATGVKQQSIALARPVASD

SEQ ID NO: 7667 - protein, 25 aa, synthetic construct
  source 1..25: note = Seed: LNVIVHSATGFKQSSKALQRPVASD
LNVIVHSATGVKQQSIALVRPVASD

SEQ ID NO: 7668 - protein, 25 aa, synthetic construct
  source 1..25: note = Seed: LNVIVHSATGFKQSSKALQRPVASD
LNVIVHSATGVKQQSLALARPVASD

SEQ ID NO: 7669 - protein, 25 aa, synthetic construct
  source 1..25: note = Seed: LNVIVHSATGFKQSSKALQRPVASD
LNVIVHSATGVKQQSRALARPVASD

SEQ ID NO: 7670 - protein, 25 aa, synthetic construct
  source 1..25: note = Seed: LNVIVHSATGFKQSSKALQRPVASD
LNVIVHSATGVKQQSRALSRPVASD

SEQ ID NO: 7671 - protein, 25 aa, synthetic construct
  source 1..25: note = Seed: LNVIVHSATGFKQSSKALQRPVASD
LNVIVHSATGVKQQSSALARPVASD

SEQ ID NO: 7672 - protein, 25 aa, synthetic construct
  source 1..25: note = Seed: LNVIVHSATGFKQSSKALQRPVASD
LNVIVHSATGVKQQSSALIRPVASD

SEQ ID NO: 7673 - protein, 25 aa, synthetic construct
  source 1..25: note = Seed: LNVIVHSATGFKQSSKALQRPVASD
LNVIVHSATGVKQQSSALLRPVASD

SEQ ID NO: 7674 - protein, 25 aa, synthetic construct
  source 1..25: note = Seed: LNVIVHSATGFKQSSKALQRPVASD
LNVIVHSATGVKQQSSALVRPVASD

SEQ ID NO: 7675 - protein, 25 aa, synthetic construct
  source 1..25: note = Seed: LNVIVHSATGFKQSSKALQRPVASD
LNVIVHSATGVKQQSVALLRPVASD

SEQ ID NO: 7676 - protein, 25 aa, synthetic construct
  source 1..25: note = Seed: LNVIVHSATGFKQSSKALQRPVASD
LNVIVHSATGVKQQSVALMRPVASD

SEQ ID NO: 7677 - protein, 25 aa, synthetic construct
  source 1..25: note = Seed: LNVIVHSATGFKQSSKALQRPVASD
LNVIVHSATGVKQRSRALMRPVASD

SEQ ID NO: 7678 - protein, 25 aa, synthetic construct
  source 1..25: note = Seed: LNVIVHSATGFKQSSKALQRPVASD
LNVIVHSATGVKQRSRALRRPVASD

SEQ ID NO: 7679 - protein, 25 aa, synthetic construct
  source 1..25: note = Seed: LNVIVHSATGFKQSSKALQRPVASD
LNVIVHSATGVKQRSRALVRPVASD

SEQ ID NO: 7680 - protein, 25 aa, synthetic construct
  source 1..25: note = Seed: LNVIVHSATGFKQSSKALQRPVASD
LNVIVHSATGVKQRSRALYRPVASD

SEQ ID NO: 7681 - protein, 25 aa, synthetic construct
  source 1..25: note = Seed: LNVIVHSATGFKQSSKALQRPVASD
LNVIVHSATGVKQSSAALIRPVASD

SEQ ID NO: 7682 - protein, 25 aa, synthetic construct
  source 1..25: note = Seed: LNVIVHSATGFKQSSKALQRPVASD
LNVIVHSATGVKQSSAALLRPVASD

SEQ ID NO: 7683 - protein, 25 aa, synthetic construct
  source 1..25: note = Seed: LNVIVHSATGFKQSSKALQRPVASD
LNVIVHSATGVKQSSAALVRPVASD

SEQ ID NO: 7684 - protein, 25 aa, synthetic construct
  source 1..25: note = Seed: LNVIVHSATGFKQSSKALQRPVASD
LNVIVHSATGVKQSSGALIRPVASD

SEQ ID NO: 7685 - protein, 25 aa, synthetic construct
  source 1..25: note = Seed: LNVIVHSATGFKQSSKALQRPVASD
LNVIVHSATGVKQSSNALIRPVASD

SEQ ID NO: 7686 - protein, 25 aa, synthetic construct
  source 1..25: note = Seed: LNVIVHSATGFKQSSKALQRPVASD
LNVIVHSATGVKQSSNALVRPVASD

SEQ ID NO: 7687 - protein, 25 aa, synthetic construct
  source 1..25: note = Seed: LNVIVHSATGFKQSSKALQRPVASD
LNVIVHSATGVKQSSPALIRPVASD

SEQ ID NO: 7688 - protein, 25 aa, synthetic construct
  source 1..25: note = Seed: LNVIVHSATGFKQSSKALQRPVASD
LNVIVHSATGVKQSSRALRRPVASD

SEQ ID NO: 7689 - protein, 25 aa, synthetic construct
  source 1..25: note = Seed: LNVIVHSATGFKQSSKALQRPVASD
LNVIVHSATGVKQSSSALIRPVASD

SEQ ID NO: 7690 - protein, 25 aa, synthetic construct
  source 1..25: note = Seed: LNVIVHSATGFKQSSKALQRPVASD
LNVIVHSATGVKQSSSALLRPVASD

SEQ ID NO: 7691 - protein, 25 aa, synthetic construct
  source 1..25: note = Seed: LNVIVHSATGFKQSSKALQRPVASD
LNVIVHSATGVKQSSSALVRPVASD

SEQ ID NO: 7692 - protein, 25 aa, synthetic construct
  source 1..25: note = Seed: LNVIVHSATGFKQSSKALQRPVASD
LNVIVHSATGVKQTSAALFRPVASD

SEQ ID NO: 7693 - protein, 25 aa, synthetic construct
  source 1..25: note = Seed: LNVIVHSATGFKQSSKALQRPVASD
LNVIVHSATGVKQTSAALIRPVASD

SEQ ID NO: 7694 - protein, 25 aa, synthetic construct
  source 1..25: note = Seed: LNVIVHSATGFKQSSKALQRPVASD
LNVIVHSATGVKQTSAALLRPVASD

SEQ ID NO: 7695 - protein, 25 aa, synthetic construct
  source 1..25: note = Seed: LNVIVHSATGFKQSSKALQRPVASD
LNVIVHSATGVKQTSAALMRPVASD

SEQ ID NO: 7696 - protein, 25 aa, synthetic construct
  source 1..25: note = Seed: LNVIVHSATGFKQSSKALQRPVASD
LNVIVHSATGVKQTSAALVRPVASD

SEQ ID NO: 7697 - protein, 25 aa, synthetic construct
  source 1..25: note = Seed: LNVIVHSATGFKQSSKALQRPVASD
LNVIVHSATGVKQTSGALIRPVASD

SEQ ID NO: 7698 - protein, 25 aa, synthetic construct
  source 1..25: note = Seed: LNVIVHSATGFKQSSKALQRPVASD
LNVIVHSATGVKQTSGALLRPVASD

SEQ ID NO: 7699 - protein, 25 aa, synthetic construct
  source 1..25: note = Seed: LNVIVHSATGFKQSSKALQRPVASD
LNVIVHSATGVKQTSGALVRPVASD

SEQ ID NO: 7700 - protein, 25 aa, synthetic construct
  source 1..25: note = Seed: LNVIVHSATGFKQSSKALQRPVASD
LNVIVHSATGVKQTSNALIRPVASD

SEQ ID NO: 7701 - protein, 25 aa, synthetic construct
  source 1..25: note = Seed: LNVIVHSATGFKQSSKALQRPVASD
LNVIVHSATGVKQTSPALIRPVASD

SEQ ID NO: 7702 - protein, 25 aa, synthetic construct
  source 1..25: note = Seed: LNVIVHSATGFKQSSKALQRPVASD
LNVIVHSATGVKQTSPALLRPVASD

SEQ ID NO: 7703 - protein, 25 aa, synthetic construct
  source 1..25: note = Seed: LNVIVHSATGFKQSSKALQRPVASD
LNVIVHSATGVKQTSPALVRPVASD

SEQ ID NO: 7704 - protein, 25 aa, synthetic construct
  source 1..25: note = Seed: LNVIVHSATGFKQSSKALQRPVASD
LNVIVHSATGVKQTSRALRRPVASD

SEQ ID NO: 7705 - protein, 25 aa, synthetic construct
  source 1..25: note = Seed: LNVIVHSATGFKQSSKALQRPVASD
LNVIVHSATGVKQTSSALFRPVASD

SEQ ID NO: 7706 - protein, 25 aa, synthetic construct
  source 1..25: note = Seed: LNVIVHSATGFKQSSKALQRPVASD
LNVIVHSATGVKQTSSALIRPVASD

SEQ ID NO: 7707 - protein, 25 aa, synthetic construct
  source 1..25: note = Seed: LNVIVHSATGFKQSSKALQRPVASD
LNVIVHSATGVKQTSSALLRPVASD

SEQ ID NO: 7708 - protein, 25 aa, synthetic construct
  source 1..25: note = Seed: LNVIVHSATGFKQSSKALQRPVASD
LNVIVHSATGVKQTSSALMRPVASD

SEQ ID NO: 7709 - protein, 25 aa, synthetic construct
  source 1..25: note = Seed: LNVIVHSATGFKQSSKALQRPVASD
LNVIVHSATGVKQTSSALVRPVASD

SEQ ID NO: 7710 - protein, 25 aa, synthetic construct
  source 1..25: note = Seed: LNVIVHSATGFKQSSKALQRPVASD
LNVIVHSATGVKQTSTALIRPVASD

SEQ ID NO: 7711 - protein, 25 aa, synthetic construct
  source 1..25: note = Seed: LNVIVHSATGFKQSSKALQRPVASD
LNVIVHSATGVKQVSAALARPVASD

SEQ ID NO: 7712 - protein, 25 aa, synthetic construct
  source 1..25: note = Seed: LNVIVHSATGFKQSSKALQRPVASD
LNVIVHSATGVKQVSAALIRPVASD

SEQ ID NO: 7713 - protein, 25 aa, synthetic construct
  source 1..25: note = Seed: LNVIVHSATGFKQSSKALQRPVASD
LNVIVHSATGVKQVSAALLRPVASD

SEQ ID NO: 7714 - protein, 25 aa, synthetic construct
  source 1..25: note = Seed: LNVIVHSATGFKQSSKALQRPVASD
LNVIVHSATGVKQVSAALNRPVASD

SEQ ID NO: 7715 - protein, 25 aa, synthetic construct
  source 1..25: note = Seed: LNVIVHSATGFKQSSKALQRPVASD
LNVIVHSATGVKQVSAALSRPVASD

SEQ ID NO: 7716 - protein, 25 aa, synthetic construct
  source 1..25: note = Seed: LNVIVHSATGFKQSSKALQRPVASD
LNVIVHSATGVKQVSAALTRPVASD

SEQ ID NO: 7717 - protein, 25 aa, synthetic construct
  source 1..25: note = Seed: LNVIVHSATGFKQSSKALQRPVASD
LNVIVHSATGVKQVSAALVRPVASD

SEQ ID NO: 7718 - protein, 25 aa, synthetic construct
  source 1..25: note = Seed: LNVIVHSATGFKQSSKALQRPVASD
LNVIVHSATGVKQVSGALARPVASD

SEQ ID NO: 7719 - protein, 25 aa, synthetic construct
  source 1..25: note = Seed: LNVIVHSATGFKQSSKALQRPVASD
LNVIVHSATGVKQVSGALIRPVASD

SEQ ID NO: 7720 - protein, 25 aa, synthetic construct
  source 1..25: note = Seed: LNVIVHSATGFKQSSKALQRPVASD
LNVIVHSATGVKQVSGALLRPVASD

SEQ ID NO: 7721 - protein, 25 aa, synthetic construct
  source 1..25: note = Seed: LNVIVHSATGFKQSSKALQRPVASD
LNVIVHSATGVKQVSGALSRPVASD

SEQ ID NO: 7722 - protein, 25 aa, synthetic construct
  source 1..25: note = Seed: LNVIVHSATGFKQSSKALQRPVASD
LNVIVHSATGVKQVSGALVRPVASD

SEQ ID NO: 7723 - protein, 25 aa, synthetic construct
  source 1..25: note = Seed: LNVIVHSATGFKQSSKALQRPVASD
LNVIVHSATGVKQVSHALRRPVASD

SEQ ID NO: 7724 - protein, 25 aa, synthetic construct
  source 1..25: note = Seed: LNVIVHSATGFKQSSKALQRPVASD
LNVIVHSATGVKQVSIALRRPVASD

SEQ ID NO: 7725 - protein, 25 aa, synthetic construct
  source 1..25: note = Seed: LNVIVHSATGFKQSSKALQRPVASD
LNVIVHSATGVKQVSIALSRPVASD

SEQ ID NO: 7726 - protein, 25 aa, synthetic construct
  source 1..25: note = Seed: LNVIVHSATGFKQSSKALQRPVASD
LNVIVHSATGVKQVSKALARPVASD

SEQ ID NO: 7727 - protein, 25 aa, synthetic construct
  source 1..25: note = Seed: LNVIVHSATGFKQSSKALQRPVASD
LNVIVHSATGVKQVSKALGRPVASD

SEQ ID NO: 7728 - protein, 25 aa, synthetic construct
  source 1..25: note = Seed: LNVIVHSATGFKQSSKALQRPVASD
LNVIVHSATGVKQVSKALHRPVASD

SEQ ID NO: 7729 - protein, 25 aa, synthetic construct
  source 1..25: note = Seed: LNVIVHSATGFKQSSKALQRPVASD
LNVIVHSATGVKQVSKALKRPVASD

SEQ ID NO: 7730 - protein, 25 aa, synthetic construct
  source 1..25: note = Seed: LNVIVHSATGFKQSSKALQRPVASD
LNVIVHSATGVKQVSKALQRPVASD

SEQ ID NO: 7731 - protein, 25 aa, synthetic construct
  source 1..25: note = Seed: LNVIVHSATGFKQSSKALQRPVASD
LNVIVHSATGVKQVSKALRRPVASD

SEQ ID NO: 7732 - protein, 25 aa, synthetic construct
  source 1..25: note = Seed: LNVIVHSATGFKQSSKALQRPVASD
LNVIVHSATGVKQVSKALSRPVASD

SEQ ID NO: 7733 - protein, 25 aa, synthetic construct
  source 1..25: note = Seed: LNVIVHSATGFKQSSKALQRPVASD
LNVIVHSATGVKQVSKALTRPVASD

SEQ ID NO: 7734 - protein, 25 aa, synthetic construct
  source 1..25: note = Seed: LNVIVHSATGFKQSSKALQRPVASD
LNVIVHSATGVKQVSKALVRPVASD

SEQ ID NO: 7735 - protein, 25 aa, synthetic construct
  source 1..25: note = Seed: LNVIVHSATGFKQSSKALQRPVASD
LNVIVHSATGVKQVSKALYRPVASD

SEQ ID NO: 7736 - protein, 25 aa, synthetic construct
  source 1..25: note = Seed: LNVIVHSATGFKQSSKALQRPVASD
LNVIVHSATGVKQVSLALSRPVASD

SEQ ID NO: 7737 - protein, 25 aa, synthetic construct
  source 1..25: note = Seed: LNVIVHSATGFKQSSKALQRPVASD
LNVIVHSATGVKQVSPALARPVASD

SEQ ID NO: 7738 - protein, 25 aa, synthetic construct
  source 1..25: note = Seed: LNVIVHSATGFKQSSKALQRPVASD
LNVIVHSATGVKQVSPALIRPVASD

SEQ ID NO: 7739 - protein, 25 aa, synthetic construct
  source 1..25: note = Seed: LNVIVHSATGFKQSSKALQRPVASD
LNVIVHSATGVKQVSPALVRPVASD

SEQ ID NO: 7740 - protein, 25 aa, synthetic construct
  source 1..25: note = Seed: LNVIVHSATGFKQSSKALQRPVASD
LNVIVHSATGVKQVSRALARPVASD

SEQ ID NO: 7741 - protein, 25 aa, synthetic construct
  source 1..25: note = Seed: LNVIVHSATGFKQSSKALQRPVASD
LNVIVHSATGVKQVSRALGRPVASD

SEQ ID NO: 7742 - protein, 25 aa, synthetic construct
  source 1..25: note = Seed: LNVIVHSATGFKQSSKALQRPVASD
LNVIVHSATGVKQVSRALHRPVASD

SEQ ID NO: 7743 - protein, 25 aa, synthetic construct
  source 1..25: note = Seed: LNVIVHSATGFKQSSKALQRPVASD
LNVIVHSATGVKQVSRALIRPVASD

SEQ ID NO: 7744 - protein, 25 aa, synthetic construct
  source 1..25: note = Seed: LNVIVHSATGFKQSSKALQRPVASD
LNVIVHSATGVKQVSRALKRPVASD

SEQ ID NO: 7745 - protein, 25 aa, synthetic construct
  source 1..25: note = Seed: LNVIVHSATGFKQSSKALQRPVASD
LNVIVHSATGVKQVSRALLRPVASD

SEQ ID NO: 7746 - protein, 25 aa, synthetic construct
  source 1..25: note = Seed: LNVIVHSATGFKQSSKALQRPVASD
LNVIVHSATGVKQVSRALMRPVASD

SEQ ID NO: 7747 - protein, 25 aa, synthetic construct
  source 1..25: note = Seed: LNVIVHSATGFKQSSKALQRPVASD
LNVIVHSATGVKQVSRALNRPVASD

SEQ ID NO: 7748 - protein, 25 aa, synthetic construct
  source 1..25: note = Seed: LNVIVHSATGFKQSSKALQRPVASD
LNVIVHSATGVKQVSRALQRPVASD

SEQ ID NO: 7749 - protein, 25 aa, synthetic construct
  source 1..25: note = Seed: LNVIVHSATGFKQSSKALQRPVASD
LNVIVHSATGVKQVSRALRRPVASD

SEQ ID NO: 7750 - protein, 25 aa, synthetic construct
  source 1..25: note = Seed: LNVIVHSATGFKQSSKALQRPVASD
LNVIVHSATGVKQVSRALSRPVASD

SEQ ID NO: 7751 - protein, 25 aa, synthetic construct
  source 1..25: note = Seed: LNVIVHSATGFKQSSKALQRPVASD
LNVIVHSATGVKQVSRALTRPVASD

SEQ ID NO: 7752 - protein, 25 aa, synthetic construct
  source 1..25: note = Seed: LNVIVHSATGFKQSSKALQRPVASD
LNVIVHSATGVKQVSRALVRPVASD

SEQ ID NO: 7753 - protein, 25 aa, synthetic construct
  source 1..25: note = Seed: LNVIVHSATGFKQSSKALQRPVASD
LNVIVHSATGVKQVSRALYRPVASD

SEQ ID NO: 7754 - protein, 25 aa, synthetic construct
  source 1..25: note = Seed: LNVIVHSATGFKQSSKALQRPVASD
LNVIVHSATGVKQVSSALARPVASD

SEQ ID NO: 7755 - protein, 25 aa, synthetic construct
  source 1..25: note = Seed: LNVIVHSATGFKQSSKALQRPVASD
LNVIVHSATGVKQVSSALIRPVASD

SEQ ID NO: 7756 - protein, 25 aa, synthetic construct
  source 1..25: note = Seed: LNVIVHSATGFKQSSKALQRPVASD
LNVIVHSATGVKQVSSALLRPVASD

SEQ ID NO: 7757 - protein, 25 aa, synthetic construct
  source 1..25: note = Seed: LNVIVHSATGFKQSSKALQRPVASD
LNVIVHSATGVKQVSSALRRPVASD

SEQ ID NO: 7758 - protein, 25 aa, synthetic construct
  source 1..25: note = Seed: LNVIVHSATGFKQSSKALQRPVASD
LNVIVHSATGVKQVSSALVRPVASD

SEQ ID NO: 7759 - protein, 25 aa, synthetic construct
  source 1..25: note = Seed: LNVIVHSATGFKQSSKALQRPVASD
LNVIVHSATGVKQVSTALARPVASD

SEQ ID NO: 7760 - protein, 25 aa, synthetic construct
  source 1..25: note = Seed: LNVIVHSATGFKQSSKALQRPVASD
LNVIVHSATGVKQVSTALRRPVASD

SEQ ID NO: 7761 - protein, 25 aa, synthetic construct
  source 1..25: note = Seed: LNVIVHSATGFKQSSKALQRPVASD
LNVIVHSATGVKQVSVALARPVASD

SEQ ID NO: 7762 - protein, 25 aa, synthetic construct
  source 1..25: note = Seed: LNVIVHSATGFKQSSKALQRPVASD
LNVIVHSATGVKQVSVALIRPVASD

SEQ ID NO: 7763 - protein, 25 aa, synthetic construct
  source 1..25: note = Seed: LNVIVHSATGFKQSSKALQRPVASD
LNVIVHSATGVKQVSVALRRPVASD

SEQ ID NO: 7764 - protein, 25 aa, synthetic construct
  source 1..25: note = Seed: LNVIVHSATGFKQSSKALQRPVASD
LNVIVHSATGVKQVSVALSRPVASD

SEQ ID NO: 7765 - protein, 25 aa, synthetic construct
  source 1..25: note = Seed: LNVIVHSATGFKQSSKALQRPVASD
LNVIVHSATGVKQWSAALIRPVASD

SEQ ID NO: 7766 - protein, 25 aa, synthetic construct
  source 1..25: note = Seed: LNVIVHSATGFKQSSKALQRPVASD
LNVIVHSATGVKQWSAALRRPVASD

SEQ ID NO: 7767 - protein, 25 aa, synthetic construct
  source 1..25: note = Seed: LNVIVHSATGFKQSSKALQRPVASD
LNVIVHSATGVKQWSAALVRPVASD

SEQ ID NO: 7768 - protein, 25 aa, synthetic construct
  source 1..25: note = Seed: LNVIVHSATGFKQSSKALQRPVASD
LNVIVHSATGVKQWSIALRRPVASD

SEQ ID NO: 7769 - protein, 25 aa, synthetic construct
  source 1..25: note = Seed: LNVIVHSATGFKQSSKALQRPVASD
LNVIVHSATGVKQWSKALARPVASD

SEQ ID NO: 7770 - protein, 25 aa, synthetic construct
  source 1..25: note = Seed: LNVIVHSATGFKQSSKALQRPVASD
LNVIVHSATGVKQWSKALKRPVASD

SEQ ID NO: 7771 - protein, 25 aa, synthetic construct
  source 1..25: note = Seed: LNVIVHSATGFKQSSKALQRPVASD
LNVIVHSATGVKQWSKALRRPVASD

SEQ ID NO: 7772 - protein, 25 aa, synthetic construct
  source 1..25: note = Seed: LNVIVHSATGFKQSSKALQRPVASD
LNVIVHSATGVKQWSLALRRPVASD

SEQ ID NO: 7773 - protein, 25 aa, synthetic construct
  source 1..25: note = Seed: LNVIVHSATGFKQSSKALQRPVASD
LNVIVHSATGVKQWSMALRRPVASD

SEQ ID NO: 7774 - protein, 25 aa, synthetic construct
  source 1..25: note = Seed: LNVIVHSATGFKQSSKALQRPVASD
LNVIVHSATGVKQWSRALARPVASD

SEQ ID NO: 7775 - protein, 25 aa, synthetic construct
  source 1..25: note = Seed: LNVIVHSATGFKQSSKALQRPVASD
LNVIVHSATGVKQWSRALFRPVASD

SEQ ID NO: 7776 - protein, 25 aa, synthetic construct
  source 1..25: note = Seed: LNVIVHSATGFKQSSKALQRPVASD
LNVIVHSATGVKQWSRALHRPVASD

SEQ ID NO: 7777 - protein, 25 aa, synthetic construct
  source 1..25: note = Seed: LNVIVHSATGFKQSSKALQRPVASD
LNVIVHSATGVKQWSRALIRPVASD

SEQ ID NO: 7778 - protein, 25 aa, synthetic construct
  source 1..25: note = Seed: LNVIVHSATGFKQSSKALQRPVASD
LNVIVHSATGVKQWSRALKRPVASD

SEQ ID NO: 7779 - protein, 25 aa, synthetic construct
  source 1..25: note = Seed: LNVIVHSATGFKQSSKALQRPVASD
LNVIVHSATGVKQWSRALLRPVASD

SEQ ID NO: 7780 - protein, 25 aa, synthetic construct
  source 1..25: note = Seed: LNVIVHSATGFKQSSKALQRPVASD
LNVIVHSATGVKQWSRALMRPVASD

SEQ ID NO: 7781 - protein, 25 aa, synthetic construct
  source 1..25: note = Seed: LNVIVHSATGFKQSSKALQRPVASD
LNVIVHSATGVKQWSRALRRPVASD

SEQ ID NO: 7782 - protein, 25 aa, synthetic construct
  source 1..25: note = Seed: LNVIVHSATGFKQSSKALQRPVASD
LNVIVHSATGVKQWSRALSRPVASD

SEQ ID NO: 7783 - protein, 25 aa, synthetic construct
  source 1..25: note = Seed: LNVIVHSATGFKQSSKALQRPVASD
LNVIVHSATGVKQWSRALVRPVASD

SEQ ID NO: 7784 - protein, 25 aa, synthetic construct
  source 1..25: note = Seed: LNVIVHSATGFKQSSKALQRPVASD
LNVIVHSATGVKQWSRALYRPVASD

SEQ ID NO: 7785 - protein, 25 aa, synthetic construct
  source 1..25: note = Seed: LNVIVHSATGFKQSSKALQRPVASD
LNVIVHSATGVKQWSSALIRPVASD

SEQ ID NO: 7786 - protein, 25 aa, synthetic construct
  source 1..25: note = Seed: LNVIVHSATGFKQSSKALQRPVASD
LNVIVHSATGVKQWSVALRRPVASD

SEQ ID NO: 7787 - protein, 25 aa, synthetic construct
  source 1..25: note = Seed: LNVIVHSATGFKQSSKALQRPVASD
LNVIVHSATGVKQYSAALARPVASD

SEQ ID NO: 7788 - protein, 25 aa, synthetic construct
  source 1..25: note = Seed: LNVIVHSATGFKQSSKALQRPVASD
LNVIVHSATGVKQYSAALGRPVASD

SEQ ID NO: 7789 - protein, 25 aa, synthetic construct
  source 1..25: note = Seed: LNVIVHSATGFKQSSKALQRPVASD
LNVIVHSATGVKQYSAALLRPVASD

SEQ ID NO: 7790 - protein, 25 aa, synthetic construct
  source 1..25: note = Seed: LNVIVHSATGFKQSSKALQRPVASD
LNVIVHSATGVKQYSIALRRPVASD

SEQ ID NO: 7791 - protein, 25 aa, synthetic construct
  source 1..25: note = Seed: LNVIVHSATGFKQSSKALQRPVASD
LNVIVHSATGVKQYSKALKRPVASD

SEQ ID NO: 7792 - protein, 25 aa, synthetic construct
  source 1..25: note = Seed: LNVIVHSATGFKQSSKALQRPVASD
LNVIVHSATGVKQYSKALRRPVASD

SEQ ID NO: 7793 - protein, 25 aa, synthetic construct
  source 1..25: note = Seed: LNVIVHSATGFKQSSKALQRPVASD
LNVIVHSATGVKQYSMALRRPVASD

SEQ ID NO: 7794 - protein, 25 aa, synthetic construct
  source 1..25: note = Seed: LNVIVHSATGFKQSSKALQRPVASD
LNVIVHSATGVKQYSRALHRPVASD

SEQ ID NO: 7795 - protein, 25 aa, synthetic construct
  source 1..25: note = Seed: LNVIVHSATGFKQSSKALQRPVASD
LNVIVHSATGVKQYSRALKRPVASD

SEQ ID NO: 7796 - protein, 25 aa, synthetic construct
  source 1..25: note = Seed: LNVIVHSATGFKQSSKALQRPVASD
LNVIVHSATGVKQYSRALRRPVASD

SEQ ID NO: 7797 - protein, 25 aa, synthetic construct
  source 1..25: note = Seed: LNVIVHSATGFKQSSKALQRPVASD
LNVIVHSATGVKQYSSALARPVASD

SEQ ID NO: 7798 - protein, 25 aa, synthetic construct
  source 1..25: note = Seed: LNVIVHSATGFKQSSKALQRPVASD
LNVIVHSATGWKQASAALARPVASD

SEQ ID NO: 7799 - protein, 25 aa, synthetic construct
  source 1..25: note = Seed: LNVIVHSATGFKQSSKALQRPVASD
LNVIVHSATGWKQASAALCRPVASD

SEQ ID NO: 7800 - protein, 25 aa, synthetic construct
  source 1..25: note = Seed: LNVIVHSATGFKQSSKALQRPVASD
LNVIVHSATGWKQASAALFRPVASD

SEQ ID NO: 7801 - protein, 25 aa, synthetic construct
  source 1..25: note = Seed: LNVIVHSATGFKQSSKALQRPVASD
LNVIVHSATGWKQASAALGRPVASD

SEQ ID NO: 7802 - protein, 25 aa, synthetic construct
  source 1..25: note = Seed: LNVIVHSATGFKQSSKALQRPVASD
LNVIVHSATGWKQASAALHRPVASD

SEQ ID NO: 7803 - protein, 25 aa, synthetic construct
  source 1..25: note = Seed: LNVIVHSATGFKQSSKALQRPVASD
LNVIVHSATGWKQASAALIRPVASD

SEQ ID NO: 7804 - protein, 25 aa, synthetic construct
  source 1..25: note = Seed: LNVIVHSATGFKQSSKALQRPVASD
LNVIVHSATGWKQASAALLRPVASD

SEQ ID NO: 7805 - protein, 25 aa, synthetic construct
  source 1..25: note = Seed: LNVIVHSATGFKQSSKALQRPVASD
LNVIVHSATGWKQASAALMRPVASD

SEQ ID NO: 7806 - protein, 25 aa, synthetic construct
  source 1..25: note = Seed: LNVIVHSATGFKQSSKALQRPVASD
LNVIVHSATGWKQASAALNRPVASD

SEQ ID NO: 7807 - protein, 25 aa, synthetic construct
  source 1..25: note = Seed: LNVIVHSATGFKQSSKALQRPVASD
LNVIVHSATGWKQASAALQRPVASD

SEQ ID NO: 7808 - protein, 25 aa, synthetic construct
  source 1..25: note = Seed: LNVIVHSATGFKQSSKALQRPVASD
LNVIVHSATGWKQASAALSRPVASD

SEQ ID NO: 7809 - protein, 25 aa, synthetic construct
  source 1..25: note = Seed: LNVIVHSATGFKQSSKALQRPVASD
LNVIVHSATGWKQASAALTRPVASD

SEQ ID NO: 7810 - protein, 25 aa, synthetic construct
  source 1..25: note = Seed: LNVIVHSATGFKQSSKALQRPVASD
LNVIVHSATGWKQASAALVRPVASD

SEQ ID NO: 7811 - protein, 25 aa, synthetic construct
  source 1..25: note = Seed: LNVIVHSATGFKQSSKALQRPVASD
LNVIVHSATGWKQASFALLRPVASD

SEQ ID NO: 7812 - protein, 25 aa, synthetic construct
  source 1..25: note = Seed: LNVIVHSATGFKQSSKALQRPVASD
LNVIVHSATGWKQASGALARPVASD

SEQ ID NO: 7813 - protein, 25 aa, synthetic construct
  source 1..25: note = Seed: LNVIVHSATGFKQSSKALQRPVASD
LNVIVHSATGWKQASGALGRPVASD

SEQ ID NO: 7814 - protein, 25 aa, synthetic construct
  source 1..25: note = Seed: LNVIVHSATGFKQSSKALQRPVASD
LNVIVHSATGWKQASGALIRPVASD

SEQ ID NO: 7815 - protein, 25 aa, synthetic construct
  source 1..25: note = Seed: LNVIVHSATGFKQSSKALQRPVASD
LNVIVHSATGWKQASGALLRPVASD

SEQ ID NO: 7816 - protein, 25 aa, synthetic construct
  source 1..25: note = Seed: LNVIVHSATGFKQSSKALQRPVASD
LNVIVHSATGWKQASGALMRPVASD

SEQ ID NO: 7817 - protein, 25 aa, synthetic construct
  source 1..25: note = Seed: LNVIVHSATGFKQSSKALQRPVASD
LNVIVHSATGWKQASGALSRPVASD

SEQ ID NO: 7818 - protein, 25 aa, synthetic construct
  source 1..25: note = Seed: LNVIVHSATGFKQSSKALQRPVASD
LNVIVHSATGWKQASGALTRPVASD

SEQ ID NO: 7819 - protein, 25 aa, synthetic construct
  source 1..25: note = Seed: LNVIVHSATGFKQSSKALQRPVASD
LNVIVHSATGWKQASGALVRPVASD

SEQ ID NO: 7820 - protein, 25 aa, synthetic construct
  source 1..25: note = Seed: LNVIVHSATGFKQSSKALQRPVASD
LNVIVHSATGWKQASIALARPVASD

SEQ ID NO: 7821 - protein, 25 aa, synthetic construct
  source 1..25: note = Seed: LNVIVHSATGFKQSSKALQRPVASD
LNVIVHSATGWKQASIALHRPVASD

SEQ ID NO: 7822 - protein, 25 aa, synthetic construct
  source 1..25: note = Seed: LNVIVHSATGFKQSSKALQRPVASD
LNVIVHSATGWKQASIALIRPVASD

SEQ ID NO: 7823 - protein, 25 aa, synthetic construct
  source 1..25: note = Seed: LNVIVHSATGFKQSSKALQRPVASD
LNVIVHSATGWKQASIALLRPVASD

SEQ ID NO: 7824 - protein, 25 aa, synthetic construct
  source 1..25: note = Seed: LNVIVHSATGFKQSSKALQRPVASD
LNVIVHSATGWKQASIALMRPVASD

SEQ ID NO: 7825 - protein, 25 aa, synthetic construct
  source 1..25: note = Seed: LNVIVHSATGFKQSSKALQRPVASD
LNVIVHSATGWKQASIALNRPVASD

SEQ ID NO: 7826 - protein, 25 aa, synthetic construct
  source 1..25: note = Seed: LNVIVHSATGFKQSSKALQRPVASD
LNVIVHSATGWKQASIALQRPVASD

SEQ ID NO: 7827 - protein, 25 aa, synthetic construct
  source 1..25: note = Seed: LNVIVHSATGFKQSSKALQRPVASD
LNVIVHSATGWKQASIALSRPVASD

SEQ ID NO: 7828 - protein, 25 aa, synthetic construct
  source 1..25: note = Seed: LNVIVHSATGFKQSSKALQRPVASD
LNVIVHSATGWKQASIALTRPVASD

SEQ ID NO: 7829 - protein, 25 aa, synthetic construct
  source 1..25: note = Seed: LNVIVHSATGFKQSSKALQRPVASD
LNVIVHSATGWKQASIALVRPVASD

SEQ ID NO: 7830 - protein, 25 aa, synthetic construct
  source 1..25: note = Seed: LNVIVHSATGFKQSSKALQRPVASD
LNVIVHSATGWKQASKALARPVASD

SEQ ID NO: 7831 - protein, 25 aa, synthetic construct
  source 1..25: note = Seed: LNVIVHSATGFKQSSKALQRPVASD
LNVIVHSATGWKQASKALGRPVASD

SEQ ID NO: 7832 - protein, 25 aa, synthetic construct
  source 1..25: note = Seed: LNVIVHSATGFKQSSKALQRPVASD
LNVIVHSATGWKQASKALQRPVASD

SEQ ID NO: 7833 - protein, 25 aa, synthetic construct
  source 1..25: note = Seed: LNVIVHSATGFKQSSKALQRPVASD
LNVIVHSATGWKQASKALSRPVASD

SEQ ID NO: 7834 - protein, 25 aa, synthetic construct
  source 1..25: note = Seed: LNVIVHSATGFKQSSKALQRPVASD
LNVIVHSATGWKQASLALARPVASD

SEQ ID NO: 7835 - protein, 25 aa, synthetic construct
  source 1..25: note = Seed: LNVIVHSATGFKQSSKALQRPVASD
LNVIVHSATGWKQASLALIRPVASD

SEQ ID NO: 7836 - protein, 25 aa, synthetic construct
  source 1..25: note = Seed: LNVIVHSATGFKQSSKALQRPVASD
LNVIVHSATGWKQASLALMRPVASD

SEQ ID NO: 7837 - protein, 25 aa, synthetic construct
  source 1..25: note = Seed: LNVIVHSATGFKQSSKALQRPVASD
LNVIVHSATGWKQASLALNRPVASD

SEQ ID NO: 7838 - protein, 25 aa, synthetic construct
  source 1..25: note = Seed: LNVIVHSATGFKQSSKALQRPVASD
LNVIVHSATGWKQASLALSRPVASD

SEQ ID NO: 7839 - protein, 25 aa, synthetic construct
  source 1..25: note = Seed: LNVIVHSATGFKQSSKALQRPVASD
LNVIVHSATGWKQASLALVRPVASD

SEQ ID NO: 7840 - protein, 25 aa, synthetic construct
  source 1..25: note = Seed: LNVIVHSATGFKQSSKALQRPVASD
LNVIVHSATGWKQASMALARPVASD

SEQ ID NO: 7841 - protein, 25 aa, synthetic construct
  source 1..25: note = Seed: LNVIVHSATGFKQSSKALQRPVASD
LNVIVHSATGWKQASMALIRPVASD

SEQ ID NO: 7842 - protein, 25 aa, synthetic construct
  source 1..25: note = Seed: LNVIVHSATGFKQSSKALQRPVASD
LNVIVHSATGWKQASMALNRPVASD

SEQ ID NO: 7843 - protein, 25 aa, synthetic construct
  source 1..25: note = Seed: LNVIVHSATGFKQSSKALQRPVASD
LNVIVHSATGWKQASMALSRPVASD

SEQ ID NO: 7844 - protein, 25 aa, synthetic construct
  source 1..25: note = Seed: LNVIVHSATGFKQSSKALQRPVASD
LNVIVHSATGWKQASNALARPVASD

SEQ ID NO: 7845 - protein, 25 aa, synthetic construct
  source 1..25: note = Seed: LNVIVHSATGFKQSSKALQRPVASD
LNVIVHSATGWKQASNALIRPVASD

SEQ ID NO: 7846 - protein, 25 aa, synthetic construct
  source 1..25: note = Seed: LNVIVHSATGFKQSSKALQRPVASD
LNVIVHSATGWKQASNALLRPVASD

SEQ ID NO: 7847 - protein, 25 aa, synthetic construct
  source 1..25: note = Seed: LNVIVHSATGFKQSSKALQRPVASD
LNVIVHSATGWKQASNALNRPVASD

SEQ ID NO: 7848 - protein, 25 aa, synthetic construct
  source 1..25: note = Seed: LNVIVHSATGFKQSSKALQRPVASD
LNVIVHSATGWKQASNALSRPVASD

SEQ ID NO: 7849 - protein, 25 aa, synthetic construct
  source 1..25: note = Seed: LNVIVHSATGFKQSSKALQRPVASD
LNVIVHSATGWKQASNALVRPVASD

SEQ ID NO: 7850 - protein, 25 aa, synthetic construct
  source 1..25: note = Seed: LNVIVHSATGFKQSSKALQRPVASD
LNVIVHSATGWKQASPALARPVASD

SEQ ID NO: 7851 - protein, 25 aa, synthetic construct
  source 1..25: note = Seed: LNVIVHSATGFKQSSKALQRPVASD
LNVIVHSATGWKQASPALIRPVASD

SEQ ID NO: 7852 - protein, 25 aa, synthetic construct
  source 1..25: note = Seed: LNVIVHSATGFKQSSKALQRPVASD
LNVIVHSATGWKQASPALLRPVASD

SEQ ID NO: 7853 - protein, 25 aa, synthetic construct
  source 1..25: note = Seed: LNVIVHSATGFKQSSKALQRPVASD
LNVIVHSATGWKQASPALMRPVASD

SEQ ID NO: 7854 - protein, 25 aa, synthetic construct
  source 1..25: note = Seed: LNVIVHSATGFKQSSKALQRPVASD
LNVIVHSATGWKQASPALNRPVASD

SEQ ID NO: 7855 - protein, 25 aa, synthetic construct
  source 1..25: note = Seed: LNVIVHSATGFKQSSKALQRPVASD
LNVIVHSATGWKQASPALQRPVASD

SEQ ID NO: 7856 - protein, 25 aa, synthetic construct
  source 1..25: note = Seed: LNVIVHSATGFKQSSKALQRPVASD
LNVIVHSATGWKQASPALSRPVASD

SEQ ID NO: 7857 - protein, 25 aa, synthetic construct
  source 1..25: note = Seed: LNVIVHSATGFKQSSKALQRPVASD
LNVIVHSATGWKQASPALTRPVASD

SEQ ID NO: 7858 - protein, 25 aa, synthetic construct
  source 1..25: note = Seed: LNVIVHSATGFKQSSKALQRPVASD
LNVIVHSATGWKQASPALVRPVASD

SEQ ID NO: 7859 - protein, 25 aa, synthetic construct
  source 1..25: note = Seed: LNVIVHSATGFKQSSKALQRPVASD
LNVIVHSATGWKQASRALARPVASD

SEQ ID NO: 7860 - protein, 25 aa, synthetic construct
  source 1..25: note = Seed: LNVIVHSATGFKQSSKALQRPVASD
LNVIVHSATGWKQASRALGRPVASD

SEQ ID NO: 7861 - protein, 25 aa, synthetic construct
  source 1..25: note = Seed: LNVIVHSATGFKQSSKALQRPVASD
LNVIVHSATGWKQASRALHRPVASD

SEQ ID NO: 7862 - protein, 25 aa, synthetic construct
  source 1..25: note = Seed: LNVIVHSATGFKQSSKALQRPVASD
LNVIVHSATGWKQASRALQRPVASD

SEQ ID NO: 7863 - protein, 25 aa, synthetic construct
  source 1..25: note = Seed: LNVIVHSATGFKQSSKALQRPVASD
LNVIVHSATGWKQASRALSRPVASD

SEQ ID NO: 7864 - protein, 25 aa, synthetic construct
  source 1..25: note = Seed: LNVIVHSATGFKQSSKALQRPVASD
LNVIVHSATGWKQASRALTRPVASD

SEQ ID NO: 7865 - protein, 25 aa, synthetic construct
  source 1..25: note = Seed: LNVIVHSATGFKQSSKALQRPVASD
LNVIVHSATGWKQASSALARPVASD

SEQ ID NO: 7866 - protein, 25 aa, synthetic construct
  source 1..25: note = Seed: LNVIVHSATGFKQSSKALQRPVASD
LNVIVHSATGWKQASSALFRPVASD

SEQ ID NO: 7867 - protein, 25 aa, synthetic construct
  source 1..25: note = Seed: LNVIVHSATGFKQSSKALQRPVASD
LNVIVHSATGWKQASSALGRPVASD

SEQ ID NO: 7868 - protein, 25 aa, synthetic construct
  source 1..25: note = Seed: LNVIVHSATGFKQSSKALQRPVASD
LNVIVHSATGWKQASSALIRPVASD

SEQ ID NO: 7869 - protein, 25 aa, synthetic construct
  source 1..25: note = Seed: LNVIVHSATGFKQSSKALQRPVASD
LNVIVHSATGWKQASSALLRPVASD

SEQ ID NO: 7870 - protein, 25 aa, synthetic construct
  source 1..25: note = Seed: LNVIVHSATGFKQSSKALQRPVASD
LNVIVHSATGWKQASSALMRPVASD

SEQ ID NO: 7871 - protein, 25 aa, synthetic construct
  source 1..25: note = Seed: LNVIVHSATGFKQSSKALQRPVASD
LNVIVHSATGWKQASSALNRPVASD

SEQ ID NO: 7872 - protein, 25 aa, synthetic construct
  source 1..25: note = Seed: LNVIVHSATGFKQSSKALQRPVASD
LNVIVHSATGWKQASSALQRPVASD

SEQ ID NO: 7873 - protein, 25 aa, synthetic construct
  source 1..25: note = Seed: LNVIVHSATGFKQSSKALQRPVASD
LNVIVHSATGWKQASSALSRPVASD

SEQ ID NO: 7874 - protein, 25 aa, synthetic construct
  source 1..25: note = Seed: LNVIVHSATGFKQSSKALQRPVASD
LNVIVHSATGWKQASSALTRPVASD

SEQ ID NO: 7875 - protein, 25 aa, synthetic construct
  source 1..25: note = Seed: LNVIVHSATGFKQSSKALQRPVASD
LNVIVHSATGWKQASSALVRPVASD

SEQ ID NO: 7876 - protein, 25 aa, synthetic construct
  source 1..25: note = Seed: LNVIVHSATGFKQSSKALQRPVASD
LNVIVHSATGWKQASTALARPVASD

SEQ ID NO: 7877 - protein, 25 aa, synthetic construct
  source 1..25: note = Seed: LNVIVHSATGFKQSSKALQRPVASD
LNVIVHSATGWKQASTALIRPVASD

SEQ ID NO: 7878 - protein, 25 aa, synthetic construct
  source 1..25: note = Seed: LNVIVHSATGFKQSSKALQRPVASD
LNVIVHSATGWKQASTALLRPVASD

SEQ ID NO: 7879 - protein, 25 aa, synthetic construct
  source 1..25: note = Seed: LNVIVHSATGFKQSSKALQRPVASD
LNVIVHSATGWKQASTALMRPVASD

SEQ ID NO: 7880 - protein, 25 aa, synthetic construct
  source 1..25: note = Seed: LNVIVHSATGFKQSSKALQRPVASD
LNVIVHSATGWKQASTALNRPVASD

SEQ ID NO: 7881 - protein, 25 aa, synthetic construct
  source 1..25: note = Seed: LNVIVHSATGFKQSSKALQRPVASD
LNVIVHSATGWKQASTALQRPVASD

SEQ ID NO: 7882 - protein, 25 aa, synthetic construct
  source 1..25: note = Seed: LNVIVHSATGFKQSSKALQRPVASD
LNVIVHSATGWKQASTALSRPVASD

SEQ ID NO: 7883 - protein, 25 aa, synthetic construct
  source 1..25: note = Seed: LNVIVHSATGFKQSSKALQRPVASD
LNVIVHSATGWKQASTALTRPVASD

SEQ ID NO: 7884 - protein, 25 aa, synthetic construct
  source 1..25: note = Seed: LNVIVHSATGFKQSSKALQRPVASD
LNVIVHSATGWKQASTALVRPVASD

SEQ ID NO: 7885 - protein, 25 aa, synthetic construct
  source 1..25: note = Seed: LNVIVHSATGFKQSSKALQRPVASD
LNVIVHSATGWKQASVALARPVASD

SEQ ID NO: 7886 - protein, 25 aa, synthetic construct
  source 1..25: note = Seed: LNVIVHSATGFKQSSKALQRPVASD
LNVIVHSATGWKQASVALGRPVASD

SEQ ID NO: 7887 - protein, 25 aa, synthetic construct
  source 1..25: note = Seed: LNVIVHSATGFKQSSKALQRPVASD
LNVIVHSATGWKQASVALHRPVASD

SEQ ID NO: 7888 - protein, 25 aa, synthetic construct
  source 1..25: note = Seed: LNVIVHSATGFKQSSKALQRPVASD
LNVIVHSATGWKQASVALIRPVASD

SEQ ID NO: 7889 - protein, 25 aa, synthetic construct
  source 1..25: note = Seed: LNVIVHSATGFKQSSKALQRPVASD
LNVIVHSATGWKQASVALLRPVASD

SEQ ID NO: 7890 - protein, 25 aa, synthetic construct
  source 1..25: note = Seed: LNVIVHSATGFKQSSKALQRPVASD
LNVIVHSATGWKQASVALMRPVASD

SEQ ID NO: 7891 - protein, 25 aa, synthetic construct
  source 1..25: note = Seed: LNVIVHSATGFKQSSKALQRPVASD
LNVIVHSATGWKQASVALNRPVASD

SEQ ID NO: 7892 - protein, 25 aa, synthetic construct
  source 1..25: note = Seed: LNVIVHSATGFKQSSKALQRPVASD
LNVIVHSATGWKQASVALQRPVASD

SEQ ID NO: 7893 - protein, 25 aa, synthetic construct
  source 1..25: note = Seed: LNVIVHSATGFKQSSKALQRPVASD
LNVIVHSATGWKQASVALSRPVASD

SEQ ID NO: 7894 - protein, 25 aa, synthetic construct
  source 1..25: note = Seed: LNVIVHSATGFKQSSKALQRPVASD
LNVIVHSATGWKQASVALTRPVASD

SEQ ID NO: 7895 - protein, 25 aa, synthetic construct
  source 1..25: note = Seed: LNVIVHSATGFKQSSKALQRPVASD
LNVIVHSATGWKQASVALVRPVASD

SEQ ID NO: 7896 - protein, 25 aa, synthetic construct
  source 1..25: note = Seed: LNVIVHSATGFKQSSKALQRPVASD
LNVIVHSATGWKQCSAALARPVASD

SEQ ID NO: 7897 - protein, 25 aa, synthetic construct
  source 1..25: note = Seed: LNVIVHSATGFKQSSKALQRPVASD
LNVIVHSATGWKQCSAALVRPVASD

SEQ ID NO: 7898 - protein, 25 aa, synthetic construct
  source 1..25: note = Seed: LNVIVHSATGFKQSSKALQRPVASD
LNVIVHSATGWKQCSIALARPVASD

SEQ ID NO: 7899 - protein, 25 aa, synthetic construct
  source 1..25: note = Seed: LNVIVHSATGFKQSSKALQRPVASD
LNVIVHSATGWKQCSSALARPVASD

SEQ ID NO: 7900 - protein, 25 aa, synthetic construct
  source 1..25: note = Seed: LNVIVHSATGFKQSSKALQRPVASD
LNVIVHSATGWKQCSVALARPVASD

SEQ ID NO: 7901 - protein, 25 aa, synthetic construct
  source 1..25: note = Seed: LNVIVHSATGFKQSSKALQRPVASD
LNVIVHSATGWKQESAALARPVASD

SEQ ID NO: 7902 - protein, 25 aa, synthetic construct
  source 1..25: note = Seed: LNVIVHSATGFKQSSKALQRPVASD
LNVIVHSATGWKQESAALIRPVASD

SEQ ID NO: 7903 - protein, 25 aa, synthetic construct
  source 1..25: note = Seed: LNVIVHSATGFKQSSKALQRPVASD
LNVIVHSATGWKQESAALLRPVASD

SEQ ID NO: 7904 - protein, 25 aa, synthetic construct
  source 1..25: note = Seed: LNVIVHSATGFKQSSKALQRPVASD
LNVIVHSATGWKQESAALVRPVASD

SEQ ID NO: 7905 - protein, 25 aa, synthetic construct
  source 1..25: note = Seed: LNVIVHSATGFKQSSKALQRPVASD
LNVIVHSATGWKQESGALARPVASD

SEQ ID NO: 7906 - protein, 25 aa, synthetic construct
  source 1..25: note = Seed: LNVIVHSATGFKQSSKALQRPVASD
LNVIVHSATGWKQESGALIRPVASD

SEQ ID NO: 7907 - protein, 25 aa, synthetic construct
  source 1..25: note = Seed: LNVIVHSATGFKQSSKALQRPVASD
LNVIVHSATGWKQESGALLRPVASD

SEQ ID NO: 7908 - protein, 25 aa, synthetic construct
  source 1..25: note = Seed: LNVIVHSATGFKQSSKALQRPVASD
LNVIVHSATGWKQESGALVRPVASD

SEQ ID NO: 7909 - protein, 25 aa, synthetic construct
  source 1..25: note = Seed: LNVIVHSATGFKQSSKALQRPVASD
LNVIVHSATGWKQESIALARPVASD

SEQ ID NO: 7910 - protein, 25 aa, synthetic construct
  source 1..25: note = Seed: LNVIVHSATGFKQSSKALQRPVASD
LNVIVHSATGWKQESIALIRPVASD

SEQ ID NO: 7911 - protein, 25 aa, synthetic construct
  source 1..25: note = Seed: LNVIVHSATGFKQSSKALQRPVASD
LNVIVHSATGWKQESIALLRPVASD

SEQ ID NO: 7912 - protein, 25 aa, synthetic construct
  source 1..25: note = Seed: LNVIVHSATGFKQSSKALQRPVASD
LNVIVHSATGWKQESIALMRPVASD

SEQ ID NO: 7913 - protein, 25 aa, synthetic construct
  source 1..25: note = Seed: LNVIVHSATGFKQSSKALQRPVASD
LNVIVHSATGWKQESLALARPVASD

SEQ ID NO: 7914 - protein, 25 aa, synthetic construct
  source 1..25: note = Seed: LNVIVHSATGFKQSSKALQRPVASD
LNVIVHSATGWKQESSALARPVASD

SEQ ID NO: 7915 - protein, 25 aa, synthetic construct
  source 1..25: note = Seed: LNVIVHSATGFKQSSKALQRPVASD
LNVIVHSATGWKQESSALIRPVASD

SEQ ID NO: 7916 - protein, 25 aa, synthetic construct
  source 1..25: note = Seed: LNVIVHSATGFKQSSKALQRPVASD
LNVIVHSATGWKQESSALLRPVASD

SEQ ID NO: 7917 - protein, 25 aa, synthetic construct
  source 1..25: note = Seed: LNVIVHSATGFKQSSKALQRPVASD
LNVIVHSATGWKQESSALVRPVASD

SEQ ID NO: 7918 - protein, 25 aa, synthetic construct
  source 1..25: note = Seed: LNVIVHSATGFKQSSKALQRPVASD
LNVIVHSATGWKQESVALARPVASD

SEQ ID NO: 7919 - protein, 25 aa, synthetic construct
  source 1..25: note = Seed: LNVIVHSATGFKQSSKALQRPVASD
LNVIVHSATGWKQESVALMRPVASD

SEQ ID NO: 7920 - protein, 25 aa, synthetic construct
  source 1..25: note = Seed: LNVIVHSATGFKQSSKALQRPVASD
LNVIVHSATGWKQFSAALARPVASD

SEQ ID NO: 7921 - protein, 25 aa, synthetic construct
  source 1..25: note = Seed: LNVIVHSATGFKQSSKALQRPVASD
LNVIVHSATGWKQFSAALCRPVASD

SEQ ID NO: 7922 - protein, 25 aa, synthetic construct
  source 1..25: note = Seed: LNVIVHSATGFKQSSKALQRPVASD
LNVIVHSATGWKQFSAALFRPVASD

SEQ ID NO: 7923 - protein, 25 aa, synthetic construct
  source 1..25: note = Seed: LNVIVHSATGFKQSSKALQRPVASD
LNVIVHSATGWKQFSAALGRPVASD

SEQ ID NO: 7924 - protein, 25 aa, synthetic construct
  source 1..25: note = Seed: LNVIVHSATGFKQSSKALQRPVASD
LNVIVHSATGWKQFSAALHRPVASD

SEQ ID NO: 7925 - protein, 25 aa, synthetic construct
  source 1..25: note = Seed: LNVIVHSATGFKQSSKALQRPVASD
LNVIVHSATGWKQFSAALIRPVASD

SEQ ID NO: 7926 - protein, 25 aa, synthetic construct
  source 1..25: note = Seed: LNVIVHSATGFKQSSKALQRPVASD
LNVIVHSATGWKQFSAALLRPVASD

SEQ ID NO: 7927 - protein, 25 aa, synthetic construct
  source 1..25: note = Seed: LNVIVHSATGFKQSSKALQRPVASD
LNVIVHSATGWKQFSAALMRPVASD

SEQ ID NO: 7928 - protein, 25 aa, synthetic construct
  source 1..25: note = Seed: LNVIVHSATGFKQSSKALQRPVASD
LNVIVHSATGWKQFSAALNRPVASD

SEQ ID NO: 7929 - protein, 25 aa, synthetic construct
  source 1..25: note = Seed: LNVIVHSATGFKQSSKALQRPVASD
LNVIVHSATGWKQFSAALQRPVASD

SEQ ID NO: 7930 - protein, 25 aa, synthetic construct
  source 1..25: note = Seed: LNVIVHSATGFKQSSKALQRPVASD
LNVIVHSATGWKQFSAALSRPVASD

SEQ ID NO: 7931 - protein, 25 aa, synthetic construct
  source 1..25: note = Seed: LNVIVHSATGFKQSSKALQRPVASD
LNVIVHSATGWKQFSEALVRPVASD

SEQ ID NO: 7932 - protein, 25 aa, synthetic construct
  source 1..25: note = Seed: LNVIVHSATGFKQSSKALQRPVASD
LNVIVHSATGWKQFSGALARPVASD

SEQ ID NO: 7933 - protein, 25 aa, synthetic construct
  source 1..25: note = Seed: LNVIVHSATGFKQSSKALQRPVASD
LNVIVHSATGWKQFSGALGRPVASD

SEQ ID NO: 7934 - protein, 25 aa, synthetic construct
  source 1..25: note = Seed: LNVIVHSATGFKQSSKALQRPVASD
LNVIVHSATGWKQFSGALIRPVASD

SEQ ID NO: 7935 - protein, 25 aa, synthetic construct
  source 1..25: note = Seed: LNVIVHSATGFKQSSKALQRPVASD
LNVIVHSATGWKQFSGALLRPVASD

SEQ ID NO: 7936 - protein, 25 aa, synthetic construct
  source 1..25: note = Seed: LNVIVHSATGFKQSSKALQRPVASD
LNVIVHSATGWKQFSGALMRPVASD

SEQ ID NO: 7937 - protein, 25 aa, synthetic construct
  source 1..25: note = Seed: LNVIVHSATGFKQSSKALQRPVASD
LNVIVHSATGWKQFSGALNRPVASD

SEQ ID NO: 7938 - protein, 25 aa, synthetic construct
  source 1..25: note = Seed: LNVIVHSATGFKQSSKALQRPVASD
LNVIVHSATGWKQFSGALSRPVASD

SEQ ID NO: 7939 - protein, 25 aa, synthetic construct
  source 1..25: note = Seed: LNVIVHSATGFKQSSKALQRPVASD
LNVIVHSATGWKQFSGALTRPVASD

SEQ ID NO: 7940 - protein, 25 aa, synthetic construct
  source 1..25: note = Seed: LNVIVHSATGFKQSSKALQRPVASD
LNVIVHSATGWKQFSGALVRPVASD

SEQ ID NO: 7941 - protein, 25 aa, synthetic construct
  source 1..25: note = Seed: LNVIVHSATGFKQSSKALQRPVASD
LNVIVHSATGWKQFSHALLRPVASD

SEQ ID NO: 7942 - protein, 25 aa, synthetic construct
  source 1..25: note = Seed: LNVIVHSATGFKQSSKALQRPVASD
LNVIVHSATGWKQFSHALRRPVASD

SEQ ID NO: 7943 - protein, 25 aa, synthetic construct
  source 1..25: note = Seed: LNVIVHSATGFKQSSKALQRPVASD
LNVIVHSATGWKQFSIALERPVASD

SEQ ID NO: 7944 - protein, 25 aa, synthetic construct
  source 1..25: note = Seed: LNVIVHSATGFKQSSKALQRPVASD
LNVIVHSATGWKQFSIALHRPVASD

SEQ ID NO: 7945 - protein, 25 aa, synthetic construct
  source 1..25: note = Seed: LNVIVHSATGFKQSSKALQRPVASD
LNVIVHSATGWKQFSIALNRPVASD

SEQ ID NO: 7946 - protein, 25 aa, synthetic construct
  source 1..25: note = Seed: LNVIVHSATGFKQSSKALQRPVASD
LNVIVHSATGWKQFSIALQRPVASD

SEQ ID NO: 7947 - protein, 25 aa, synthetic construct
  source 1..25: note = Seed: LNVIVHSATGFKQSSKALQRPVASD
LNVIVHSATGWKQFSKALARPVASD

SEQ ID NO: 7948 - protein, 25 aa, synthetic construct
  source 1..25: note = Seed: LNVIVHSATGFKQSSKALQRPVASD
LNVIVHSATGWKQFSKALKRPVASD

SEQ ID NO: 7949 - protein, 25 aa, synthetic construct
  source 1..25: note = Seed: LNVIVHSATGFKQSSKALQRPVASD
LNVIVHSATGWKQFSKALRRPVASD

SEQ ID NO: 7950 - protein, 25 aa, synthetic construct
  source 1..25: note = Seed: LNVIVHSATGFKQSSKALQRPVASD
LNVIVHSATGWKQFSKALSRPVASD

SEQ ID NO: 7951 - protein, 25 aa, synthetic construct
  source 1..25: note = Seed: LNVIVHSATGFKQSSKALQRPVASD
LNVIVHSATGWKQFSLALQRPVASD

SEQ ID NO: 7952 - protein, 25 aa, synthetic construct
  source 1..25: note = Seed: LNVIVHSATGFKQSSKALQRPVASD
LNVIVHSATGWKQFSNALARPVASD

SEQ ID NO: 7953 - protein, 25 aa, synthetic construct
  source 1..25: note = Seed: LNVIVHSATGFKQSSKALQRPVASD
LNVIVHSATGWKQFSNALIRPVASD

SEQ ID NO: 7954 - protein, 25 aa, synthetic construct
  source 1..25: note = Seed: LNVIVHSATGFKQSSKALQRPVASD
LNVIVHSATGWKQFSNALNRPVASD

SEQ ID NO: 7955 - protein, 25 aa, synthetic construct
  source 1..25: note = Seed: LNVIVHSATGFKQSSKALQRPVASD
LNVIVHSATGWKQFSNALSRPVASD

SEQ ID NO: 7956 - protein, 25 aa, synthetic construct
  source 1..25: note = Seed: LNVIVHSATGFKQSSKALQRPVASD
LNVIVHSATGWKQFSNALVRPVASD

SEQ ID NO: 7957 - protein, 25 aa, synthetic construct
  source 1..25: note = Seed: LNVIVHSATGFKQSSKALQRPVASD
LNVIVHSATGWKQFSPALARPVASD

SEQ ID NO: 7958 - protein, 25 aa, synthetic construct
  source 1..25: note = Seed: LNVIVHSATGFKQSSKALQRPVASD
LNVIVHSATGWKQFSPALGRPVASD

SEQ ID NO: 7959 - protein, 25 aa, synthetic construct
  source 1..25: note = Seed: LNVIVHSATGFKQSSKALQRPVASD
LNVIVHSATGWKQFSPALIRPVASD

SEQ ID NO: 7960 - protein, 25 aa, synthetic construct
  source 1..25: note = Seed: LNVIVHSATGFKQSSKALQRPVASD
LNVIVHSATGWKQFSPALLRPVASD

SEQ ID NO: 7961 - protein, 25 aa, synthetic construct
  source 1..25: note = Seed: LNVIVHSATGFKQSSKALQRPVASD
LNVIVHSATGWKQFSPALMRPVASD

SEQ ID NO: 7962 - protein, 25 aa, synthetic construct
  source 1..25: note = Seed: LNVIVHSATGFKQSSKALQRPVASD
LNVIVHSATGWKQFSPALNRPVASD

SEQ ID NO: 7963 - protein, 25 aa, synthetic construct
  source 1..25: note = Seed: LNVIVHSATGFKQSSKALQRPVASD
LNVIVHSATGWKQFSPALSRPVASD

SEQ ID NO: 7964 - protein, 25 aa, synthetic construct
  source 1..25: note = Seed: LNVIVHSATGFKQSSKALQRPVASD
LNVIVHSATGWKQFSPALVRPVASD

SEQ ID NO: 7965 - protein, 25 aa, synthetic construct
  source 1..25: note = Seed: LNVIVHSATGFKQSSKALQRPVASD
LNVIVHSATGWKQFSRALARPVASD

SEQ ID NO: 7966 - protein, 25 aa, synthetic construct
  source 1..25: note = Seed: LNVIVHSATGFKQSSKALQRPVASD
LNVIVHSATGWKQFSRALGRPVASD

SEQ ID NO: 7967 - protein, 25 aa, synthetic construct
  source 1..25: note = Seed: LNVIVHSATGFKQSSKALQRPVASD
LNVIVHSATGWKQFSRALHRPVASD

SEQ ID NO: 7968 - protein, 25 aa, synthetic construct
  source 1..25: note = Seed: LNVIVHSATGFKQSSKALQRPVASD
LNVIVHSATGWKQFSRALKRPVASD

SEQ ID NO: 7969 - protein, 25 aa, synthetic construct
  source 1..25: note = Seed: LNVIVHSATGFKQSSKALQRPVASD
LNVIVHSATGWKQFSRALRRPVASD

SEQ ID NO: 7970 - protein, 25 aa, synthetic construct
  source 1..25: note = Seed: LNVIVHSATGFKQSSKALQRPVASD
LNVIVHSATGWKQFSRALSRPVASD

SEQ ID NO: 7971 - protein, 25 aa, synthetic construct
  source 1..25: note = Seed: LNVIVHSATGFKQSSKALQRPVASD
LNVIVHSATGWKQFSRALTRPVASD

SEQ ID NO: 7972 - protein, 25 aa, synthetic construct
  source 1..25: note = Seed: LNVIVHSATGFKQSSKALQRPVASD
LNVIVHSATGWKQFSSALARPVASD

SEQ ID NO: 7973 - protein, 25 aa, synthetic construct
  source 1..25: note = Seed: LNVIVHSATGFKQSSKALQRPVASD
LNVIVHSATGWKQFSSALFRPVASD

SEQ ID NO: 7974 - protein, 25 aa, synthetic construct
  source 1..25: note = Seed: LNVIVHSATGFKQSSKALQRPVASD
LNVIVHSATGWKQFSSALGRPVASD

SEQ ID NO: 7975 - protein, 25 aa, synthetic construct
  source 1..25: note = Seed: LNVIVHSATGFKQSSKALQRPVASD
LNVIVHSATGWKQFSSALIRPVASD

SEQ ID NO: 7976 - protein, 25 aa, synthetic construct
  source 1..25: note = Seed: LNVIVHSATGFKQSSKALQRPVASD
LNVIVHSATGWKQFSSALLRPVASD

SEQ ID NO: 7977 - protein, 25 aa, synthetic construct
  source 1..25: note = Seed: LNVIVHSATGFKQSSKALQRPVASD
LNVIVHSATGWKQFSSALMRPVASD

SEQ ID NO: 7978 - protein, 25 aa, synthetic construct
  source 1..25: note = Seed: LNVIVHSATGFKQSSKALQRPVASD
LNVIVHSATGWKQFSSALNRPVASD

SEQ ID NO: 7979 - protein, 25 aa, synthetic construct
  source 1..25: note = Seed: LNVIVHSATGFKQSSKALQRPVASD
LNVIVHSATGWKQFSSALSRPVASD

SEQ ID NO: 7980 - protein, 25 aa, synthetic construct
  source 1..25: note = Seed: LNVIVHSATGFKQSSKALQRPVASD
LNVIVHSATGWKQFSSALTRPVASD

SEQ ID NO: 7981 - protein, 25 aa, synthetic construct
  source 1..25: note = Seed: LNVIVHSATGFKQSSKALQRPVASD
LNVIVHSATGWKQFSSALVRPVASD

SEQ ID NO: 7982 - protein, 25 aa, synthetic construct
  source 1..25: note = Seed: LNVIVHSATGFKQSSKALQRPVASD
LNVIVHSATGWKQFSTALARPVASD

SEQ ID NO: 7983 - protein, 25 aa, synthetic construct
  source 1..25: note = Seed: LNVIVHSATGFKQSSKALQRPVASD
LNVIVHSATGWKQFSTALGRPVASD

SEQ ID NO: 7984 - protein, 25 aa, synthetic construct
  source 1..25: note = Seed: LNVIVHSATGFKQSSKALQRPVASD
LNVIVHSATGWKQFSTALIRPVASD

SEQ ID NO: 7985 - protein, 25 aa, synthetic construct
  source 1..25: note = Seed: LNVIVHSATGFKQSSKALQRPVASD
LNVIVHSATGWKQFSTALLRPVASD

SEQ ID NO: 7986 - protein, 25 aa, synthetic construct
  source 1..25: note = Seed: LNVIVHSATGFKQSSKALQRPVASD
LNVIVHSATGWKQFSTALMRPVASD

SEQ ID NO: 7987 - protein, 25 aa, synthetic construct
  source 1..25: note = Seed: LNVIVHSATGFKQSSKALQRPVASD
LNVIVHSATGWKQFSTALNRPVASD

SEQ ID NO: 7988 - protein, 25 aa, synthetic construct
  source 1..25: note = Seed: LNVIVHSATGFKQSSKALQRPVASD
LNVIVHSATGWKQFSTALSRPVASD

SEQ ID NO: 7989 - protein, 25 aa, synthetic construct
  source 1..25: note = Seed: LNVIVHSATGFKQSSKALQRPVASD
LNVIVHSATGWKQFSTALVRPVASD

SEQ ID NO: 7990 - protein, 25 aa, synthetic construct
  source 1..25: note = Seed: LNVIVHSATGFKQSSKALQRPVASD
LNVIVHSATGWKQFSVALCRPVASD

SEQ ID NO: 7991 - protein, 25 aa, synthetic construct
  source 1..25: note = Seed: LNVIVHSATGFKQSSKALQRPVASD
LNVIVHSATGWKQFSVALGRPVASD

SEQ ID NO: 7992 - protein, 25 aa, synthetic construct
  source 1..25: note = Seed: LNVIVHSATGFKQSSKALQRPVASD
LNVIVHSATGWKQFSVALHRPVASD

SEQ ID NO: 7993 - protein, 25 aa, synthetic construct
  source 1..25: note = Seed: LNVIVHSATGFKQSSKALQRPVASD
LNVIVHSATGWKQFSVALIRPVASD

SEQ ID NO: 7994 - protein, 25 aa, synthetic construct
  source 1..25: note = Seed: LNVIVHSATGFKQSSKALQRPVASD
LNVIVHSATGWKQFSVALLRPVASD

SEQ ID NO: 7995 - protein, 25 aa, synthetic construct
  source 1..25: note = Seed: LNVIVHSATGFKQSSKALQRPVASD
LNVIVHSATGWKQFSVALMRPVASD

SEQ ID NO: 7996 - protein, 25 aa, synthetic construct
  source 1..25: note = Seed: LNVIVHSATGFKQSSKALQRPVASD
LNVIVHSATGWKQFSVALNRPVASD

SEQ ID NO: 7997 - protein, 25 aa, synthetic construct
  source 1..25: note = Seed: LNVIVHSATGFKQSSKALQRPVASD
LNVIVHSATGWKQFSVALQRPVASD

SEQ ID NO: 7998 - protein, 25 aa, synthetic construct
  source 1..25: note = Seed: LNVIVHSATGFKQSSKALQRPVASD
LNVIVHSATGWKQGSAALARPVASD

SEQ ID NO: 7999 - protein, 25 aa, synthetic construct
  source 1..25: note = Seed: LNVIVHSATGFKQSSKALQRPVASD
LNVIVHSATGWKQGSAALIRPVASD

SEQ ID NO: 8000 - protein, 25 aa, synthetic construct
  source 1..25: note = Seed: LNVIVHSATGFKQSSKALQRPVASD
LNVIVHSATGWKQGSAALLRPVASD

SEQ ID NO: 8001 - protein, 25 aa, synthetic construct
  source 1..25: note = Seed: LNVIVHSATGFKQSSKALQRPVASD
LNVIVHSATGWKQGSAALMRPVASD

SEQ ID NO: 8002 - protein, 25 aa, synthetic construct
  source 1..25: note = Seed: LNVIVHSATGFKQSSKALQRPVASD
LNVIVHSATGWKQGSAALVRPVASD

SEQ ID NO: 8003 - protein, 25 aa, synthetic construct
  source 1..25: note = Seed: LNVIVHSATGFKQSSKALQRPVASD
LNVIVHSATGWKQGSGALIRPVASD

SEQ ID NO: 8004 - protein, 25 aa, synthetic construct
  source 1..25: note = Seed: LNVIVHSATGFKQSSKALQRPVASD
LNVIVHSATGWKQGSGALLRPVASD

SEQ ID NO: 8005 - protein, 25 aa, synthetic construct
  source 1..25: note = Seed: LNVIVHSATGFKQSSKALQRPVASD
LNVIVHSATGWKQGSGALVRPVASD

SEQ ID NO: 8006 - protein, 25 aa, synthetic construct
  source 1..25: note = Seed: LNVIVHSATGFKQSSKALQRPVASD
LNVIVHSATGWKQGSIALARPVASD

SEQ ID NO: 8007 - protein, 25 aa, synthetic construct
  source 1..25: note = Seed: LNVIVHSATGFKQSSKALQRPVASD
LNVIVHSATGWKQGSLALARPVASD

SEQ ID NO: 8008 - protein, 25 aa, synthetic construct
  source 1..25: note = Seed: LNVIVHSATGFKQSSKALQRPVASD
LNVIVHSATGWKQGSSALIRPVASD

SEQ ID NO: 8009 - protein, 25 aa, synthetic construct
  source 1..25: note = Seed: LNVIVHSATGFKQSSKALQRPVASD
LNVIVHSATGWKQGSSALLRPVASD

SEQ ID NO: 8010 - protein, 25 aa, synthetic construct
  source 1..25: note = Seed: LNVIVHSATGFKQSSKALQRPVASD
LNVIVHSATGWKQGSSALVRPVASD

SEQ ID NO: 8011 - protein, 25 aa, synthetic construct
  source 1..25: note = Seed: LNVIVHSATGFKQSSKALQRPVASD
LNVIVHSATGWKQHSAALARPVASD

SEQ ID NO: 8012 - protein, 25 aa, synthetic construct
  source 1..25: note = Seed: LNVIVHSATGFKQSSKALQRPVASD
LNVIVHSATGWKQHSAALIRPVASD

SEQ ID NO: 8013 - protein, 25 aa, synthetic construct
  source 1..25: note = Seed: LNVIVHSATGFKQSSKALQRPVASD
LNVIVHSATGWKQHSAALLRPVASD

SEQ ID NO: 8014 - protein, 25 aa, synthetic construct
  source 1..25: note = Seed: LNVIVHSATGFKQSSKALQRPVASD
LNVIVHSATGWKQHSAALVRPVASD

SEQ ID NO: 8015 - protein, 25 aa, synthetic construct
  source 1..25: note = Seed: LNVIVHSATGFKQSSKALQRPVASD
LNVIVHSATGWKQHSIALARPVASD

SEQ ID NO: 8016 - protein, 25 aa, synthetic construct
  source 1..25: note = Seed: LNVIVHSATGFKQSSKALQRPVASD
LNVIVHSATGWKQHSSALIRPVASD

SEQ ID NO: 8017 - protein, 25 aa, synthetic construct
  source 1..25: note = Seed: LNVIVHSATGFKQSSKALQRPVASD
LNVIVHSATGWKQHSSALLRPVASD

SEQ ID NO: 8018 - protein, 25 aa, synthetic construct
  source 1..25: note = Seed: LNVIVHSATGFKQSSKALQRPVASD
LNVIVHSATGWKQHSSALVRPVASD

SEQ ID NO: 8019 - protein, 25 aa, synthetic construct
  source 1..25: note = Seed: LNVIVHSATGFKQSSKALQRPVASD
LNVIVHSATGWKQISAALARPVASD

SEQ ID NO: 8020 - protein, 25 aa, synthetic construct
  source 1..25: note = Seed: LNVIVHSATGFKQSSKALQRPVASD
LNVIVHSATGWKQISAALCRPVASD

SEQ ID NO: 8021 - protein, 25 aa, synthetic construct
  source 1..25: note = Seed: LNVIVHSATGFKQSSKALQRPVASD
LNVIVHSATGWKQISAALDRPVASD

SEQ ID NO: 8022 - protein, 25 aa, synthetic construct
  source 1..25: note = Seed: LNVIVHSATGFKQSSKALQRPVASD
LNVIVHSATGWKQISAALERPVASD

SEQ ID NO: 8023 - protein, 25 aa, synthetic construct
  source 1..25: note = Seed: LNVIVHSATGFKQSSKALQRPVASD
LNVIVHSATGWKQISAALGRPVASD

SEQ ID NO: 8024 - protein, 25 aa, synthetic construct
  source 1..25: note = Seed: LNVIVHSATGFKQSSKALQRPVASD
LNVIVHSATGWKQISAALHRPVASD

SEQ ID NO: 8025 - protein, 25 aa, synthetic construct
  source 1..25: note = Seed: LNVIVHSATGFKQSSKALQRPVASD
LNVIVHSATGWKQISAALIRPVASD

SEQ ID NO: 8026 - protein, 25 aa, synthetic construct
  source 1..25: note = Seed: LNVIVHSATGFKQSSKALQRPVASD
LNVIVHSATGWKQISAALLRPVASD

SEQ ID NO: 8027 - protein, 25 aa, synthetic construct
  source 1..25: note = Seed: LNVIVHSATGFKQSSKALQRPVASD
LNVIVHSATGWKQISAALMRPVASD

SEQ ID NO: 8028 - protein, 25 aa, synthetic construct
  source 1..25: note = Seed: LNVIVHSATGFKQSSKALQRPVASD
LNVIVHSATGWKQISAALNRPVASD

SEQ ID NO: 8029 - protein, 25 aa, synthetic construct
  source 1..25: note = Seed: LNVIVHSATGFKQSSKALQRPVASD
LNVIVHSATGWKQISAALPRPVASD

SEQ ID NO: 8030 - protein, 25 aa, synthetic construct
  source 1..25: note = Seed: LNVIVHSATGFKQSSKALQRPVASD
LNVIVHSATGWKQISAALQRPVASD

SEQ ID NO: 8031 - protein, 25 aa, synthetic construct
  source 1..25: note = Seed: LNVIVHSATGFKQSSKALQRPVASD
LNVIVHSATGWKQISAALSRPVASD

SEQ ID NO: 8032 - protein, 25 aa, synthetic construct
  source 1..25: note = Seed: LNVIVHSATGFKQSSKALQRPVASD
LNVIVHSATGWKQISAALTRPVASD

SEQ ID NO: 8033 - protein, 25 aa, synthetic construct
  source 1..25: note = Seed: LNVIVHSATGFKQSSKALQRPVASD
LNVIVHSATGWKQISAALVRPVASD

SEQ ID NO: 8034 - protein, 25 aa, synthetic construct
  source 1..25: note = Seed: LNVIVHSATGFKQSSKALQRPVASD
LNVIVHSATGWKQISEALARPVASD

SEQ ID NO: 8035 - protein, 25 aa, synthetic construct
  source 1..25: note = Seed: LNVIVHSATGFKQSSKALQRPVASD
LNVIVHSATGWKQISFALIRPVASD

SEQ ID NO: 8036 - protein, 25 aa, synthetic construct
  source 1..25: note = Seed: LNVIVHSATGFKQSSKALQRPVASD
LNVIVHSATGWKQISFALLRPVASD

SEQ ID NO: 8037 - protein, 25 aa, synthetic construct
  source 1..25: note = Seed: LNVIVHSATGFKQSSKALQRPVASD
LNVIVHSATGWKQISFALVRPVASD

SEQ ID NO: 8038 - protein, 25 aa, synthetic construct
  source 1..25: note = Seed: LNVIVHSATGFKQSSKALQRPVASD
LNVIVHSATGWKQISGALARPVASD

SEQ ID NO: 8039 - protein, 25 aa, synthetic construct
  source 1..25: note = Seed: LNVIVHSATGFKQSSKALQRPVASD
LNVIVHSATGWKQISGALCRPVASD

SEQ ID NO: 8040 - protein, 25 aa, synthetic construct
  source 1..25: note = Seed: LNVIVHSATGFKQSSKALQRPVASD
LNVIVHSATGWKQISGALGRPVASD

SEQ ID NO: 8041 - protein, 25 aa, synthetic construct
  source 1..25: note = Seed: LNVIVHSATGFKQSSKALQRPVASD
LNVIVHSATGWKQISGALIRPVASD

SEQ ID NO: 8042 - protein, 25 aa, synthetic construct
  source 1..25: note = Seed: LNVIVHSATGFKQSSKALQRPVASD
LNVIVHSATGWKQISGALLRPVASD

SEQ ID NO: 8043 - protein, 25 aa, synthetic construct
  source 1..25: note = Seed: LNVIVHSATGFKQSSKALQRPVASD
LNVIVHSATGWKQISGALMRPVASD

SEQ ID NO: 8044 - protein, 25 aa, synthetic construct
  source 1..25: note = Seed: LNVIVHSATGFKQSSKALQRPVASD
LNVIVHSATGWKQISGALNRPVASD

SEQ ID NO: 8045 - protein, 25 aa, synthetic construct
  source 1..25: note = Seed: LNVIVHSATGFKQSSKALQRPVASD
LNVIVHSATGWKQISGALPRPVASD

SEQ ID NO: 8046 - protein, 25 aa, synthetic construct
  source 1..25: note = Seed: LNVIVHSATGFKQSSKALQRPVASD
LNVIVHSATGWKQISGALSRPVASD

SEQ ID NO: 8047 - protein, 25 aa, synthetic construct
  source 1..25: note = Seed: LNVIVHSATGFKQSSKALQRPVASD
LNVIVHSATGWKQISGALTRPVASD

SEQ ID NO: 8048 - protein, 25 aa, synthetic construct
  source 1..25: note = Seed: LNVIVHSATGFKQSSKALQRPVASD
LNVIVHSATGWKQISGALVRPVASD

SEQ ID NO: 8049 - protein, 25 aa, synthetic construct
  source 1..25: note = Seed: LNVIVHSATGFKQSSKALQRPVASD
LNVIVHSATGWKQISHALARPVASD

SEQ ID NO: 8050 - protein, 25 aa, synthetic construct
  source 1..25: note = Seed: LNVIVHSATGFKQSSKALQRPVASD
LNVIVHSATGWKQISHALIRPVASD

SEQ ID NO: 8051 - protein, 25 aa, synthetic construct
  source 1..25: note = Seed: LNVIVHSATGFKQSSKALQRPVASD
LNVIVHSATGWKQISHALSRPVASD

SEQ ID NO: 8052 - protein, 25 aa, synthetic construct
  source 1..25: note = Seed: LNVIVHSATGFKQSSKALQRPVASD
LNVIVHSATGWKQISHALVRPVASD

SEQ ID NO: 8053 - protein, 25 aa, synthetic construct
  source 1..25: note = Seed: LNVIVHSATGFKQSSKALQRPVASD
LNVIVHSATGWKQISIALARPVASD

SEQ ID NO: 8054 - protein, 25 aa, synthetic construct
  source 1..25: note = Seed: LNVIVHSATGFKQSSKALQRPVASD
LNVIVHSATGWKQISIALGRPVASD

SEQ ID NO: 8055 - protein, 25 aa, synthetic construct
  source 1..25: note = Seed: LNVIVHSATGFKQSSKALQRPVASD
LNVIVHSATGWKQISIALHRPVASD

SEQ ID NO: 8056 - protein, 25 aa, synthetic construct
  source 1..25: note = Seed: LNVIVHSATGFKQSSKALQRPVASD
LNVIVHSATGWKQISIALIRPVASD

SEQ ID NO: 8057 - protein, 25 aa, synthetic construct
  source 1..25: note = Seed: LNVIVHSATGFKQSSKALQRPVASD
LNVIVHSATGWKQISIALLRPVASD

SEQ ID NO: 8058 - protein, 25 aa, synthetic construct
  source 1..25: note = Seed: LNVIVHSATGFKQSSKALQRPVASD
LNVIVHSATGWKQISIALMRPVASD

SEQ ID NO: 8059 - protein, 25 aa, synthetic construct
  source 1..25: note = Seed: LNVIVHSATGFKQSSKALQRPVASD
LNVIVHSATGWKQISIALNRPVASD

SEQ ID NO: 8060 - protein, 25 aa, synthetic construct
  source 1..25: note = Seed: LNVIVHSATGFKQSSKALQRPVASD
LNVIVHSATGWKQISIALQRPVASD

SEQ ID NO: 8061 - protein, 25 aa, synthetic construct
  source 1..25: note = Seed: LNVIVHSATGFKQSSKALQRPVASD
LNVIVHSATGWKQISIALSRPVASD

SEQ ID NO: 8062 - protein, 25 aa, synthetic construct
  source 1..25: note = Seed: LNVIVHSATGFKQSSKALQRPVASD
LNVIVHSATGWKQISIALTRPVASD

SEQ ID NO: 8063 - protein, 25 aa, synthetic construct
  source 1..25: note = Seed: LNVIVHSATGFKQSSKALQRPVASD
LNVIVHSATGWKQISIALVRPVASD

SEQ ID NO: 8064 - protein, 25 aa, synthetic construct
  source 1..25: note = Seed: LNVIVHSATGFKQSSKALQRPVASD
LNVIVHSATGWKQISKALARPVASD

SEQ ID NO: 8065 - protein, 25 aa, synthetic construct
  source 1..25: note = Seed: LNVIVHSATGFKQSSKALQRPVASD
LNVIVHSATGWKQISKALGRPVASD

SEQ ID NO: 8066 - protein, 25 aa, synthetic construct
  source 1..25: note = Seed: LNVIVHSATGFKQSSKALQRPVASD
LNVIVHSATGWKQISKALHRPVASD

SEQ ID NO: 8067 - protein, 25 aa, synthetic construct
  source 1..25: note = Seed: LNVIVHSATGFKQSSKALQRPVASD
LNVIVHSATGWKQISKALKRPVASD

SEQ ID NO: 8068 - protein, 25 aa, synthetic construct
  source 1..25: note = Seed: LNVIVHSATGFKQSSKALQRPVASD
LNVIVHSATGWKQISKALMRPVASD

SEQ ID NO: 8069 - protein, 25 aa, synthetic construct
  source 1..25: note = Seed: LNVIVHSATGFKQSSKALQRPVASD
LNVIVHSATGWKQISKALNRPVASD

SEQ ID NO: 8070 - protein, 25 aa, synthetic construct
  source 1..25: note = Seed: LNVIVHSATGFKQSSKALQRPVASD
LNVIVHSATGWKQISKALQRPVASD

SEQ ID NO: 8071 - protein, 25 aa, synthetic construct
  source 1..25: note = Seed: LNVIVHSATGFKQSSKALQRPVASD
LNVIVHSATGWKQISKALRRPVASD

SEQ ID NO: 8072 - protein, 25 aa, synthetic construct
  source 1..25: note = Seed: LNVIVHSATGFKQSSKALQRPVASD
LNVIVHSATGWKQISKALSRPVASD

SEQ ID NO: 8073 - protein, 25 aa, synthetic construct
  source 1..25: note = Seed: LNVIVHSATGFKQSSKALQRPVASD
LNVIVHSATGWKQISKALTRPVASD

SEQ ID NO: 8074 - protein, 25 aa, synthetic construct
  source 1..25: note = Seed: LNVIVHSATGFKQSSKALQRPVASD
LNVIVHSATGWKQISKALVRPVASD

SEQ ID NO: 8075 - protein, 25 aa, synthetic construct
  source 1..25: note = Seed: LNVIVHSATGFKQSSKALQRPVASD
LNVIVHSATGWKQISLALARPVASD

SEQ ID NO: 8076 - protein, 25 aa, synthetic construct
  source 1..25: note = Seed: LNVIVHSATGFKQSSKALQRPVASD
LNVIVHSATGWKQISLALGRPVASD

SEQ ID NO: 8077 - protein, 25 aa, synthetic construct
  source 1..25: note = Seed: LNVIVHSATGFKQSSKALQRPVASD
LNVIVHSATGWKQISLALIRPVASD

SEQ ID NO: 8078 - protein, 25 aa, synthetic construct
  source 1..25: note = Seed: LNVIVHSATGFKQSSKALQRPVASD
LNVIVHSATGWKQISLALNRPVASD

SEQ ID NO: 8079 - protein, 25 aa, synthetic construct
  source 1..25: note = Seed: LNVIVHSATGFKQSSKALQRPVASD
LNVIVHSATGWKQISLALQRPVASD

SEQ ID NO: 8080 - protein, 25 aa, synthetic construct
  source 1..25: note = Seed: LNVIVHSATGFKQSSKALQRPVASD
LNVIVHSATGWKQISLALSRPVASD

SEQ ID NO: 8081 - protein, 25 aa, synthetic construct
  source 1..25: note = Seed: LNVIVHSATGFKQSSKALQRPVASD
LNVIVHSATGWKQISLALTRPVASD

SEQ ID NO: 8082 - protein, 25 aa, synthetic construct
  source 1..25: note = Seed: LNVIVHSATGFKQSSKALQRPVASD
LNVIVHSATGWKQISLALVRPVASD

SEQ ID NO: 8083 - protein, 25 aa, synthetic construct
  source 1..25: note = Seed: LNVIVHSATGFKQSSKALQRPVASD
LNVIVHSATGWKQISMALARPVASD

SEQ ID NO: 8084 - protein, 25 aa, synthetic construct
  source 1..25: note = Seed: LNVIVHSATGFKQSSKALQRPVASD
LNVIVHSATGWKQISMALGRPVASD

SEQ ID NO: 8085 - protein, 25 aa, synthetic construct
  source 1..25: note = Seed: LNVIVHSATGFKQSSKALQRPVASD
LNVIVHSATGWKQISMALLRPVASD

SEQ ID NO: 8086 - protein, 25 aa, synthetic construct
  source 1..25: note = Seed: LNVIVHSATGFKQSSKALQRPVASD
LNVIVHSATGWKQISMALMRPVASD

SEQ ID NO: 8087 - protein, 25 aa, synthetic construct
  source 1..25: note = Seed: LNVIVHSATGFKQSSKALQRPVASD
LNVIVHSATGWKQISMALNRPVASD

SEQ ID NO: 8088 - protein, 25 aa, synthetic construct
  source 1..25: note = Seed: LNVIVHSATGFKQSSKALQRPVASD
LNVIVHSATGWKQISMALSRPVASD

SEQ ID NO: 8089 - protein, 25 aa, synthetic construct
  source 1..25: note = Seed: LNVIVHSATGFKQSSKALQRPVASD
LNVIVHSATGWKQISNALARPVASD

SEQ ID NO: 8090 - protein, 25 aa, synthetic construct
  source 1..25: note = Seed: LNVIVHSATGFKQSSKALQRPVASD
LNVIVHSATGWKQISNALGRPVASD

SEQ ID NO: 8091 - protein, 25 aa, synthetic construct
  source 1..25: note = Seed: LNVIVHSATGFKQSSKALQRPVASD
LNVIVHSATGWKQISNALIRPVASD

SEQ ID NO: 8092 - protein, 25 aa, synthetic construct
  source 1..25: note = Seed: LNVIVHSATGFKQSSKALQRPVASD
LNVIVHSATGWKQISNALLRPVASD

SEQ ID NO: 8093 - protein, 25 aa, synthetic construct
  source 1..25: note = Seed: LNVIVHSATGFKQSSKALQRPVASD
LNVIVHSATGWKQISNALMRPVASD

SEQ ID NO: 8094 - protein, 25 aa, synthetic construct
  source 1..25: note = Seed: LNVIVHSATGFKQSSKALQRPVASD
LNVIVHSATGWKQISNALNRPVASD

SEQ ID NO: 8095 - protein, 25 aa, synthetic construct
  source 1..25: note = Seed: LNVIVHSATGFKQSSKALQRPVASD
LNVIVHSATGWKQISNALSRPVASD

SEQ ID NO: 8096 - protein, 25 aa, synthetic construct
  source 1..25: note = Seed: LNVIVHSATGFKQSSKALQRPVASD
LNVIVHSATGWKQISNALTRPVASD

SEQ ID NO: 8097 - protein, 25 aa, synthetic construct
  source 1..25: note = Seed: LNVIVHSATGFKQSSKALQRPVASD
LNVIVHSATGWKQISNALVRPVASD

SEQ ID NO: 8098 - protein, 25 aa, synthetic construct
  source 1..25: note = Seed: LNVIVHSATGFKQSSKALQRPVASD
LNVIVHSATGWKQISPALARPVASD

SEQ ID NO: 8099 - protein, 25 aa, synthetic construct
  source 1..25: note = Seed: LNVIVHSATGFKQSSKALQRPVASD
LNVIVHSATGWKQISPALGRPVASD

SEQ ID NO: 8100 - protein, 25 aa, synthetic construct
  source 1..25: note = Seed: LNVIVHSATGFKQSSKALQRPVASD
LNVIVHSATGWKQISPALHRPVASD

SEQ ID NO: 8101 - protein, 25 aa, synthetic construct
  source 1..25: note = Seed: LNVIVHSATGFKQSSKALQRPVASD
LNVIVHSATGWKQISPALIRPVASD

SEQ ID NO: 8102 - protein, 25 aa, synthetic construct
  source 1..25: note = Seed: LNVIVHSATGFKQSSKALQRPVASD
LNVIVHSATGWKQISPALLRPVASD

SEQ ID NO: 8103 - protein, 25 aa, synthetic construct
  source 1..25: note = Seed: LNVIVHSATGFKQSSKALQRPVASD
LNVIVHSATGWKQISPALMRPVASD

SEQ ID NO: 8104 - protein, 25 aa, synthetic construct
  source 1..25: note = Seed: LNVIVHSATGFKQSSKALQRPVASD
LNVIVHSATGWKQISPALNRPVASD

SEQ ID NO: 8105 - protein, 25 aa, synthetic construct
  source 1..25: note = Seed: LNVIVHSATGFKQSSKALQRPVASD
LNVIVHSATGWKQISPALPRPVASD

SEQ ID NO: 8106 - protein, 25 aa, synthetic construct
  source 1..25: note = Seed: LNVIVHSATGFKQSSKALQRPVASD
LNVIVHSATGWKQISPALQRPVASD

SEQ ID NO: 8107 - protein, 25 aa, synthetic construct
  source 1..25: note = Seed: LNVIVHSATGFKQSSKALQRPVASD
LNVIVHSATGWKQISPALSRPVASD

SEQ ID NO: 8108 - protein, 25 aa, synthetic construct
  source 1..25: note = Seed: LNVIVHSATGFKQSSKALQRPVASD
LNVIVHSATGWKQISPALTRPVASD

SEQ ID NO: 8109 - protein, 25 aa, synthetic construct
  source 1..25: note = Seed: LNVIVHSATGFKQSSKALQRPVASD
LNVIVHSATGWKQISPALVRPVASD

SEQ ID NO: 8110 - protein, 25 aa, synthetic construct
  source 1..25: note = Seed: LNVIVHSATGFKQSSKALQRPVASD
LNVIVHSATGWKQISQALARPVASD

SEQ ID NO: 8111 - protein, 25 aa, synthetic construct
  source 1..25: note = Seed: LNVIVHSATGFKQSSKALQRPVASD
LNVIVHSATGWKQISRALARPVASD

SEQ ID NO: 8112 - protein, 25 aa, synthetic construct
  source 1..25: note = Seed: LNVIVHSATGFKQSSKALQRPVASD
LNVIVHSATGWKQISRALGRPVASD

SEQ ID NO: 8113 - protein, 25 aa, synthetic construct
  source 1..25: note = Seed: LNVIVHSATGFKQSSKALQRPVASD
LNVIVHSATGWKQISRALHRPVASD

SEQ ID NO: 8114 - protein, 25 aa, synthetic construct
  source 1..25: note = Seed: LNVIVHSATGFKQSSKALQRPVASD
LNVIVHSATGWKQISRALIRPVASD

SEQ ID NO: 8115 - protein, 25 aa, synthetic construct
  source 1..25: note = Seed: LNVIVHSATGFKQSSKALQRPVASD
LNVIVHSATGWKQISRALKRPVASD

SEQ ID NO: 8116 - protein, 25 aa, synthetic construct
  source 1..25: note = Seed: LNVIVHSATGFKQSSKALQRPVASD
LNVIVHSATGWKQISRALMRPVASD

SEQ ID NO: 8117 - protein, 25 aa, synthetic construct
  source 1..25: note = Seed: LNVIVHSATGFKQSSKALQRPVASD
LNVIVHSATGWKQISRALNRPVASD

SEQ ID NO: 8118 - protein, 25 aa, synthetic construct
  source 1..25: note = Seed: LNVIVHSATGFKQSSKALQRPVASD
LNVIVHSATGWKQISRALPRPVASD

SEQ ID NO: 8119 - protein, 25 aa, synthetic construct
  source 1..25: note = Seed: LNVIVHSATGFKQSSKALQRPVASD
LNVIVHSATGWKQISRALQRPVASD

SEQ ID NO: 8120 - protein, 25 aa, synthetic construct
  source 1..25: note = Seed: LNVIVHSATGFKQSSKALQRPVASD
LNVIVHSATGWKQISRALRRPVASD

SEQ ID NO: 8121 - protein, 25 aa, synthetic construct
  source 1..25: note = Seed: LNVIVHSATGFKQSSKALQRPVASD
LNVIVHSATGWKQISRALSRPVASD

SEQ ID NO: 8122 - protein, 25 aa, synthetic construct
  source 1..25: note = Seed: LNVIVHSATGFKQSSKALQRPVASD
LNVIVHSATGWKQISRALTRPVASD

SEQ ID NO: 8123 - protein, 25 aa, synthetic construct
  source 1..25: note = Seed: LNVIVHSATGFKQSSKALQRPVASD
LNVIVHSATGWKQISRALVRPVASD

SEQ ID NO: 8124 - protein, 25 aa, synthetic construct
  source 1..25: note = Seed: LNVIVHSATGFKQSSKALQRPVASD
LNVIVHSATGWKQISSALARPVASD

SEQ ID NO: 8125 - protein, 25 aa, synthetic construct
  source 1..25: note = Seed: LNVIVHSATGFKQSSKALQRPVASD
LNVIVHSATGWKQISSALCRPVASD

SEQ ID NO: 8126 - protein, 25 aa, synthetic construct
  source 1..25: note = Seed: LNVIVHSATGFKQSSKALQRPVASD
LNVIVHSATGWKQISSALFRPVASD

SEQ ID NO: 8127 - protein, 25 aa, synthetic construct
  source 1..25: note = Seed: LNVIVHSATGFKQSSKALQRPVASD
LNVIVHSATGWKQISSALGRPVASD

SEQ ID NO: 8128 - protein, 25 aa, synthetic construct
  source 1..25: note = Seed: LNVIVHSATGFKQSSKALQRPVASD
LNVIVHSATGWKQISSALHRPVASD

SEQ ID NO: 8129 - protein, 25 aa, synthetic construct
  source 1..25: note = Seed: LNVIVHSATGFKQSSKALQRPVASD
LNVIVHSATGWKQISSALIRPVASD

SEQ ID NO: 8130 - protein, 25 aa, synthetic construct
  source 1..25: note = Seed: LNVIVHSATGFKQSSKALQRPVASD
LNVIVHSATGWKQISSALLRPVASD

SEQ ID NO: 8131 - protein, 25 aa, synthetic construct
  source 1..25: note = Seed: LNVIVHSATGFKQSSKALQRPVASD
LNVIVHSATGWKQISSALMRPVASD

SEQ ID NO: 8132 - protein, 25 aa, synthetic construct
  source 1..25: note = Seed: LNVIVHSATGFKQSSKALQRPVASD
LNVIVHSATGWKQISSALNRPVASD

SEQ ID NO: 8133 - protein, 25 aa, synthetic construct
  source 1..25: note = Seed: LNVIVHSATGFKQSSKALQRPVASD
LNVIVHSATGWKQISSALPRPVASD

SEQ ID NO: 8134 - protein, 25 aa, synthetic construct
  source 1..25: note = Seed: LNVIVHSATGFKQSSKALQRPVASD
LNVIVHSATGWKQISSALQRPVASD

SEQ ID NO: 8135 - protein, 25 aa, synthetic construct
  source 1..25: note = Seed: LNVIVHSATGFKQSSKALQRPVASD
LNVIVHSATGWKQISSALSRPVASD

SEQ ID NO: 8136 - protein, 25 aa, synthetic construct
  source 1..25: note = Seed: LNVIVHSATGFKQSSKALQRPVASD
LNVIVHSATGWKQISSALTRPVASD

SEQ ID NO: 8137 - protein, 25 aa, synthetic construct
  source 1..25: note = Seed: LNVIVHSATGFKQSSKALQRPVASD
LNVIVHSATGWKQISSALVRPVASD

SEQ ID NO: 8138 - protein, 25 aa, synthetic construct
  source 1..25: note = Seed: LNVIVHSATGFKQSSKALQRPVASD
LNVIVHSATGWKQISTALARPVASD

SEQ ID NO: 8139 - protein, 25 aa, synthetic construct
  source 1..25: note = Seed: LNVIVHSATGFKQSSKALQRPVASD
LNVIVHSATGWKQISTALGRPVASD

SEQ ID NO: 8140 - protein, 25 aa, synthetic construct
  source 1..25: note = Seed: LNVIVHSATGFKQSSKALQRPVASD
LNVIVHSATGWKQISTALHRPVASD

SEQ ID NO: 8141 - protein, 25 aa, synthetic construct
  source 1..25: note = Seed: LNVIVHSATGFKQSSKALQRPVASD
LNVIVHSATGWKQISTALIRPVASD

SEQ ID NO: 8142 - protein, 25 aa, synthetic construct
  source 1..25: note = Seed: LNVIVHSATGFKQSSKALQRPVASD
LNVIVHSATGWKQISTALLRPVASD

SEQ ID NO: 8143 - protein, 25 aa, synthetic construct
  source 1..25: note = Seed: LNVIVHSATGFKQSSKALQRPVASD
LNVIVHSATGWKQISTALMRPVASD

SEQ ID NO: 8144 - protein, 25 aa, synthetic construct
  source 1..25: note = Seed: LNVIVHSATGFKQSSKALQRPVASD
LNVIVHSATGWKQISTALNRPVASD

SEQ ID NO: 8145 - protein, 25 aa, synthetic construct
  source 1..25: note = Seed: LNVIVHSATGFKQSSKALQRPVASD
LNVIVHSATGWKQISTALPRPVASD

SEQ ID NO: 8146 - protein, 25 aa, synthetic construct
  source 1..25: note = Seed: LNVIVHSATGFKQSSKALQRPVASD
LNVIVHSATGWKQISTALQRPVASD

SEQ ID NO: 8147 - protein, 25 aa, synthetic construct
  source 1..25: note = Seed: LNVIVHSATGFKQSSKALQRPVASD
LNVIVHSATGWKQISTALSRPVASD

SEQ ID NO: 8148 - protein, 25 aa, synthetic construct
  source 1..25: note = Seed: LNVIVHSATGFKQSSKALQRPVASD
LNVIVHSATGWKQISTALTRPVASD

SEQ ID NO: 8149 - protein, 25 aa, synthetic construct
  source 1..25: note = Seed: LNVIVHSATGFKQSSKALQRPVASD
LNVIVHSATGWKQISTALVRPVASD

SEQ ID NO: 8150 - protein, 25 aa, synthetic construct
  source 1..25: note = Seed: LNVIVHSATGFKQSSKALQRPVASD
LNVIVHSATGWKQISVALARPVASD

SEQ ID NO: 8151 - protein, 25 aa, synthetic construct
  source 1..25: note = Seed: LNVIVHSATGFKQSSKALQRPVASD
LNVIVHSATGWKQISVALGRPVASD

SEQ ID NO: 8152 - protein, 25 aa, synthetic construct
  source 1..25: note = Seed: LNVIVHSATGFKQSSKALQRPVASD
LNVIVHSATGWKQISVALHRPVASD

SEQ ID NO: 8153 - protein, 25 aa, synthetic construct
  source 1..25: note = Seed: LNVIVHSATGFKQSSKALQRPVASD
LNVIVHSATGWKQISVALIRPVASD

SEQ ID NO: 8154 - protein, 25 aa, synthetic construct
  source 1..25: note = Seed: LNVIVHSATGFKQSSKALQRPVASD
LNVIVHSATGWKQISVALLRPVASD

SEQ ID NO: 8155 - protein, 25 aa, synthetic construct
  source 1..25: note = Seed: LNVIVHSATGFKQSSKALQRPVASD
LNVIVHSATGWKQISVALMRPVASD

SEQ ID NO: 8156 - protein, 25 aa, synthetic construct
  source 1..25: note = Seed: LNVIVHSATGFKQSSKALQRPVASD
LNVIVHSATGWKQISVALNRPVASD

SEQ ID NO: 8157 - protein, 25 aa, synthetic construct
  source 1..25: note = Seed: LNVIVHSATGFKQSSKALQRPVASD
LNVIVHSATGWKQISVALPRPVASD

SEQ ID NO: 8158 - protein, 25 aa, synthetic construct
  source 1..25: note = Seed: LNVIVHSATGFKQSSKALQRPVASD
LNVIVHSATGWKQISVALQRPVASD

SEQ ID NO: 8159 - protein, 25 aa, synthetic construct
  source 1..25: note = Seed: LNVIVHSATGFKQSSKALQRPVASD
LNVIVHSATGWKQISVALSRPVASD

SEQ ID NO: 8160 - protein, 25 aa, synthetic construct
  source 1..25: note = Seed: LNVIVHSATGFKQSSKALQRPVASD
LNVIVHSATGWKQISVALTRPVASD

SEQ ID NO: 8161 - protein, 25 aa, synthetic construct
  source 1..25: note = Seed: LNVIVHSATGFKQSSKALQRPVASD
LNVIVHSATGWKQISVALVRPVASD

SEQ ID NO: 8162 - protein, 25 aa, synthetic construct
  source 1..25: note = Seed: LNVIVHSATGFKQSSKALQRPVASD
LNVIVHSATGWKQLSAALARPVASD

SEQ ID NO: 8163 - protein, 25 aa, synthetic construct
  source 1..25: note = Seed: LNVIVHSATGFKQSSKALQRPVASD
LNVIVHSATGWKQLSAALCRPVASD

SEQ ID NO: 8164 - protein, 25 aa, synthetic construct
  source 1..25: note = Seed: LNVIVHSATGFKQSSKALQRPVASD
LNVIVHSATGWKQLSAALDRPVASD

SEQ ID NO: 8165 - protein, 25 aa, synthetic construct
  source 1..25: note = Seed: LNVIVHSATGFKQSSKALQRPVASD
LNVIVHSATGWKQLSAALERPVASD

SEQ ID NO: 8166 - protein, 25 aa, synthetic construct
  source 1..25: note = Seed: LNVIVHSATGFKQSSKALQRPVASD
LNVIVHSATGWKQLSAALFRPVASD

SEQ ID NO: 8167 - protein, 25 aa, synthetic construct
  source 1..25: note = Seed: LNVIVHSATGFKQSSKALQRPVASD
LNVIVHSATGWKQLSAALGRPVASD

SEQ ID NO: 8168 - protein, 25 aa, synthetic construct
  source 1..25: note = Seed: LNVIVHSATGFKQSSKALQRPVASD
LNVIVHSATGWKQLSAALHRPVASD

SEQ ID NO: 8169 - protein, 25 aa, synthetic construct
  source 1..25: note = Seed: LNVIVHSATGFKQSSKALQRPVASD
LNVIVHSATGWKQLSAALIRPVASD

SEQ ID NO: 8170 - protein, 25 aa, synthetic construct
  source 1..25: note = Seed: LNVIVHSATGFKQSSKALQRPVASD
LNVIVHSATGWKQLSAALKRPVASD

SEQ ID NO: 8171 - protein, 25 aa, synthetic construct
  source 1..25: note = Seed: LNVIVHSATGFKQSSKALQRPVASD
LNVIVHSATGWKQLSAALLRPVASD

SEQ ID NO: 8172 - protein, 25 aa, synthetic construct
  source 1..25: note = Seed: LNVIVHSATGFKQSSKALQRPVASD
LNVIVHSATGWKQLSAALMRPVASD

SEQ ID NO: 8173 - protein, 25 aa, synthetic construct
  source 1..25: note = Seed: LNVIVHSATGFKQSSKALQRPVASD
LNVIVHSATGWKQLSAALNRPVASD

SEQ ID NO: 8174 - protein, 25 aa, synthetic construct
  source 1..25: note = Seed: LNVIVHSATGFKQSSKALQRPVASD
LNVIVHSATGWKQLSAALPRPVASD

SEQ ID NO: 8175 - protein, 25 aa, synthetic construct
  source 1..25: note = Seed: LNVIVHSATGFKQSSKALQRPVASD
LNVIVHSATGWKQLSAALQRPVASD

SEQ ID NO: 8176 - protein, 25 aa, synthetic construct
  source 1..25: note = Seed: LNVIVHSATGFKQSSKALQRPVASD
LNVIVHSATGWKQLSAALRRPVASD

SEQ ID NO: 8177 - protein, 25 aa, synthetic construct
  source 1..25: note = Seed: LNVIVHSATGFKQSSKALQRPVASD
LNVIVHSATGWKQLSAALSRPVASD

SEQ ID NO: 8178 - protein, 25 aa, synthetic construct
  source 1..25: note = Seed: LNVIVHSATGFKQSSKALQRPVASD
LNVIVHSATGWKQLSAALTRPVASD

SEQ ID NO: 8179 - protein, 25 aa, synthetic construct
  source 1..25: note = Seed: LNVIVHSATGFKQSSKALQRPVASD
LNVIVHSATGWKQLSAALVRPVASD

SEQ ID NO: 8180 - protein, 25 aa, synthetic construct
  source 1..25: note = Seed: LNVIVHSATGFKQSSKALQRPVASD
LNVIVHSATGWKQLSAALYRPVASD

SEQ ID NO: 8181 - protein, 25 aa, synthetic construct
  source 1..25: note = Seed: LNVIVHSATGFKQSSKALQRPVASD
LNVIVHSATGWKQLSCALARPVASD

SEQ ID NO: 8182 - protein, 25 aa, synthetic construct
  source 1..25: note = Seed: LNVIVHSATGFKQSSKALQRPVASD
LNVIVHSATGWKQLSEALARPVASD

SEQ ID NO: 8183 - protein, 25 aa, synthetic construct
  source 1..25: note = Seed: LNVIVHSATGFKQSSKALQRPVASD
LNVIVHSATGWKQLSFALGRPVASD

SEQ ID NO: 8184 - protein, 25 aa, synthetic construct
  source 1..25: note = Seed: LNVIVHSATGFKQSSKALQRPVASD
LNVIVHSATGWKQLSFALIRPVASD

SEQ ID NO: 8185 - protein, 25 aa, synthetic construct
  source 1..25: note = Seed: LNVIVHSATGFKQSSKALQRPVASD
LNVIVHSATGWKQLSFALVRPVASD

SEQ ID NO: 8186 - protein, 25 aa, synthetic construct
  source 1..25: note = Seed: LNVIVHSATGFKQSSKALQRPVASD
LNVIVHSATGWKQLSGALARPVASD

SEQ ID NO: 8187 - protein, 25 aa, synthetic construct
  source 1..25: note = Seed: LNVIVHSATGFKQSSKALQRPVASD
LNVIVHSATGWKQLSGALCRPVASD

SEQ ID NO: 8188 - protein, 25 aa, synthetic construct
  source 1..25: note = Seed: LNVIVHSATGFKQSSKALQRPVASD
LNVIVHSATGWKQLSGALFRPVASD

SEQ ID NO: 8189 - protein, 25 aa, synthetic construct
  source 1..25: note = Seed: LNVIVHSATGFKQSSKALQRPVASD
LNVIVHSATGWKQLSGALGRPVASD

SEQ ID NO: 8190 - protein, 25 aa, synthetic construct
  source 1..25: note = Seed: LNVIVHSATGFKQSSKALQRPVASD
LNVIVHSATGWKQLSGALHRPVASD

SEQ ID NO: 8191 - protein, 25 aa, synthetic construct
  source 1..25: note = Seed: LNVIVHSATGFKQSSKALQRPVASD
LNVIVHSATGWKQLSGALIRPVASD

SEQ ID NO: 8192 - protein, 25 aa, synthetic construct
  source 1..25: note = Seed: LNVIVHSATGFKQSSKALQRPVASD
LNVIVHSATGWKQLSGALLRPVASD

SEQ ID NO: 8193 - protein, 25 aa, synthetic construct
  source 1..25: note = Seed: LNVIVHSATGFKQSSKALQRPVASD
LNVIVHSATGWKQLSGALMRPVASD

SEQ ID NO: 8194 - protein, 25 aa, synthetic construct
  source 1..25: note = Seed: LNVIVHSATGFKQSSKALQRPVASD
LNVIVHSATGWKQLSGALNRPVASD

SEQ ID NO: 8195 - protein, 25 aa, synthetic construct
  source 1..25: note = Seed: LNVIVHSATGFKQSSKALQRPVASD
LNVIVHSATGWKQLSGALPRPVASD

SEQ ID NO: 8196 - protein, 25 aa, synthetic construct
  source 1..25: note = Seed: LNVIVHSATGFKQSSKALQRPVASD
LNVIVHSATGWKQLSGALQRPVASD

SEQ ID NO: 8197 - protein, 25 aa, synthetic construct
  source 1..25: note = Seed: LNVIVHSATGFKQSSKALQRPVASD
LNVIVHSATGWKQLSGALSRPVASD

SEQ ID NO: 8198 - protein, 25 aa, synthetic construct
  source 1..25: note = Seed: LNVIVHSATGFKQSSKALQRPVASD
LNVIVHSATGWKQLSGALTRPVASD

SEQ ID NO: 8199 - protein, 25 aa, synthetic construct
  source 1..25: note = Seed: LNVIVHSATGFKQSSKALQRPVASD
LNVIVHSATGWKQLSGALVRPVASD

SEQ ID NO: 8200 - protein, 25 aa, synthetic construct
  source 1..25: note = Seed: LNVIVHSATGFKQSSKALQRPVASD
LNVIVHSATGWKQLSHALARPVASD

SEQ ID NO: 8201 - protein, 25 aa, synthetic construct
  source 1..25: note = Seed: LNVIVHSATGFKQSSKALQRPVASD
LNVIVHSATGWKQLSHALGRPVASD

SEQ ID NO: 8202 - protein, 25 aa, synthetic construct
  source 1..25: note = Seed: LNVIVHSATGFKQSSKALQRPVASD
LNVIVHSATGWKQLSHALIRPVASD

SEQ ID NO: 8203 - protein, 25 aa, synthetic construct
  source 1..25: note = Seed: LNVIVHSATGFKQSSKALQRPVASD
LNVIVHSATGWKQLSHALLRPVASD

SEQ ID NO: 8204 - protein, 25 aa, synthetic construct
  source 1..25: note = Seed: LNVIVHSATGFKQSSKALQRPVASD
LNVIVHSATGWKQLSHALRRPVASD

SEQ ID NO: 8205 - protein, 25 aa, synthetic construct
  source 1..25: note = Seed: LNVIVHSATGFKQSSKALQRPVASD
LNVIVHSATGWKQLSHALSRPVASD

SEQ ID NO: 8206 - protein, 25 aa, synthetic construct
  source 1..25: note = Seed: LNVIVHSATGFKQSSKALQRPVASD
LNVIVHSATGWKQLSHALTRPVASD

SEQ ID NO: 8207 - protein, 25 aa, synthetic construct
  source 1..25: note = Seed: LNVIVHSATGFKQSSKALQRPVASD
LNVIVHSATGWKQLSHALVRPVASD

SEQ ID NO: 8208 - protein, 25 aa, synthetic construct
  source 1..25: note = Seed: LNVIVHSATGFKQSSKALQRPVASD
LNVIVHSATGWKQLSIALARPVASD

SEQ ID NO: 8209 - protein, 25 aa, synthetic construct
  source 1..25: note = Seed: LNVIVHSATGFKQSSKALQRPVASD
LNVIVHSATGWKQLSIALDRPVASD

SEQ ID NO: 8210 - protein, 25 aa, synthetic construct
  source 1..25: note = Seed: LNVIVHSATGFKQSSKALQRPVASD
LNVIVHSATGWKQLSIALERPVASD

SEQ ID NO: 8211 - protein, 25 aa, synthetic construct
  source 1..25: note = Seed: LNVIVHSATGFKQSSKALQRPVASD
LNVIVHSATGWKQLSIALGRPVASD

SEQ ID NO: 8212 - protein, 25 aa, synthetic construct
  source 1..25: note = Seed: LNVIVHSATGFKQSSKALQRPVASD
LNVIVHSATGWKQLSIALHRPVASD

SEQ ID NO: 8213 - protein, 25 aa, synthetic construct
  source 1..25: note = Seed: LNVIVHSATGFKQSSKALQRPVASD
LNVIVHSATGWKQLSIALIRPVASD

SEQ ID NO: 8214 - protein, 25 aa, synthetic construct
  source 1..25: note = Seed: LNVIVHSATGFKQSSKALQRPVASD
LNVIVHSATGWKQLSIALLRPVASD

SEQ ID NO: 8215 - protein, 25 aa, synthetic construct
  source 1..25: note = Seed: LNVIVHSATGFKQSSKALQRPVASD
LNVIVHSATGWKQLSIALMRPVASD

SEQ ID NO: 8216 - protein, 25 aa, synthetic construct
  source 1..25: note = Seed: LNVIVHSATGFKQSSKALQRPVASD
LNVIVHSATGWKQLSIALNRPVASD

SEQ ID NO: 8217 - protein, 25 aa, synthetic construct
  source 1..25: note = Seed: LNVIVHSATGFKQSSKALQRPVASD
LNVIVHSATGWKQLSIALPRPVASD

SEQ ID NO: 8218 - protein, 25 aa, synthetic construct
  source 1..25: note = Seed: LNVIVHSATGFKQSSKALQRPVASD
LNVIVHSATGWKQLSIALQRPVASD

SEQ ID NO: 8219 - protein, 25 aa, synthetic construct
  source 1..25: note = Seed: LNVIVHSATGFKQSSKALQRPVASD
LNVIVHSATGWKQLSIALSRPVASD

SEQ ID NO: 8220 - protein, 25 aa, synthetic construct
  source 1..25: note = Seed: LNVIVHSATGFKQSSKALQRPVASD
LNVIVHSATGWKQLSIALTRPVASD

SEQ ID NO: 8221 - protein, 25 aa, synthetic construct
  source 1..25: note = Seed: LNVIVHSATGFKQSSKALQRPVASD
LNVIVHSATGWKQLSIALVRPVASD

SEQ ID NO: 8222 - protein, 25 aa, synthetic construct
  source 1..25: note = Seed: LNVIVHSATGFKQSSKALQRPVASD
LNVIVHSATGWKQLSKALARPVASD

SEQ ID NO: 8223 - protein, 25 aa, synthetic construct
  source 1..25: note = Seed: LNVIVHSATGFKQSSKALQRPVASD
LNVIVHSATGWKQLSKALGRPVASD

SEQ ID NO: 8224 - protein, 25 aa, synthetic construct
  source 1..25: note = Seed: LNVIVHSATGFKQSSKALQRPVASD
LNVIVHSATGWKQLSKALHRPVASD

SEQ ID NO: 8225 - protein, 25 aa, synthetic construct
  source 1..25: note = Seed: LNVIVHSATGFKQSSKALQRPVASD
LNVIVHSATGWKQLSKALKRPVASD

SEQ ID NO: 8226 - protein, 25 aa, synthetic construct
  source 1..25: note = Seed: LNVIVHSATGFKQSSKALQRPVASD
LNVIVHSATGWKQLSKALNRPVASD

SEQ ID NO: 8227 - protein, 25 aa, synthetic construct
  source 1..25: note = Seed: LNVIVHSATGFKQSSKALQRPVASD
LNVIVHSATGWKQLSKALQRPVASD

SEQ ID NO: 8228 - protein, 25 aa, synthetic construct
  source 1..25: note = Seed: LNVIVHSATGFKQSSKALQRPVASD
LNVIVHSATGWKQLSKALRRPVASD

SEQ ID NO: 8229 - protein, 25 aa, synthetic construct
  source 1..25: note = Seed: LNVIVHSATGFKQSSKALQRPVASD
LNVIVHSATGWKQLSKALSRPVASD

SEQ ID NO: 8230 - protein, 25 aa, synthetic construct
  source 1..25: note = Seed: LNVIVHSATGFKQSSKALQRPVASD
LNVIVHSATGWKQLSKALTRPVASD

SEQ ID NO: 8231 - protein, 25 aa, synthetic construct
  source 1..25: note = Seed: LNVIVHSATGFKQSSKALQRPVASD
LNVIVHSATGWKQLSLALARPVASD

SEQ ID NO: 8232 - protein, 25 aa, synthetic construct
  source 1..25: note = Seed: LNVIVHSATGFKQSSKALQRPVASD
LNVIVHSATGWKQLSLALGRPVASD

SEQ ID NO: 8233 - protein, 25 aa, synthetic construct
  source 1..25: note = Seed: LNVIVHSATGFKQSSKALQRPVASD
LNVIVHSATGWKQLSLALHRPVASD

SEQ ID NO: 8234 - protein, 25 aa, synthetic construct
  source 1..25: note = Seed: LNVIVHSATGFKQSSKALQRPVASD
LNVIVHSATGWKQLSLALIRPVASD

SEQ ID NO: 8235 - protein, 25 aa, synthetic construct
  source 1..25: note = Seed: LNVIVHSATGFKQSSKALQRPVASD
LNVIVHSATGWKQLSLALLRPVASD

SEQ ID NO: 8236 - protein, 25 aa, synthetic construct
  source 1..25: note = Seed: LNVIVHSATGFKQSSKALQRPVASD
LNVIVHSATGWKQLSLALMRPVASD

SEQ ID NO: 8237 - protein, 25 aa, synthetic construct
  source 1..25: note = Seed: LNVIVHSATGFKQSSKALQRPVASD
LNVIVHSATGWKQLSLALNRPVASD

SEQ ID NO: 8238 - protein, 25 aa, synthetic construct
  source 1..25: note = Seed: LNVIVHSATGFKQSSKALQRPVASD
LNVIVHSATGWKQLSLALQRPVASD

SEQ ID NO: 8239 - protein, 25 aa, synthetic construct
  source 1..25: note = Seed: LNVIVHSATGFKQSSKALQRPVASD
LNVIVHSATGWKQLSLALSRPVASD

SEQ ID NO: 8240 - protein, 25 aa, synthetic construct
  source 1..25: note = Seed: LNVIVHSATGFKQSSKALQRPVASD
LNVIVHSATGWKQLSLALTRPVASD

SEQ ID NO: 8241 - protein, 25 aa, synthetic construct
  source 1..25: note = Seed: LNVIVHSATGFKQSSKALQRPVASD
LNVIVHSATGWKQLSLALVRPVASD

SEQ ID NO: 8242 - protein, 25 aa, synthetic construct
  source 1..25: note = Seed: LNVIVHSATGFKQSSKALQRPVASD
LNVIVHSATGWKQLSMALARPVASD

SEQ ID NO: 8243 - protein, 25 aa, synthetic construct
  source 1..25: note = Seed: LNVIVHSATGFKQSSKALQRPVASD
LNVIVHSATGWKQLSMALGRPVASD

SEQ ID NO: 8244 - protein, 25 aa, synthetic construct
  source 1..25: note = Seed: LNVIVHSATGFKQSSKALQRPVASD
LNVIVHSATGWKQLSMALHRPVASD

SEQ ID NO: 8245 - protein, 25 aa, synthetic construct
  source 1..25: note = Seed: LNVIVHSATGFKQSSKALQRPVASD
LNVIVHSATGWKQLSMALIRPVASD

SEQ ID NO: 8246 - protein, 25 aa, synthetic construct
  source 1..25: note = Seed: LNVIVHSATGFKQSSKALQRPVASD
LNVIVHSATGWKQLSMALLRPVASD

SEQ ID NO: 8247 - protein, 25 aa, synthetic construct
  source 1..25: note = Seed: LNVIVHSATGFKQSSKALQRPVASD
LNVIVHSATGWKQLSMALMRPVASD

SEQ ID NO: 8248 - protein, 25 aa, synthetic construct
  source 1..25: note = Seed: LNVIVHSATGFKQSSKALQRPVASD
LNVIVHSATGWKQLSMALNRPVASD

SEQ ID NO: 8249 - protein, 25 aa, synthetic construct
  source 1..25: note = Seed: LNVIVHSATGFKQSSKALQRPVASD
LNVIVHSATGWKQLSMALSRPVASD

SEQ ID NO: 8250 - protein, 25 aa, synthetic construct
  source 1..25: note = Seed: LNVIVHSATGFKQSSKALQRPVASD
LNVIVHSATGWKQLSMALTRPVASD

SEQ ID NO: 8251 - protein, 25 aa, synthetic construct
  source 1..25: note = Seed: LNVIVHSATGFKQSSKALQRPVASD
LNVIVHSATGWKQLSMALVRPVASD

SEQ ID NO: 8252 - protein, 25 aa, synthetic construct
  source 1..25: note = Seed: LNVIVHSATGFKQSSKALQRPVASD
LNVIVHSATGWKQLSNALARPVASD

SEQ ID NO: 8253 - protein, 25 aa, synthetic construct
  source 1..25: note = Seed: LNVIVHSATGFKQSSKALQRPVASD
LNVIVHSATGWKQLSNALGRPVASD

SEQ ID NO: 8254 - protein, 25 aa, synthetic construct
  source 1..25: note = Seed: LNVIVHSATGFKQSSKALQRPVASD
LNVIVHSATGWKQLSNALIRPVASD

SEQ ID NO: 8255 - protein, 25 aa, synthetic construct
  source 1..25: note = Seed: LNVIVHSATGFKQSSKALQRPVASD
LNVIVHSATGWKQLSNALLRPVASD

SEQ ID NO: 8256 - protein, 25 aa, synthetic construct
  source 1..25: note = Seed: LNVIVHSATGFKQSSKALQRPVASD
LNVIVHSATGWKQLSNALMRPVASD

SEQ ID NO: 8257 - protein, 25 aa, synthetic construct
  source 1..25: note = Seed: LNVIVHSATGFKQSSKALQRPVASD
LNVIVHSATGWKQLSNALNRPVASD

SEQ ID NO: 8258 - protein, 25 aa, synthetic construct
  source 1..25: note = Seed: LNVIVHSATGFKQSSKALQRPVASD
LNVIVHSATGWKQLSNALSRPVASD

SEQ ID NO: 8259 - protein, 25 aa, synthetic construct
  source 1..25: note = Seed: LNVIVHSATGFKQSSKALQRPVASD
LNVIVHSATGWKQLSNALTRPVASD

SEQ ID NO: 8260 - protein, 25 aa, synthetic construct
  source 1..25: note = Seed: LNVIVHSATGFKQSSKALQRPVASD
LNVIVHSATGWKQLSNALVRPVASD

SEQ ID NO: 8261 - protein, 25 aa, synthetic construct
  source 1..25: note = Seed: LNVIVHSATGFKQSSKALQRPVASD
LNVIVHSATGWKQLSPALARPVASD

SEQ ID NO: 8262 - protein, 25 aa, synthetic construct
  source 1..25: note = Seed: LNVIVHSATGFKQSSKALQRPVASD
LNVIVHSATGWKQLSPALCRPVASD

SEQ ID NO: 8263 - protein, 25 aa, synthetic construct
  source 1..25: note = Seed: LNVIVHSATGFKQSSKALQRPVASD
LNVIVHSATGWKQLSPALDRPVASD

SEQ ID NO: 8264 - protein, 25 aa, synthetic construct
  source 1..25: note = Seed: LNVIVHSATGFKQSSKALQRPVASD
LNVIVHSATGWKQLSPALERPVASD

SEQ ID NO: 8265 - protein, 25 aa, synthetic construct
  source 1..25: note = Seed: LNVIVHSATGFKQSSKALQRPVASD
LNVIVHSATGWKQLSPALFRPVASD

SEQ ID NO: 8266 - protein, 25 aa, synthetic construct
  source 1..25: note = Seed: LNVIVHSATGFKQSSKALQRPVASD
LNVIVHSATGWKQLSPALGRPVASD

SEQ ID NO: 8267 - protein, 25 aa, synthetic construct
  source 1..25: note = Seed: LNVIVHSATGFKQSSKALQRPVASD
LNVIVHSATGWKQLSPALHRPVASD

SEQ ID NO: 8268 - protein, 25 aa, synthetic construct
  source 1..25: note = Seed: LNVIVHSATGFKQSSKALQRPVASD
LNVIVHSATGWKQLSPALIRPVASD

SEQ ID NO: 8269 - protein, 25 aa, synthetic construct
  source 1..25: note = Seed: LNVIVHSATGFKQSSKALQRPVASD
LNVIVHSATGWKQLSPALLRPVASD

SEQ ID NO: 8270 - protein, 25 aa, synthetic construct
  source 1..25: note = Seed: LNVIVHSATGFKQSSKALQRPVASD
LNVIVHSATGWKQLSPALMRPVASD

SEQ ID NO: 8271 - protein, 25 aa, synthetic construct
  source 1..25: note = Seed: LNVIVHSATGFKQSSKALQRPVASD
LNVIVHSATGWKQLSPALNRPVASD

SEQ ID NO: 8272 - protein, 25 aa, synthetic construct
  source 1..25: note = Seed: LNVIVHSATGFKQSSKALQRPVASD
LNVIVHSATGWKQLSPALPRPVASD

SEQ ID NO: 8273 - protein, 25 aa, synthetic construct
  source 1..25: note = Seed: LNVIVHSATGFKQSSKALQRPVASD
LNVIVHSATGWKQLSPALQRPVASD

SEQ ID NO: 8274 - protein, 25 aa, synthetic construct
  source 1..25: note = Seed: LNVIVHSATGFKQSSKALQRPVASD
LNVIVHSATGWKQLSPALSRPVASD

SEQ ID NO: 8275 - protein, 25 aa, synthetic construct
  source 1..25: note = Seed: LNVIVHSATGFKQSSKALQRPVASD
LNVIVHSATGWKQLSPALTRPVASD

SEQ ID NO: 8276 - protein, 25 aa, synthetic construct
  source 1..25: note = Seed: LNVIVHSATGFKQSSKALQRPVASD
LNVIVHSATGWKQLSPALVRPVASD

SEQ ID NO: 8277 - protein, 25 aa, synthetic construct
  source 1..25: note = Seed: LNVIVHSATGFKQSSKALQRPVASD
LNVIVHSATGWKQLSQALARPVASD

SEQ ID NO: 8278 - protein, 25 aa, synthetic construct
  source 1..25: note = Seed: LNVIVHSATGFKQSSKALQRPVASD
LNVIVHSATGWKQLSQALGRPVASD

SEQ ID NO: 8279 - protein, 25 aa, synthetic construct
  source 1..25: note = Seed: LNVIVHSATGFKQSSKALQRPVASD
LNVIVHSATGWKQLSQALSRPVASD

SEQ ID NO: 8280 - protein, 25 aa, synthetic construct
  source 1..25: note = Seed: LNVIVHSATGFKQSSKALQRPVASD
LNVIVHSATGWKQLSQALVRPVASD

SEQ ID NO: 8281 - protein, 25 aa, synthetic construct
  source 1..25: note = Seed: LNVIVHSATGFKQSSKALQRPVASD
LNVIVHSATGWKQLSRALARPVASD

SEQ ID NO: 8282 - protein, 25 aa, synthetic construct
  source 1..25: note = Seed: LNVIVHSATGFKQSSKALQRPVASD
LNVIVHSATGWKQLSRALGRPVASD

SEQ ID NO: 8283 - protein, 25 aa, synthetic construct
  source 1..25: note = Seed: LNVIVHSATGFKQSSKALQRPVASD
LNVIVHSATGWKQLSRALHRPVASD

SEQ ID NO: 8284 - protein, 25 aa, synthetic construct
  source 1..25: note = Seed: LNVIVHSATGFKQSSKALQRPVASD
LNVIVHSATGWKQLSRALKRPVASD

SEQ ID NO: 8285 - protein, 25 aa, synthetic construct
  source 1..25: note = Seed: LNVIVHSATGFKQSSKALQRPVASD
LNVIVHSATGWKQLSRALMRPVASD

SEQ ID NO: 8286 - protein, 25 aa, synthetic construct
  source 1..25: note = Seed: LNVIVHSATGFKQSSKALQRPVASD
LNVIVHSATGWKQLSRALNRPVASD

SEQ ID NO: 8287 - protein, 25 aa, synthetic construct
  source 1..25: note = Seed: LNVIVHSATGFKQSSKALQRPVASD
LNVIVHSATGWKQLSRALPRPVASD

SEQ ID NO: 8288 - protein, 25 aa, synthetic construct
  source 1..25: note = Seed: LNVIVHSATGFKQSSKALQRPVASD
LNVIVHSATGWKQLSRALQRPVASD

SEQ ID NO: 8289 - protein, 25 aa, synthetic construct
  source 1..25: note = Seed: LNVIVHSATGFKQSSKALQRPVASD
LNVIVHSATGWKQLSRALRRPVASD

SEQ ID NO: 8290 - protein, 25 aa, synthetic construct
  source 1..25: note = Seed: LNVIVHSATGFKQSSKALQRPVASD
LNVIVHSATGWKQLSRALSRPVASD

SEQ ID NO: 8291 - protein, 25 aa, synthetic construct
  source 1..25: note = Seed: LNVIVHSATGFKQSSKALQRPVASD
LNVIVHSATGWKQLSRALTRPVASD

SEQ ID NO: 8292 - protein, 25 aa, synthetic construct
  source 1..25: note = Seed: LNVIVHSATGFKQSSKALQRPVASD
LNVIVHSATGWKQLSRALVRPVASD

SEQ ID NO: 8293 - protein, 25 aa, synthetic construct
  source 1..25: note = Seed: LNVIVHSATGFKQSSKALQRPVASD
LNVIVHSATGWKQLSSALARPVASD

SEQ ID NO: 8294 - protein, 25 aa, synthetic construct
  source 1..25: note = Seed: LNVIVHSATGFKQSSKALQRPVASD
LNVIVHSATGWKQLSSALCRPVASD

SEQ ID NO: 8295 - protein, 25 aa, synthetic construct
  source 1..25: note = Seed: LNVIVHSATGFKQSSKALQRPVASD
LNVIVHSATGWKQLSSALDRPVASD

SEQ ID NO: 8296 - protein, 25 aa, synthetic construct
  source 1..25: note = Seed: LNVIVHSATGFKQSSKALQRPVASD
LNVIVHSATGWKQLSSALFRPVASD

SEQ ID NO: 8297 - protein, 25 aa, synthetic construct
  source 1..25: note = Seed: LNVIVHSATGFKQSSKALQRPVASD
LNVIVHSATGWKQLSSALGRPVASD

SEQ ID NO: 8298 - protein, 25 aa, synthetic construct
  source 1..25: note = Seed: LNVIVHSATGFKQSSKALQRPVASD
LNVIVHSATGWKQLSSALHRPVASD

SEQ ID NO: 8299 - protein, 25 aa, synthetic construct
  source 1..25: note = Seed: LNVIVHSATGFKQSSKALQRPVASD
LNVIVHSATGWKQLSSALIRPVASD

SEQ ID NO: 8300 - protein, 25 aa, synthetic construct
  source 1..25: note = Seed: LNVIVHSATGFKQSSKALQRPVASD
LNVIVHSATGWKQLSSALLRPVASD

SEQ ID NO: 8301 - protein, 25 aa, synthetic construct
  source 1..25: note = Seed: LNVIVHSATGFKQSSKALQRPVASD
LNVIVHSATGWKQLSSALMRPVASD

SEQ ID NO: 8302 - protein, 25 aa, synthetic construct
  source 1..25: note = Seed: LNVIVHSATGFKQSSKALQRPVASD
LNVIVHSATGWKQLSSALNRPVASD

SEQ ID NO: 8303 - protein, 25 aa, synthetic construct
  source 1..25: note = Seed: LNVIVHSATGFKQSSKALQRPVASD
LNVIVHSATGWKQLSSALPRPVASD

SEQ ID NO: 8304 - protein, 25 aa, synthetic construct
  source 1..25: note = Seed: LNVIVHSATGFKQSSKALQRPVASD
LNVIVHSATGWKQLSSALQRPVASD

SEQ ID NO: 8305 - protein, 25 aa, synthetic construct
  source 1..25: note = Seed: LNVIVHSATGFKQSSKALQRPVASD
LNVIVHSATGWKQLSSALSRPVASD

SEQ ID NO: 8306 - protein, 25 aa, synthetic construct
  source 1..25: note = Seed: LNVIVHSATGFKQSSKALQRPVASD
LNVIVHSATGWKQLSSALTRPVASD

SEQ ID NO: 8307 - protein, 25 aa, synthetic construct
  source 1..25: note = Seed: LNVIVHSATGFKQSSKALQRPVASD
LNVIVHSATGWKQLSSALVRPVASD

SEQ ID NO: 8308 - protein, 25 aa, synthetic construct
  source 1..25: note = Seed: LNVIVHSATGFKQSSKALQRPVASD
LNVIVHSATGWKQLSTALARPVASD

SEQ ID NO: 8309 - protein, 25 aa, synthetic construct
  source 1..25: note = Seed: LNVIVHSATGFKQSSKALQRPVASD
LNVIVHSATGWKQLSTALDRPVASD

SEQ ID NO: 8310 - protein, 25 aa, synthetic construct
  source 1..25: note = Seed: LNVIVHSATGFKQSSKALQRPVASD
LNVIVHSATGWKQLSTALERPVASD

SEQ ID NO: 8311 - protein, 25 aa, synthetic construct
  source 1..25: note = Seed: LNVIVHSATGFKQSSKALQRPVASD
LNVIVHSATGWKQLSTALGRPVASD

SEQ ID NO: 8312 - protein, 25 aa, synthetic construct
  source 1..25: note = Seed: LNVIVHSATGFKQSSKALQRPVASD
LNVIVHSATGWKQLSTALHRPVASD

SEQ ID NO: 8313 - protein, 25 aa, synthetic construct
  source 1..25: note = Seed: LNVIVHSATGFKQSSKALQRPVASD
LNVIVHSATGWKQLSTALIRPVASD

SEQ ID NO: 8314 - protein, 25 aa, synthetic construct
  source 1..25: note = Seed: LNVIVHSATGFKQSSKALQRPVASD
LNVIVHSATGWKQLSTALLRPVASD

SEQ ID NO: 8315 - protein, 25 aa, synthetic construct
  source 1..25: note = Seed: LNVIVHSATGFKQSSKALQRPVASD
LNVIVHSATGWKQLSTALMRPVASD

SEQ ID NO: 8316 - protein, 25 aa, synthetic construct
  source 1..25: note = Seed: LNVIVHSATGFKQSSKALQRPVASD
LNVIVHSATGWKQLSTALNRPVASD

SEQ ID NO: 8317 - protein, 25 aa, synthetic construct
  source 1..25: note = Seed: LNVIVHSATGFKQSSKALQRPVASD
LNVIVHSATGWKQLSTALPRPVASD

SEQ ID NO: 8318 - protein, 25 aa, synthetic construct
  source 1..25: note = Seed: LNVIVHSATGFKQSSKALQRPVASD
LNVIVHSATGWKQLSTALQRPVASD

SEQ ID NO: 8319 - protein, 25 aa, synthetic construct
  source 1..25: note = Seed: LNVIVHSATGFKQSSKALQRPVASD
LNVIVHSATGWKQLSTALSRPVASD

SEQ ID NO: 8320 - protein, 25 aa, synthetic construct
  source 1..25: note = Seed: LNVIVHSATGFKQSSKALQRPVASD
LNVIVHSATGWKQLSTALTRPVASD

SEQ ID NO: 8321 - protein, 25 aa, synthetic construct
  source 1..25: note = Seed: LNVIVHSATGFKQSSKALQRPVASD
LNVIVHSATGWKQLSTALVRPVASD

SEQ ID NO: 8322 - protein, 25 aa, synthetic construct
  source 1..25: note = Seed: LNVIVHSATGFKQSSKALQRPVASD
LNVIVHSATGWKQLSVALARPVASD

SEQ ID NO: 8323 - protein, 25 aa, synthetic construct
  source 1..25: note = Seed: LNVIVHSATGFKQSSKALQRPVASD
LNVIVHSATGWKQLSVALDRPVASD

SEQ ID NO: 8324 - protein, 25 aa, synthetic construct
  source 1..25: note = Seed: LNVIVHSATGFKQSSKALQRPVASD
LNVIVHSATGWKQLSVALERPVASD

SEQ ID NO: 8325 - protein, 25 aa, synthetic construct
  source 1..25: note = Seed: LNVIVHSATGFKQSSKALQRPVASD
LNVIVHSATGWKQLSVALGRPVASD

SEQ ID NO: 8326 - protein, 25 aa, synthetic construct
  source 1..25: note = Seed: LNVIVHSATGFKQSSKALQRPVASD
LNVIVHSATGWKQLSVALHRPVASD

SEQ ID NO: 8327 - protein, 25 aa, synthetic construct
  source 1..25: note = Seed: LNVIVHSATGFKQSSKALQRPVASD
LNVIVHSATGWKQLSVALIRPVASD

SEQ ID NO: 8328 - protein, 25 aa, synthetic construct
  source 1..25: note = Seed: LNVIVHSATGFKQSSKALQRPVASD
LNVIVHSATGWKQLSVALLRPVASD

SEQ ID NO: 8329 - protein, 25 aa, synthetic construct
  source 1..25: note = Seed: LNVIVHSATGFKQSSKALQRPVASD
LNVIVHSATGWKQLSVALMRPVASD

SEQ ID NO: 8330 - protein, 25 aa, synthetic construct
  source 1..25: note = Seed: LNVIVHSATGFKQSSKALQRPVASD
LNVIVHSATGWKQLSVALNRPVASD

SEQ ID NO: 8331 - protein, 25 aa, synthetic construct
  source 1..25: note = Seed: LNVIVHSATGFKQSSKALQRPVASD
LNVIVHSATGWKQLSVALPRPVASD

SEQ ID NO: 8332 - protein, 25 aa, synthetic construct
  source 1..25: note = Seed: LNVIVHSATGFKQSSKALQRPVASD
LNVIVHSATGWKQLSVALQRPVASD

SEQ ID NO: 8333 - protein, 25 aa, synthetic construct
  source 1..25: note = Seed: LNVIVHSATGFKQSSKALQRPVASD
LNVIVHSATGWKQLSVALSRPVASD

SEQ ID NO: 8334 - protein, 25 aa, synthetic construct
  source 1..25: note = Seed: LNVIVHSATGFKQSSKALQRPVASD
LNVIVHSATGWKQLSVALTRPVASD

SEQ ID NO: 8335 - protein, 25 aa, synthetic construct
  source 1..25: note = Seed: LNVIVHSATGFKQSSKALQRPVASD
LNVIVHSATGWKQLSVALVRPVASD

SEQ ID NO: 8336 - protein, 25 aa, synthetic construct
  source 1..25: note = Seed: LNVIVHSATGFKQSSKALQRPVASD
LNVIVHSATGWKQLSWALIRPVASD

SEQ ID NO: 8337 - protein, 25 aa, synthetic construct
  source 1..25: note = Seed: LNVIVHSATGFKQSSKALQRPVASD
LNVIVHSATGWKQLSWALVRPVASD

SEQ ID NO: 8338 - protein, 25 aa, synthetic construct
  source 1..25: note = Seed: LNVIVHSATGFKQSSKALQRPVASD
LNVIVHSATGWKQLSYALGRPVASD

SEQ ID NO: 8339 - protein, 25 aa, synthetic construct
  source 1..25: note = Seed: LNVIVHSATGFKQSSKALQRPVASD
LNVIVHSATGWKQLSYALVRPVASD

SEQ ID NO: 8340 - protein, 25 aa, synthetic construct
  source 1..25: note = Seed: LNVIVHSATGFKQSSKALQRPVASD
LNVIVHSATGWKQMSAALARPVASD

SEQ ID NO: 8341 - protein, 25 aa, synthetic construct
  source 1..25: note = Seed: LNVIVHSATGFKQSSKALQRPVASD
LNVIVHSATGWKQMSAALCRPVASD

SEQ ID NO: 8342 - protein, 25 aa, synthetic construct
  source 1..25: note = Seed: LNVIVHSATGFKQSSKALQRPVASD
LNVIVHSATGWKQMSAALDRPVASD

SEQ ID NO: 8343 - protein, 25 aa, synthetic construct
  source 1..25: note = Seed: LNVIVHSATGFKQSSKALQRPVASD
LNVIVHSATGWKQMSAALERPVASD

SEQ ID NO: 8344 - protein, 25 aa, synthetic construct
  source 1..25: note = Seed: LNVIVHSATGFKQSSKALQRPVASD
LNVIVHSATGWKQMSAALFRPVASD

SEQ ID NO: 8345 - protein, 25 aa, synthetic construct
  source 1..25: note = Seed: LNVIVHSATGFKQSSKALQRPVASD
LNVIVHSATGWKQMSAALGRPVASD

SEQ ID NO: 8346 - protein, 25 aa, synthetic construct
  source 1..25: note = Seed: LNVIVHSATGFKQSSKALQRPVASD
LNVIVHSATGWKQMSAALHRPVASD

SEQ ID NO: 8347 - protein, 25 aa, synthetic construct
  source 1..25: note = Seed: LNVIVHSATGFKQSSKALQRPVASD
LNVIVHSATGWKQMSAALIRPVASD

SEQ ID NO: 8348 - protein, 25 aa, synthetic construct
  source 1..25: note = Seed: LNVIVHSATGFKQSSKALQRPVASD
LNVIVHSATGWKQMSAALKRPVASD

SEQ ID NO: 8349 - protein, 25 aa, synthetic construct
  source 1..25: note = Seed: LNVIVHSATGFKQSSKALQRPVASD
LNVIVHSATGWKQMSAALLRPVASD

SEQ ID NO: 8350 - protein, 25 aa, synthetic construct
  source 1..25: note = Seed: LNVIVHSATGFKQSSKALQRPVASD
LNVIVHSATGWKQMSAALMRPVASD

SEQ ID NO: 8351 - protein, 25 aa, synthetic construct
  source 1..25: note = Seed: LNVIVHSATGFKQSSKALQRPVASD
LNVIVHSATGWKQMSAALNRPVASD

SEQ ID NO: 8352 - protein, 25 aa, synthetic construct
  source 1..25: note = Seed: LNVIVHSATGFKQSSKALQRPVASD
LNVIVHSATGWKQMSAALPRPVASD

SEQ ID NO: 8353 - protein, 25 aa, synthetic construct
  source 1..25: note = Seed: LNVIVHSATGFKQSSKALQRPVASD
LNVIVHSATGWKQMSAALQRPVASD

SEQ ID NO: 8354 - protein, 25 aa, synthetic construct
  source 1..25: note = Seed: LNVIVHSATGFKQSSKALQRPVASD
LNVIVHSATGWKQMSAALRRPVASD

SEQ ID NO: 8355 - protein, 25 aa, synthetic construct
  source 1..25: note = Seed: LNVIVHSATGFKQSSKALQRPVASD
LNVIVHSATGWKQMSAALSRPVASD

SEQ ID NO: 8356 - protein, 25 aa, synthetic construct
  source 1..25: note = Seed: LNVIVHSATGFKQSSKALQRPVASD
LNVIVHSATGWKQMSAALTRPVASD

SEQ ID NO: 8357 - protein, 25 aa, synthetic construct
  source 1..25: note = Seed: LNVIVHSATGFKQSSKALQRPVASD
LNVIVHSATGWKQMSAALVRPVASD

SEQ ID NO: 8358 - protein, 25 aa, synthetic construct
  source 1..25: note = Seed: LNVIVHSATGFKQSSKALQRPVASD
LNVIVHSATGWKQMSAALYRPVASD

SEQ ID NO: 8359 - protein, 25 aa, synthetic construct
  source 1..25: note = Seed: LNVIVHSATGFKQSSKALQRPVASD
LNVIVHSATGWKQMSCALARPVASD

SEQ ID NO: 8360 - protein, 25 aa, synthetic construct
  source 1..25: note = Seed: LNVIVHSATGFKQSSKALQRPVASD
LNVIVHSATGWKQMSFALGRPVASD

SEQ ID NO: 8361 - protein, 25 aa, synthetic construct
  source 1..25: note = Seed: LNVIVHSATGFKQSSKALQRPVASD
LNVIVHSATGWKQMSFALIRPVASD

SEQ ID NO: 8362 - protein, 25 aa, synthetic construct
  source 1..25: note = Seed: LNVIVHSATGFKQSSKALQRPVASD
LNVIVHSATGWKQMSFALVRPVASD

SEQ ID NO: 8363 - protein, 25 aa, synthetic construct
  source 1..25: note = Seed: LNVIVHSATGFKQSSKALQRPVASD
LNVIVHSATGWKQMSGALARPVASD

SEQ ID NO: 8364 - protein, 25 aa, synthetic construct
  source 1..25: note = Seed: LNVIVHSATGFKQSSKALQRPVASD
LNVIVHSATGWKQMSGALCRPVASD

SEQ ID NO: 8365 - protein, 25 aa, synthetic construct
  source 1..25: note = Seed: LNVIVHSATGFKQSSKALQRPVASD
LNVIVHSATGWKQMSGALFRPVASD

SEQ ID NO: 8366 - protein, 25 aa, synthetic construct
  source 1..25: note = Seed: LNVIVHSATGFKQSSKALQRPVASD
LNVIVHSATGWKQMSGALGRPVASD

SEQ ID NO: 8367 - protein, 25 aa, synthetic construct
  source 1..25: note = Seed: LNVIVHSATGFKQSSKALQRPVASD
LNVIVHSATGWKQMSGALHRPVASD

SEQ ID NO: 8368 - protein, 25 aa, synthetic construct
  source 1..25: note = Seed: LNVIVHSATGFKQSSKALQRPVASD
LNVIVHSATGWKQMSGALIRPVASD

SEQ ID NO: 8369 - protein, 25 aa, synthetic construct
  source 1..25: note = Seed: LNVIVHSATGFKQSSKALQRPVASD
LNVIVHSATGWKQMSGALLRPVASD

SEQ ID NO: 8370 - protein, 25 aa, synthetic construct
  source 1..25: note = Seed: LNVIVHSATGFKQSSKALQRPVASD
LNVIVHSATGWKQMSGALMRPVASD

SEQ ID NO: 8371 - protein, 25 aa, synthetic construct
  source 1..25: note = Seed: LNVIVHSATGFKQSSKALQRPVASD
LNVIVHSATGWKQMSGALNRPVASD

SEQ ID NO: 8372 - protein, 25 aa, synthetic construct
  source 1..25: note = Seed: LNVIVHSATGFKQSSKALQRPVASD
LNVIVHSATGWKQMSGALPRPVASD

SEQ ID NO: 8373 - protein, 25 aa, synthetic construct
  source 1..25: note = Seed: LNVIVHSATGFKQSSKALQRPVASD
LNVIVHSATGWKQMSGALQRPVASD

SEQ ID NO: 8374 - protein, 25 aa, synthetic construct
  source 1..25: note = Seed: LNVIVHSATGFKQSSKALQRPVASD
LNVIVHSATGWKQMSGALSRPVASD

SEQ ID NO: 8375 - protein, 25 aa, synthetic construct
  source 1..25: note = Seed: LNVIVHSATGFKQSSKALQRPVASD
LNVIVHSATGWKQMSGALTRPVASD

SEQ ID NO: 8376 - protein, 25 aa, synthetic construct
  source 1..25: note = Seed: LNVIVHSATGFKQSSKALQRPVASD
LNVIVHSATGWKQMSGALVRPVASD

SEQ ID NO: 8377 - protein, 25 aa, synthetic construct
  source 1..25: note = Seed: LNVIVHSATGFKQSSKALQRPVASD
LNVIVHSATGWKQMSHALARPVASD

SEQ ID NO: 8378 - protein, 25 aa, synthetic construct
  source 1..25: note = Seed: LNVIVHSATGFKQSSKALQRPVASD
LNVIVHSATGWKQMSHALGRPVASD

SEQ ID NO: 8379 - protein, 25 aa, synthetic construct
  source 1..25: note = Seed: LNVIVHSATGFKQSSKALQRPVASD
LNVIVHSATGWKQMSHALIRPVASD

SEQ ID NO: 8380 - protein, 25 aa, synthetic construct
  source 1..25: note = Seed: LNVIVHSATGFKQSSKALQRPVASD
LNVIVHSATGWKQMSHALLRPVASD

SEQ ID NO: 8381 - protein, 25 aa, synthetic construct
  source 1..25: note = Seed: LNVIVHSATGFKQSSKALQRPVASD
LNVIVHSATGWKQMSHALSRPVASD

SEQ ID NO: 8382 - protein, 25 aa, synthetic construct
  source 1..25: note = Seed: LNVIVHSATGFKQSSKALQRPVASD
LNVIVHSATGWKQMSHALVRPVASD

SEQ ID NO: 8383 - protein, 25 aa, synthetic construct
  source 1..25: note = Seed: LNVIVHSATGFKQSSKALQRPVASD
LNVIVHSATGWKQMSIALARPVASD

SEQ ID NO: 8384 - protein, 25 aa, synthetic construct
  source 1..25: note = Seed: LNVIVHSATGFKQSSKALQRPVASD
LNVIVHSATGWKQMSIALDRPVASD

SEQ ID NO: 8385 - protein, 25 aa, synthetic construct
  source 1..25: note = Seed: LNVIVHSATGFKQSSKALQRPVASD
LNVIVHSATGWKQMSIALERPVASD

SEQ ID NO: 8386 - protein, 25 aa, synthetic construct
  source 1..25: note = Seed: LNVIVHSATGFKQSSKALQRPVASD
LNVIVHSATGWKQMSIALFRPVASD

SEQ ID NO: 8387 - protein, 25 aa, synthetic construct
  source 1..25: note = Seed: LNVIVHSATGFKQSSKALQRPVASD
LNVIVHSATGWKQMSIALGRPVASD

SEQ ID NO: 8388 - protein, 25 aa, synthetic construct
  source 1..25: note = Seed: LNVIVHSATGFKQSSKALQRPVASD
LNVIVHSATGWKQMSIALHRPVASD

SEQ ID NO: 8389 - protein, 25 aa, synthetic construct
  source 1..25: note = Seed: LNVIVHSATGFKQSSKALQRPVASD
LNVIVHSATGWKQMSIALIRPVASD

SEQ ID NO: 8390 - protein, 25 aa, synthetic construct
  source 1..25: note = Seed: LNVIVHSATGFKQSSKALQRPVASD
LNVIVHSATGWKQMSIALLRPVASD

SEQ ID NO: 8391 - protein, 25 aa, synthetic construct
  source 1..25: note = Seed: LNVIVHSATGFKQSSKALQRPVASD
LNVIVHSATGWKQMSIALMRPVASD

SEQ ID NO: 8392 - protein, 25 aa, synthetic construct
  source 1..25: note = Seed: LNVIVHSATGFKQSSKALQRPVASD
LNVIVHSATGWKQMSIALNRPVASD

SEQ ID NO: 8393 - protein, 25 aa, synthetic construct
  source 1..25: note = Seed: LNVIVHSATGFKQSSKALQRPVASD
LNVIVHSATGWKQMSIALPRPVASD

SEQ ID NO: 8394 - protein, 25 aa, synthetic construct
  source 1..25: note = Seed: LNVIVHSATGFKQSSKALQRPVASD
LNVIVHSATGWKQMSIALQRPVASD

SEQ ID NO: 8395 - protein, 25 aa, synthetic construct
  source 1..25: note = Seed: LNVIVHSATGFKQSSKALQRPVASD
LNVIVHSATGWKQMSIALSRPVASD

SEQ ID NO: 8396 - protein, 25 aa, synthetic construct
  source 1..25: note = Seed: LNVIVHSATGFKQSSKALQRPVASD
LNVIVHSATGWKQMSIALTRPVASD

SEQ ID NO: 8397 - protein, 25 aa, synthetic construct
  source 1..25: note = Seed: LNVIVHSATGFKQSSKALQRPVASD
LNVIVHSATGWKQMSIALVRPVASD

SEQ ID NO: 8398 - protein, 25 aa, synthetic construct
  source 1..25: note = Seed: LNVIVHSATGFKQSSKALQRPVASD
LNVIVHSATGWKQMSKALARPVASD

SEQ ID NO: 8399 - protein, 25 aa, synthetic construct
  source 1..25: note = Seed: LNVIVHSATGFKQSSKALQRPVASD
LNVIVHSATGWKQMSKALGRPVASD

SEQ ID NO: 8400 - protein, 25 aa, synthetic construct
  source 1..25: note = Seed: LNVIVHSATGFKQSSKALQRPVASD
LNVIVHSATGWKQMSKALHRPVASD

SEQ ID NO: 8401 - protein, 25 aa, synthetic construct
  source 1..25: note = Seed: LNVIVHSATGFKQSSKALQRPVASD
LNVIVHSATGWKQMSKALKRPVASD

SEQ ID NO: 8402 - protein, 25 aa, synthetic construct
  source 1..25: note = Seed: LNVIVHSATGFKQSSKALQRPVASD
LNVIVHSATGWKQMSKALMRPVASD

SEQ ID NO: 8403 - protein, 25 aa, synthetic construct
  source 1..25: note = Seed: LNVIVHSATGFKQSSKALQRPVASD
LNVIVHSATGWKQMSKALNRPVASD

SEQ ID NO: 8404 - protein, 25 aa, synthetic construct
  source 1..25: note = Seed: LNVIVHSATGFKQSSKALQRPVASD
LNVIVHSATGWKQMSKALPRPVASD

SEQ ID NO: 8405 - protein, 25 aa, synthetic construct
  source 1..25: note = Seed: LNVIVHSATGFKQSSKALQRPVASD
LNVIVHSATGWKQMSKALQRPVASD

SEQ ID NO: 8406 - protein, 25 aa, synthetic construct
  source 1..25: note = Seed: LNVIVHSATGFKQSSKALQRPVASD
LNVIVHSATGWKQMSKALRRPVASD

SEQ ID NO: 8407 - protein, 25 aa, synthetic construct
  source 1..25: note = Seed: LNVIVHSATGFKQSSKALQRPVASD
LNVIVHSATGWKQMSKALSRPVASD

SEQ ID NO: 8408 - protein, 25 aa, synthetic construct
  source 1..25: note = Seed: LNVIVHSATGFKQSSKALQRPVASD
LNVIVHSATGWKQMSKALTRPVASD

SEQ ID NO: 8409 - protein, 25 aa, synthetic construct
  source 1..25: note = Seed: LNVIVHSATGFKQSSKALQRPVASD
LNVIVHSATGWKQMSKALVRPVASD

SEQ ID NO: 8410 - protein, 25 aa, synthetic construct
  source 1..25: note = Seed: LNVIVHSATGFKQSSKALQRPVASD
LNVIVHSATGWKQMSLALARPVASD

SEQ ID NO: 8411 - protein, 25 aa, synthetic construct
  source 1..25: note = Seed: LNVIVHSATGFKQSSKALQRPVASD
LNVIVHSATGWKQMSLALGRPVASD

SEQ ID NO: 8412 - protein, 25 aa, synthetic construct
  source 1..25: note = Seed: LNVIVHSATGFKQSSKALQRPVASD
LNVIVHSATGWKQMSLALHRPVASD

SEQ ID NO: 8413 - protein, 25 aa, synthetic construct
  source 1..25: note = Seed: LNVIVHSATGFKQSSKALQRPVASD
LNVIVHSATGWKQMSLALIRPVASD

SEQ ID NO: 8414 - protein, 25 aa, synthetic construct
  source 1..25: note = Seed: LNVIVHSATGFKQSSKALQRPVASD
LNVIVHSATGWKQMSLALLRPVASD

SEQ ID NO: 8415 - protein, 25 aa, synthetic construct
  source 1..25: note = Seed: LNVIVHSATGFKQSSKALQRPVASD
LNVIVHSATGWKQMSLALMRPVASD

SEQ ID NO: 8416 - protein, 25 aa, synthetic construct
  source 1..25: note = Seed: LNVIVHSATGFKQSSKALQRPVASD
LNVIVHSATGWKQMSLALNRPVASD

SEQ ID NO: 8417 - protein, 25 aa, synthetic construct
  source 1..25: note = Seed: LNVIVHSATGFKQSSKALQRPVASD
LNVIVHSATGWKQMSLALPRPVASD

SEQ ID NO: 8418 - protein, 25 aa, synthetic construct
  source 1..25: note = Seed: LNVIVHSATGFKQSSKALQRPVASD
LNVIVHSATGWKQMSLALQRPVASD

SEQ ID NO: 8419 - protein, 25 aa, synthetic construct
  source 1..25: note = Seed: LNVIVHSATGFKQSSKALQRPVASD
LNVIVHSATGWKQMSLALSRPVASD

SEQ ID NO: 8420 - protein, 25 aa, synthetic construct
  source 1..25: note = Seed: LNVIVHSATGFKQSSKALQRPVASD
LNVIVHSATGWKQMSLALTRPVASD

SEQ ID NO: 8421 - protein, 25 aa, synthetic construct
  source 1..25: note = Seed: LNVIVHSATGFKQSSKALQRPVASD
LNVIVHSATGWKQMSLALVRPVASD

SEQ ID NO: 8422 - protein, 25 aa, synthetic construct
  source 1..25: note = Seed: LNVIVHSATGFKQSSKALQRPVASD
LNVIVHSATGWKQMSMALARPVASD

SEQ ID NO: 8423 - protein, 25 aa, synthetic construct
  source 1..25: note = Seed: LNVIVHSATGFKQSSKALQRPVASD
LNVIVHSATGWKQMSMALGRPVASD

SEQ ID NO: 8424 - protein, 25 aa, synthetic construct
  source 1..25: note = Seed: LNVIVHSATGFKQSSKALQRPVASD
LNVIVHSATGWKQMSMALHRPVASD

SEQ ID NO: 8425 - protein, 25 aa, synthetic construct
  source 1..25: note = Seed: LNVIVHSATGFKQSSKALQRPVASD
LNVIVHSATGWKQMSMALIRPVASD

SEQ ID NO: 8426 - protein, 25 aa, synthetic construct
  source 1..25: note = Seed: LNVIVHSATGFKQSSKALQRPVASD
LNVIVHSATGWKQMSMALLRPVASD

SEQ ID NO: 8427 - protein, 25 aa, synthetic construct
  source 1..25: note = Seed: LNVIVHSATGFKQSSKALQRPVASD
LNVIVHSATGWKQMSMALMRPVASD

SEQ ID NO: 8428 - protein, 25 aa, synthetic construct
  source 1..25: note = Seed: LNVIVHSATGFKQSSKALQRPVASD
LNVIVHSATGWKQMSMALNRPVASD

SEQ ID NO: 8429 - protein, 25 aa, synthetic construct
  source 1..25: note = Seed: LNVIVHSATGFKQSSKALQRPVASD
LNVIVHSATGWKQMSMALSRPVASD

SEQ ID NO: 8430 - protein, 25 aa, synthetic construct
  source 1..25: note = Seed: LNVIVHSATGFKQSSKALQRPVASD
LNVIVHSATGWKQMSMALTRPVASD

SEQ ID NO: 8431 - protein, 25 aa, synthetic construct
  source 1..25: note = Seed: LNVIVHSATGFKQSSKALQRPVASD
LNVIVHSATGWKQMSMALVRPVASD

SEQ ID NO: 8432 - protein, 25 aa, synthetic construct
  source 1..25: note = Seed: LNVIVHSATGFKQSSKALQRPVASD
LNVIVHSATGWKQMSNALARPVASD

SEQ ID NO: 8433 - protein, 25 aa, synthetic construct
  source 1..25: note = Seed: LNVIVHSATGFKQSSKALQRPVASD
LNVIVHSATGWKQMSNALGRPVASD

SEQ ID NO: 8434 - protein, 25 aa, synthetic construct
  source 1..25: note = Seed: LNVIVHSATGFKQSSKALQRPVASD
LNVIVHSATGWKQMSNALIRPVASD

SEQ ID NO: 8435 - protein, 25 aa, synthetic construct
  source 1..25: note = Seed: LNVIVHSATGFKQSSKALQRPVASD
LNVIVHSATGWKQMSNALLRPVASD

SEQ ID NO: 8436 - protein, 25 aa, synthetic construct
  source 1..25: note = Seed: LNVIVHSATGFKQSSKALQRPVASD
LNVIVHSATGWKQMSNALMRPVASD

SEQ ID NO: 8437 - protein, 25 aa, synthetic construct
  source 1..25: note = Seed: LNVIVHSATGFKQSSKALQRPVASD
LNVIVHSATGWKQMSNALNRPVASD

SEQ ID NO: 8438 - protein, 25 aa, synthetic construct
  source 1..25: note = Seed: LNVIVHSATGFKQSSKALQRPVASD
LNVIVHSATGWKQMSNALSRPVASD

SEQ ID NO: 8439 - protein, 25 aa, synthetic construct
  source 1..25: note = Seed: LNVIVHSATGFKQSSKALQRPVASD
LNVIVHSATGWKQMSNALTRPVASD

SEQ ID NO: 8440 - protein, 25 aa, synthetic construct
  source 1..25: note = Seed: LNVIVHSATGFKQSSKALQRPVASD
LNVIVHSATGWKQMSNALVRPVASD

SEQ ID NO: 8441 - protein, 25 aa, synthetic construct
  source 1..25: note = Seed: LNVIVHSATGFKQSSKALQRPVASD
LNVIVHSATGWKQMSPALARPVASD

SEQ ID NO: 8442 - protein, 25 aa, synthetic construct
  source 1..25: note = Seed: LNVIVHSATGFKQSSKALQRPVASD
LNVIVHSATGWKQMSPALCRPVASD

SEQ ID NO: 8443 - protein, 25 aa, synthetic construct
  source 1..25: note = Seed: LNVIVHSATGFKQSSKALQRPVASD
LNVIVHSATGWKQMSPALDRPVASD

SEQ ID NO: 8444 - protein, 25 aa, synthetic construct
  source 1..25: note = Seed: LNVIVHSATGFKQSSKALQRPVASD
LNVIVHSATGWKQMSPALERPVASD

SEQ ID NO: 8445 - protein, 25 aa, synthetic construct
  source 1..25: note = Seed: LNVIVHSATGFKQSSKALQRPVASD
LNVIVHSATGWKQMSPALFRPVASD

SEQ ID NO: 8446 - protein, 25 aa, synthetic construct
  source 1..25: note = Seed: LNVIVHSATGFKQSSKALQRPVASD
LNVIVHSATGWKQMSPALGRPVASD

SEQ ID NO: 8447 - protein, 25 aa, synthetic construct
  source 1..25: note = Seed: LNVIVHSATGFKQSSKALQRPVASD
LNVIVHSATGWKQMSPALHRPVASD

SEQ ID NO: 8448 - protein, 25 aa, synthetic construct
  source 1..25: note = Seed: LNVIVHSATGFKQSSKALQRPVASD
LNVIVHSATGWKQMSPALIRPVASD

SEQ ID NO: 8449 - protein, 25 aa, synthetic construct
  source 1..25: note = Seed: LNVIVHSATGFKQSSKALQRPVASD
LNVIVHSATGWKQMSPALLRPVASD

SEQ ID NO: 8450 - protein, 25 aa, synthetic construct
  source 1..25: note = Seed: LNVIVHSATGFKQSSKALQRPVASD
LNVIVHSATGWKQMSPALMRPVASD

SEQ ID NO: 8451 - protein, 25 aa, synthetic construct
  source 1..25: note = Seed: LNVIVHSATGFKQSSKALQRPVASD
LNVIVHSATGWKQMSPALNRPVASD

SEQ ID NO: 8452 - protein, 25 aa, synthetic construct
  source 1..25: note = Seed: LNVIVHSATGFKQSSKALQRPVASD
LNVIVHSATGWKQMSPALPRPVASD

SEQ ID NO: 8453 - protein, 25 aa, synthetic construct
  source 1..25: note = Seed: LNVIVHSATGFKQSSKALQRPVASD
LNVIVHSATGWKQMSPALQRPVASD

SEQ ID NO: 8454 - protein, 25 aa, synthetic construct
  source 1..25: note = Seed: LNVIVHSATGFKQSSKALQRPVASD
LNVIVHSATGWKQMSPALSRPVASD

SEQ ID NO: 8455 - protein, 25 aa, synthetic construct
  source 1..25: note = Seed: LNVIVHSATGFKQSSKALQRPVASD
LNVIVHSATGWKQMSPALTRPVASD

SEQ ID NO: 8456 - protein, 25 aa, synthetic construct
  source 1..25: note = Seed: LNVIVHSATGFKQSSKALQRPVASD
LNVIVHSATGWKQMSPALVRPVASD

SEQ ID NO: 8457 - protein, 25 aa, synthetic construct
  source 1..25: note = Seed: LNVIVHSATGFKQSSKALQRPVASD
LNVIVHSATGWKQMSQALARPVASD

SEQ ID NO: 8458 - protein, 25 aa, synthetic construct
  source 1..25: note = Seed: LNVIVHSATGFKQSSKALQRPVASD
LNVIVHSATGWKQMSRALARPVASD

SEQ ID NO: 8459 - protein, 25 aa, synthetic construct
  source 1..25: note = Seed: LNVIVHSATGFKQSSKALQRPVASD
LNVIVHSATGWKQMSRALGRPVASD

SEQ ID NO: 8460 - protein, 25 aa, synthetic construct
  source 1..25: note = Seed: LNVIVHSATGFKQSSKALQRPVASD
LNVIVHSATGWKQMSRALHRPVASD

SEQ ID NO: 8461 - protein, 25 aa, synthetic construct
  source 1..25: note = Seed: LNVIVHSATGFKQSSKALQRPVASD
LNVIVHSATGWKQMSRALIRPVASD

SEQ ID NO: 8462 - protein, 25 aa, synthetic construct
  source 1..25: note = Seed: LNVIVHSATGFKQSSKALQRPVASD
LNVIVHSATGWKQMSRALKRPVASD

SEQ ID NO: 8463 - protein, 25 aa, synthetic construct
  source 1..25: note = Seed: LNVIVHSATGFKQSSKALQRPVASD
LNVIVHSATGWKQMSRALLRPVASD

SEQ ID NO: 8464 - protein, 25 aa, synthetic construct
  source 1..25: note = Seed: LNVIVHSATGFKQSSKALQRPVASD
LNVIVHSATGWKQMSRALMRPVASD

SEQ ID NO: 8465 - protein, 25 aa, synthetic construct
  source 1..25: note = Seed: LNVIVHSATGFKQSSKALQRPVASD
LNVIVHSATGWKQMSRALNRPVASD

SEQ ID NO: 8466 - protein, 25 aa, synthetic construct
  source 1..25: note = Seed: LNVIVHSATGFKQSSKALQRPVASD
LNVIVHSATGWKQMSRALPRPVASD

SEQ ID NO: 8467 - protein, 25 aa, synthetic construct
  source 1..25: note = Seed: LNVIVHSATGFKQSSKALQRPVASD
LNVIVHSATGWKQMSRALQRPVASD

SEQ ID NO: 8468 - protein, 25 aa, synthetic construct
  source 1..25: note = Seed: LNVIVHSATGFKQSSKALQRPVASD
LNVIVHSATGWKQMSRALRRPVASD

SEQ ID NO: 8469 - protein, 25 aa, synthetic construct
  source 1..25: note = Seed: LNVIVHSATGFKQSSKALQRPVASD
LNVIVHSATGWKQMSRALSRPVASD

SEQ ID NO: 8470 - protein, 25 aa, synthetic construct
  source 1..25: note = Seed: LNVIVHSATGFKQSSKALQRPVASD
LNVIVHSATGWKQMSRALTRPVASD

SEQ ID NO: 8471 - protein, 25 aa, synthetic construct
  source 1..25: note = Seed: LNVIVHSATGFKQSSKALQRPVASD
LNVIVHSATGWKQMSRALVRPVASD

SEQ ID NO: 8472 - protein, 25 aa, synthetic construct
  source 1..25: note = Seed: LNVIVHSATGFKQSSKALQRPVASD
LNVIVHSATGWKQMSSALARPVASD

SEQ ID NO: 8473 - protein, 25 aa, synthetic construct
  source 1..25: note = Seed: LNVIVHSATGFKQSSKALQRPVASD
LNVIVHSATGWKQMSSALCRPVASD

SEQ ID NO: 8474 - protein, 25 aa, synthetic construct
  source 1..25: note = Seed: LNVIVHSATGFKQSSKALQRPVASD
LNVIVHSATGWKQMSSALDRPVASD

SEQ ID NO: 8475 - protein, 25 aa, synthetic construct
  source 1..25: note = Seed: LNVIVHSATGFKQSSKALQRPVASD
LNVIVHSATGWKQMSSALERPVASD

SEQ ID NO: 8476 - protein, 25 aa, synthetic construct
  source 1..25: note = Seed: LNVIVHSATGFKQSSKALQRPVASD
LNVIVHSATGWKQMSSALFRPVASD

SEQ ID NO: 8477 - protein, 25 aa, synthetic construct
  source 1..25: note = Seed: LNVIVHSATGFKQSSKALQRPVASD
LNVIVHSATGWKQMSSALGRPVASD

SEQ ID NO: 8478 - protein, 25 aa, synthetic construct
  source 1..25: note = Seed: LNVIVHSATGFKQSSKALQRPVASD
LNVIVHSATGWKQMSSALHRPVASD

SEQ ID NO: 8479 - protein, 25 aa, synthetic construct
  source 1..25: note = Seed: LNVIVHSATGFKQSSKALQRPVASD
LNVIVHSATGWKQMSSALIRPVASD

SEQ ID NO: 8480 - protein, 25 aa, synthetic construct
  source 1..25: note = Seed: LNVIVHSATGFKQSSKALQRPVASD
LNVIVHSATGWKQMSSALLRPVASD

SEQ ID NO: 8481 - protein, 25 aa, synthetic construct
  source 1..25: note = Seed: LNVIVHSATGFKQSSKALQRPVASD
LNVIVHSATGWKQMSSALMRPVASD

SEQ ID NO: 8482 - protein, 25 aa, synthetic construct
  source 1..25: note = Seed: LNVIVHSATGFKQSSKALQRPVASD
LNVIVHSATGWKQMSSALNRPVASD

SEQ ID NO: 8483 - protein, 25 aa, synthetic construct
  source 1..25: note = Seed: LNVIVHSATGFKQSSKALQRPVASD
LNVIVHSATGWKQMSSALPRPVASD

SEQ ID NO: 8484 - protein, 25 aa, synthetic construct
  source 1..25: note = Seed: LNVIVHSATGFKQSSKALQRPVASD
LNVIVHSATGWKQMSSALQRPVASD

SEQ ID NO: 8485 - protein, 25 aa, synthetic construct
  source 1..25: note = Seed: LNVIVHSATGFKQSSKALQRPVASD
LNVIVHSATGWKQMSSALSRPVASD

SEQ ID NO: 8486 - protein, 25 aa, synthetic construct
  source 1..25: note = Seed: LNVIVHSATGFKQSSKALQRPVASD
LNVIVHSATGWKQMSSALTRPVASD

SEQ ID NO: 8487 - protein, 25 aa, synthetic construct
  source 1..25: note = Seed: LNVIVHSATGFKQSSKALQRPVASD
LNVIVHSATGWKQMSSALVRPVASD

SEQ ID NO: 8488 - protein, 25 aa, synthetic construct
  source 1..25: note = Seed: LNVIVHSATGFKQSSKALQRPVASD
LNVIVHSATGWKQMSTALARPVASD

SEQ ID NO: 8489 - protein, 25 aa, synthetic construct
  source 1..25: note = Seed: LNVIVHSATGFKQSSKALQRPVASD
LNVIVHSATGWKQMSTALDRPVASD

SEQ ID NO: 8490 - protein, 25 aa, synthetic construct
  source 1..25: note = Seed: LNVIVHSATGFKQSSKALQRPVASD
LNVIVHSATGWKQMSTALERPVASD

SEQ ID NO: 8491 - protein, 25 aa, synthetic construct
  source 1..25: note = Seed: LNVIVHSATGFKQSSKALQRPVASD
LNVIVHSATGWKQMSTALGRPVASD

SEQ ID NO: 8492 - protein, 25 aa, synthetic construct
  source 1..25: note = Seed: LNVIVHSATGFKQSSKALQRPVASD
LNVIVHSATGWKQMSTALHRPVASD

SEQ ID NO: 8493 - protein, 25 aa, synthetic construct
  source 1..25: note = Seed: LNVIVHSATGFKQSSKALQRPVASD
LNVIVHSATGWKQMSTALIRPVASD

SEQ ID NO: 8494 - protein, 25 aa, synthetic construct
  source 1..25: note = Seed: LNVIVHSATGFKQSSKALQRPVASD
LNVIVHSATGWKQMSTALLRPVASD

SEQ ID NO: 8495 - protein, 25 aa, synthetic construct
  source 1..25: note = Seed: LNVIVHSATGFKQSSKALQRPVASD
LNVIVHSATGWKQMSTALMRPVASD

SEQ ID NO: 8496 - protein, 25 aa, synthetic construct
  source 1..25: note = Seed: LNVIVHSATGFKQSSKALQRPVASD
LNVIVHSATGWKQMSTALNRPVASD

SEQ ID NO: 8497 - protein, 25 aa, synthetic construct
  source 1..25: note = Seed: LNVIVHSATGFKQSSKALQRPVASD
LNVIVHSATGWKQMSTALPRPVASD

SEQ ID NO: 8498 - protein, 25 aa, synthetic construct
  source 1..25: note = Seed: LNVIVHSATGFKQSSKALQRPVASD
LNVIVHSATGWKQMSTALQRPVASD

SEQ ID NO: 8499 - protein, 25 aa, synthetic construct
  source 1..25: note = Seed: LNVIVHSATGFKQSSKALQRPVASD
LNVIVHSATGWKQMSTALSRPVASD

SEQ ID NO: 8500 - protein, 25 aa, synthetic construct
  source 1..25: note = Seed: LNVIVHSATGFKQSSKALQRPVASD
LNVIVHSATGWKQMSTALTRPVASD

SEQ ID NO: 8501 - protein, 25 aa, synthetic construct
  source 1..25: note = Seed: LNVIVHSATGFKQSSKALQRPVASD
LNVIVHSATGWKQMSTALVRPVASD

SEQ ID NO: 8502 - protein, 25 aa, synthetic construct
  source 1..25: note = Seed: LNVIVHSATGFKQSSKALQRPVASD
LNVIVHSATGWKQMSVALARPVASD

SEQ ID NO: 8503 - protein, 25 aa, synthetic construct
  source 1..25: note = Seed: LNVIVHSATGFKQSSKALQRPVASD
LNVIVHSATGWKQMSVALDRPVASD

SEQ ID NO: 8504 - protein, 25 aa, synthetic construct
  source 1..25: note = Seed: LNVIVHSATGFKQSSKALQRPVASD
LNVIVHSATGWKQMSVALERPVASD

SEQ ID NO: 8505 - protein, 25 aa, synthetic construct
  source 1..25: note = Seed: LNVIVHSATGFKQSSKALQRPVASD
LNVIVHSATGWKQMSVALGRPVASD

SEQ ID NO: 8506 - protein, 25 aa, synthetic construct
  source 1..25: note = Seed: LNVIVHSATGFKQSSKALQRPVASD
LNVIVHSATGWKQMSVALHRPVASD

SEQ ID NO: 8507 - protein, 25 aa, synthetic construct
  source 1..25: note = Seed: LNVIVHSATGFKQSSKALQRPVASD
LNVIVHSATGWKQMSVALIRPVASD

SEQ ID NO: 8508 - protein, 25 aa, synthetic construct
  source 1..25: note = Seed: LNVIVHSATGFKQSSKALQRPVASD
LNVIVHSATGWKQMSVALLRPVASD

SEQ ID NO: 8509 - protein, 25 aa, synthetic construct
  source 1..25: note = Seed: LNVIVHSATGFKQSSKALQRPVASD
LNVIVHSATGWKQMSVALMRPVASD

SEQ ID NO: 8510 - protein, 25 aa, synthetic construct
  source 1..25: note = Seed: LNVIVHSATGFKQSSKALQRPVASD
LNVIVHSATGWKQMSVALNRPVASD

SEQ ID NO: 8511 - protein, 25 aa, synthetic construct
  source 1..25: note = Seed: LNVIVHSATGFKQSSKALQRPVASD
LNVIVHSATGWKQMSVALPRPVASD

SEQ ID NO: 8512 - protein, 25 aa, synthetic construct
  source 1..25: note = Seed: LNVIVHSATGFKQSSKALQRPVASD
LNVIVHSATGWKQMSVALQRPVASD

SEQ ID NO: 8513 - protein, 25 aa, synthetic construct
  source 1..25: note = Seed: LNVIVHSATGFKQSSKALQRPVASD
LNVIVHSATGWKQMSVALSRPVASD

SEQ ID NO: 8514 - protein, 25 aa, synthetic construct
  source 1..25: note = Seed: LNVIVHSATGFKQSSKALQRPVASD
LNVIVHSATGWKQMSVALTRPVASD

SEQ ID NO: 8515 - protein, 25 aa, synthetic construct
  source 1..25: note = Seed: LNVIVHSATGFKQSSKALQRPVASD
LNVIVHSATGWKQMSVALVRPVASD

SEQ ID NO: 8516 - protein, 25 aa, synthetic construct
  source 1..25: note = Seed: LNVIVHSATGFKQSSKALQRPVASD
LNVIVHSATGWKQMSWALIRPVASD

SEQ ID NO: 8517 - protein, 25 aa, synthetic construct
  source 1..25: note = Seed: LNVIVHSATGFKQSSKALQRPVASD
LNVIVHSATGWKQMSWALVRPVASD

SEQ ID NO: 8518 - protein, 25 aa, synthetic construct
  source 1..25: note = Seed: LNVIVHSATGFKQSSKALQRPVASD
LNVIVHSATGWKQMSYALGRPVASD

SEQ ID NO: 8519 - protein, 25 aa, synthetic construct
  source 1..25: note = Seed: LNVIVHSATGFKQSSKALQRPVASD
LNVIVHSATGWKQMSYALVRPVASD

SEQ ID NO: 8520 - protein, 25 aa, synthetic construct
  source 1..25: note = Seed: LNVIVHSATGFKQSSKALQRPVASD
LNVIVHSATGWKQNSAALARPVASD

SEQ ID NO: 8521 - protein, 25 aa, synthetic construct
  source 1..25: note = Seed: LNVIVHSATGFKQSSKALQRPVASD
LNVIVHSATGWKQNSAALFRPVASD

SEQ ID NO: 8522 - protein, 25 aa, synthetic construct
  source 1..25: note = Seed: LNVIVHSATGFKQSSKALQRPVASD
LNVIVHSATGWKQNSAALIRPVASD

SEQ ID NO: 8523 - protein, 25 aa, synthetic construct
  source 1..25: note = Seed: LNVIVHSATGFKQSSKALQRPVASD
LNVIVHSATGWKQNSAALLRPVASD

SEQ ID NO: 8524 - protein, 25 aa, synthetic construct
  source 1..25: note = Seed: LNVIVHSATGFKQSSKALQRPVASD
LNVIVHSATGWKQNSAALMRPVASD

SEQ ID NO: 8525 - protein, 25 aa, synthetic construct
  source 1..25: note = Seed: LNVIVHSATGFKQSSKALQRPVASD
LNVIVHSATGWKQNSAALVRPVASD

SEQ ID NO: 8526 - protein, 25 aa, synthetic construct
  source 1..25: note = Seed: LNVIVHSATGFKQSSKALQRPVASD
LNVIVHSATGWKQNSAALYRPVASD

SEQ ID NO: 8527 - protein, 25 aa, synthetic construct
  source 1..25: note = Seed: LNVIVHSATGFKQSSKALQRPVASD
LNVIVHSATGWKQNSGALIRPVASD

SEQ ID NO: 8528 - protein, 25 aa, synthetic construct
  source 1..25: note = Seed: LNVIVHSATGFKQSSKALQRPVASD
LNVIVHSATGWKQNSIALARPVASD

SEQ ID NO: 8529 - protein, 25 aa, synthetic construct
  source 1..25: note = Seed: LNVIVHSATGFKQSSKALQRPVASD
LNVIVHSATGWKQNSIALIRPVASD

SEQ ID NO: 8530 - protein, 25 aa, synthetic construct
  source 1..25: note = Seed: LNVIVHSATGFKQSSKALQRPVASD
LNVIVHSATGWKQNSIALVRPVASD

SEQ ID NO: 8531 - protein, 25 aa, synthetic construct
  source 1..25: note = Seed: LNVIVHSATGFKQSSKALQRPVASD
LNVIVHSATGWKQNSIALYRPVASD

SEQ ID NO: 8532 - protein, 25 aa, synthetic construct
  source 1..25: note = Seed: LNVIVHSATGFKQSSKALQRPVASD
LNVIVHSATGWKQNSLALARPVASD

SEQ ID NO: 8533 - protein, 25 aa, synthetic construct
  source 1..25: note = Seed: LNVIVHSATGFKQSSKALQRPVASD
LNVIVHSATGWKQNSNALFRPVASD

SEQ ID NO: 8534 - protein, 25 aa, synthetic construct
  source 1..25: note = Seed: LNVIVHSATGFKQSSKALQRPVASD
LNVIVHSATGWKQNSNALIRPVASD

SEQ ID NO: 8535 - protein, 25 aa, synthetic construct
  source 1..25: note = Seed: LNVIVHSATGFKQSSKALQRPVASD
LNVIVHSATGWKQNSNALLRPVASD

SEQ ID NO: 8536 - protein, 25 aa, synthetic construct
  source 1..25: note = Seed: LNVIVHSATGFKQSSKALQRPVASD
LNVIVHSATGWKQNSNALVRPVASD

SEQ ID NO: 8537 - protein, 25 aa, synthetic construct
  source 1..25: note = Seed: LNVIVHSATGFKQSSKALQRPVASD
LNVIVHSATGWKQNSNALYRPVASD

SEQ ID NO: 8538 - protein, 25 aa, synthetic construct
  source 1..25: note = Seed: LNVIVHSATGFKQSSKALQRPVASD
LNVIVHSATGWKQNSPALIRPVASD

SEQ ID NO: 8539 - protein, 25 aa, synthetic construct
  source 1..25: note = Seed: LNVIVHSATGFKQSSKALQRPVASD
LNVIVHSATGWKQNSPALVRPVASD

SEQ ID NO: 8540 - protein, 25 aa, synthetic construct
  source 1..25: note = Seed: LNVIVHSATGFKQSSKALQRPVASD
LNVIVHSATGWKQNSSALFRPVASD

SEQ ID NO: 8541 - protein, 25 aa, synthetic construct
  source 1..25: note = Seed: LNVIVHSATGFKQSSKALQRPVASD
LNVIVHSATGWKQNSSALIRPVASD

SEQ ID NO: 8542 - protein, 25 aa, synthetic construct
  source 1..25: note = Seed: LNVIVHSATGFKQSSKALQRPVASD
LNVIVHSATGWKQNSSALLRPVASD

SEQ ID NO: 8543 - protein, 25 aa, synthetic construct
  source 1..25: note = Seed: LNVIVHSATGFKQSSKALQRPVASD
LNVIVHSATGWKQNSSALVRPVASD

SEQ ID NO: 8544 - protein, 25 aa, synthetic construct
  source 1..25: note = Seed: LNVIVHSATGFKQSSKALQRPVASD
LNVIVHSATGWKQNSSALYRPVASD

SEQ ID NO: 8545 - protein, 25 aa, synthetic construct
  source 1..25: note = Seed: LNVIVHSATGFKQSSKALQRPVASD
LNVIVHSATGWKQNSTALIRPVASD

SEQ ID NO: 8546 - protein, 25 aa, synthetic construct
  source 1..25: note = Seed: LNVIVHSATGFKQSSKALQRPVASD
LNVIVHSATGWKQNSTALVRPVASD

SEQ ID NO: 8547 - protein, 25 aa, synthetic construct
  source 1..25: note = Seed: LNVIVHSATGFKQSSKALQRPVASD
LNVIVHSATGWKQNSVALIRPVASD

SEQ ID NO: 8548 - protein, 25 aa, synthetic construct
  source 1..25: note = Seed: LNVIVHSATGFKQSSKALQRPVASD
LNVIVHSATGWKQNSVALVRPVASD

SEQ ID NO: 8549 - protein, 25 aa, synthetic construct
  source 1..25: note = Seed: LNVIVHSATGFKQSSKALQRPVASD
LNVIVHSATGWKQNSVALYRPVASD

SEQ ID NO: 8550 - protein, 25 aa, synthetic construct
  source 1..25: note = Seed: LNVIVHSATGFKQSSKALQRPVASD
LNVIVHSATGWKQQSAALARPVASD

SEQ ID NO: 8551 - protein, 25 aa, synthetic construct
  source 1..25: note = Seed: LNVIVHSATGFKQSSKALQRPVASD
LNVIVHSATGWKQQSAALGRPVASD

SEQ ID NO: 8552 - protein, 25 aa, synthetic construct
  source 1..25: note = Seed: LNVIVHSATGFKQSSKALQRPVASD
LNVIVHSATGWKQQSAALIRPVASD

SEQ ID NO: 8553 - protein, 25 aa, synthetic construct
  source 1..25: note = Seed: LNVIVHSATGFKQSSKALQRPVASD
LNVIVHSATGWKQQSAALLRPVASD

SEQ ID NO: 8554 - protein, 25 aa, synthetic construct
  source 1..25: note = Seed: LNVIVHSATGFKQSSKALQRPVASD
LNVIVHSATGWKQQSAALMRPVASD

SEQ ID NO: 8555 - protein, 25 aa, synthetic construct
  source 1..25: note = Seed: LNVIVHSATGFKQSSKALQRPVASD
LNVIVHSATGWKQQSAALNRPVASD

SEQ ID NO: 8556 - protein, 25 aa, synthetic construct
  source 1..25: note = Seed: LNVIVHSATGFKQSSKALQRPVASD
LNVIVHSATGWKQQSAALSRPVASD

SEQ ID NO: 8557 - protein, 25 aa, synthetic construct
  source 1..25: note = Seed: LNVIVHSATGFKQSSKALQRPVASD
LNVIVHSATGWKQQSAALTRPVASD

SEQ ID NO: 8558 - protein, 25 aa, synthetic construct
  source 1..25: note = Seed: LNVIVHSATGFKQSSKALQRPVASD
LNVIVHSATGWKQQSAALVRPVASD

SEQ ID NO: 8559 - protein, 25 aa, synthetic construct
  source 1..25: note = Seed: LNVIVHSATGFKQSSKALQRPVASD
LNVIVHSATGWKQQSGALARPVASD

SEQ ID NO: 8560 - protein, 25 aa, synthetic construct
  source 1..25: note = Seed: LNVIVHSATGFKQSSKALQRPVASD
LNVIVHSATGWKQQSGALIRPVASD

SEQ ID NO: 8561 - protein, 25 aa, synthetic construct
  source 1..25: note = Seed: LNVIVHSATGFKQSSKALQRPVASD
LNVIVHSATGWKQQSGALLRPVASD

SEQ ID NO: 8562 - protein, 25 aa, synthetic construct
  source 1..25: note = Seed: LNVIVHSATGFKQSSKALQRPVASD
LNVIVHSATGWKQQSGALMRPVASD

SEQ ID NO: 8563 - protein, 25 aa, synthetic construct
  source 1..25: note = Seed: LNVIVHSATGFKQSSKALQRPVASD
LNVIVHSATGWKQQSGALSRPVASD

SEQ ID NO: 8564 - protein, 25 aa, synthetic construct
  source 1..25: note = Seed: LNVIVHSATGFKQSSKALQRPVASD
LNVIVHSATGWKQQSGALTRPVASD

SEQ ID NO: 8565 - protein, 25 aa, synthetic construct
  source 1..25: note = Seed: LNVIVHSATGFKQSSKALQRPVASD
LNVIVHSATGWKQQSGALVRPVASD

SEQ ID NO: 8566 - protein, 25 aa, synthetic construct
  source 1..25: note = Seed: LNVIVHSATGFKQSSKALQRPVASD
LNVIVHSATGWKQQSIALARPVASD

SEQ ID NO: 8567 - protein, 25 aa, synthetic construct
  source 1..25: note = Seed: LNVIVHSATGFKQSSKALQRPVASD
LNVIVHSATGWKQQSIALIRPVASD

SEQ ID NO: 8568 - protein, 25 aa, synthetic construct
  source 1..25: note = Seed: LNVIVHSATGFKQSSKALQRPVASD
LNVIVHSATGWKQQSIALLRPVASD

SEQ ID NO: 8569 - protein, 25 aa, synthetic construct
  source 1..25: note = Seed: LNVIVHSATGFKQSSKALQRPVASD
LNVIVHSATGWKQQSIALMRPVASD

SEQ ID NO: 8570 - protein, 25 aa, synthetic construct
  source 1..25: note = Seed: LNVIVHSATGFKQSSKALQRPVASD
LNVIVHSATGWKQQSIALNRPVASD

SEQ ID NO: 8571 - protein, 25 aa, synthetic construct
  source 1..25: note = Seed: LNVIVHSATGFKQSSKALQRPVASD
LNVIVHSATGWKQQSIALQRPVASD

SEQ ID NO: 8572 - protein, 25 aa, synthetic construct
  source 1..25: note = Seed: LNVIVHSATGFKQSSKALQRPVASD
LNVIVHSATGWKQQSIALSRPVASD

SEQ ID NO: 8573 - protein, 25 aa, synthetic construct
  source 1..25: note = Seed: LNVIVHSATGFKQSSKALQRPVASD
LNVIVHSATGWKQQSIALTRPVASD

SEQ ID NO: 8574 - protein, 25 aa, synthetic construct
  source 1..25: note = Seed: LNVIVHSATGFKQSSKALQRPVASD
LNVIVHSATGWKQQSIALVRPVASD

SEQ ID NO: 8575 - protein, 25 aa, synthetic construct
  source 1..25: note = Seed: LNVIVHSATGFKQSSKALQRPVASD
LNVIVHSATGWKQQSLALARPVASD

SEQ ID NO: 8576 - protein, 25 aa, synthetic construct
  source 1..25: note = Seed: LNVIVHSATGFKQSSKALQRPVASD
LNVIVHSATGWKQQSLALIRPVASD

SEQ ID NO: 8577 - protein, 25 aa, synthetic construct
  source 1..25: note = Seed: LNVIVHSATGFKQSSKALQRPVASD
LNVIVHSATGWKQQSLALVRPVASD

SEQ ID NO: 8578 - protein, 25 aa, synthetic construct
  source 1..25: note = Seed: LNVIVHSATGFKQSSKALQRPVASD
LNVIVHSATGWKQQSMALARPVASD

SEQ ID NO: 8579 - protein, 25 aa, synthetic construct
  source 1..25: note = Seed: LNVIVHSATGFKQSSKALQRPVASD
LNVIVHSATGWKQQSMALIRPVASD

SEQ ID NO: 8580 - protein, 25 aa, synthetic construct
  source 1..25: note = Seed: LNVIVHSATGFKQSSKALQRPVASD
LNVIVHSATGWKQQSNALARPVASD

SEQ ID NO: 8581 - protein, 25 aa, synthetic construct
  source 1..25: note = Seed: LNVIVHSATGFKQSSKALQRPVASD
LNVIVHSATGWKQQSNALIRPVASD

SEQ ID NO: 8582 - protein, 25 aa, synthetic construct
  source 1..25: note = Seed: LNVIVHSATGFKQSSKALQRPVASD
LNVIVHSATGWKQQSNALLRPVASD

SEQ ID NO: 8583 - protein, 25 aa, synthetic construct
  source 1..25: note = Seed: LNVIVHSATGFKQSSKALQRPVASD
LNVIVHSATGWKQQSNALVRPVASD

SEQ ID NO: 8584 - protein, 25 aa, synthetic construct
  source 1..25: note = Seed: LNVIVHSATGFKQSSKALQRPVASD
LNVIVHSATGWKQQSPALARPVASD

SEQ ID NO: 8585 - protein, 25 aa, synthetic construct
  source 1..25: note = Seed: LNVIVHSATGFKQSSKALQRPVASD
LNVIVHSATGWKQQSPALIRPVASD

SEQ ID NO: 8586 - protein, 25 aa, synthetic construct
  source 1..25: note = Seed: LNVIVHSATGFKQSSKALQRPVASD
LNVIVHSATGWKQQSPALLRPVASD

SEQ ID NO: 8587 - protein, 25 aa, synthetic construct
  source 1..25: note = Seed: LNVIVHSATGFKQSSKALQRPVASD
LNVIVHSATGWKQQSPALVRPVASD

SEQ ID NO: 8588 - protein, 25 aa, synthetic construct
  source 1..25: note = Seed: LNVIVHSATGFKQSSKALQRPVASD
LNVIVHSATGWKQQSSALARPVASD

SEQ ID NO: 8589 - protein, 25 aa, synthetic construct
  source 1..25: note = Seed: LNVIVHSATGFKQSSKALQRPVASD
LNVIVHSATGWKQQSSALIRPVASD

SEQ ID NO: 8590 - protein, 25 aa, synthetic construct
  source 1..25: note = Seed: LNVIVHSATGFKQSSKALQRPVASD
LNVIVHSATGWKQQSSALLRPVASD

SEQ ID NO: 8591 - protein, 25 aa, synthetic construct
  source 1..25: note = Seed: LNVIVHSATGFKQSSKALQRPVASD
LNVIVHSATGWKQQSSALMRPVASD

SEQ ID NO: 8592 - protein, 25 aa, synthetic construct
  source 1..25: note = Seed: LNVIVHSATGFKQSSKALQRPVASD
LNVIVHSATGWKQQSSALSRPVASD

SEQ ID NO: 8593 - protein, 25 aa, synthetic construct
  source 1..25: note = Seed: LNVIVHSATGFKQSSKALQRPVASD
LNVIVHSATGWKQQSSALTRPVASD

SEQ ID NO: 8594 - protein, 25 aa, synthetic construct
  source 1..25: note = Seed: LNVIVHSATGFKQSSKALQRPVASD
LNVIVHSATGWKQQSSALVRPVASD

SEQ ID NO: 8595 - protein, 25 aa, synthetic construct
  source 1..25: note = Seed: LNVIVHSATGFKQSSKALQRPVASD
LNVIVHSATGWKQQSTALARPVASD

SEQ ID NO: 8596 - protein, 25 aa, synthetic construct
  source 1..25: note = Seed: LNVIVHSATGFKQSSKALQRPVASD
LNVIVHSATGWKQQSTALIRPVASD

SEQ ID NO: 8597 - protein, 25 aa, synthetic construct
  source 1..25: note = Seed: LNVIVHSATGFKQSSKALQRPVASD
LNVIVHSATGWKQQSTALLRPVASD

SEQ ID NO: 8598 - protein, 25 aa, synthetic construct
  source 1..25: note = Seed: LNVIVHSATGFKQSSKALQRPVASD
LNVIVHSATGWKQQSTALNRPVASD

SEQ ID NO: 8599 - protein, 25 aa, synthetic construct
  source 1..25: note = Seed: LNVIVHSATGFKQSSKALQRPVASD
LNVIVHSATGWKQQSTALSRPVASD

SEQ ID NO: 8600 - protein, 25 aa, synthetic construct
  source 1..25: note = Seed: LNVIVHSATGFKQSSKALQRPVASD
LNVIVHSATGWKQQSTALVRPVASD

SEQ ID NO: 8601 - protein, 25 aa, synthetic construct
  source 1..25: note = Seed: LNVIVHSATGFKQSSKALQRPVASD
LNVIVHSATGWKQQSVALARPVASD

SEQ ID NO: 8602 - protein, 25 aa, synthetic construct
  source 1..25: note = Seed: LNVIVHSATGFKQSSKALQRPVASD
LNVIVHSATGWKQQSVALIRPVASD

SEQ ID NO: 8603 - protein, 25 aa, synthetic construct
  source 1..25: note = Seed: LNVIVHSATGFKQSSKALQRPVASD
LNVIVHSATGWKQQSVALLRPVASD

SEQ ID NO: 8604 - protein, 25 aa, synthetic construct
  source 1..25: note = Seed: LNVIVHSATGFKQSSKALQRPVASD
LNVIVHSATGWKQQSVALMRPVASD

SEQ ID NO: 8605 - protein, 25 aa, synthetic construct
  source 1..25: note = Seed: LNVIVHSATGFKQSSKALQRPVASD
LNVIVHSATGWKQQSVALNRPVASD

SEQ ID NO: 8606 - protein, 25 aa, synthetic construct
  source 1..25: note = Seed: LNVIVHSATGFKQSSKALQRPVASD
LNVIVHSATGWKQQSVALSRPVASD

SEQ ID NO: 8607 - protein, 25 aa, synthetic construct
  source 1..25: note = Seed: LNVIVHSATGFKQSSKALQRPVASD
LNVIVHSATGWKQQSVALVRPVASD

SEQ ID NO: 8608 - protein, 25 aa, synthetic construct
  source 1..25: note = Seed: LNVIVHSATGFKQSSKALQRPVASD
LNVIVHSATGWKQSSAALARPVASD

SEQ ID NO: 8609 - protein, 25 aa, synthetic construct
  source 1..25: note = Seed: LNVIVHSATGFKQSSKALQRPVASD
LNVIVHSATGWKQSSAALFRPVASD

SEQ ID NO: 8610 - protein, 25 aa, synthetic construct
  source 1..25: note = Seed: LNVIVHSATGFKQSSKALQRPVASD
LNVIVHSATGWKQSSAALIRPVASD

SEQ ID NO: 8611 - protein, 25 aa, synthetic construct
  source 1..25: note = Seed: LNVIVHSATGFKQSSKALQRPVASD
LNVIVHSATGWKQSSAALLRPVASD

SEQ ID NO: 8612 - protein, 25 aa, synthetic construct
  source 1..25: note = Seed: LNVIVHSATGFKQSSKALQRPVASD
LNVIVHSATGWKQSSAALMRPVASD

SEQ ID NO: 8613 - protein, 25 aa, synthetic construct
  source 1..25: note = Seed: LNVIVHSATGFKQSSKALQRPVASD
LNVIVHSATGWKQSSAALNRPVASD

SEQ ID NO: 8614 - protein, 25 aa, synthetic construct
  source 1..25: note = Seed: LNVIVHSATGFKQSSKALQRPVASD
LNVIVHSATGWKQSSAALSRPVASD

SEQ ID NO: 8615 - protein, 25 aa, synthetic construct
  source 1..25: note = Seed: LNVIVHSATGFKQSSKALQRPVASD
LNVIVHSATGWKQSSAALTRPVASD

SEQ ID NO: 8616 - protein, 25 aa, synthetic construct
  source 1..25: note = Seed: LNVIVHSATGFKQSSKALQRPVASD
LNVIVHSATGWKQSSAALVRPVASD

SEQ ID NO: 8617 - protein, 25 aa, synthetic construct
  source 1..25: note = Seed: LNVIVHSATGFKQSSKALQRPVASD
LNVIVHSATGWKQSSFALIRPVASD

SEQ ID NO: 8618 - protein, 25 aa, synthetic construct
  source 1..25: note = Seed: LNVIVHSATGFKQSSKALQRPVASD
LNVIVHSATGWKQSSFALLRPVASD

SEQ ID NO: 8619 - protein, 25 aa, synthetic construct
  source 1..25: note = Seed: LNVIVHSATGFKQSSKALQRPVASD
LNVIVHSATGWKQSSGALARPVASD

SEQ ID NO: 8620 - protein, 25 aa, synthetic construct
  source 1..25: note = Seed: LNVIVHSATGFKQSSKALQRPVASD
LNVIVHSATGWKQSSGALIRPVASD

SEQ ID NO: 8621 - protein, 25 aa, synthetic construct
  source 1..25: note = Seed: LNVIVHSATGFKQSSKALQRPVASD
LNVIVHSATGWKQSSGALLRPVASD

SEQ ID NO: 8622 - protein, 25 aa, synthetic construct
  source 1..25: note = Seed: LNVIVHSATGFKQSSKALQRPVASD
LNVIVHSATGWKQSSGALVRPVASD

SEQ ID NO: 8623 - protein, 25 aa, synthetic construct
  source 1..25: note = Seed: LNVIVHSATGFKQSSKALQRPVASD
LNVIVHSATGWKQSSIALARPVASD

SEQ ID NO: 8624 - protein, 25 aa, synthetic construct
  source 1..25: note = Seed: LNVIVHSATGFKQSSKALQRPVASD
LNVIVHSATGWKQSSIALSRPVASD

SEQ ID NO: 8625 - protein, 25 aa, synthetic construct
  source 1..25: note = Seed: LNVIVHSATGFKQSSKALQRPVASD
LNVIVHSATGWKQSSIALVRPVASD

SEQ ID NO: 8626 - protein, 25 aa, synthetic construct
  source 1..25: note = Seed: LNVIVHSATGFKQSSKALQRPVASD
LNVIVHSATGWKQSSLALARPVASD

SEQ ID NO: 8627 - protein, 25 aa, synthetic construct
  source 1..25: note = Seed: LNVIVHSATGFKQSSKALQRPVASD
LNVIVHSATGWKQSSNALIRPVASD

SEQ ID NO: 8628 - protein, 25 aa, synthetic construct
  source 1..25: note = Seed: LNVIVHSATGFKQSSKALQRPVASD
LNVIVHSATGWKQSSPALARPVASD

SEQ ID NO: 8629 - protein, 25 aa, synthetic construct
  source 1..25: note = Seed: LNVIVHSATGFKQSSKALQRPVASD
LNVIVHSATGWKQSSPALIRPVASD

SEQ ID NO: 8630 - protein, 25 aa, synthetic construct
  source 1..25: note = Seed: LNVIVHSATGFKQSSKALQRPVASD
LNVIVHSATGWKQSSPALLRPVASD

SEQ ID NO: 8631 - protein, 25 aa, synthetic construct
  source 1..25: note = Seed: LNVIVHSATGFKQSSKALQRPVASD
LNVIVHSATGWKQSSPALVRPVASD

SEQ ID NO: 8632 - protein, 25 aa, synthetic construct
  source 1..25: note = Seed: LNVIVHSATGFKQSSKALQRPVASD
LNVIVHSATGWKQSSSALARPVASD

SEQ ID NO: 8633 - protein, 25 aa, synthetic construct
  source 1..25: note = Seed: LNVIVHSATGFKQSSKALQRPVASD
LNVIVHSATGWKQSSSALFRPVASD

SEQ ID NO: 8634 - protein, 25 aa, synthetic construct
  source 1..25: note = Seed: LNVIVHSATGFKQSSKALQRPVASD
LNVIVHSATGWKQSSSALIRPVASD

SEQ ID NO: 8635 - protein, 25 aa, synthetic construct
  source 1..25: note = Seed: LNVIVHSATGFKQSSKALQRPVASD
LNVIVHSATGWKQSSSALLRPVASD

SEQ ID NO: 8636 - protein, 25 aa, synthetic construct
  source 1..25: note = Seed: LNVIVHSATGFKQSSKALQRPVASD
LNVIVHSATGWKQSSSALMRPVASD

SEQ ID NO: 8637 - protein, 25 aa, synthetic construct
  source 1..25: note = Seed: LNVIVHSATGFKQSSKALQRPVASD
LNVIVHSATGWKQSSSALVRPVASD

SEQ ID NO: 8638 - protein, 25 aa, synthetic construct
  source 1..25: note = Seed: LNVIVHSATGFKQSSKALQRPVASD
LNVIVHSATGWKQSSTALARPVASD

SEQ ID NO: 8639 - protein, 25 aa, synthetic construct
  source 1..25: note = Seed: LNVIVHSATGFKQSSKALQRPVASD
LNVIVHSATGWKQSSTALIRPVASD

SEQ ID NO: 8640 - protein, 25 aa, synthetic construct
  source 1..25: note = Seed: LNVIVHSATGFKQSSKALQRPVASD
LNVIVHSATGWKQSSTALLRPVASD

SEQ ID NO: 8641 - protein, 25 aa, synthetic construct
  source 1..25: note = Seed: LNVIVHSATGFKQSSKALQRPVASD
LNVIVHSATGWKQSSTALVRPVASD

SEQ ID NO: 8642 - protein, 25 aa, synthetic construct
  source 1..25: note = Seed: LNVIVHSATGFKQSSKALQRPVASD
LNVIVHSATGWKQSSVALARPVASD

SEQ ID NO: 8643 - protein, 25 aa, synthetic construct
  source 1..25: note = Seed: LNVIVHSATGFKQSSKALQRPVASD
LNVIVHSATGWKQSSVALIRPVASD

SEQ ID NO: 8644 - protein, 25 aa, synthetic construct
  source 1..25: note = Seed: LNVIVHSATGFKQSSKALQRPVASD
LNVIVHSATGWKQSSVALLRPVASD

SEQ ID NO: 8645 - protein, 25 aa, synthetic construct
  source 1..25: note = Seed: LNVIVHSATGFKQSSKALQRPVASD
LNVIVHSATGWKQSSVALMRPVASD

SEQ ID NO: 8646 - protein, 25 aa, synthetic construct
  source 1..25: note = Seed: LNVIVHSATGFKQSSKALQRPVASD
LNVIVHSATGWKQSSVALNRPVASD

SEQ ID NO: 8647 - protein, 25 aa, synthetic construct
  source 1..25: note = Seed: LNVIVHSATGFKQSSKALQRPVASD
LNVIVHSATGWKQSSVALSRPVASD

SEQ ID NO: 8648 - protein, 25 aa, synthetic construct
  source 1..25: note = Seed: LNVIVHSATGFKQSSKALQRPVASD
LNVIVHSATGWKQTSAALARPVASD

SEQ ID NO: 8649 - protein, 25 aa, synthetic construct
  source 1..25: note = Seed: LNVIVHSATGFKQSSKALQRPVASD
LNVIVHSATGWKQTSAALFRPVASD

SEQ ID NO: 8650 - protein, 25 aa, synthetic construct
  source 1..25: note = Seed: LNVIVHSATGFKQSSKALQRPVASD
LNVIVHSATGWKQTSAALIRPVASD

SEQ ID NO: 8651 - protein, 25 aa, synthetic construct
  source 1..25: note = Seed: LNVIVHSATGFKQSSKALQRPVASD
LNVIVHSATGWKQTSAALLRPVASD

SEQ ID NO: 8652 - protein, 25 aa, synthetic construct
  source 1..25: note = Seed: LNVIVHSATGFKQSSKALQRPVASD
LNVIVHSATGWKQTSAALMRPVASD

SEQ ID NO: 8653 - protein, 25 aa, synthetic construct
  source 1..25: note = Seed: LNVIVHSATGFKQSSKALQRPVASD
LNVIVHSATGWKQTSAALNRPVASD

SEQ ID NO: 8654 - protein, 25 aa, synthetic construct
  source 1..25: note = Seed: LNVIVHSATGFKQSSKALQRPVASD
LNVIVHSATGWKQTSAALSRPVASD

SEQ ID NO: 8655 - protein, 25 aa, synthetic construct
  source 1..25: note = Seed: LNVIVHSATGFKQSSKALQRPVASD
LNVIVHSATGWKQTSAALVRPVASD

SEQ ID NO: 8656 - protein, 25 aa, synthetic construct
  source 1..25: note = Seed: LNVIVHSATGFKQSSKALQRPVASD
LNVIVHSATGWKQTSAALYRPVASD

SEQ ID NO: 8657 - protein, 25 aa, synthetic construct
  source 1..25: note = Seed: LNVIVHSATGFKQSSKALQRPVASD
LNVIVHSATGWKQTSFALIRPVASD

SEQ ID NO: 8658 - protein, 25 aa, synthetic construct
  source 1..25: note = Seed: LNVIVHSATGFKQSSKALQRPVASD
LNVIVHSATGWKQTSFALLRPVASD

SEQ ID NO: 8659 - protein, 25 aa, synthetic construct
  source 1..25: note = Seed: LNVIVHSATGFKQSSKALQRPVASD
LNVIVHSATGWKQTSFALVRPVASD

SEQ ID NO: 8660 - protein, 25 aa, synthetic construct
  source 1..25: note = Seed: LNVIVHSATGFKQSSKALQRPVASD
LNVIVHSATGWKQTSGALARPVASD

SEQ ID NO: 8661 - protein, 25 aa, synthetic construct
  source 1..25: note = Seed: LNVIVHSATGFKQSSKALQRPVASD
LNVIVHSATGWKQTSGALFRPVASD

SEQ ID NO: 8662 - protein, 25 aa, synthetic construct
  source 1..25: note = Seed: LNVIVHSATGFKQSSKALQRPVASD
LNVIVHSATGWKQTSGALIRPVASD

SEQ ID NO: 8663 - protein, 25 aa, synthetic construct
  source 1..25: note = Seed: LNVIVHSATGFKQSSKALQRPVASD
LNVIVHSATGWKQTSGALLRPVASD

SEQ ID NO: 8664 - protein, 25 aa, synthetic construct
  source 1..25: note = Seed: LNVIVHSATGFKQSSKALQRPVASD
LNVIVHSATGWKQTSGALVRPVASD

SEQ ID NO: 8665 - protein, 25 aa, synthetic construct
  source 1..25: note = Seed: LNVIVHSATGFKQSSKALQRPVASD
LNVIVHSATGWKQTSIALARPVASD

SEQ ID NO: 8666 - protein, 25 aa, synthetic construct
  source 1..25: note = Seed: LNVIVHSATGFKQSSKALQRPVASD
LNVIVHSATGWKQTSIALVRPVASD

SEQ ID NO: 8667 - protein, 25 aa, synthetic construct
  source 1..25: note = Seed: LNVIVHSATGFKQSSKALQRPVASD
LNVIVHSATGWKQTSLALARPVASD

SEQ ID NO: 8668 - protein, 25 aa, synthetic construct
  source 1..25: note = Seed: LNVIVHSATGFKQSSKALQRPVASD
LNVIVHSATGWKQTSNALIRPVASD

SEQ ID NO: 8669 - protein, 25 aa, synthetic construct
  source 1..25: note = Seed: LNVIVHSATGFKQSSKALQRPVASD
LNVIVHSATGWKQTSNALLRPVASD

SEQ ID NO: 8670 - protein, 25 aa, synthetic construct
  source 1..25: note = Seed: LNVIVHSATGFKQSSKALQRPVASD
LNVIVHSATGWKQTSNALVRPVASD

SEQ ID NO: 8671 - protein, 25 aa, synthetic construct
  source 1..25: note = Seed: LNVIVHSATGFKQSSKALQRPVASD
LNVIVHSATGWKQTSPALFRPVASD

SEQ ID NO: 8672 - protein, 25 aa, synthetic construct
  source 1..25: note = Seed: LNVIVHSATGFKQSSKALQRPVASD
LNVIVHSATGWKQTSPALIRPVASD

SEQ ID NO: 8673 - protein, 25 aa, synthetic construct
  source 1..25: note = Seed: LNVIVHSATGFKQSSKALQRPVASD
LNVIVHSATGWKQTSPALLRPVASD

SEQ ID NO: 8674 - protein, 25 aa, synthetic construct
  source 1..25: note = Seed: LNVIVHSATGFKQSSKALQRPVASD
LNVIVHSATGWKQTSPALVRPVASD

SEQ ID NO: 8675 - protein, 25 aa, synthetic construct
  source 1..25: note = Seed: LNVIVHSATGFKQSSKALQRPVASD
LNVIVHSATGWKQTSSALARPVASD

SEQ ID NO: 8676 - protein, 25 aa, synthetic construct
  source 1..25: note = Seed: LNVIVHSATGFKQSSKALQRPVASD
LNVIVHSATGWKQTSSALFRPVASD

SEQ ID NO: 8677 - protein, 25 aa, synthetic construct
  source 1..25: note = Seed: LNVIVHSATGFKQSSKALQRPVASD
LNVIVHSATGWKQTSSALIRPVASD

SEQ ID NO: 8678 - protein, 25 aa, synthetic construct
  source 1..25: note = Seed: LNVIVHSATGFKQSSKALQRPVASD
LNVIVHSATGWKQTSSALLRPVASD

SEQ ID NO: 8679 - protein, 25 aa, synthetic construct
  source 1..25: note = Seed: LNVIVHSATGFKQSSKALQRPVASD
LNVIVHSATGWKQTSSALMRPVASD

SEQ ID NO: 8680 - protein, 25 aa, synthetic construct
  source 1..25: note = Seed: LNVIVHSATGFKQSSKALQRPVASD
LNVIVHSATGWKQTSSALVRPVASD

SEQ ID NO: 8681 - protein, 25 aa, synthetic construct
  source 1..25: note = Seed: LNVIVHSATGFKQSSKALQRPVASD
LNVIVHSATGWKQTSSALYRPVASD

SEQ ID NO: 8682 - protein, 25 aa, synthetic construct
  source 1..25: note = Seed: LNVIVHSATGFKQSSKALQRPVASD
LNVIVHSATGWKQTSTALFRPVASD

SEQ ID NO: 8683 - protein, 25 aa, synthetic construct
  source 1..25: note = Seed: LNVIVHSATGFKQSSKALQRPVASD
LNVIVHSATGWKQTSTALIRPVASD

SEQ ID NO: 8684 - protein, 25 aa, synthetic construct
  source 1..25: note = Seed: LNVIVHSATGFKQSSKALQRPVASD
LNVIVHSATGWKQTSTALLRPVASD

SEQ ID NO: 8685 - protein, 25 aa, synthetic construct
  source 1..25: note = Seed: LNVIVHSATGFKQSSKALQRPVASD
LNVIVHSATGWKQTSTALVRPVASD

SEQ ID NO: 8686 - protein, 25 aa, synthetic construct
  source 1..25: note = Seed: LNVIVHSATGFKQSSKALQRPVASD
LNVIVHSATGWKQTSVALARPVASD

SEQ ID NO: 8687 - protein, 25 aa, synthetic construct
  source 1..25: note = Seed: LNVIVHSATGFKQSSKALQRPVASD
LNVIVHSATGWKQTSVALIRPVASD

SEQ ID NO: 8688 - protein, 25 aa, synthetic construct
  source 1..25: note = Seed: LNVIVHSATGFKQSSKALQRPVASD
LNVIVHSATGWKQTSVALLRPVASD

SEQ ID NO: 8689 - protein, 25 aa, synthetic construct
  source 1..25: note = Seed: LNVIVHSATGFKQSSKALQRPVASD
LNVIVHSATGWKQTSVALMRPVASD

SEQ ID NO: 8690 - protein, 25 aa, synthetic construct
  source 1..25: note = Seed: LNVIVHSATGFKQSSKALQRPVASD
LNVIVHSATGWKQVSAALARPVASD

SEQ ID NO: 8691 - protein, 25 aa, synthetic construct
  source 1..25: note = Seed: LNVIVHSATGFKQSSKALQRPVASD
LNVIVHSATGWKQVSAALGRPVASD

SEQ ID NO: 8692 - protein, 25 aa, synthetic construct
  source 1..25: note = Seed: LNVIVHSATGFKQSSKALQRPVASD
LNVIVHSATGWKQVSAALIRPVASD

SEQ ID NO: 8693 - protein, 25 aa, synthetic construct
  source 1..25: note = Seed: LNVIVHSATGFKQSSKALQRPVASD
LNVIVHSATGWKQVSAALLRPVASD

SEQ ID NO: 8694 - protein, 25 aa, synthetic construct
  source 1..25: note = Seed: LNVIVHSATGFKQSSKALQRPVASD
LNVIVHSATGWKQVSAALMRPVASD

SEQ ID NO: 8695 - protein, 25 aa, synthetic construct
  source 1..25: note = Seed: LNVIVHSATGFKQSSKALQRPVASD
LNVIVHSATGWKQVSAALNRPVASD

SEQ ID NO: 8696 - protein, 25 aa, synthetic construct
  source 1..25: note = Seed: LNVIVHSATGFKQSSKALQRPVASD
LNVIVHSATGWKQVSAALQRPVASD

SEQ ID NO: 8697 - protein, 25 aa, synthetic construct
  source 1..25: note = Seed: LNVIVHSATGFKQSSKALQRPVASD
LNVIVHSATGWKQVSAALSRPVASD

SEQ ID NO: 8698 - protein, 25 aa, synthetic construct
  source 1..25: note = Seed: LNVIVHSATGFKQSSKALQRPVASD
LNVIVHSATGWKQVSAALTRPVASD

SEQ ID NO: 8699 - protein, 25 aa, synthetic construct
  source 1..25: note = Seed: LNVIVHSATGFKQSSKALQRPVASD
LNVIVHSATGWKQVSAALVRPVASD

SEQ ID NO: 8700 - protein, 25 aa, synthetic construct
  source 1..25: note = Seed: LNVIVHSATGFKQSSKALQRPVASD
LNVIVHSATGWKQVSGALARPVASD

SEQ ID NO: 8701 - protein, 25 aa, synthetic construct
  source 1..25: note = Seed: LNVIVHSATGFKQSSKALQRPVASD
LNVIVHSATGWKQVSGALGRPVASD

SEQ ID NO: 8702 - protein, 25 aa, synthetic construct
  source 1..25: note = Seed: LNVIVHSATGFKQSSKALQRPVASD
LNVIVHSATGWKQVSGALIRPVASD

SEQ ID NO: 8703 - protein, 25 aa, synthetic construct
  source 1..25: note = Seed: LNVIVHSATGFKQSSKALQRPVASD
LNVIVHSATGWKQVSGALLRPVASD

SEQ ID NO: 8704 - protein, 25 aa, synthetic construct
  source 1..25: note = Seed: LNVIVHSATGFKQSSKALQRPVASD
LNVIVHSATGWKQVSGALMRPVASD

SEQ ID NO: 8705 - protein, 25 aa, synthetic construct
  source 1..25: note = Seed: LNVIVHSATGFKQSSKALQRPVASD
LNVIVHSATGWKQVSGALNRPVASD

SEQ ID NO: 8706 - protein, 25 aa, synthetic construct
  source 1..25: note = Seed: LNVIVHSATGFKQSSKALQRPVASD
LNVIVHSATGWKQVSGALSRPVASD

SEQ ID NO: 8707 - protein, 25 aa, synthetic construct
  source 1..25: note = Seed: LNVIVHSATGFKQSSKALQRPVASD
LNVIVHSATGWKQVSGALTRPVASD

SEQ ID NO: 8708 - protein, 25 aa, synthetic construct
  source 1..25: note = Seed: LNVIVHSATGFKQSSKALQRPVASD
LNVIVHSATGWKQVSGALVRPVASD

SEQ ID NO: 8709 - protein, 25 aa, synthetic construct
  source 1..25: note = Seed: LNVIVHSATGFKQSSKALQRPVASD
LNVIVHSATGWKQVSIALARPVASD

SEQ ID NO: 8710 - protein, 25 aa, synthetic construct
  source 1..25: note = Seed: LNVIVHSATGFKQSSKALQRPVASD
LNVIVHSATGWKQVSIALIRPVASD

SEQ ID NO: 8711 - protein, 25 aa, synthetic construct
  source 1..25: note = Seed: LNVIVHSATGFKQSSKALQRPVASD
LNVIVHSATGWKQVSIALLRPVASD

SEQ ID NO: 8712 - protein, 25 aa, synthetic construct
  source 1..25: note = Seed: LNVIVHSATGFKQSSKALQRPVASD
LNVIVHSATGWKQVSIALNRPVASD

SEQ ID NO: 8713 - protein, 25 aa, synthetic construct
  source 1..25: note = Seed: LNVIVHSATGFKQSSKALQRPVASD
LNVIVHSATGWKQVSIALQRPVASD

SEQ ID NO: 8714 - protein, 25 aa, synthetic construct
  source 1..25: note = Seed: LNVIVHSATGFKQSSKALQRPVASD
LNVIVHSATGWKQVSIALSRPVASD

SEQ ID NO: 8715 - protein, 25 aa, synthetic construct
  source 1..25: note = Seed: LNVIVHSATGFKQSSKALQRPVASD
LNVIVHSATGWKQVSIALTRPVASD

SEQ ID NO: 8716 - protein, 25 aa, synthetic construct
  source 1..25: note = Seed: LNVIVHSATGFKQSSKALQRPVASD
LNVIVHSATGWKQVSIALVRPVASD

SEQ ID NO: 8717 - protein, 25 aa, synthetic construct
  source 1..25: note = Seed: LNVIVHSATGFKQSSKALQRPVASD
LNVIVHSATGWKQVSKALARPVASD

SEQ ID NO: 8718 - protein, 25 aa, synthetic construct
  source 1..25: note = Seed: LNVIVHSATGFKQSSKALQRPVASD
LNVIVHSATGWKQVSKALGRPVASD

SEQ ID NO: 8719 - protein, 25 aa, synthetic construct
  source 1..25: note = Seed: LNVIVHSATGFKQSSKALQRPVASD
LNVIVHSATGWKQVSKALHRPVASD

SEQ ID NO: 8720 - protein, 25 aa, synthetic construct
  source 1..25: note = Seed: LNVIVHSATGFKQSSKALQRPVASD
LNVIVHSATGWKQVSKALKRPVASD

SEQ ID NO: 8721 - protein, 25 aa, synthetic construct
  source 1..25: note = Seed: LNVIVHSATGFKQSSKALQRPVASD
LNVIVHSATGWKQVSKALQRPVASD

SEQ ID NO: 8722 - protein, 25 aa, synthetic construct
  source 1..25: note = Seed: LNVIVHSATGFKQSSKALQRPVASD
LNVIVHSATGWKQVSKALRRPVASD

SEQ ID NO: 8723 - protein, 25 aa, synthetic construct
  source 1..25: note = Seed: LNVIVHSATGFKQSSKALQRPVASD
LNVIVHSATGWKQVSKALSRPVASD

SEQ ID NO: 8724 - protein, 25 aa, synthetic construct
  source 1..25: note = Seed: LNVIVHSATGFKQSSKALQRPVASD
LNVIVHSATGWKQVSKALTRPVASD

SEQ ID NO: 8725 - protein, 25 aa, synthetic construct
  source 1..25: note = Seed: LNVIVHSATGFKQSSKALQRPVASD
LNVIVHSATGWKQVSLALARPVASD

SEQ ID NO: 8726 - protein, 25 aa, synthetic construct
  source 1..25: note = Seed: LNVIVHSATGFKQSSKALQRPVASD
LNVIVHSATGWKQVSLALNRPVASD

SEQ ID NO: 8727 - protein, 25 aa, synthetic construct
  source 1..25: note = Seed: LNVIVHSATGFKQSSKALQRPVASD
LNVIVHSATGWKQVSLALSRPVASD

SEQ ID NO: 8728 - protein, 25 aa, synthetic construct
  source 1..25: note = Seed: LNVIVHSATGFKQSSKALQRPVASD
LNVIVHSATGWKQVSLALTRPVASD

SEQ ID NO: 8729 - protein, 25 aa, synthetic construct
  source 1..25: note = Seed: LNVIVHSATGFKQSSKALQRPVASD
LNVIVHSATGWKQVSLALVRPVASD

SEQ ID NO: 8730 - protein, 25 aa, synthetic construct
  source 1..25: note = Seed: LNVIVHSATGFKQSSKALQRPVASD
LNVIVHSATGWKQVSMALARPVASD

SEQ ID NO: 8731 - protein, 25 aa, synthetic construct
  source 1..25: note = Seed: LNVIVHSATGFKQSSKALQRPVASD
LNVIVHSATGWKQVSMALNRPVASD

SEQ ID NO: 8732 - protein, 25 aa, synthetic construct
  source 1..25: note = Seed: LNVIVHSATGFKQSSKALQRPVASD
LNVIVHSATGWKQVSMALSRPVASD

SEQ ID NO: 8733 - protein, 25 aa, synthetic construct
  source 1..25: note = Seed: LNVIVHSATGFKQSSKALQRPVASD
LNVIVHSATGWKQVSNALARPVASD

SEQ ID NO: 8734 - protein, 25 aa, synthetic construct
  source 1..25: note = Seed: LNVIVHSATGFKQSSKALQRPVASD
LNVIVHSATGWKQVSNALSRPVASD

SEQ ID NO: 8735 - protein, 25 aa, synthetic construct
  source 1..25: note = Seed: LNVIVHSATGFKQSSKALQRPVASD
LNVIVHSATGWKQVSNALVRPVASD

SEQ ID NO: 8736 - protein, 25 aa, synthetic construct
  source 1..25: note = Seed: LNVIVHSATGFKQSSKALQRPVASD
LNVIVHSATGWKQVSPALARPVASD

SEQ ID NO: 8737 - protein, 25 aa, synthetic construct
  source 1..25: note = Seed: LNVIVHSATGFKQSSKALQRPVASD
LNVIVHSATGWKQVSPALIRPVASD

SEQ ID NO: 8738 - protein, 25 aa, synthetic construct
  source 1..25: note = Seed: LNVIVHSATGFKQSSKALQRPVASD
LNVIVHSATGWKQVSPALLRPVASD

SEQ ID NO: 8739 - protein, 25 aa, synthetic construct
  source 1..25: note = Seed: LNVIVHSATGFKQSSKALQRPVASD
LNVIVHSATGWKQVSPALMRPVASD

SEQ ID NO: 8740 - protein, 25 aa, synthetic construct
  source 1..25: note = Seed: LNVIVHSATGFKQSSKALQRPVASD
LNVIVHSATGWKQVSPALNRPVASD

SEQ ID NO: 8741 - protein, 25 aa, synthetic construct
  source 1..25: note = Seed: LNVIVHSATGFKQSSKALQRPVASD
LNVIVHSATGWKQVSPALSRPVASD

SEQ ID NO: 8742 - protein, 25 aa, synthetic construct
  source 1..25: note = Seed: LNVIVHSATGFKQSSKALQRPVASD
LNVIVHSATGWKQVSPALTRPVASD

SEQ ID NO: 8743 - protein, 25 aa, synthetic construct
  source 1..25: note = Seed: LNVIVHSATGFKQSSKALQRPVASD
LNVIVHSATGWKQVSPALVRPVASD

SEQ ID NO: 8744 - protein, 25 aa, synthetic construct
  source 1..25: note = Seed: LNVIVHSATGFKQSSKALQRPVASD
LNVIVHSATGWKQVSRALARPVASD

SEQ ID NO: 8745 - protein, 25 aa, synthetic construct
  source 1..25: note = Seed: LNVIVHSATGFKQSSKALQRPVASD
LNVIVHSATGWKQVSRALGRPVASD

SEQ ID NO: 8746 - protein, 25 aa, synthetic construct
  source 1..25: note = Seed: LNVIVHSATGFKQSSKALQRPVASD
LNVIVHSATGWKQVSRALHRPVASD

SEQ ID NO: 8747 - protein, 25 aa, synthetic construct
  source 1..25: note = Seed: LNVIVHSATGFKQSSKALQRPVASD
LNVIVHSATGWKQVSRALKRPVASD

SEQ ID NO: 8748 - protein, 25 aa, synthetic construct
  source 1..25: note = Seed: LNVIVHSATGFKQSSKALQRPVASD
LNVIVHSATGWKQVSRALNRPVASD

SEQ ID NO: 8749 - protein, 25 aa, synthetic construct
  source 1..25: note = Seed: LNVIVHSATGFKQSSKALQRPVASD
LNVIVHSATGWKQVSRALQRPVASD

SEQ ID NO: 8750 - protein, 25 aa, synthetic construct
  source 1..25: note = Seed: LNVIVHSATGFKQSSKALQRPVASD
LNVIVHSATGWKQVSRALRRPVASD

SEQ ID NO: 8751 - protein, 25 aa, synthetic construct
  source 1..25: note = Seed: LNVIVHSATGFKQSSKALQRPVASD
LNVIVHSATGWKQVSRALSRPVASD

SEQ ID NO: 8752 - protein, 25 aa, synthetic construct
  source 1..25: note = Seed: LNVIVHSATGFKQSSKALQRPVASD
LNVIVHSATGWKQVSRALTRPVASD

SEQ ID NO: 8753 - protein, 25 aa, synthetic construct
  source 1..25: note = Seed: LNVIVHSATGFKQSSKALQRPVASD
LNVIVHSATGWKQVSSALARPVASD

SEQ ID NO: 8754 - protein, 25 aa, synthetic construct
  source 1..25: note = Seed: LNVIVHSATGFKQSSKALQRPVASD
LNVIVHSATGWKQVSSALFRPVASD

SEQ ID NO: 8755 - protein, 25 aa, synthetic construct
  source 1..25: note = Seed: LNVIVHSATGFKQSSKALQRPVASD
LNVIVHSATGWKQVSSALGRPVASD

SEQ ID NO: 8756 - protein, 25 aa, synthetic construct
  source 1..25: note = Seed: LNVIVHSATGFKQSSKALQRPVASD
LNVIVHSATGWKQVSSALIRPVASD

SEQ ID NO: 8757 - protein, 25 aa, synthetic construct
  source 1..25: note = Seed: LNVIVHSATGFKQSSKALQRPVASD
LNVIVHSATGWKQVSSALLRPVASD

SEQ ID NO: 8758 - protein, 25 aa, synthetic construct
  source 1..25: note = Seed: LNVIVHSATGFKQSSKALQRPVASD
LNVIVHSATGWKQVSSALMRPVASD

SEQ ID NO: 8759 - protein, 25 aa, synthetic construct
  source 1..25: note = Seed: LNVIVHSATGFKQSSKALQRPVASD
LNVIVHSATGWKQVSSALNRPVASD

SEQ ID NO: 8760 - protein, 25 aa, synthetic construct
  source 1..25: note = Seed: LNVIVHSATGFKQSSKALQRPVASD
LNVIVHSATGWKQVSSALSRPVASD

SEQ ID NO: 8761 - protein, 25 aa, synthetic construct
  source 1..25: note = Seed: LNVIVHSATGFKQSSKALQRPVASD
LNVIVHSATGWKQVSSALTRPVASD

SEQ ID NO: 8762 - protein, 25 aa, synthetic construct
  source 1..25: note = Seed: LNVIVHSATGFKQSSKALQRPVASD
LNVIVHSATGWKQVSSALVRPVASD

SEQ ID NO: 8763 - protein, 25 aa, synthetic construct
  source 1..25: note = Seed: LNVIVHSATGFKQSSKALQRPVASD
LNVIVHSATGWKQVSTALARPVASD

SEQ ID NO: 8764 - protein, 25 aa, synthetic construct
  source 1..25: note = Seed: LNVIVHSATGFKQSSKALQRPVASD
LNVIVHSATGWKQVSTALGRPVASD

SEQ ID NO: 8765 - protein, 25 aa, synthetic construct
  source 1..25: note = Seed: LNVIVHSATGFKQSSKALQRPVASD
LNVIVHSATGWKQVSTALIRPVASD

SEQ ID NO: 8766 - protein, 25 aa, synthetic construct
  source 1..25: note = Seed: LNVIVHSATGFKQSSKALQRPVASD
LNVIVHSATGWKQVSTALLRPVASD

SEQ ID NO: 8767 - protein, 25 aa, synthetic construct
  source 1..25: note = Seed: LNVIVHSATGFKQSSKALQRPVASD
LNVIVHSATGWKQVSTALMRPVASD

SEQ ID NO: 8768 - protein, 25 aa, synthetic construct
  source 1..25: note = Seed: LNVIVHSATGFKQSSKALQRPVASD
LNVIVHSATGWKQVSTALNRPVASD

SEQ ID NO: 8769 - protein, 25 aa, synthetic construct
  source 1..25: note = Seed: LNVIVHSATGFKQSSKALQRPVASD
LNVIVHSATGWKQVSTALSRPVASD

SEQ ID NO: 8770 - protein, 25 aa, synthetic construct
  source 1..25: note = Seed: LNVIVHSATGFKQSSKALQRPVASD
LNVIVHSATGWKQVSTALTRPVASD

SEQ ID NO: 8771 - protein, 25 aa, synthetic construct
  source 1..25: note = Seed: LNVIVHSATGFKQSSKALQRPVASD
LNVIVHSATGWKQVSTALVRPVASD

SEQ ID NO: 8772 - protein, 25 aa, synthetic construct
  source 1..25: note = Seed: LNVIVHSATGFKQSSKALQRPVASD
LNVIVHSATGWKQVSVALARPVASD

SEQ ID NO: 8773 - protein, 25 aa, synthetic construct
  source 1..25: note = Seed: LNVIVHSATGFKQSSKALQRPVASD
LNVIVHSATGWKQVSVALGRPVASD

SEQ ID NO: 8774 - protein, 25 aa, synthetic construct
  source 1..25: note = Seed: LNVIVHSATGFKQSSKALQRPVASD
LNVIVHSATGWKQVSVALIRPVASD

SEQ ID NO: 8775 - protein, 25 aa, synthetic construct
  source 1..25: note = Seed: LNVIVHSATGFKQSSKALQRPVASD
LNVIVHSATGWKQVSVALLRPVASD

SEQ ID NO: 8776 - protein, 25 aa, synthetic construct
  source 1..25: note = Seed: LNVIVHSATGFKQSSKALQRPVASD
LNVIVHSATGWKQVSVALMRPVASD

SEQ ID NO: 8777 - protein, 25 aa, synthetic construct
  source 1..25: note = Seed: LNVIVHSATGFKQSSKALQRPVASD
LNVIVHSATGWKQVSVALNRPVASD

SEQ ID NO: 8778 - protein, 25 aa, synthetic construct
  source 1..25: note = Seed: LNVIVHSATGFKQSSKALQRPVASD
LNVIVHSATGWKQVSVALSRPVASD

SEQ ID NO: 8779 - protein, 25 aa, synthetic construct
  source 1..25: note = Seed: LNVIVHSATGFKQSSKALQRPVASD
LNVIVHSATGWKQVSVALTRPVASD

SEQ ID NO: 8780 - protein, 25 aa, synthetic construct
  source 1..25: note = Seed: LNVIVHSATGFKQSSKALQRPVASD
LNVIVHSATGWKQVSVALVRPVASD

SEQ ID NO: 8781 - protein, 25 aa, synthetic construct
  source 1..25: note = Seed: LNVIVHSATGFKQSSKALQRPVASD
LNVIVHSATGWKQWSAALARPVASD

SEQ ID NO: 8782 - protein, 25 aa, synthetic construct
  source 1..25: note = Seed: LNVIVHSATGFKQSSKALQRPVASD
LNVIVHSATGWKQWSAALGRPVASD

SEQ ID NO: 8783 - protein, 25 aa, synthetic construct
  source 1..25: note = Seed: LNVIVHSATGFKQSSKALQRPVASD
LNVIVHSATGWKQWSAALIRPVASD

SEQ ID NO: 8784 - protein, 25 aa, synthetic construct
  source 1..25: note = Seed: LNVIVHSATGFKQSSKALQRPVASD
LNVIVHSATGWKQWSAALLRPVASD

SEQ ID NO: 8785 - protein, 25 aa, synthetic construct
  source 1..25: note = Seed: LNVIVHSATGFKQSSKALQRPVASD
LNVIVHSATGWKQWSAALMRPVASD

SEQ ID NO: 8786 - protein, 25 aa, synthetic construct
  source 1..25: note = Seed: LNVIVHSATGFKQSSKALQRPVASD
LNVIVHSATGWKQWSAALNRPVASD

SEQ ID NO: 8787 - protein, 25 aa, synthetic construct
  source 1..25: note = Seed: LNVIVHSATGFKQSSKALQRPVASD
LNVIVHSATGWKQWSAALSRPVASD

SEQ ID NO: 8788 - protein, 25 aa, synthetic construct
  source 1..25: note = Seed: LNVIVHSATGFKQSSKALQRPVASD
LNVIVHSATGWKQWSAALVRPVASD

SEQ ID NO: 8789 - protein, 25 aa, synthetic construct
  source 1..25: note = Seed: LNVIVHSATGFKQSSKALQRPVASD
LNVIVHSATGWKQWSGALARPVASD

SEQ ID NO: 8790 - protein, 25 aa, synthetic construct
  source 1..25: note = Seed: LNVIVHSATGFKQSSKALQRPVASD
LNVIVHSATGWKQWSIALNRPVASD

SEQ ID NO: 8791 - protein, 25 aa, synthetic construct
  source 1..25: note = Seed: LNVIVHSATGFKQSSKALQRPVASD
LNVIVHSATGWKQWSIALQRPVASD

SEQ ID NO: 8792 - protein, 25 aa, synthetic construct
  source 1..25: note = Seed: LNVIVHSATGFKQSSKALQRPVASD
LNVIVHSATGWKQWSLALQRPVASD

SEQ ID NO: 8793 - protein, 25 aa, synthetic construct
  source 1..25: note = Seed: LNVIVHSATGFKQSSKALQRPVASD
LNVIVHSATGWKQWSPALARPVASD

SEQ ID NO: 8794 - protein, 25 aa, synthetic construct
  source 1..25: note = Seed: LNVIVHSATGFKQSSKALQRPVASD
LNVIVHSATGWKQWSPALSRPVASD

SEQ ID NO: 8795 - protein, 25 aa, synthetic construct
  source 1..25: note = Seed: LNVIVHSATGFKQSSKALQRPVASD
LNVIVHSATGWKQWSPALVRPVASD

SEQ ID NO: 8796 - protein, 25 aa, synthetic construct
  source 1..25: note = Seed: LNVIVHSATGFKQSSKALQRPVASD
LNVIVHSATGWKQWSRALRRPVASD

SEQ ID NO: 8797 - protein, 25 aa, synthetic construct
  source 1..25: note = Seed: LNVIVHSATGFKQSSKALQRPVASD
LNVIVHSATGWKQWSSALIRPVASD

SEQ ID NO: 8798 - protein, 25 aa, synthetic construct
  source 1..25: note = Seed: LNVIVHSATGFKQSSKALQRPVASD
LNVIVHSATGWKQWSSALSRPVASD

SEQ ID NO: 8799 - protein, 25 aa, synthetic construct
  source 1..25: note = Seed: LNVIVHSATGFKQSSKALQRPVASD
LNVIVHSATGWKQWSSALVRPVASD

SEQ ID NO: 8800 - protein, 25 aa, synthetic construct
  source 1..25: note = Seed: LNVIVHSATGFKQSSKALQRPVASD
LNVIVHSATGWKQWSTALARPVASD

SEQ ID NO: 8801 - protein, 25 aa, synthetic construct
  source 1..25: note = Seed: LNVIVHSATGFKQSSKALQRPVASD
LNVIVHSATGWKQWSTALSRPVASD

SEQ ID NO: 8802 - protein, 25 aa, synthetic construct
  source 1..25: note = Seed: LNVIVHSATGFKQSSKALQRPVASD
LNVIVHSATGWKQWSTALVRPVASD

SEQ ID NO: 8803 - protein, 25 aa, synthetic construct
  source 1..25: note = Seed: LNVIVHSATGFKQSSKALQRPVASD
LNVIVHSATGWKQWSVALGRPVASD

SEQ ID NO: 8804 - protein, 25 aa, synthetic construct
  source 1..25: note = Seed: LNVIVHSATGFKQSSKALQRPVASD
LNVIVHSATGWKQWSVALIRPVASD

SEQ ID NO: 8805 - protein, 25 aa, synthetic construct
  source 1..25: note = Seed: LNVIVHSATGFKQSSKALQRPVASD
LNVIVHSATGWKQWSVALLRPVASD

SEQ ID NO: 8806 - protein, 25 aa, synthetic construct
  source 1..25: note = Seed: LNVIVHSATGFKQSSKALQRPVASD
LNVIVHSATGWKQWSVALMRPVASD

SEQ ID NO: 8807 - protein, 25 aa, synthetic construct
  source 1..25: note = Seed: LNVIVHSATGFKQSSKALQRPVASD
LNVIVHSATGWKQWSVALNRPVASD

SEQ ID NO: 8808 - protein, 25 aa, synthetic construct
  source 1..25: note = Seed: LNVIVHSATGFKQSSKALQRPVASD
LNVIVHSATGWKQWSVALSRPVASD

SEQ ID NO: 8809 - protein, 25 aa, synthetic construct
  source 1..25: note = Seed: LNVIVHSATGFKQSSKALQRPVASD
LNVIVHSATGWKQYSAALARPVASD

SEQ ID NO: 8810 - protein, 25 aa, synthetic construct
  source 1..25: note = Seed: LNVIVHSATGFKQSSKALQRPVASD
LNVIVHSATGWKQYSAALGRPVASD

SEQ ID NO: 8811 - protein, 25 aa, synthetic construct
  source 1..25: note = Seed: LNVIVHSATGFKQSSKALQRPVASD
LNVIVHSATGWKQYSAALIRPVASD

SEQ ID NO: 8812 - protein, 25 aa, synthetic construct
  source 1..25: note = Seed: LNVIVHSATGFKQSSKALQRPVASD
LNVIVHSATGWKQYSAALLRPVASD

SEQ ID NO: 8813 - protein, 25 aa, synthetic construct
  source 1..25: note = Seed: LNVIVHSATGFKQSSKALQRPVASD
LNVIVHSATGWKQYSAALMRPVASD

SEQ ID NO: 8814 - protein, 25 aa, synthetic construct
  source 1..25: note = Seed: LNVIVHSATGFKQSSKALQRPVASD
LNVIVHSATGWKQYSGALVRPVASD

SEQ ID NO: 8815 - protein, 25 aa, synthetic construct
  source 1..25: note = Seed: LNVIVHSATGFKQSSKALQRPVASD
LNVIVHSATGWKQYSKALRRPVASD

SEQ ID NO: 8816 - protein, 25 aa, synthetic construct
  source 1..25: note = Seed: LNVIVHSATGFKQSSKALQRPVASD
LNVIVHSATGWKQYSPALIRPVASD

SEQ ID NO: 8817 - protein, 25 aa, synthetic construct
  source 1..25: note = Seed: LNVIVHSATGFKQSSKALQRPVASD
LNVIVHSATGWKQYSRALKRPVASD

SEQ ID NO: 8818 - protein, 25 aa, synthetic construct
  source 1..25: note = Seed: LNVIVHSATGFKQSSKALQRPVASD
LNVIVHSATGWKQYSRALRRPVASD

SEQ ID NO: 8819 - protein, 25 aa, synthetic construct
  source 1..25: note = Seed: LNVIVHSATGFKQSSKALQRPVASD
LNVIVHSATGWKQYSSALARPVASD

SEQ ID NO: 8820 - protein, 25 aa, synthetic construct
  source 1..25: note = Seed: LNVIVHSATGFKQSSKALQRPVASD
LNVIVHSATGWKQYSSALIRPVASD

SEQ ID NO: 8821 - protein, 25 aa, synthetic construct
  source 1..25: note = Seed: LNVIVHSATGFKQSSKALQRPVASD
LNVIVHSATGWKQYSSALVRPVASD

SEQ ID NO: 8822 - protein, 25 aa, synthetic construct
  source 1..25: note = Seed: LNVIVHSATGFKQSSKALQRPVASD
LNVIVHSATGWKQYSVALQRPVASD

SEQ ID NO: 8823 - protein, 25 aa, synthetic construct
  source 1..25: note = Seed: LNVIVHSATGFKQSSKALQRPVASD
LNVIVHSATGYKQASAALARPVASD

SEQ ID NO: 8824 - protein, 25 aa, synthetic construct
  source 1..25: note = Seed: LNVIVHSATGFKQSSKALQRPVASD
LNVIVHSATGYKQASAALCRPVASD

SEQ ID NO: 8825 - protein, 25 aa, synthetic construct
  source 1..25: note = Seed: LNVIVHSATGFKQSSKALQRPVASD
LNVIVHSATGYKQASAALDRPVASD

SEQ ID NO: 8826 - protein, 25 aa, synthetic construct
  source 1..25: note = Seed: LNVIVHSATGFKQSSKALQRPVASD
LNVIVHSATGYKQASAALERPVASD

SEQ ID NO: 8827 - protein, 25 aa, synthetic construct
  source 1..25: note = Seed: LNVIVHSATGFKQSSKALQRPVASD
LNVIVHSATGYKQASAALFRPVASD

SEQ ID NO: 8828 - protein, 25 aa, synthetic construct
  source 1..25: note = Seed: LNVIVHSATGFKQSSKALQRPVASD
LNVIVHSATGYKQASAALGRPVASD

SEQ ID NO: 8829 - protein, 25 aa, synthetic construct
  source 1..25: note = Seed: LNVIVHSATGFKQSSKALQRPVASD
LNVIVHSATGYKQASAALHRPVASD

SEQ ID NO: 8830 - protein, 25 aa, synthetic construct
  source 1..25: note = Seed: LNVIVHSATGFKQSSKALQRPVASD
LNVIVHSATGYKQASAALIRPVASD

SEQ ID NO: 8831 - protein, 25 aa, synthetic construct
  source 1..25: note = Seed: LNVIVHSATGFKQSSKALQRPVASD
LNVIVHSATGYKQASAALKRPVASD

SEQ ID NO: 8832 - protein, 25 aa, synthetic construct
  source 1..25: note = Seed: LNVIVHSATGFKQSSKALQRPVASD
LNVIVHSATGYKQASAALLRPVASD

SEQ ID NO: 8833 - protein, 25 aa, synthetic construct
  source 1..25: note = Seed: LNVIVHSATGFKQSSKALQRPVASD
LNVIVHSATGYKQASAALMRPVASD

SEQ ID NO: 8834 - protein, 25 aa, synthetic construct
  source 1..25: note = Seed: LNVIVHSATGFKQSSKALQRPVASD
LNVIVHSATGYKQASAALNRPVASD

SEQ ID NO: 8835 - protein, 25 aa, synthetic construct
  source 1..25: note = Seed: LNVIVHSATGFKQSSKALQRPVASD
LNVIVHSATGYKQASAALPRPVASD

SEQ ID NO: 8836 - protein, 25 aa, synthetic construct
  source 1..25: note = Seed: LNVIVHSATGFKQSSKALQRPVASD
LNVIVHSATGYKQASAALQRPVASD

SEQ ID NO: 8837 - protein, 25 aa, synthetic construct
  source 1..25: note = Seed: LNVIVHSATGFKQSSKALQRPVASD
LNVIVHSATGYKQASAALRRPVASD

SEQ ID NO: 8838 - protein, 25 aa, synthetic construct
  source 1..25: note = Seed: LNVIVHSATGFKQSSKALQRPVASD
LNVIVHSATGYKQASAALSRPVASD

SEQ ID NO: 8839 - protein, 25 aa, synthetic construct
  source 1..25: note = Seed: LNVIVHSATGFKQSSKALQRPVASD
LNVIVHSATGYKQASAALTRPVASD

SEQ ID NO: 8840 - protein, 25 aa, synthetic construct
  source 1..25: note = Seed: LNVIVHSATGFKQSSKALQRPVASD
LNVIVHSATGYKQASAALVRPVASD

SEQ ID NO: 8841 - protein, 25 aa, synthetic construct
  source 1..25: note = Seed: LNVIVHSATGFKQSSKALQRPVASD
LNVIVHSATGYKQASAALWRPVASD

SEQ ID NO: 8842 - protein, 25 aa, synthetic construct
  source 1..25: note = Seed: LNVIVHSATGFKQSSKALQRPVASD
LNVIVHSATGYKQASAALYRPVASD

SEQ ID NO: 8843 - protein, 25 aa, synthetic construct
  source 1..25: note = Seed: LNVIVHSATGFKQSSKALQRPVASD
LNVIVHSATGYKQASFALFRPVASD

SEQ ID NO: 8844 - protein, 25 aa, synthetic construct
  source 1..25: note = Seed: LNVIVHSATGFKQSSKALQRPVASD
LNVIVHSATGYKQASFALIRPVASD

SEQ ID NO: 8845 - protein, 25 aa, synthetic construct
  source 1..25: note = Seed: LNVIVHSATGFKQSSKALQRPVASD
LNVIVHSATGYKQASFALLRPVASD

SEQ ID NO: 8846 - protein, 25 aa, synthetic construct
  source 1..25: note = Seed: LNVIVHSATGFKQSSKALQRPVASD
LNVIVHSATGYKQASFALVRPVASD

SEQ ID NO: 8847 - protein, 25 aa, synthetic construct
  source 1..25: note = Seed: LNVIVHSATGFKQSSKALQRPVASD
LNVIVHSATGYKQASGALARPVASD

SEQ ID NO: 8848 - protein, 25 aa, synthetic construct
  source 1..25: note = Seed: LNVIVHSATGFKQSSKALQRPVASD
LNVIVHSATGYKQASGALCRPVASD

SEQ ID NO: 8849 - protein, 25 aa, synthetic construct
  source 1..25: note = Seed: LNVIVHSATGFKQSSKALQRPVASD
LNVIVHSATGYKQASGALFRPVASD

SEQ ID NO: 8850 - protein, 25 aa, synthetic construct
  source 1..25: note = Seed: LNVIVHSATGFKQSSKALQRPVASD
LNVIVHSATGYKQASGALGRPVASD

SEQ ID NO: 8851 - protein, 25 aa, synthetic construct
  source 1..25: note = Seed: LNVIVHSATGFKQSSKALQRPVASD
LNVIVHSATGYKQASGALHRPVASD

SEQ ID NO: 8852 - protein, 25 aa, synthetic construct
  source 1..25: note = Seed: LNVIVHSATGFKQSSKALQRPVASD
LNVIVHSATGYKQASGALIRPVASD

SEQ ID NO: 8853 - protein, 25 aa, synthetic construct
  source 1..25: note = Seed: LNVIVHSATGFKQSSKALQRPVASD
LNVIVHSATGYKQASGALLRPVASD

SEQ ID NO: 8854 - protein, 25 aa, synthetic construct
  source 1..25: note = Seed: LNVIVHSATGFKQSSKALQRPVASD
LNVIVHSATGYKQASGALMRPVASD

SEQ ID NO: 8855 - protein, 25 aa, synthetic construct
  source 1..25: note = Seed: LNVIVHSATGFKQSSKALQRPVASD
LNVIVHSATGYKQASGALNRPVASD

SEQ ID NO: 8856 - protein, 25 aa, synthetic construct
  source 1..25: note = Seed: LNVIVHSATGFKQSSKALQRPVASD
LNVIVHSATGYKQASGALPRPVASD

SEQ ID NO: 8857 - protein, 25 aa, synthetic construct
  source 1..25: note = Seed: LNVIVHSATGFKQSSKALQRPVASD
LNVIVHSATGYKQASGALQRPVASD

SEQ ID NO: 8858 - protein, 25 aa, synthetic construct
  source 1..25: note = Seed: LNVIVHSATGFKQSSKALQRPVASD
LNVIVHSATGYKQASGALSRPVASD

SEQ ID NO: 8859 - protein, 25 aa, synthetic construct
  source 1..25: note = Seed: LNVIVHSATGFKQSSKALQRPVASD
LNVIVHSATGYKQASGALTRPVASD

SEQ ID NO: 8860 - protein, 25 aa, synthetic construct
  source 1..25: note = Seed: LNVIVHSATGFKQSSKALQRPVASD
LNVIVHSATGYKQASGALVRPVASD

SEQ ID NO: 8861 - protein, 25 aa, synthetic construct
  source 1..25: note = Seed: LNVIVHSATGFKQSSKALQRPVASD
LNVIVHSATGYKQASGALYRPVASD

SEQ ID NO: 8862 - protein, 25 aa, synthetic construct
  source 1..25: note = Seed: LNVIVHSATGFKQSSKALQRPVASD
LNVIVHSATGYKQASHALARPVASD

SEQ ID NO: 8863 - protein, 25 aa, synthetic construct
  source 1..25: note = Seed: LNVIVHSATGFKQSSKALQRPVASD
LNVIVHSATGYKQASHALIRPVASD

SEQ ID NO: 8864 - protein, 25 aa, synthetic construct
  source 1..25: note = Seed: LNVIVHSATGFKQSSKALQRPVASD
LNVIVHSATGYKQASHALLRPVASD

SEQ ID NO: 8865 - protein, 25 aa, synthetic construct
  source 1..25: note = Seed: LNVIVHSATGFKQSSKALQRPVASD
LNVIVHSATGYKQASHALVRPVASD

SEQ ID NO: 8866 - protein, 25 aa, synthetic construct
  source 1..25: note = Seed: LNVIVHSATGFKQSSKALQRPVASD
LNVIVHSATGYKQASIALARPVASD

SEQ ID NO: 8867 - protein, 25 aa, synthetic construct
  source 1..25: note = Seed: LNVIVHSATGFKQSSKALQRPVASD
LNVIVHSATGYKQASIALDRPVASD

SEQ ID NO: 8868 - protein, 25 aa, synthetic construct
  source 1..25: note = Seed: LNVIVHSATGFKQSSKALQRPVASD
LNVIVHSATGYKQASIALERPVASD

SEQ ID NO: 8869 - protein, 25 aa, synthetic construct
  source 1..25: note = Seed: LNVIVHSATGFKQSSKALQRPVASD
LNVIVHSATGYKQASIALFRPVASD

SEQ ID NO: 8870 - protein, 25 aa, synthetic construct
  source 1..25: note = Seed: LNVIVHSATGFKQSSKALQRPVASD
LNVIVHSATGYKQASIALGRPVASD

SEQ ID NO: 8871 - protein, 25 aa, synthetic construct
  source 1..25: note = Seed: LNVIVHSATGFKQSSKALQRPVASD
LNVIVHSATGYKQASIALHRPVASD

SEQ ID NO: 8872 - protein, 25 aa, synthetic construct
  source 1..25: note = Seed: LNVIVHSATGFKQSSKALQRPVASD
LNVIVHSATGYKQASIALIRPVASD

SEQ ID NO: 8873 - protein, 25 aa, synthetic construct
  source 1..25: note = Seed: LNVIVHSATGFKQSSKALQRPVASD
LNVIVHSATGYKQASIALLRPVASD

SEQ ID NO: 8874 - protein, 25 aa, synthetic construct
  source 1..25: note = Seed: LNVIVHSATGFKQSSKALQRPVASD
LNVIVHSATGYKQASIALMRPVASD

SEQ ID NO: 8875 - protein, 25 aa, synthetic construct
  source 1..25: note = Seed: LNVIVHSATGFKQSSKALQRPVASD
LNVIVHSATGYKQASIALNRPVASD

SEQ ID NO: 8876 - protein, 25 aa, synthetic construct
  source 1..25: note = Seed: LNVIVHSATGFKQSSKALQRPVASD
LNVIVHSATGYKQASIALPRPVASD

SEQ ID NO: 8877 - protein, 25 aa, synthetic construct
  source 1..25: note = Seed: LNVIVHSATGFKQSSKALQRPVASD
LNVIVHSATGYKQASIALQRPVASD

SEQ ID NO: 8878 - protein, 25 aa, synthetic construct
  source 1..25: note = Seed: LNVIVHSATGFKQSSKALQRPVASD
LNVIVHSATGYKQASIALSRPVASD

SEQ ID NO: 8879 - protein, 25 aa, synthetic construct
  source 1..25: note = Seed: LNVIVHSATGFKQSSKALQRPVASD
LNVIVHSATGYKQASIALTRPVASD

SEQ ID NO: 8880 - protein, 25 aa, synthetic construct
  source 1..25: note = Seed: LNVIVHSATGFKQSSKALQRPVASD
LNVIVHSATGYKQASIALVRPVASD

SEQ ID NO: 8881 - protein, 25 aa, synthetic construct
  source 1..25: note = Seed: LNVIVHSATGFKQSSKALQRPVASD
LNVIVHSATGYKQASKALARPVASD

SEQ ID NO: 8882 - protein, 25 aa, synthetic construct
  source 1..25: note = Seed: LNVIVHSATGFKQSSKALQRPVASD
LNVIVHSATGYKQASKALGRPVASD

SEQ ID NO: 8883 - protein, 25 aa, synthetic construct
  source 1..25: note = Seed: LNVIVHSATGFKQSSKALQRPVASD
LNVIVHSATGYKQASKALHRPVASD

SEQ ID NO: 8884 - protein, 25 aa, synthetic construct
  source 1..25: note = Seed: LNVIVHSATGFKQSSKALQRPVASD
LNVIVHSATGYKQASKALIRPVASD

SEQ ID NO: 8885 - protein, 25 aa, synthetic construct
  source 1..25: note = Seed: LNVIVHSATGFKQSSKALQRPVASD
LNVIVHSATGYKQASKALMRPVASD

SEQ ID NO: 8886 - protein, 25 aa, synthetic construct
  source 1..25: note = Seed: LNVIVHSATGFKQSSKALQRPVASD
LNVIVHSATGYKQASKALNRPVASD

SEQ ID NO: 8887 - protein, 25 aa, synthetic construct
  source 1..25: note = Seed: LNVIVHSATGFKQSSKALQRPVASD
LNVIVHSATGYKQASKALQRPVASD

SEQ ID NO: 8888 - protein, 25 aa, synthetic construct
  source 1..25: note = Seed: LNVIVHSATGFKQSSKALQRPVASD
LNVIVHSATGYKQASKALSRPVASD

SEQ ID NO: 8889 - protein, 25 aa, synthetic construct
  source 1..25: note = Seed: LNVIVHSATGFKQSSKALQRPVASD
LNVIVHSATGYKQASKALTRPVASD

SEQ ID NO: 8890 - protein, 25 aa, synthetic construct
  source 1..25: note = Seed: LNVIVHSATGFKQSSKALQRPVASD
LNVIVHSATGYKQASKALVRPVASD

SEQ ID NO: 8891 - protein, 25 aa, synthetic construct
  source 1..25: note = Seed: LNVIVHSATGFKQSSKALQRPVASD
LNVIVHSATGYKQASLALARPVASD

SEQ ID NO: 8892 - protein, 25 aa, synthetic construct
  source 1..25: note = Seed: LNVIVHSATGFKQSSKALQRPVASD
LNVIVHSATGYKQASLALGRPVASD

SEQ ID NO: 8893 - protein, 25 aa, synthetic construct
  source 1..25: note = Seed: LNVIVHSATGFKQSSKALQRPVASD
LNVIVHSATGYKQASLALHRPVASD

SEQ ID NO: 8894 - protein, 25 aa, synthetic construct
  source 1..25: note = Seed: LNVIVHSATGFKQSSKALQRPVASD
LNVIVHSATGYKQASLALIRPVASD

SEQ ID NO: 8895 - protein, 25 aa, synthetic construct
  source 1..25: note = Seed: LNVIVHSATGFKQSSKALQRPVASD
LNVIVHSATGYKQASLALLRPVASD

SEQ ID NO: 8896 - protein, 25 aa, synthetic construct
  source 1..25: note = Seed: LNVIVHSATGFKQSSKALQRPVASD
LNVIVHSATGYKQASLALMRPVASD

SEQ ID NO: 8897 - protein, 25 aa, synthetic construct
  source 1..25: note = Seed: LNVIVHSATGFKQSSKALQRPVASD
LNVIVHSATGYKQASLALNRPVASD

SEQ ID NO: 8898 - protein, 25 aa, synthetic construct
  source 1..25: note = Seed: LNVIVHSATGFKQSSKALQRPVASD
LNVIVHSATGYKQASLALQRPVASD

SEQ ID NO: 8899 - protein, 25 aa, synthetic construct
  source 1..25: note = Seed: LNVIVHSATGFKQSSKALQRPVASD
LNVIVHSATGYKQASLALSRPVASD

SEQ ID NO: 8900 - protein, 25 aa, synthetic construct
  source 1..25: note = Seed: LNVIVHSATGFKQSSKALQRPVASD
LNVIVHSATGYKQASLALTRPVASD

SEQ ID NO: 8901 - protein, 25 aa, synthetic construct
  source 1..25: note = Seed: LNVIVHSATGFKQSSKALQRPVASD
LNVIVHSATGYKQASLALVRPVASD

SEQ ID NO: 8902 - protein, 25 aa, synthetic construct
  source 1..25: note = Seed: LNVIVHSATGFKQSSKALQRPVASD
LNVIVHSATGYKQASMALARPVASD

SEQ ID NO: 8903 - protein, 25 aa, synthetic construct
  source 1..25: note = Seed: LNVIVHSATGFKQSSKALQRPVASD
LNVIVHSATGYKQASMALGRPVASD

SEQ ID NO: 8904 - protein, 25 aa, synthetic construct
  source 1..25: note = Seed: LNVIVHSATGFKQSSKALQRPVASD
LNVIVHSATGYKQASMALHRPVASD

SEQ ID NO: 8905 - protein, 25 aa, synthetic construct
  source 1..25: note = Seed: LNVIVHSATGFKQSSKALQRPVASD
LNVIVHSATGYKQASMALIRPVASD

SEQ ID NO: 8906 - protein, 25 aa, synthetic construct
  source 1..25: note = Seed: LNVIVHSATGFKQSSKALQRPVASD
LNVIVHSATGYKQASMALLRPVASD

SEQ ID NO: 8907 - protein, 25 aa, synthetic construct
  source 1..25: note = Seed: LNVIVHSATGFKQSSKALQRPVASD
LNVIVHSATGYKQASMALMRPVASD

SEQ ID NO: 8908 - protein, 25 aa, synthetic construct
  source 1..25: note = Seed: LNVIVHSATGFKQSSKALQRPVASD
LNVIVHSATGYKQASMALNRPVASD

SEQ ID NO: 8909 - protein, 25 aa, synthetic construct
  source 1..25: note = Seed: LNVIVHSATGFKQSSKALQRPVASD
LNVIVHSATGYKQASMALQRPVASD

SEQ ID NO: 8910 - protein, 25 aa, synthetic construct
  source 1..25: note = Seed: LNVIVHSATGFKQSSKALQRPVASD
LNVIVHSATGYKQASMALSRPVASD

SEQ ID NO: 8911 - protein, 25 aa, synthetic construct
  source 1..25: note = Seed: LNVIVHSATGFKQSSKALQRPVASD
LNVIVHSATGYKQASMALTRPVASD

SEQ ID NO: 8912 - protein, 25 aa, synthetic construct
  source 1..25: note = Seed: LNVIVHSATGFKQSSKALQRPVASD
LNVIVHSATGYKQASMALVRPVASD

SEQ ID NO: 8913 - protein, 25 aa, synthetic construct
  source 1..25: note = Seed: LNVIVHSATGFKQSSKALQRPVASD
LNVIVHSATGYKQASNALARPVASD

SEQ ID NO: 8914 - protein, 25 aa, synthetic construct
  source 1..25: note = Seed: LNVIVHSATGFKQSSKALQRPVASD
LNVIVHSATGYKQASNALGRPVASD

SEQ ID NO: 8915 - protein, 25 aa, synthetic construct
  source 1..25: note = Seed: LNVIVHSATGFKQSSKALQRPVASD
LNVIVHSATGYKQASNALIRPVASD

SEQ ID NO: 8916 - protein, 25 aa, synthetic construct
  source 1..25: note = Seed: LNVIVHSATGFKQSSKALQRPVASD
LNVIVHSATGYKQASNALLRPVASD

SEQ ID NO: 8917 - protein, 25 aa, synthetic construct
  source 1..25: note = Seed: LNVIVHSATGFKQSSKALQRPVASD
LNVIVHSATGYKQASNALMRPVASD

SEQ ID NO: 8918 - protein, 25 aa, synthetic construct
  source 1..25: note = Seed: LNVIVHSATGFKQSSKALQRPVASD
LNVIVHSATGYKQASNALNRPVASD

SEQ ID NO: 8919 - protein, 25 aa, synthetic construct
  source 1..25: note = Seed: LNVIVHSATGFKQSSKALQRPVASD
LNVIVHSATGYKQASNALQRPVASD

SEQ ID NO: 8920 - protein, 25 aa, synthetic construct
  source 1..25: note = Seed: LNVIVHSATGFKQSSKALQRPVASD
LNVIVHSATGYKQASNALSRPVASD

SEQ ID NO: 8921 - protein, 25 aa, synthetic construct
  source 1..25: note = Seed: LNVIVHSATGFKQSSKALQRPVASD
LNVIVHSATGYKQASNALTRPVASD

SEQ ID NO: 8922 - protein, 25 aa, synthetic construct
  source 1..25: note = Seed: LNVIVHSATGFKQSSKALQRPVASD
LNVIVHSATGYKQASNALVRPVASD

SEQ ID NO: 8923 - protein, 25 aa, synthetic construct
  source 1..25: note = Seed: LNVIVHSATGFKQSSKALQRPVASD
LNVIVHSATGYKQASPALARPVASD

SEQ ID NO: 8924 - protein, 25 aa, synthetic construct
  source 1..25: note = Seed: LNVIVHSATGFKQSSKALQRPVASD
LNVIVHSATGYKQASPALCRPVASD

SEQ ID NO: 8925 - protein, 25 aa, synthetic construct
  source 1..25: note = Seed: LNVIVHSATGFKQSSKALQRPVASD
LNVIVHSATGYKQASPALDRPVASD

SEQ ID NO: 8926 - protein, 25 aa, synthetic construct
  source 1..25: note = Seed: LNVIVHSATGFKQSSKALQRPVASD
LNVIVHSATGYKQASPALERPVASD

SEQ ID NO: 8927 - protein, 25 aa, synthetic construct
  source 1..25: note = Seed: LNVIVHSATGFKQSSKALQRPVASD
LNVIVHSATGYKQASPALFRPVASD

SEQ ID NO: 8928 - protein, 25 aa, synthetic construct
  source 1..25: note = Seed: LNVIVHSATGFKQSSKALQRPVASD
LNVIVHSATGYKQASPALGRPVASD

SEQ ID NO: 8929 - protein, 25 aa, synthetic construct
  source 1..25: note = Seed: LNVIVHSATGFKQSSKALQRPVASD
LNVIVHSATGYKQASPALHRPVASD

SEQ ID NO: 8930 - protein, 25 aa, synthetic construct
  source 1..25: note = Seed: LNVIVHSATGFKQSSKALQRPVASD
LNVIVHSATGYKQASPALIRPVASD

SEQ ID NO: 8931 - protein, 25 aa, synthetic construct
  source 1..25: note = Seed: LNVIVHSATGFKQSSKALQRPVASD
LNVIVHSATGYKQASPALLRPVASD

SEQ ID NO: 8932 - protein, 25 aa, synthetic construct
  source 1..25: note = Seed: LNVIVHSATGFKQSSKALQRPVASD
LNVIVHSATGYKQASPALMRPVASD

SEQ ID NO: 8933 - protein, 25 aa, synthetic construct
  source 1..25: note = Seed: LNVIVHSATGFKQSSKALQRPVASD
LNVIVHSATGYKQASPALNRPVASD

SEQ ID NO: 8934 - protein, 25 aa, synthetic construct
  source 1..25: note = Seed: LNVIVHSATGFKQSSKALQRPVASD
LNVIVHSATGYKQASPALPRPVASD

SEQ ID NO: 8935 - protein, 25 aa, synthetic construct
  source 1..25: note = Seed: LNVIVHSATGFKQSSKALQRPVASD
LNVIVHSATGYKQASPALQRPVASD

SEQ ID NO: 8936 - protein, 25 aa, synthetic construct
  source 1..25: note = Seed: LNVIVHSATGFKQSSKALQRPVASD
LNVIVHSATGYKQASPALSRPVASD

SEQ ID NO: 8937 - protein, 25 aa, synthetic construct
  source 1..25: note = Seed: LNVIVHSATGFKQSSKALQRPVASD
LNVIVHSATGYKQASPALTRPVASD

SEQ ID NO: 8938 - protein, 25 aa, synthetic construct
  source 1..25: note = Seed: LNVIVHSATGFKQSSKALQRPVASD
LNVIVHSATGYKQASPALVRPVASD

SEQ ID NO: 8939 - protein, 25 aa, synthetic construct
  source 1..25: note = Seed: LNVIVHSATGFKQSSKALQRPVASD
LNVIVHSATGYKQASPALWRPVASD

SEQ ID NO: 8940 - protein, 25 aa, synthetic construct
  source 1..25: note = Seed: LNVIVHSATGFKQSSKALQRPVASD
LNVIVHSATGYKQASPALYRPVASD

SEQ ID NO: 8941 - protein, 25 aa, synthetic construct
  source 1..25: note = Seed: LNVIVHSATGFKQSSKALQRPVASD
LNVIVHSATGYKQASQALARPVASD

SEQ ID NO: 8942 - protein, 25 aa, synthetic construct
  source 1..25: note = Seed: LNVIVHSATGFKQSSKALQRPVASD
LNVIVHSATGYKQASQALIRPVASD

SEQ ID NO: 8943 - protein, 25 aa, synthetic construct
  source 1..25: note = Seed: LNVIVHSATGFKQSSKALQRPVASD
LNVIVHSATGYKQASQALLRPVASD

SEQ ID NO: 8944 - protein, 25 aa, synthetic construct
  source 1..25: note = Seed: LNVIVHSATGFKQSSKALQRPVASD
LNVIVHSATGYKQASQALNRPVASD

SEQ ID NO: 8945 - protein, 25 aa, synthetic construct
  source 1..25: note = Seed: LNVIVHSATGFKQSSKALQRPVASD
LNVIVHSATGYKQASQALSRPVASD

SEQ ID NO: 8946 - protein, 25 aa, synthetic construct
  source 1..25: note = Seed: LNVIVHSATGFKQSSKALQRPVASD
LNVIVHSATGYKQASQALVRPVASD

SEQ ID NO: 8947 - protein, 25 aa, synthetic construct
  source 1..25: note = Seed: LNVIVHSATGFKQSSKALQRPVASD
LNVIVHSATGYKQASRALARPVASD

SEQ ID NO: 8948 - protein, 25 aa, synthetic construct
  source 1..25: note = Seed: LNVIVHSATGFKQSSKALQRPVASD
LNVIVHSATGYKQASRALGRPVASD

SEQ ID NO: 8949 - protein, 25 aa, synthetic construct
  source 1..25: note = Seed: LNVIVHSATGFKQSSKALQRPVASD
LNVIVHSATGYKQASRALHRPVASD

SEQ ID NO: 8950 - protein, 25 aa, synthetic construct
  source 1..25: note = Seed: LNVIVHSATGFKQSSKALQRPVASD
LNVIVHSATGYKQASRALIRPVASD

SEQ ID NO: 8951 - protein, 25 aa, synthetic construct
  source 1..25: note = Seed: LNVIVHSATGFKQSSKALQRPVASD
LNVIVHSATGYKQASRALKRPVASD

SEQ ID NO: 8952 - protein, 25 aa, synthetic construct
  source 1..25: note = Seed: LNVIVHSATGFKQSSKALQRPVASD
LNVIVHSATGYKQASRALLRPVASD

SEQ ID NO: 8953 - protein, 25 aa, synthetic construct
  source 1..25: note = Seed: LNVIVHSATGFKQSSKALQRPVASD
LNVIVHSATGYKQASRALMRPVASD

SEQ ID NO: 8954 - protein, 25 aa, synthetic construct
  source 1..25: note = Seed: LNVIVHSATGFKQSSKALQRPVASD
LNVIVHSATGYKQASRALNRPVASD

SEQ ID NO: 8955 - protein, 25 aa, synthetic construct
  source 1..25: note = Seed: LNVIVHSATGFKQSSKALQRPVASD
LNVIVHSATGYKQASRALPRPVASD

SEQ ID NO: 8956 - protein, 25 aa, synthetic construct
  source 1..25: note = Seed: LNVIVHSATGFKQSSKALQRPVASD
LNVIVHSATGYKQASRALQRPVASD

SEQ ID NO: 8957 - protein, 25 aa, synthetic construct
  source 1..25: note = Seed: LNVIVHSATGFKQSSKALQRPVASD
LNVIVHSATGYKQASRALRRPVASD

SEQ ID NO: 8958 - protein, 25 aa, synthetic construct
  source 1..25: note = Seed: LNVIVHSATGFKQSSKALQRPVASD
LNVIVHSATGYKQASRALSRPVASD

SEQ ID NO: 8959 - protein, 25 aa, synthetic construct
  source 1..25: note = Seed: LNVIVHSATGFKQSSKALQRPVASD
LNVIVHSATGYKQASRALTRPVASD

SEQ ID NO: 8960 - protein, 25 aa, synthetic construct
  source 1..25: note = Seed: LNVIVHSATGFKQSSKALQRPVASD
LNVIVHSATGYKQASRALVRPVASD

SEQ ID NO: 8961 - protein, 25 aa, synthetic construct
  source 1..25: note = Seed: LNVIVHSATGFKQSSKALQRPVASD
LNVIVHSATGYKQASRALYRPVASD

SEQ ID NO: 8962 - protein, 25 aa, synthetic construct
  source 1..25: note = Seed: LNVIVHSATGFKQSSKALQRPVASD
LNVIVHSATGYKQASSALARPVASD

SEQ ID NO: 8963 - protein, 25 aa, synthetic construct
  source 1..25: note = Seed: LNVIVHSATGFKQSSKALQRPVASD
LNVIVHSATGYKQASSALCRPVASD

SEQ ID NO: 8964 - protein, 25 aa, synthetic construct
  source 1..25: note = Seed: LNVIVHSATGFKQSSKALQRPVASD
LNVIVHSATGYKQASSALDRPVASD

SEQ ID NO: 8965 - protein, 25 aa, synthetic construct
  source 1..25: note = Seed: LNVIVHSATGFKQSSKALQRPVASD
LNVIVHSATGYKQASSALERPVASD

SEQ ID NO: 8966 - protein, 25 aa, synthetic construct
  source 1..25: note = Seed: LNVIVHSATGFKQSSKALQRPVASD
LNVIVHSATGYKQASSALFRPVASD

SEQ ID NO: 8967 - protein, 25 aa, synthetic construct
  source 1..25: note = Seed: LNVIVHSATGFKQSSKALQRPVASD
LNVIVHSATGYKQASSALGRPVASD

SEQ ID NO: 8968 - protein, 25 aa, synthetic construct
  source 1..25: note = Seed: LNVIVHSATGFKQSSKALQRPVASD
LNVIVHSATGYKQASSALHRPVASD

SEQ ID NO: 8969 - protein, 25 aa, synthetic construct
  source 1..25: note = Seed: LNVIVHSATGFKQSSKALQRPVASD
LNVIVHSATGYKQASSALIRPVASD

SEQ ID NO: 8970 - protein, 25 aa, synthetic construct
  source 1..25: note = Seed: LNVIVHSATGFKQSSKALQRPVASD
LNVIVHSATGYKQASSALLRPVASD

SEQ ID NO: 8971 - protein, 25 aa, synthetic construct
  source 1..25: note = Seed: LNVIVHSATGFKQSSKALQRPVASD
LNVIVHSATGYKQASSALMRPVASD

SEQ ID NO: 8972 - protein, 25 aa, synthetic construct
  source 1..25: note = Seed: LNVIVHSATGFKQSSKALQRPVASD
LNVIVHSATGYKQASSALNRPVASD

SEQ ID NO: 8973 - protein, 25 aa, synthetic construct
  source 1..25: note = Seed: LNVIVHSATGFKQSSKALQRPVASD
LNVIVHSATGYKQASSALPRPVASD

SEQ ID NO: 8974 - protein, 25 aa, synthetic construct
  source 1..25: note = Seed: LNVIVHSATGFKQSSKALQRPVASD
LNVIVHSATGYKQASSALQRPVASD

SEQ ID NO: 8975 - protein, 25 aa, synthetic construct
  source 1..25: note = Seed: LNVIVHSATGFKQSSKALQRPVASD
LNVIVHSATGYKQASSALSRPVASD

SEQ ID NO: 8976 - protein, 25 aa, synthetic construct
  source 1..25: note = Seed: LNVIVHSATGFKQSSKALQRPVASD
LNVIVHSATGYKQASSALTRPVASD

SEQ ID NO: 8977 - protein, 25 aa, synthetic construct
  source 1..25: note = Seed: LNVIVHSATGFKQSSKALQRPVASD
LNVIVHSATGYKQASSALVRPVASD

SEQ ID NO: 8978 - protein, 25 aa, synthetic construct
  source 1..25: note = Seed: LNVIVHSATGFKQSSKALQRPVASD
LNVIVHSATGYKQASSALYRPVASD

SEQ ID NO: 8979 - protein, 25 aa, synthetic construct
  source 1..25: note = Seed: LNVIVHSATGFKQSSKALQRPVASD
LNVIVHSATGYKQASTALARPVASD

SEQ ID NO: 8980 - protein, 25 aa, synthetic construct
  source 1..25: note = Seed: LNVIVHSATGFKQSSKALQRPVASD
LNVIVHSATGYKQASTALERPVASD

SEQ ID NO: 8981 - protein, 25 aa, synthetic construct
  source 1..25: note = Seed: LNVIVHSATGFKQSSKALQRPVASD
LNVIVHSATGYKQASTALFRPVASD

SEQ ID NO: 8982 - protein, 25 aa, synthetic construct
  source 1..25: note = Seed: LNVIVHSATGFKQSSKALQRPVASD
LNVIVHSATGYKQASTALGRPVASD

SEQ ID NO: 8983 - protein, 25 aa, synthetic construct
  source 1..25: note = Seed: LNVIVHSATGFKQSSKALQRPVASD
LNVIVHSATGYKQASTALHRPVASD

SEQ ID NO: 8984 - protein, 25 aa, synthetic construct
  source 1..25: note = Seed: LNVIVHSATGFKQSSKALQRPVASD
LNVIVHSATGYKQASTALIRPVASD

SEQ ID NO: 8985 - protein, 25 aa, synthetic construct
  source 1..25: note = Seed: LNVIVHSATGFKQSSKALQRPVASD
LNVIVHSATGYKQASTALLRPVASD

SEQ ID NO: 8986 - protein, 25 aa, synthetic construct
  source 1..25: note = Seed: LNVIVHSATGFKQSSKALQRPVASD
LNVIVHSATGYKQASTALMRPVASD

SEQ ID NO: 8987 - protein, 25 aa, synthetic construct
  source 1..25: note = Seed: LNVIVHSATGFKQSSKALQRPVASD
LNVIVHSATGYKQASTALNRPVASD

SEQ ID NO: 8988 - protein, 25 aa, synthetic construct
  source 1..25: note = Seed: LNVIVHSATGFKQSSKALQRPVASD
LNVIVHSATGYKQASTALPRPVASD

SEQ ID NO: 8989 - protein, 25 aa, synthetic construct
  source 1..25: note = Seed: LNVIVHSATGFKQSSKALQRPVASD
LNVIVHSATGYKQASTALQRPVASD

SEQ ID NO: 8990 - protein, 25 aa, synthetic construct
  source 1..25: note = Seed: LNVIVHSATGFKQSSKALQRPVASD
LNVIVHSATGYKQASTALSRPVASD

SEQ ID NO: 8991 - protein, 25 aa, synthetic construct
  source 1..25: note = Seed: LNVIVHSATGFKQSSKALQRPVASD
LNVIVHSATGYKQASTALTRPVASD

SEQ ID NO: 8992 - protein, 25 aa, synthetic construct
  source 1..25: note = Seed: LNVIVHSATGFKQSSKALQRPVASD
LNVIVHSATGYKQASTALVRPVASD

SEQ ID NO: 8993 - protein, 25 aa, synthetic construct
  source 1..25: note = Seed: LNVIVHSATGFKQSSKALQRPVASD
LNVIVHSATGYKQASTALYRPVASD

SEQ ID NO: 8994 - protein, 25 aa, synthetic construct
  source 1..25: note = Seed: LNVIVHSATGFKQSSKALQRPVASD
LNVIVHSATGYKQASVALARPVASD

SEQ ID NO: 8995 - protein, 25 aa, synthetic construct
  source 1..25: note = Seed: LNVIVHSATGFKQSSKALQRPVASD
LNVIVHSATGYKQASVALCRPVASD

SEQ ID NO: 8996 - protein, 25 aa, synthetic construct
  source 1..25: note = Seed: LNVIVHSATGFKQSSKALQRPVASD
LNVIVHSATGYKQASVALDRPVASD

SEQ ID NO: 8997 - protein, 25 aa, synthetic construct
  source 1..25: note = Seed: LNVIVHSATGFKQSSKALQRPVASD
LNVIVHSATGYKQASVALERPVASD

SEQ ID NO: 8998 - protein, 25 aa, synthetic construct
  source 1..25: note = Seed: LNVIVHSATGFKQSSKALQRPVASD
LNVIVHSATGYKQASVALFRPVASD

SEQ ID NO: 8999 - protein, 25 aa, synthetic construct
  source 1..25: note = Seed: LNVIVHSATGFKQSSKALQRPVASD
LNVIVHSATGYKQASVALGRPVASD

SEQ ID NO: 9000 - protein, 25 aa, synthetic construct
  source 1..25: note = Seed: LNVIVHSATGFKQSSKALQRPVASD
LNVIVHSATGYKQASVALHRPVASD

SEQ ID NO: 9001 - protein, 25 aa, synthetic construct
  source 1..25: note = Seed: LNVIVHSATGFKQSSKALQRPVASD
LNVIVHSATGYKQASVALIRPVASD

SEQ ID NO: 9002 - protein, 25 aa, synthetic construct
  source 1..25: note = Seed: LNVIVHSATGFKQSSKALQRPVASD
LNVIVHSATGYKQASVALLRPVASD

SEQ ID NO: 9003 - protein, 25 aa, synthetic construct
  source 1..25: note = Seed: LNVIVHSATGFKQSSKALQRPVASD
LNVIVHSATGYKQASVALMRPVASD

SEQ ID NO: 9004 - protein, 25 aa, synthetic construct
  source 1..25: note = Seed: LNVIVHSATGFKQSSKALQRPVASD
LNVIVHSATGYKQASVALNRPVASD

SEQ ID NO: 9005 - protein, 25 aa, synthetic construct
  source 1..25: note = Seed: LNVIVHSATGFKQSSKALQRPVASD
LNVIVHSATGYKQASVALPRPVASD

SEQ ID NO: 9006 - protein, 25 aa, synthetic construct
  source 1..25: note = Seed: LNVIVHSATGFKQSSKALQRPVASD
LNVIVHSATGYKQASVALQRPVASD

SEQ ID NO: 9007 - protein, 25 aa, synthetic construct
  source 1..25: note = Seed: LNVIVHSATGFKQSSKALQRPVASD
LNVIVHSATGYKQASVALSRPVASD

SEQ ID NO: 9008 - protein, 25 aa, synthetic construct
  source 1..25: note = Seed: LNVIVHSATGFKQSSKALQRPVASD
LNVIVHSATGYKQASVALTRPVASD

SEQ ID NO: 9009 - protein, 25 aa, synthetic construct
  source 1..25: note = Seed: LNVIVHSATGFKQSSKALQRPVASD
LNVIVHSATGYKQASVALVRPVASD

SEQ ID NO: 9010 - protein, 25 aa, synthetic construct
  source 1..25: note = Seed: LNVIVHSATGFKQSSKALQRPVASD
LNVIVHSATGYKQASVALYRPVASD

SEQ ID NO: 9011 - protein, 25 aa, synthetic construct
  source 1..25: note = Seed: LNVIVHSATGFKQSSKALQRPVASD
LNVIVHSATGYKQASWALARPVASD

SEQ ID NO: 9012 - protein, 25 aa, synthetic construct
  source 1..25: note = Seed: LNVIVHSATGFKQSSKALQRPVASD
LNVIVHSATGYKQASWALIRPVASD

SEQ ID NO: 9013 - protein, 25 aa, synthetic construct
  source 1..25: note = Seed: LNVIVHSATGFKQSSKALQRPVASD
LNVIVHSATGYKQASWALVRPVASD

SEQ ID NO: 9014 - protein, 25 aa, synthetic construct
  source 1..25: note = Seed: LNVIVHSATGFKQSSKALQRPVASD
LNVIVHSATGYKQCSAALARPVASD

SEQ ID NO: 9015 - protein, 25 aa, synthetic construct
  source 1..25: note = Seed: LNVIVHSATGFKQSSKALQRPVASD
LNVIVHSATGYKQCSAALGRPVASD

SEQ ID NO: 9016 - protein, 25 aa, synthetic construct
  source 1..25: note = Seed: LNVIVHSATGFKQSSKALQRPVASD
LNVIVHSATGYKQCSAALIRPVASD

SEQ ID NO: 9017 - protein, 25 aa, synthetic construct
  source 1..25: note = Seed: LNVIVHSATGFKQSSKALQRPVASD
LNVIVHSATGYKQCSAALLRPVASD

SEQ ID NO: 9018 - protein, 25 aa, synthetic construct
  source 1..25: note = Seed: LNVIVHSATGFKQSSKALQRPVASD
LNVIVHSATGYKQCSAALMRPVASD

SEQ ID NO: 9019 - protein, 25 aa, synthetic construct
  source 1..25: note = Seed: LNVIVHSATGFKQSSKALQRPVASD
LNVIVHSATGYKQCSAALSRPVASD

SEQ ID NO: 9020 - protein, 25 aa, synthetic construct
  source 1..25: note = Seed: LNVIVHSATGFKQSSKALQRPVASD
LNVIVHSATGYKQCSAALTRPVASD

SEQ ID NO: 9021 - protein, 25 aa, synthetic construct
  source 1..25: note = Seed: LNVIVHSATGFKQSSKALQRPVASD
LNVIVHSATGYKQCSAALVRPVASD

SEQ ID NO: 9022 - protein, 25 aa, synthetic construct
  source 1..25: note = Seed: LNVIVHSATGFKQSSKALQRPVASD
LNVIVHSATGYKQCSFALIRPVASD

SEQ ID NO: 9023 - protein, 25 aa, synthetic construct
  source 1..25: note = Seed: LNVIVHSATGFKQSSKALQRPVASD
LNVIVHSATGYKQCSFALSRPVASD

SEQ ID NO: 9024 - protein, 25 aa, synthetic construct
  source 1..25: note = Seed: LNVIVHSATGFKQSSKALQRPVASD
LNVIVHSATGYKQCSGALARPVASD

SEQ ID NO: 9025 - protein, 25 aa, synthetic construct
  source 1..25: note = Seed: LNVIVHSATGFKQSSKALQRPVASD
LNVIVHSATGYKQCSGALIRPVASD

SEQ ID NO: 9026 - protein, 25 aa, synthetic construct
  source 1..25: note = Seed: LNVIVHSATGFKQSSKALQRPVASD
LNVIVHSATGYKQCSGALLRPVASD

SEQ ID NO: 9027 - protein, 25 aa, synthetic construct
  source 1..25: note = Seed: LNVIVHSATGFKQSSKALQRPVASD
LNVIVHSATGYKQCSGALVRPVASD

SEQ ID NO: 9028 - protein, 25 aa, synthetic construct
  source 1..25: note = Seed: LNVIVHSATGFKQSSKALQRPVASD
LNVIVHSATGYKQCSIALARPVASD

SEQ ID NO: 9029 - protein, 25 aa, synthetic construct
  source 1..25: note = Seed: LNVIVHSATGFKQSSKALQRPVASD
LNVIVHSATGYKQCSIALIRPVASD

SEQ ID NO: 9030 - protein, 25 aa, synthetic construct
  source 1..25: note = Seed: LNVIVHSATGFKQSSKALQRPVASD
LNVIVHSATGYKQCSIALLRPVASD

SEQ ID NO: 9031 - protein, 25 aa, synthetic construct
  source 1..25: note = Seed: LNVIVHSATGFKQSSKALQRPVASD
LNVIVHSATGYKQCSIALMRPVASD

SEQ ID NO: 9032 - protein, 25 aa, synthetic construct
  source 1..25: note = Seed: LNVIVHSATGFKQSSKALQRPVASD
LNVIVHSATGYKQCSIALSRPVASD

SEQ ID NO: 9033 - protein, 25 aa, synthetic construct
  source 1..25: note = Seed: LNVIVHSATGFKQSSKALQRPVASD
LNVIVHSATGYKQCSLALARPVASD

SEQ ID NO: 9034 - protein, 25 aa, synthetic construct
  source 1..25: note = Seed: LNVIVHSATGFKQSSKALQRPVASD
LNVIVHSATGYKQCSLALMRPVASD

SEQ ID NO: 9035 - protein, 25 aa, synthetic construct
  source 1..25: note = Seed: LNVIVHSATGFKQSSKALQRPVASD
LNVIVHSATGYKQCSLALSRPVASD

SEQ ID NO: 9036 - protein, 25 aa, synthetic construct
  source 1..25: note = Seed: LNVIVHSATGFKQSSKALQRPVASD
LNVIVHSATGYKQCSMALMRPVASD

SEQ ID NO: 9037 - protein, 25 aa, synthetic construct
  source 1..25: note = Seed: LNVIVHSATGFKQSSKALQRPVASD
LNVIVHSATGYKQCSMALSRPVASD

SEQ ID NO: 9038 - protein, 25 aa, synthetic construct
  source 1..25: note = Seed: LNVIVHSATGFKQSSKALQRPVASD
LNVIVHSATGYKQCSPALARPVASD

SEQ ID NO: 9039 - protein, 25 aa, synthetic construct
  source 1..25: note = Seed: LNVIVHSATGFKQSSKALQRPVASD
LNVIVHSATGYKQCSPALIRPVASD

SEQ ID NO: 9040 - protein, 25 aa, synthetic construct
  source 1..25: note = Seed: LNVIVHSATGFKQSSKALQRPVASD
LNVIVHSATGYKQCSPALLRPVASD

SEQ ID NO: 9041 - protein, 25 aa, synthetic construct
  source 1..25: note = Seed: LNVIVHSATGFKQSSKALQRPVASD
LNVIVHSATGYKQCSPALVRPVASD

SEQ ID NO: 9042 - protein, 25 aa, synthetic construct
  source 1..25: note = Seed: LNVIVHSATGFKQSSKALQRPVASD
LNVIVHSATGYKQCSRALARPVASD

SEQ ID NO: 9043 - protein, 25 aa, synthetic construct
  source 1..25: note = Seed: LNVIVHSATGFKQSSKALQRPVASD
LNVIVHSATGYKQCSRALSRPVASD

SEQ ID NO: 9044 - protein, 25 aa, synthetic construct
  source 1..25: note = Seed: LNVIVHSATGFKQSSKALQRPVASD
LNVIVHSATGYKQCSSALARPVASD

SEQ ID NO: 9045 - protein, 25 aa, synthetic construct
  source 1..25: note = Seed: LNVIVHSATGFKQSSKALQRPVASD
LNVIVHSATGYKQCSSALIRPVASD

SEQ ID NO: 9046 - protein, 25 aa, synthetic construct
  source 1..25: note = Seed: LNVIVHSATGFKQSSKALQRPVASD
LNVIVHSATGYKQCSSALLRPVASD

SEQ ID NO: 9047 - protein, 25 aa, synthetic construct
  source 1..25: note = Seed: LNVIVHSATGFKQSSKALQRPVASD
LNVIVHSATGYKQCSSALVRPVASD

SEQ ID NO: 9048 - protein, 25 aa, synthetic construct
  source 1..25: note = Seed: LNVIVHSATGFKQSSKALQRPVASD
LNVIVHSATGYKQCSTALARPVASD

SEQ ID NO: 9049 - protein, 25 aa, synthetic construct
  source 1..25: note = Seed: LNVIVHSATGFKQSSKALQRPVASD
LNVIVHSATGYKQCSVALARPVASD

SEQ ID NO: 9050 - protein, 25 aa, synthetic construct
  source 1..25: note = Seed: LNVIVHSATGFKQSSKALQRPVASD
LNVIVHSATGYKQCSVALMRPVASD

SEQ ID NO: 9051 - protein, 25 aa, synthetic construct
  source 1..25: note = Seed: LNVIVHSATGFKQSSKALQRPVASD
LNVIVHSATGYKQDSIALARPVASD

SEQ ID NO: 9052 - protein, 25 aa, synthetic construct
  source 1..25: note = Seed: LNVIVHSATGFKQSSKALQRPVASD
LNVIVHSATGYKQDSIALIRPVASD

SEQ ID NO: 9053 - protein, 25 aa, synthetic construct
  source 1..25: note = Seed: LNVIVHSATGFKQSSKALQRPVASD
LNVIVHSATGYKQESAALARPVASD

SEQ ID NO: 9054 - protein, 25 aa, synthetic construct
  source 1..25: note = Seed: LNVIVHSATGFKQSSKALQRPVASD
LNVIVHSATGYKQESAALGRPVASD

SEQ ID NO: 9055 - protein, 25 aa, synthetic construct
  source 1..25: note = Seed: LNVIVHSATGFKQSSKALQRPVASD
LNVIVHSATGYKQESAALIRPVASD

SEQ ID NO: 9056 - protein, 25 aa, synthetic construct
  source 1..25: note = Seed: LNVIVHSATGFKQSSKALQRPVASD
LNVIVHSATGYKQESAALLRPVASD

SEQ ID NO: 9057 - protein, 25 aa, synthetic construct
  source 1..25: note = Seed: LNVIVHSATGFKQSSKALQRPVASD
LNVIVHSATGYKQESAALMRPVASD

SEQ ID NO: 9058 - protein, 25 aa, synthetic construct
  source 1..25: note = Seed: LNVIVHSATGFKQSSKALQRPVASD
LNVIVHSATGYKQESAALNRPVASD

SEQ ID NO: 9059 - protein, 25 aa, synthetic construct
  source 1..25: note = Seed: LNVIVHSATGFKQSSKALQRPVASD
LNVIVHSATGYKQESAALSRPVASD

SEQ ID NO: 9060 - protein, 25 aa, synthetic construct
  source 1..25: note = Seed: LNVIVHSATGFKQSSKALQRPVASD
LNVIVHSATGYKQESAALTRPVASD

SEQ ID NO: 9061 - protein, 25 aa, synthetic construct
  source 1..25: note = Seed: LNVIVHSATGFKQSSKALQRPVASD
LNVIVHSATGYKQESAALVRPVASD

SEQ ID NO: 9062 - protein, 25 aa, synthetic construct
  source 1..25: note = Seed: LNVIVHSATGFKQSSKALQRPVASD
LNVIVHSATGYKQESFALIRPVASD

SEQ ID NO: 9063 - protein, 25 aa, synthetic construct
  source 1..25: note = Seed: LNVIVHSATGFKQSSKALQRPVASD
LNVIVHSATGYKQESFALLRPVASD

SEQ ID NO: 9064 - protein, 25 aa, synthetic construct
  source 1..25: note = Seed: LNVIVHSATGFKQSSKALQRPVASD
LNVIVHSATGYKQESFALVRPVASD

SEQ ID NO: 9065 - protein, 25 aa, synthetic construct
  source 1..25: note = Seed: LNVIVHSATGFKQSSKALQRPVASD
LNVIVHSATGYKQESGALARPVASD

SEQ ID NO: 9066 - protein, 25 aa, synthetic construct
  source 1..25: note = Seed: LNVIVHSATGFKQSSKALQRPVASD
LNVIVHSATGYKQESGALIRPVASD

SEQ ID NO: 9067 - protein, 25 aa, synthetic construct
  source 1..25: note = Seed: LNVIVHSATGFKQSSKALQRPVASD
LNVIVHSATGYKQESGALLRPVASD

SEQ ID NO: 9068 - protein, 25 aa, synthetic construct
  source 1..25: note = Seed: LNVIVHSATGFKQSSKALQRPVASD
LNVIVHSATGYKQESGALMRPVASD

SEQ ID NO: 9069 - protein, 25 aa, synthetic construct
  source 1..25: note = Seed: LNVIVHSATGFKQSSKALQRPVASD
LNVIVHSATGYKQESGALSRPVASD

SEQ ID NO: 9070 - protein, 25 aa, synthetic construct
  source 1..25: note = Seed: LNVIVHSATGFKQSSKALQRPVASD
LNVIVHSATGYKQESGALTRPVASD

SEQ ID NO: 9071 - protein, 25 aa, synthetic construct
  source 1..25: note = Seed: LNVIVHSATGFKQSSKALQRPVASD
LNVIVHSATGYKQESGALVRPVASD

SEQ ID NO: 9072 - protein, 25 aa, synthetic construct
  source 1..25: note = Seed: LNVIVHSATGFKQSSKALQRPVASD
LNVIVHSATGYKQESIALARPVASD

SEQ ID NO: 9073 - protein, 25 aa, synthetic construct
  source 1..25: note = Seed: LNVIVHSATGFKQSSKALQRPVASD
LNVIVHSATGYKQESIALIRPVASD

SEQ ID NO: 9074 - protein, 25 aa, synthetic construct
  source 1..25: note = Seed: LNVIVHSATGFKQSSKALQRPVASD
LNVIVHSATGYKQESIALLRPVASD

SEQ ID NO: 9075 - protein, 25 aa, synthetic construct
  source 1..25: note = Seed: LNVIVHSATGFKQSSKALQRPVASD
LNVIVHSATGYKQESIALMRPVASD

SEQ ID NO: 9076 - protein, 25 aa, synthetic construct
  source 1..25: note = Seed: LNVIVHSATGFKQSSKALQRPVASD
LNVIVHSATGYKQESIALNRPVASD

SEQ ID NO: 9077 - protein, 25 aa, synthetic construct
  source 1..25: note = Seed: LNVIVHSATGFKQSSKALQRPVASD
LNVIVHSATGYKQESIALQRPVASD

SEQ ID NO: 9078 - protein, 25 aa, synthetic construct
  source 1..25: note = Seed: LNVIVHSATGFKQSSKALQRPVASD
LNVIVHSATGYKQESIALSRPVASD

SEQ ID NO: 9079 - protein, 25 aa, synthetic construct
  source 1..25: note = Seed: LNVIVHSATGFKQSSKALQRPVASD
LNVIVHSATGYKQESIALTRPVASD

SEQ ID NO: 9080 - protein, 25 aa, synthetic construct
  source 1..25: note = Seed: LNVIVHSATGFKQSSKALQRPVASD
LNVIVHSATGYKQESIALVRPVASD

SEQ ID NO: 9081 - protein, 25 aa, synthetic construct
  source 1..25: note = Seed: LNVIVHSATGFKQSSKALQRPVASD
LNVIVHSATGYKQESLALARPVASD

SEQ ID NO: 9082 - protein, 25 aa, synthetic construct
  source 1..25: note = Seed: LNVIVHSATGFKQSSKALQRPVASD
LNVIVHSATGYKQESLALIRPVASD

SEQ ID NO: 9083 - protein, 25 aa, synthetic construct
  source 1..25: note = Seed: LNVIVHSATGFKQSSKALQRPVASD
LNVIVHSATGYKQESLALSRPVASD

SEQ ID NO: 9084 - protein, 25 aa, synthetic construct
  source 1..25: note = Seed: LNVIVHSATGFKQSSKALQRPVASD
LNVIVHSATGYKQESMALARPVASD

SEQ ID NO: 9085 - protein, 25 aa, synthetic construct
  source 1..25: note = Seed: LNVIVHSATGFKQSSKALQRPVASD
LNVIVHSATGYKQESNALARPVASD

SEQ ID NO: 9086 - protein, 25 aa, synthetic construct
  source 1..25: note = Seed: LNVIVHSATGFKQSSKALQRPVASD
LNVIVHSATGYKQESNALIRPVASD

SEQ ID NO: 9087 - protein, 25 aa, synthetic construct
  source 1..25: note = Seed: LNVIVHSATGFKQSSKALQRPVASD
LNVIVHSATGYKQESNALLRPVASD

SEQ ID NO: 9088 - protein, 25 aa, synthetic construct
  source 1..25: note = Seed: LNVIVHSATGFKQSSKALQRPVASD
LNVIVHSATGYKQESNALVRPVASD

SEQ ID NO: 9089 - protein, 25 aa, synthetic construct
  source 1..25: note = Seed: LNVIVHSATGFKQSSKALQRPVASD
LNVIVHSATGYKQESPALARPVASD

SEQ ID NO: 9090 - protein, 25 aa, synthetic construct
  source 1..25: note = Seed: LNVIVHSATGFKQSSKALQRPVASD
LNVIVHSATGYKQESPALIRPVASD

SEQ ID NO: 9091 - protein, 25 aa, synthetic construct
  source 1..25: note = Seed: LNVIVHSATGFKQSSKALQRPVASD
LNVIVHSATGYKQESPALLRPVASD

SEQ ID NO: 9092 - protein, 25 aa, synthetic construct
  source 1..25: note = Seed: LNVIVHSATGFKQSSKALQRPVASD
LNVIVHSATGYKQESPALMRPVASD

SEQ ID NO: 9093 - protein, 25 aa, synthetic construct
  source 1..25: note = Seed: LNVIVHSATGFKQSSKALQRPVASD
LNVIVHSATGYKQESPALNRPVASD

SEQ ID NO: 9094 - protein, 25 aa, synthetic construct
  source 1..25: note = Seed: LNVIVHSATGFKQSSKALQRPVASD
LNVIVHSATGYKQESPALSRPVASD

SEQ ID NO: 9095 - protein, 25 aa, synthetic construct
  source 1..25: note = Seed: LNVIVHSATGFKQSSKALQRPVASD
LNVIVHSATGYKQESPALVRPVASD

SEQ ID NO: 9096 - protein, 25 aa, synthetic construct
  source 1..25: note = Seed: LNVIVHSATGFKQSSKALQRPVASD
LNVIVHSATGYKQESSALARPVASD

SEQ ID NO: 9097 - protein, 25 aa, synthetic construct
  source 1..25: note = Seed: LNVIVHSATGFKQSSKALQRPVASD
LNVIVHSATGYKQESSALIRPVASD

SEQ ID NO: 9098 - protein, 25 aa, synthetic construct
  source 1..25: note = Seed: LNVIVHSATGFKQSSKALQRPVASD
LNVIVHSATGYKQESSALLRPVASD

SEQ ID NO: 9099 - protein, 25 aa, synthetic construct
  source 1..25: note = Seed: LNVIVHSATGFKQSSKALQRPVASD
LNVIVHSATGYKQESSALMRPVASD

SEQ ID NO: 9100 - protein, 25 aa, synthetic construct
  source 1..25: note = Seed: LNVIVHSATGFKQSSKALQRPVASD
LNVIVHSATGYKQESSALNRPVASD

SEQ ID NO: 9101 - protein, 25 aa, synthetic construct
  source 1..25: note = Seed: LNVIVHSATGFKQSSKALQRPVASD
LNVIVHSATGYKQESSALSRPVASD

SEQ ID NO: 9102 - protein, 25 aa, synthetic construct
  source 1..25: note = Seed: LNVIVHSATGFKQSSKALQRPVASD
LNVIVHSATGYKQESSALTRPVASD

SEQ ID NO: 9103 - protein, 25 aa, synthetic construct
  source 1..25: note = Seed: LNVIVHSATGFKQSSKALQRPVASD
LNVIVHSATGYKQESSALVRPVASD

SEQ ID NO: 9104 - protein, 25 aa, synthetic construct
  source 1..25: note = Seed: LNVIVHSATGFKQSSKALQRPVASD
LNVIVHSATGYKQESTALARPVASD

SEQ ID NO: 9105 - protein, 25 aa, synthetic construct
  source 1..25: note = Seed: LNVIVHSATGFKQSSKALQRPVASD
LNVIVHSATGYKQESTALIRPVASD

SEQ ID NO: 9106 - protein, 25 aa, synthetic construct
  source 1..25: note = Seed: LNVIVHSATGFKQSSKALQRPVASD
LNVIVHSATGYKQESTALLRPVASD

SEQ ID NO: 9107 - protein, 25 aa, synthetic construct
  source 1..25: note = Seed: LNVIVHSATGFKQSSKALQRPVASD
LNVIVHSATGYKQESTALNRPVASD

SEQ ID NO: 9108 - protein, 25 aa, synthetic construct
  source 1..25: note = Seed: LNVIVHSATGFKQSSKALQRPVASD
LNVIVHSATGYKQESTALSRPVASD

SEQ ID NO: 9109 - protein, 25 aa, synthetic construct
  source 1..25: note = Seed: LNVIVHSATGFKQSSKALQRPVASD
LNVIVHSATGYKQESTALVRPVASD

SEQ ID NO: 9110 - protein, 25 aa, synthetic construct
  source 1..25: note = Seed: LNVIVHSATGFKQSSKALQRPVASD
LNVIVHSATGYKQESVALARPVASD

SEQ ID NO: 9111 - protein, 25 aa, synthetic construct
  source 1..25: note = Seed: LNVIVHSATGFKQSSKALQRPVASD
LNVIVHSATGYKQESVALGRPVASD

SEQ ID NO: 9112 - protein, 25 aa, synthetic construct
  source 1..25: note = Seed: LNVIVHSATGFKQSSKALQRPVASD
LNVIVHSATGYKQESVALIRPVASD

SEQ ID NO: 9113 - protein, 25 aa, synthetic construct
  source 1..25: note = Seed: LNVIVHSATGFKQSSKALQRPVASD
LNVIVHSATGYKQESVALLRPVASD

SEQ ID NO: 9114 - protein, 25 aa, synthetic construct
  source 1..25: note = Seed: LNVIVHSATGFKQSSKALQRPVASD
LNVIVHSATGYKQESVALMRPVASD

SEQ ID NO: 9115 - protein, 25 aa, synthetic construct
  source 1..25: note = Seed: LNVIVHSATGFKQSSKALQRPVASD
LNVIVHSATGYKQESVALNRPVASD

SEQ ID NO: 9116 - protein, 25 aa, synthetic construct
  source 1..25: note = Seed: LNVIVHSATGFKQSSKALQRPVASD
LNVIVHSATGYKQESVALSRPVASD

SEQ ID NO: 9117 - protein, 25 aa, synthetic construct
  source 1..25: note = Seed: LNVIVHSATGFKQSSKALQRPVASD
LNVIVHSATGYKQESVALTRPVASD

SEQ ID NO: 9118 - protein, 25 aa, synthetic construct
  source 1..25: note = Seed: LNVIVHSATGFKQSSKALQRPVASD
LNVIVHSATGYKQESVALVRPVASD

SEQ ID NO: 9119 - protein, 25 aa, synthetic construct
  source 1..25: note = Seed: LNVIVHSATGFKQSSKALQRPVASD
LNVIVHSATGYKQFSAALARPVASD

SEQ ID NO: 9120 - protein, 25 aa, synthetic construct
  source 1..25: note = Seed: LNVIVHSATGFKQSSKALQRPVASD
LNVIVHSATGYKQFSAALCRPVASD

SEQ ID NO: 9121 - protein, 25 aa, synthetic construct
  source 1..25: note = Seed: LNVIVHSATGFKQSSKALQRPVASD
LNVIVHSATGYKQFSAALDRPVASD

SEQ ID NO: 9122 - protein, 25 aa, synthetic construct
  source 1..25: note = Seed: LNVIVHSATGFKQSSKALQRPVASD
LNVIVHSATGYKQFSAALERPVASD

SEQ ID NO: 9123 - protein, 25 aa, synthetic construct
  source 1..25: note = Seed: LNVIVHSATGFKQSSKALQRPVASD
LNVIVHSATGYKQFSAALFRPVASD

SEQ ID NO: 9124 - protein, 25 aa, synthetic construct
  source 1..25: note = Seed: LNVIVHSATGFKQSSKALQRPVASD
LNVIVHSATGYKQFSAALGRPVASD

SEQ ID NO: 9125 - protein, 25 aa, synthetic construct
  source 1..25: note = Seed: LNVIVHSATGFKQSSKALQRPVASD
LNVIVHSATGYKQFSAALHRPVASD

SEQ ID NO: 9126 - protein, 25 aa, synthetic construct
  source 1..25: note = Seed: LNVIVHSATGFKQSSKALQRPVASD
LNVIVHSATGYKQFSAALIRPVASD

SEQ ID NO: 9127 - protein, 25 aa, synthetic construct
  source 1..25: note = Seed: LNVIVHSATGFKQSSKALQRPVASD
LNVIVHSATGYKQFSAALKRPVASD

SEQ ID NO: 9128 - protein, 25 aa, synthetic construct
  source 1..25: note = Seed: LNVIVHSATGFKQSSKALQRPVASD
LNVIVHSATGYKQFSAALLRPVASD

SEQ ID NO: 9129 - protein, 25 aa, synthetic construct
  source 1..25: note = Seed: LNVIVHSATGFKQSSKALQRPVASD
LNVIVHSATGYKQFSAALMRPVASD

SEQ ID NO: 9130 - protein, 25 aa, synthetic construct
  source 1..25: note = Seed: LNVIVHSATGFKQSSKALQRPVASD
LNVIVHSATGYKQFSAALNRPVASD

SEQ ID NO: 9131 - protein, 25 aa, synthetic construct
  source 1..25: note = Seed: LNVIVHSATGFKQSSKALQRPVASD
LNVIVHSATGYKQFSAALPRPVASD

SEQ ID NO: 9132 - protein, 25 aa, synthetic construct
  source 1..25: note = Seed: LNVIVHSATGFKQSSKALQRPVASD
LNVIVHSATGYKQFSAALQRPVASD

SEQ ID NO: 9133 - protein, 25 aa, synthetic construct
  source 1..25: note = Seed: LNVIVHSATGFKQSSKALQRPVASD
LNVIVHSATGYKQFSAALRRPVASD

SEQ ID NO: 9134 - protein, 25 aa, synthetic construct
  source 1..25: note = Seed: LNVIVHSATGFKQSSKALQRPVASD
LNVIVHSATGYKQFSAALSRPVASD

SEQ ID NO: 9135 - protein, 25 aa, synthetic construct
  source 1..25: note = Seed: LNVIVHSATGFKQSSKALQRPVASD
LNVIVHSATGYKQFSAALVRPVASD

SEQ ID NO: 9136 - protein, 25 aa, synthetic construct
  source 1..25: note = Seed: LNVIVHSATGFKQSSKALQRPVASD
LNVIVHSATGYKQFSAALYRPVASD

SEQ ID NO: 9137 - protein, 25 aa, synthetic construct
  source 1..25: note = Seed: LNVIVHSATGFKQSSKALQRPVASD
LNVIVHSATGYKQFSCALIRPVASD

SEQ ID NO: 9138 - protein, 25 aa, synthetic construct
  source 1..25: note = Seed: LNVIVHSATGFKQSSKALQRPVASD
LNVIVHSATGYKQFSCALNRPVASD

SEQ ID NO: 9139 - protein, 25 aa, synthetic construct
  source 1..25: note = Seed: LNVIVHSATGFKQSSKALQRPVASD
LNVIVHSATGYKQFSDALARPVASD

SEQ ID NO: 9140 - protein, 25 aa, synthetic construct
  source 1..25: note = Seed: LNVIVHSATGFKQSSKALQRPVASD
LNVIVHSATGYKQFSEALNRPVASD

SEQ ID NO: 9141 - protein, 25 aa, synthetic construct
  source 1..25: note = Seed: LNVIVHSATGFKQSSKALQRPVASD
LNVIVHSATGYKQFSEALSRPVASD

SEQ ID NO: 9142 - protein, 25 aa, synthetic construct
  source 1..25: note = Seed: LNVIVHSATGFKQSSKALQRPVASD
LNVIVHSATGYKQFSEALVRPVASD

SEQ ID NO: 9143 - protein, 25 aa, synthetic construct
  source 1..25: note = Seed: LNVIVHSATGFKQSSKALQRPVASD
LNVIVHSATGYKQFSFALVRPVASD

SEQ ID NO: 9144 - protein, 25 aa, synthetic construct
  source 1..25: note = Seed: LNVIVHSATGFKQSSKALQRPVASD
LNVIVHSATGYKQFSGALARPVASD

SEQ ID NO: 9145 - protein, 25 aa, synthetic construct
  source 1..25: note = Seed: LNVIVHSATGFKQSSKALQRPVASD
LNVIVHSATGYKQFSGALGRPVASD

SEQ ID NO: 9146 - protein, 25 aa, synthetic construct
  source 1..25: note = Seed: LNVIVHSATGFKQSSKALQRPVASD
LNVIVHSATGYKQFSGALIRPVASD

SEQ ID NO: 9147 - protein, 25 aa, synthetic construct
  source 1..25: note = Seed: LNVIVHSATGFKQSSKALQRPVASD
LNVIVHSATGYKQFSGALLRPVASD

SEQ ID NO: 9148 - protein, 25 aa, synthetic construct
  source 1..25: note = Seed: LNVIVHSATGFKQSSKALQRPVASD
LNVIVHSATGYKQFSGALMRPVASD

SEQ ID NO: 9149 - protein, 25 aa, synthetic construct
  source 1..25: note = Seed: LNVIVHSATGFKQSSKALQRPVASD
LNVIVHSATGYKQFSGALNRPVASD

SEQ ID NO: 9150 - protein, 25 aa, synthetic construct
  source 1..25: note = Seed: LNVIVHSATGFKQSSKALQRPVASD
LNVIVHSATGYKQFSGALSRPVASD

SEQ ID NO: 9151 - protein, 25 aa, synthetic construct
  source 1..25: note = Seed: LNVIVHSATGFKQSSKALQRPVASD
LNVIVHSATGYKQFSGALTRPVASD

SEQ ID NO: 9152 - protein, 25 aa, synthetic construct
  source 1..25: note = Seed: LNVIVHSATGFKQSSKALQRPVASD
LNVIVHSATGYKQFSGALVRPVASD

SEQ ID NO: 9153 - protein, 25 aa, synthetic construct
  source 1..25: note = Seed: LNVIVHSATGFKQSSKALQRPVASD
LNVIVHSATGYKQFSHALARPVASD

SEQ ID NO: 9154 - protein, 25 aa, synthetic construct
  source 1..25: note = Seed: LNVIVHSATGFKQSSKALQRPVASD
LNVIVHSATGYKQFSHALIRPVASD

SEQ ID NO: 9155 - protein, 25 aa, synthetic construct
  source 1..25: note = Seed: LNVIVHSATGFKQSSKALQRPVASD
LNVIVHSATGYKQFSHALLRPVASD

SEQ ID NO: 9156 - protein, 25 aa, synthetic construct
  source 1..25: note = Seed: LNVIVHSATGFKQSSKALQRPVASD
LNVIVHSATGYKQFSHALMRPVASD

SEQ ID NO: 9157 - protein, 25 aa, synthetic construct
  source 1..25: note = Seed: LNVIVHSATGFKQSSKALQRPVASD
LNVIVHSATGYKQFSHALNRPVASD

SEQ ID NO: 9158 - protein, 25 aa, synthetic construct
  source 1..25: note = Seed: LNVIVHSATGFKQSSKALQRPVASD
LNVIVHSATGYKQFSHALRRPVASD

SEQ ID NO: 9159 - protein, 25 aa, synthetic construct
  source 1..25: note = Seed: LNVIVHSATGFKQSSKALQRPVASD
LNVIVHSATGYKQFSHALSRPVASD

SEQ ID NO: 9160 - protein, 25 aa, synthetic construct
  source 1..25: note = Seed: LNVIVHSATGFKQSSKALQRPVASD
LNVIVHSATGYKQFSIALCRPVASD

SEQ ID NO: 9161 - protein, 25 aa, synthetic construct
  source 1..25: note = Seed: LNVIVHSATGFKQSSKALQRPVASD
LNVIVHSATGYKQFSIALDRPVASD

SEQ ID NO: 9162 - protein, 25 aa, synthetic construct
  source 1..25: note = Seed: LNVIVHSATGFKQSSKALQRPVASD
LNVIVHSATGYKQFSIALERPVASD

SEQ ID NO: 9163 - protein, 25 aa, synthetic construct
  source 1..25: note = Seed: LNVIVHSATGFKQSSKALQRPVASD
LNVIVHSATGYKQFSIALGRPVASD

SEQ ID NO: 9164 - protein, 25 aa, synthetic construct
  source 1..25: note = Seed: LNVIVHSATGFKQSSKALQRPVASD
LNVIVHSATGYKQFSIALHRPVASD

SEQ ID NO: 9165 - protein, 25 aa, synthetic construct
  source 1..25: note = Seed: LNVIVHSATGFKQSSKALQRPVASD
LNVIVHSATGYKQFSIALLRPVASD

SEQ ID NO: 9166 - protein, 25 aa, synthetic construct
  source 1..25: note = Seed: LNVIVHSATGFKQSSKALQRPVASD
LNVIVHSATGYKQFSIALNRPVASD

SEQ ID NO: 9167 - protein, 25 aa, synthetic construct
  source 1..25: note = Seed: LNVIVHSATGFKQSSKALQRPVASD
LNVIVHSATGYKQFSIALQRPVASD

SEQ ID NO: 9168 - protein, 25 aa, synthetic construct
  source 1..25: note = Seed: LNVIVHSATGFKQSSKALQRPVASD
LNVIVHSATGYKQFSKALARPVASD

SEQ ID NO: 9169 - protein, 25 aa, synthetic construct
  source 1..25: note = Seed: LNVIVHSATGFKQSSKALQRPVASD
LNVIVHSATGYKQFSKALGRPVASD

SEQ ID NO: 9170 - protein, 25 aa, synthetic construct
  source 1..25: note = Seed: LNVIVHSATGFKQSSKALQRPVASD
LNVIVHSATGYKQFSKALHRPVASD

SEQ ID NO: 9171 - protein, 25 aa, synthetic construct
  source 1..25: note = Seed: LNVIVHSATGFKQSSKALQRPVASD
LNVIVHSATGYKQFSKALIRPVASD

SEQ ID NO: 9172 - protein, 25 aa, synthetic construct
  source 1..25: note = Seed: LNVIVHSATGFKQSSKALQRPVASD
LNVIVHSATGYKQFSKALKRPVASD

SEQ ID NO: 9173 - protein, 25 aa, synthetic construct
  source 1..25: note = Seed: LNVIVHSATGFKQSSKALQRPVASD
LNVIVHSATGYKQFSKALMRPVASD

SEQ ID NO: 9174 - protein, 25 aa, synthetic construct
  source 1..25: note = Seed: LNVIVHSATGFKQSSKALQRPVASD
LNVIVHSATGYKQFSKALNRPVASD

SEQ ID NO: 9175 - protein, 25 aa, synthetic construct
  source 1..25: note = Seed: LNVIVHSATGFKQSSKALQRPVASD
LNVIVHSATGYKQFSKALQRPVASD

SEQ ID NO: 9176 - protein, 25 aa, synthetic construct
  source 1..25: note = Seed: LNVIVHSATGFKQSSKALQRPVASD
LNVIVHSATGYKQFSKALRRPVASD

SEQ ID NO: 9177 - protein, 25 aa, synthetic construct
  source 1..25: note = Seed: LNVIVHSATGFKQSSKALQRPVASD
LNVIVHSATGYKQFSKALSRPVASD

SEQ ID NO: 9178 - protein, 25 aa, synthetic construct
  source 1..25: note = Seed: LNVIVHSATGFKQSSKALQRPVASD
LNVIVHSATGYKQFSKALTRPVASD

SEQ ID NO: 9179 - protein, 25 aa, synthetic construct
  source 1..25: note = Seed: LNVIVHSATGFKQSSKALQRPVASD
LNVIVHSATGYKQFSKALVRPVASD

SEQ ID NO: 9180 - protein, 25 aa, synthetic construct
  source 1..25: note = Seed: LNVIVHSATGFKQSSKALQRPVASD
LNVIVHSATGYKQFSLALDRPVASD

SEQ ID NO: 9181 - protein, 25 aa, synthetic construct
  source 1..25: note = Seed: LNVIVHSATGFKQSSKALQRPVASD
LNVIVHSATGYKQFSLALERPVASD

SEQ ID NO: 9182 - protein, 25 aa, synthetic construct
  source 1..25: note = Seed: LNVIVHSATGFKQSSKALQRPVASD
LNVIVHSATGYKQFSLALHRPVASD

SEQ ID NO: 9183 - protein, 25 aa, synthetic construct
  source 1..25: note = Seed: LNVIVHSATGFKQSSKALQRPVASD
LNVIVHSATGYKQFSLALNRPVASD

SEQ ID NO: 9184 - protein, 25 aa, synthetic construct
  source 1..25: note = Seed: LNVIVHSATGFKQSSKALQRPVASD
LNVIVHSATGYKQFSLALQRPVASD

SEQ ID NO: 9185 - protein, 25 aa, synthetic construct
  source 1..25: note = Seed: LNVIVHSATGFKQSSKALQRPVASD
LNVIVHSATGYKQFSNALARPVASD

SEQ ID NO: 9186 - protein, 25 aa, synthetic construct
  source 1..25: note = Seed: LNVIVHSATGFKQSSKALQRPVASD
LNVIVHSATGYKQFSNALGRPVASD

SEQ ID NO: 9187 - protein, 25 aa, synthetic construct
  source 1..25: note = Seed: LNVIVHSATGFKQSSKALQRPVASD
LNVIVHSATGYKQFSNALIRPVASD

SEQ ID NO: 9188 - protein, 25 aa, synthetic construct
  source 1..25: note = Seed: LNVIVHSATGFKQSSKALQRPVASD
LNVIVHSATGYKQFSNALLRPVASD

SEQ ID NO: 9189 - protein, 25 aa, synthetic construct
  source 1..25: note = Seed: LNVIVHSATGFKQSSKALQRPVASD
LNVIVHSATGYKQFSNALMRPVASD

SEQ ID NO: 9190 - protein, 25 aa, synthetic construct
  source 1..25: note = Seed: LNVIVHSATGFKQSSKALQRPVASD
LNVIVHSATGYKQFSNALNRPVASD

SEQ ID NO: 9191 - protein, 25 aa, synthetic construct
  source 1..25: note = Seed: LNVIVHSATGFKQSSKALQRPVASD
LNVIVHSATGYKQFSNALSRPVASD

SEQ ID NO: 9192 - protein, 25 aa, synthetic construct
  source 1..25: note = Seed: LNVIVHSATGFKQSSKALQRPVASD
LNVIVHSATGYKQFSNALTRPVASD

SEQ ID NO: 9193 - protein, 25 aa, synthetic construct
  source 1..25: note = Seed: LNVIVHSATGFKQSSKALQRPVASD
LNVIVHSATGYKQFSNALVRPVASD

SEQ ID NO: 9194 - protein, 25 aa, synthetic construct
  source 1..25: note = Seed: LNVIVHSATGFKQSSKALQRPVASD
LNVIVHSATGYKQFSPALARPVASD

SEQ ID NO: 9195 - protein, 25 aa, synthetic construct
  source 1..25: note = Seed: LNVIVHSATGFKQSSKALQRPVASD
LNVIVHSATGYKQFSPALCRPVASD

SEQ ID NO: 9196 - protein, 25 aa, synthetic construct
  source 1..25: note = Seed: LNVIVHSATGFKQSSKALQRPVASD
LNVIVHSATGYKQFSPALDRPVASD

SEQ ID NO: 9197 - protein, 25 aa, synthetic construct
  source 1..25: note = Seed: LNVIVHSATGFKQSSKALQRPVASD
LNVIVHSATGYKQFSPALERPVASD

SEQ ID NO: 9198 - protein, 25 aa, synthetic construct
  source 1..25: note = Seed: LNVIVHSATGFKQSSKALQRPVASD
LNVIVHSATGYKQFSPALFRPVASD

SEQ ID NO: 9199 - protein, 25 aa, synthetic construct
  source 1..25: note = Seed: LNVIVHSATGFKQSSKALQRPVASD
LNVIVHSATGYKQFSPALGRPVASD

SEQ ID NO: 9200 - protein, 25 aa, synthetic construct
  source 1..25: note = Seed: LNVIVHSATGFKQSSKALQRPVASD
LNVIVHSATGYKQFSPALHRPVASD

SEQ ID NO: 9201 - protein, 25 aa, synthetic construct
  source 1..25: note = Seed: LNVIVHSATGFKQSSKALQRPVASD
LNVIVHSATGYKQFSPALIRPVASD

SEQ ID NO: 9202 - protein, 25 aa, synthetic construct
  source 1..25: note = Seed: LNVIVHSATGFKQSSKALQRPVASD
LNVIVHSATGYKQFSPALLRPVASD

SEQ ID NO: 9203 - protein, 25 aa, synthetic construct
  source 1..25: note = Seed: LNVIVHSATGFKQSSKALQRPVASD
LNVIVHSATGYKQFSPALMRPVASD

SEQ ID NO: 9204 - protein, 25 aa, synthetic construct
  source 1..25: note = Seed: LNVIVHSATGFKQSSKALQRPVASD
LNVIVHSATGYKQFSPALNRPVASD

SEQ ID NO: 9205 - protein, 25 aa, synthetic construct
  source 1..25: note = Seed: LNVIVHSATGFKQSSKALQRPVASD
LNVIVHSATGYKQFSPALQRPVASD

SEQ ID NO: 9206 - protein, 25 aa, synthetic construct
  source 1..25: note = Seed: LNVIVHSATGFKQSSKALQRPVASD
LNVIVHSATGYKQFSPALSRPVASD

SEQ ID NO: 9207 - protein, 25 aa, synthetic construct
  source 1..25: note = Seed: LNVIVHSATGFKQSSKALQRPVASD
LNVIVHSATGYKQFSPALTRPVASD

SEQ ID NO: 9208 - protein, 25 aa, synthetic construct
  source 1..25: note = Seed: LNVIVHSATGFKQSSKALQRPVASD
LNVIVHSATGYKQFSPALVRPVASD

SEQ ID NO: 9209 - protein, 25 aa, synthetic construct
  source 1..25: note = Seed: LNVIVHSATGFKQSSKALQRPVASD
LNVIVHSATGYKQFSQALIRPVASD

SEQ ID NO: 9210 - protein, 25 aa, synthetic construct
  source 1..25: note = Seed: LNVIVHSATGFKQSSKALQRPVASD
LNVIVHSATGYKQFSQALLRPVASD

SEQ ID NO: 9211 - protein, 25 aa, synthetic construct
  source 1..25: note = Seed: LNVIVHSATGFKQSSKALQRPVASD
LNVIVHSATGYKQFSQALMRPVASD

SEQ ID NO: 9212 - protein, 25 aa, synthetic construct
  source 1..25: note = Seed: LNVIVHSATGFKQSSKALQRPVASD
LNVIVHSATGYKQFSQALNRPVASD

SEQ ID NO: 9213 - protein, 25 aa, synthetic construct
  source 1..25: note = Seed: LNVIVHSATGFKQSSKALQRPVASD
LNVIVHSATGYKQFSRALARPVASD

SEQ ID NO: 9214 - protein, 25 aa, synthetic construct
  source 1..25: note = Seed: LNVIVHSATGFKQSSKALQRPVASD
LNVIVHSATGYKQFSRALGRPVASD

SEQ ID NO: 9215 - protein, 25 aa, synthetic construct
  source 1..25: note = Seed: LNVIVHSATGFKQSSKALQRPVASD
LNVIVHSATGYKQFSRALHRPVASD

SEQ ID NO: 9216 - protein, 25 aa, synthetic construct
  source 1..25: note = Seed: LNVIVHSATGFKQSSKALQRPVASD
LNVIVHSATGYKQFSRALIRPVASD

SEQ ID NO: 9217 - protein, 25 aa, synthetic construct
  source 1..25: note = Seed: LNVIVHSATGFKQSSKALQRPVASD
LNVIVHSATGYKQFSRALKRPVASD

SEQ ID NO: 9218 - protein, 25 aa, synthetic construct
  source 1..25: note = Seed: LNVIVHSATGFKQSSKALQRPVASD
LNVIVHSATGYKQFSRALLRPVASD

SEQ ID NO: 9219 - protein, 25 aa, synthetic construct
  source 1..25: note = Seed: LNVIVHSATGFKQSSKALQRPVASD
LNVIVHSATGYKQFSRALMRPVASD

SEQ ID NO: 9220 - protein, 25 aa, synthetic construct
  source 1..25: note = Seed: LNVIVHSATGFKQSSKALQRPVASD
LNVIVHSATGYKQFSRALNRPVASD

SEQ ID NO: 9221 - protein, 25 aa, synthetic construct
  source 1..25: note = Seed: LNVIVHSATGFKQSSKALQRPVASD
LNVIVHSATGYKQFSRALPRPVASD

SEQ ID NO: 9222 - protein, 25 aa, synthetic construct
  source 1..25: note = Seed: LNVIVHSATGFKQSSKALQRPVASD
LNVIVHSATGYKQFSRALQRPVASD

SEQ ID NO: 9223 - protein, 25 aa, synthetic construct
  source 1..25: note = Seed: LNVIVHSATGFKQSSKALQRPVASD
LNVIVHSATGYKQFSRALRRPVASD

SEQ ID NO: 9224 - protein, 25 aa, synthetic construct
  source 1..25: note = Seed: LNVIVHSATGFKQSSKALQRPVASD
LNVIVHSATGYKQFSRALSRPVASD

SEQ ID NO: 9225 - protein, 25 aa, synthetic construct
  source 1..25: note = Seed: LNVIVHSATGFKQSSKALQRPVASD
LNVIVHSATGYKQFSRALTRPVASD

SEQ ID NO: 9226 - protein, 25 aa, synthetic construct
  source 1..25: note = Seed: LNVIVHSATGFKQSSKALQRPVASD
LNVIVHSATGYKQFSRALVRPVASD

SEQ ID NO: 9227 - protein, 25 aa, synthetic construct
  source 1..25: note = Seed: LNVIVHSATGFKQSSKALQRPVASD
LNVIVHSATGYKQFSSALARPVASD

SEQ ID NO: 9228 - protein, 25 aa, synthetic construct
  source 1..25: note = Seed: LNVIVHSATGFKQSSKALQRPVASD
LNVIVHSATGYKQFSSALCRPVASD

SEQ ID NO: 9229 - protein, 25 aa, synthetic construct
  source 1..25: note = Seed: LNVIVHSATGFKQSSKALQRPVASD
LNVIVHSATGYKQFSSALFRPVASD

SEQ ID NO: 9230 - protein, 25 aa, synthetic construct
  source 1..25: note = Seed: LNVIVHSATGFKQSSKALQRPVASD
LNVIVHSATGYKQFSSALGRPVASD

SEQ ID NO: 9231 - protein, 25 aa, synthetic construct
  source 1..25: note = Seed: LNVIVHSATGFKQSSKALQRPVASD
LNVIVHSATGYKQFSSALHRPVASD

SEQ ID NO: 9232 - protein, 25 aa, synthetic construct
  source 1..25: note = Seed: LNVIVHSATGFKQSSKALQRPVASD
LNVIVHSATGYKQFSSALIRPVASD

SEQ ID NO: 9233 - protein, 25 aa, synthetic construct
  source 1..25: note = Seed: LNVIVHSATGFKQSSKALQRPVASD
LNVIVHSATGYKQFSSALKRPVASD

SEQ ID NO: 9234 - protein, 25 aa, synthetic construct
  source 1..25: note = Seed: LNVIVHSATGFKQSSKALQRPVASD
LNVIVHSATGYKQFSSALLRPVASD

SEQ ID NO: 9235 - protein, 25 aa, synthetic construct
  source 1..25: note = Seed: LNVIVHSATGFKQSSKALQRPVASD
LNVIVHSATGYKQFSSALMRPVASD

SEQ ID NO: 9236 - protein, 25 aa, synthetic construct
  source 1..25: note = Seed: LNVIVHSATGFKQSSKALQRPVASD
LNVIVHSATGYKQFSSALNRPVASD

SEQ ID NO: 9237 - protein, 25 aa, synthetic construct
  source 1..25: note = Seed: LNVIVHSATGFKQSSKALQRPVASD
LNVIVHSATGYKQFSSALPRPVASD

SEQ ID NO: 9238 - protein, 25 aa, synthetic construct
  source 1..25: note = Seed: LNVIVHSATGFKQSSKALQRPVASD
LNVIVHSATGYKQFSSALQRPVASD

SEQ ID NO: 9239 - protein, 25 aa, synthetic construct
  source 1..25: note = Seed: LNVIVHSATGFKQSSKALQRPVASD
LNVIVHSATGYKQFSSALRRPVASD

SEQ ID NO: 9240 - protein, 25 aa, synthetic construct
  source 1..25: note = Seed: LNVIVHSATGFKQSSKALQRPVASD
LNVIVHSATGYKQFSSALSRPVASD

SEQ ID NO: 9241 - protein, 25 aa, synthetic construct
  source 1..25: note = Seed: LNVIVHSATGFKQSSKALQRPVASD
LNVIVHSATGYKQFSSALTRPVASD

SEQ ID NO: 9242 - protein, 25 aa, synthetic construct
  source 1..25: note = Seed: LNVIVHSATGFKQSSKALQRPVASD
LNVIVHSATGYKQFSSALVRPVASD

SEQ ID NO: 9243 - protein, 25 aa, synthetic construct
  source 1..25: note = Seed: LNVIVHSATGFKQSSKALQRPVASD
LNVIVHSATGYKQFSSALYRPVASD

SEQ ID NO: 9244 - protein, 25 aa, synthetic construct
  source 1..25: note = Seed: LNVIVHSATGFKQSSKALQRPVASD
LNVIVHSATGYKQFSTALARPVASD

SEQ ID NO: 9245 - protein, 25 aa, synthetic construct
  source 1..25: note = Seed: LNVIVHSATGFKQSSKALQRPVASD
LNVIVHSATGYKQFSTALCRPVASD

SEQ ID NO: 9246 - protein, 25 aa, synthetic construct
  source 1..25: note = Seed: LNVIVHSATGFKQSSKALQRPVASD
LNVIVHSATGYKQFSTALFRPVASD

SEQ ID NO: 9247 - protein, 25 aa, synthetic construct
  source 1..25: note = Seed: LNVIVHSATGFKQSSKALQRPVASD
LNVIVHSATGYKQFSTALGRPVASD

SEQ ID NO: 9248 - protein, 25 aa, synthetic construct
  source 1..25: note = Seed: LNVIVHSATGFKQSSKALQRPVASD
LNVIVHSATGYKQFSTALHRPVASD

SEQ ID NO: 9249 - protein, 25 aa, synthetic construct
  source 1..25: note = Seed: LNVIVHSATGFKQSSKALQRPVASD
LNVIVHSATGYKQFSTALIRPVASD

SEQ ID NO: 9250 - protein, 25 aa, synthetic construct
  source 1..25: note = Seed: LNVIVHSATGFKQSSKALQRPVASD
LNVIVHSATGYKQFSTALLRPVASD

SEQ ID NO: 9251 - protein, 25 aa, synthetic construct
  source 1..25: note = Seed: LNVIVHSATGFKQSSKALQRPVASD
LNVIVHSATGYKQFSTALMRPVASD

SEQ ID NO: 9252 - protein, 25 aa, synthetic construct
  source 1..25: note = Seed: LNVIVHSATGFKQSSKALQRPVASD
LNVIVHSATGYKQFSTALNRPVASD

SEQ ID NO: 9253 - protein, 25 aa, synthetic construct
  source 1..25: note = Seed: LNVIVHSATGFKQSSKALQRPVASD
LNVIVHSATGYKQFSTALQRPVASD

SEQ ID NO: 9254 - protein, 25 aa, synthetic construct
  source 1..25: note = Seed: LNVIVHSATGFKQSSKALQRPVASD
LNVIVHSATGYKQFSTALRRPVASD

SEQ ID NO: 9255 - protein, 25 aa, synthetic construct
  source 1..25: note = Seed: LNVIVHSATGFKQSSKALQRPVASD
LNVIVHSATGYKQFSTALSRPVASD

SEQ ID NO: 9256 - protein, 25 aa, synthetic construct
  source 1..25: note = Seed: LNVIVHSATGFKQSSKALQRPVASD
LNVIVHSATGYKQFSTALTRPVASD

SEQ ID NO: 9257 - protein, 25 aa, synthetic construct
  source 1..25: note = Seed: LNVIVHSATGFKQSSKALQRPVASD
LNVIVHSATGYKQFSTALVRPVASD

SEQ ID NO: 9258 - protein, 25 aa, synthetic construct
  source 1..25: note = Seed: LNVIVHSATGFKQSSKALQRPVASD
LNVIVHSATGYKQFSVALARPVASD

SEQ ID NO: 9259 - protein, 25 aa, synthetic construct
  source 1..25: note = Seed: LNVIVHSATGFKQSSKALQRPVASD
LNVIVHSATGYKQFSVALCRPVASD

SEQ ID NO: 9260 - protein, 25 aa, synthetic construct
  source 1..25: note = Seed: LNVIVHSATGFKQSSKALQRPVASD
LNVIVHSATGYKQFSVALDRPVASD

SEQ ID NO: 9261 - protein, 25 aa, synthetic construct
  source 1..25: note = Seed: LNVIVHSATGFKQSSKALQRPVASD
LNVIVHSATGYKQFSVALERPVASD

SEQ ID NO: 9262 - protein, 25 aa, synthetic construct
  source 1..25: note = Seed: LNVIVHSATGFKQSSKALQRPVASD
LNVIVHSATGYKQFSVALFRPVASD

SEQ ID NO: 9263 - protein, 25 aa, synthetic construct
  source 1..25: note = Seed: LNVIVHSATGFKQSSKALQRPVASD
LNVIVHSATGYKQFSVALGRPVASD

SEQ ID NO: 9264 - protein, 25 aa, synthetic construct
  source 1..25: note = Seed: LNVIVHSATGFKQSSKALQRPVASD
LNVIVHSATGYKQFSVALHRPVASD

SEQ ID NO: 9265 - protein, 25 aa, synthetic construct
  source 1..25: note = Seed: LNVIVHSATGFKQSSKALQRPVASD
LNVIVHSATGYKQFSVALIRPVASD

SEQ ID NO: 9266 - protein, 25 aa, synthetic construct
  source 1..25: note = Seed: LNVIVHSATGFKQSSKALQRPVASD
LNVIVHSATGYKQFSVALLRPVASD

SEQ ID NO: 9267 - protein, 25 aa, synthetic construct
  source 1..25: note = Seed: LNVIVHSATGFKQSSKALQRPVASD
LNVIVHSATGYKQFSVALMRPVASD

SEQ ID NO: 9268 - protein, 25 aa, synthetic construct
  source 1..25: note = Seed: LNVIVHSATGFKQSSKALQRPVASD
LNVIVHSATGYKQFSVALNRPVASD

SEQ ID NO: 9269 - protein, 25 aa, synthetic construct
  source 1..25: note = Seed: LNVIVHSATGFKQSSKALQRPVASD
LNVIVHSATGYKQFSVALQRPVASD

SEQ ID NO: 9270 - protein, 25 aa, synthetic construct
  source 1..25: note = Seed: LNVIVHSATGFKQSSKALQRPVASD
LNVIVHSATGYKQFSVALRRPVASD

SEQ ID NO: 9271 - protein, 25 aa, synthetic construct
  source 1..25: note = Seed: LNVIVHSATGFKQSSKALQRPVASD
LNVIVHSATGYKQFSVALSRPVASD

SEQ ID NO: 9272 - protein, 25 aa, synthetic construct
  source 1..25: note = Seed: LNVIVHSATGFKQSSKALQRPVASD
LNVIVHSATGYKQFSVALVRPVASD

SEQ ID NO: 9273 - protein, 25 aa, synthetic construct
  source 1..25: note = Seed: LNVIVHSATGFKQSSKALQRPVASD
LNVIVHSATGYKQFSVALYRPVASD

SEQ ID NO: 9274 - protein, 25 aa, synthetic construct
  source 1..25: note = Seed: LNVIVHSATGFKQSSKALQRPVASD
LNVIVHSATGYKQGSAALARPVASD

SEQ ID NO: 9275 - protein, 25 aa, synthetic construct
  source 1..25: note = Seed: LNVIVHSATGFKQSSKALQRPVASD
LNVIVHSATGYKQGSAALFRPVASD

SEQ ID NO: 9276 - protein, 25 aa, synthetic construct
  source 1..25: note = Seed: LNVIVHSATGFKQSSKALQRPVASD
LNVIVHSATGYKQGSAALGRPVASD

SEQ ID NO: 9277 - protein, 25 aa, synthetic construct
  source 1..25: note = Seed: LNVIVHSATGFKQSSKALQRPVASD
LNVIVHSATGYKQGSAALIRPVASD

SEQ ID NO: 9278 - protein, 25 aa, synthetic construct
  source 1..25: note = Seed: LNVIVHSATGFKQSSKALQRPVASD
LNVIVHSATGYKQGSAALLRPVASD

SEQ ID NO: 9279 - protein, 25 aa, synthetic construct
  source 1..25: note = Seed: LNVIVHSATGFKQSSKALQRPVASD
LNVIVHSATGYKQGSAALMRPVASD

SEQ ID NO: 9280 - protein, 25 aa, synthetic construct
  source 1..25: note = Seed: LNVIVHSATGFKQSSKALQRPVASD
LNVIVHSATGYKQGSAALSRPVASD

SEQ ID NO: 9281 - protein, 25 aa, synthetic construct
  source 1..25: note = Seed: LNVIVHSATGFKQSSKALQRPVASD
LNVIVHSATGYKQGSAALTRPVASD

SEQ ID NO: 9282 - protein, 25 aa, synthetic construct
  source 1..25: note = Seed: LNVIVHSATGFKQSSKALQRPVASD
LNVIVHSATGYKQGSAALVRPVASD

SEQ ID NO: 9283 - protein, 25 aa, synthetic construct
  source 1..25: note = Seed: LNVIVHSATGFKQSSKALQRPVASD
LNVIVHSATGYKQGSGALARPVASD

SEQ ID NO: 9284 - protein, 25 aa, synthetic construct
  source 1..25: note = Seed: LNVIVHSATGFKQSSKALQRPVASD
LNVIVHSATGYKQGSGALIRPVASD

SEQ ID NO: 9285 - protein, 25 aa, synthetic construct
  source 1..25: note = Seed: LNVIVHSATGFKQSSKALQRPVASD
LNVIVHSATGYKQGSGALLRPVASD

SEQ ID NO: 9286 - protein, 25 aa, synthetic construct
  source 1..25: note = Seed: LNVIVHSATGFKQSSKALQRPVASD
LNVIVHSATGYKQGSGALMRPVASD

SEQ ID NO: 9287 - protein, 25 aa, synthetic construct
  source 1..25: note = Seed: LNVIVHSATGFKQSSKALQRPVASD
LNVIVHSATGYKQGSGALVRPVASD

SEQ ID NO: 9288 - protein, 25 aa, synthetic construct
  source 1..25: note = Seed: LNVIVHSATGFKQSSKALQRPVASD
LNVIVHSATGYKQGSIALARPVASD

SEQ ID NO: 9289 - protein, 25 aa, synthetic construct
  source 1..25: note = Seed: LNVIVHSATGFKQSSKALQRPVASD
LNVIVHSATGYKQGSIALIRPVASD

SEQ ID NO: 9290 - protein, 25 aa, synthetic construct
  source 1..25: note = Seed: LNVIVHSATGFKQSSKALQRPVASD
LNVIVHSATGYKQGSIALLRPVASD

SEQ ID NO: 9291 - protein, 25 aa, synthetic construct
  source 1..25: note = Seed: LNVIVHSATGFKQSSKALQRPVASD
LNVIVHSATGYKQGSIALMRPVASD

SEQ ID NO: 9292 - protein, 25 aa, synthetic construct
  source 1..25: note = Seed: LNVIVHSATGFKQSSKALQRPVASD
LNVIVHSATGYKQGSIALNRPVASD

SEQ ID NO: 9293 - protein, 25 aa, synthetic construct
  source 1..25: note = Seed: LNVIVHSATGFKQSSKALQRPVASD
LNVIVHSATGYKQGSIALQRPVASD

SEQ ID NO: 9294 - protein, 25 aa, synthetic construct
  source 1..25: note = Seed: LNVIVHSATGFKQSSKALQRPVASD
LNVIVHSATGYKQGSIALSRPVASD

SEQ ID NO: 9295 - protein, 25 aa, synthetic construct
  source 1..25: note = Seed: LNVIVHSATGFKQSSKALQRPVASD
LNVIVHSATGYKQGSIALVRPVASD

SEQ ID NO: 9296 - protein, 25 aa, synthetic construct
  source 1..25: note = Seed: LNVIVHSATGFKQSSKALQRPVASD
LNVIVHSATGYKQGSLALARPVASD

SEQ ID NO: 9297 - protein, 25 aa, synthetic construct
  source 1..25: note = Seed: LNVIVHSATGFKQSSKALQRPVASD
LNVIVHSATGYKQGSLALLRPVASD

SEQ ID NO: 9298 - protein, 25 aa, synthetic construct
  source 1..25: note = Seed: LNVIVHSATGFKQSSKALQRPVASD
LNVIVHSATGYKQGSLALMRPVASD

SEQ ID NO: 9299 - protein, 25 aa, synthetic construct
  source 1..25: note = Seed: LNVIVHSATGFKQSSKALQRPVASD
LNVIVHSATGYKQGSLALVRPVASD

SEQ ID NO: 9300 - protein, 25 aa, synthetic construct
  source 1..25: note = Seed: LNVIVHSATGFKQSSKALQRPVASD
LNVIVHSATGYKQGSMALARPVASD

SEQ ID NO: 9301 - protein, 25 aa, synthetic construct
  source 1..25: note = Seed: LNVIVHSATGFKQSSKALQRPVASD
LNVIVHSATGYKQGSMALLRPVASD

SEQ ID NO: 9302 - protein, 25 aa, synthetic construct
  source 1..25: note = Seed: LNVIVHSATGFKQSSKALQRPVASD
LNVIVHSATGYKQGSNALARPVASD

SEQ ID NO: 9303 - protein, 25 aa, synthetic construct
  source 1..25: note = Seed: LNVIVHSATGFKQSSKALQRPVASD
LNVIVHSATGYKQGSNALIRPVASD

SEQ ID NO: 9304 - protein, 25 aa, synthetic construct
  source 1..25: note = Seed: LNVIVHSATGFKQSSKALQRPVASD
LNVIVHSATGYKQGSNALLRPVASD

SEQ ID NO: 9305 - protein, 25 aa, synthetic construct
  source 1..25: note = Seed: LNVIVHSATGFKQSSKALQRPVASD
LNVIVHSATGYKQGSNALVRPVASD

SEQ ID NO: 9306 - protein, 25 aa, synthetic construct
  source 1..25: note = Seed: LNVIVHSATGFKQSSKALQRPVASD
LNVIVHSATGYKQGSPALARPVASD

SEQ ID NO: 9307 - protein, 25 aa, synthetic construct
  source 1..25: note = Seed: LNVIVHSATGFKQSSKALQRPVASD
LNVIVHSATGYKQGSPALIRPVASD

SEQ ID NO: 9308 - protein, 25 aa, synthetic construct
  source 1..25: note = Seed: LNVIVHSATGFKQSSKALQRPVASD
LNVIVHSATGYKQGSPALLRPVASD

SEQ ID NO: 9309 - protein, 25 aa, synthetic construct
  source 1..25: note = Seed: LNVIVHSATGFKQSSKALQRPVASD
LNVIVHSATGYKQGSPALMRPVASD

SEQ ID NO: 9310 - protein, 25 aa, synthetic construct
  source 1..25: note = Seed: LNVIVHSATGFKQSSKALQRPVASD
LNVIVHSATGYKQGSPALVRPVASD

SEQ ID NO: 9311 - protein, 25 aa, synthetic construct
  source 1..25: note = Seed: LNVIVHSATGFKQSSKALQRPVASD
LNVIVHSATGYKQGSSALARPVASD

SEQ ID NO: 9312 - protein, 25 aa, synthetic construct
  source 1..25: note = Seed: LNVIVHSATGFKQSSKALQRPVASD
LNVIVHSATGYKQGSSALIRPVASD

SEQ ID NO: 9313 - protein, 25 aa, synthetic construct
  source 1..25: note = Seed: LNVIVHSATGFKQSSKALQRPVASD
LNVIVHSATGYKQGSSALLRPVASD

SEQ ID NO: 9314 - protein, 25 aa, synthetic construct
  source 1..25: note = Seed: LNVIVHSATGFKQSSKALQRPVASD
LNVIVHSATGYKQGSSALMRPVASD

SEQ ID NO: 9315 - protein, 25 aa, synthetic construct
  source 1..25: note = Seed: LNVIVHSATGFKQSSKALQRPVASD
LNVIVHSATGYKQGSSALSRPVASD

SEQ ID NO: 9316 - protein, 25 aa, synthetic construct
  source 1..25: note = Seed: LNVIVHSATGFKQSSKALQRPVASD
LNVIVHSATGYKQGSSALTRPVASD

SEQ ID NO: 9317 - protein, 25 aa, synthetic construct
  source 1..25: note = Seed: LNVIVHSATGFKQSSKALQRPVASD
LNVIVHSATGYKQGSSALVRPVASD

SEQ ID NO: 9318 - protein, 25 aa, synthetic construct
  source 1..25: note = Seed: LNVIVHSATGFKQSSKALQRPVASD
LNVIVHSATGYKQGSTALARPVASD

SEQ ID NO: 9319 - protein, 25 aa, synthetic construct
  source 1..25: note = Seed: LNVIVHSATGFKQSSKALQRPVASD
LNVIVHSATGYKQGSTALIRPVASD

SEQ ID NO: 9320 - protein, 25 aa, synthetic construct
  source 1..25: note = Seed: LNVIVHSATGFKQSSKALQRPVASD
LNVIVHSATGYKQGSTALLRPVASD

SEQ ID NO: 9321 - protein, 25 aa, synthetic construct
  source 1..25: note = Seed: LNVIVHSATGFKQSSKALQRPVASD
LNVIVHSATGYKQGSTALMRPVASD

SEQ ID NO: 9322 - protein, 25 aa, synthetic construct
  source 1..25: note = Seed: LNVIVHSATGFKQSSKALQRPVASD
LNVIVHSATGYKQGSTALVRPVASD

SEQ ID NO: 9323 - protein, 25 aa, synthetic construct
  source 1..25: note = Seed: LNVIVHSATGFKQSSKALQRPVASD
LNVIVHSATGYKQGSVALARPVASD

SEQ ID NO: 9324 - protein, 25 aa, synthetic construct
  source 1..25: note = Seed: LNVIVHSATGFKQSSKALQRPVASD
LNVIVHSATGYKQGSVALIRPVASD

SEQ ID NO: 9325 - protein, 25 aa, synthetic construct
  source 1..25: note = Seed: LNVIVHSATGFKQSSKALQRPVASD
LNVIVHSATGYKQGSVALLRPVASD

SEQ ID NO: 9326 - protein, 25 aa, synthetic construct
  source 1..25: note = Seed: LNVIVHSATGFKQSSKALQRPVASD
LNVIVHSATGYKQGSVALMRPVASD

SEQ ID NO: 9327 - protein, 25 aa, synthetic construct
  source 1..25: note = Seed: LNVIVHSATGFKQSSKALQRPVASD
LNVIVHSATGYKQGSVALNRPVASD

SEQ ID NO: 9328 - protein, 25 aa, synthetic construct
  source 1..25: note = Seed: LNVIVHSATGFKQSSKALQRPVASD
LNVIVHSATGYKQGSVALSRPVASD

SEQ ID NO: 9329 - protein, 25 aa, synthetic construct
  source 1..25: note = Seed: LNVIVHSATGFKQSSKALQRPVASD
LNVIVHSATGYKQGSVALVRPVASD

SEQ ID NO: 9330 - protein, 25 aa, synthetic construct
  source 1..25: note = Seed: LNVIVHSATGFKQSSKALQRPVASD
LNVIVHSATGYKQHSAALARPVASD

SEQ ID NO: 9331 - protein, 25 aa, synthetic construct
  source 1..25: note = Seed: LNVIVHSATGFKQSSKALQRPVASD
LNVIVHSATGYKQHSAALFRPVASD

SEQ ID NO: 9332 - protein, 25 aa, synthetic construct
  source 1..25: note = Seed: LNVIVHSATGFKQSSKALQRPVASD
LNVIVHSATGYKQHSAALIRPVASD

SEQ ID NO: 9333 - protein, 25 aa, synthetic construct
  source 1..25: note = Seed: LNVIVHSATGFKQSSKALQRPVASD
LNVIVHSATGYKQHSAALLRPVASD

SEQ ID NO: 9334 - protein, 25 aa, synthetic construct
  source 1..25: note = Seed: LNVIVHSATGFKQSSKALQRPVASD
LNVIVHSATGYKQHSAALMRPVASD

SEQ ID NO: 9335 - protein, 25 aa, synthetic construct
  source 1..25: note = Seed: LNVIVHSATGFKQSSKALQRPVASD
LNVIVHSATGYKQHSAALSRPVASD

SEQ ID NO: 9336 - protein, 25 aa, synthetic construct
  source 1..25: note = Seed: LNVIVHSATGFKQSSKALQRPVASD
LNVIVHSATGYKQHSAALTRPVASD

SEQ ID NO: 9337 - protein, 25 aa, synthetic construct
  source 1..25: note = Seed: LNVIVHSATGFKQSSKALQRPVASD
LNVIVHSATGYKQHSAALVRPVASD

SEQ ID NO: 9338 - protein, 25 aa, synthetic construct
  source 1..25: note = Seed: LNVIVHSATGFKQSSKALQRPVASD
LNVIVHSATGYKQHSGALARPVASD

SEQ ID NO: 9339 - protein, 25 aa, synthetic construct
  source 1..25: note = Seed: LNVIVHSATGFKQSSKALQRPVASD
LNVIVHSATGYKQHSGALIRPVASD

SEQ ID NO: 9340 - protein, 25 aa, synthetic construct
  source 1..25: note = Seed: LNVIVHSATGFKQSSKALQRPVASD
LNVIVHSATGYKQHSGALLRPVASD

SEQ ID NO: 9341 - protein, 25 aa, synthetic construct
  source 1..25: note = Seed: LNVIVHSATGFKQSSKALQRPVASD
LNVIVHSATGYKQHSGALVRPVASD

SEQ ID NO: 9342 - protein, 25 aa, synthetic construct
  source 1..25: note = Seed: LNVIVHSATGFKQSSKALQRPVASD
LNVIVHSATGYKQHSIALARPVASD

SEQ ID NO: 9343 - protein, 25 aa, synthetic construct
  source 1..25: note = Seed: LNVIVHSATGFKQSSKALQRPVASD
LNVIVHSATGYKQHSIALSRPVASD

SEQ ID NO: 9344 - protein, 25 aa, synthetic construct
  source 1..25: note = Seed: LNVIVHSATGFKQSSKALQRPVASD
LNVIVHSATGYKQHSIALVRPVASD

SEQ ID NO: 9345 - protein, 25 aa, synthetic construct
  source 1..25: note = Seed: LNVIVHSATGFKQSSKALQRPVASD
LNVIVHSATGYKQHSLALARPVASD

SEQ ID NO: 9346 - protein, 25 aa, synthetic construct
  source 1..25: note = Seed: LNVIVHSATGFKQSSKALQRPVASD
LNVIVHSATGYKQHSMALARPVASD

SEQ ID NO: 9347 - protein, 25 aa, synthetic construct
  source 1..25: note = Seed: LNVIVHSATGFKQSSKALQRPVASD
LNVIVHSATGYKQHSPALARPVASD

SEQ ID NO: 9348 - protein, 25 aa, synthetic construct
  source 1..25: note = Seed: LNVIVHSATGFKQSSKALQRPVASD
LNVIVHSATGYKQHSPALIRPVASD

SEQ ID NO: 9349 - protein, 25 aa, synthetic construct
  source 1..25: note = Seed: LNVIVHSATGFKQSSKALQRPVASD
LNVIVHSATGYKQHSPALLRPVASD

SEQ ID NO: 9350 - protein, 25 aa, synthetic construct
  source 1..25: note = Seed: LNVIVHSATGFKQSSKALQRPVASD
LNVIVHSATGYKQHSPALVRPVASD

SEQ ID NO: 9351 - protein, 25 aa, synthetic construct
  source 1..25: note = Seed: LNVIVHSATGFKQSSKALQRPVASD
LNVIVHSATGYKQHSSALARPVASD

SEQ ID NO: 9352 - protein, 25 aa, synthetic construct
  source 1..25: note = Seed: LNVIVHSATGFKQSSKALQRPVASD
LNVIVHSATGYKQHSSALFRPVASD

SEQ ID NO: 9353 - protein, 25 aa, synthetic construct
  source 1..25: note = Seed: LNVIVHSATGFKQSSKALQRPVASD
LNVIVHSATGYKQHSSALIRPVASD

SEQ ID NO: 9354 - protein, 25 aa, synthetic construct
  source 1..25: note = Seed: LNVIVHSATGFKQSSKALQRPVASD
LNVIVHSATGYKQHSSALLRPVASD

SEQ ID NO: 9355 - protein, 25 aa, synthetic construct
  source 1..25: note = Seed: LNVIVHSATGFKQSSKALQRPVASD
LNVIVHSATGYKQHSSALVRPVASD

SEQ ID NO: 9356 - protein, 25 aa, synthetic construct
  source 1..25: note = Seed: LNVIVHSATGFKQSSKALQRPVASD
LNVIVHSATGYKQHSVALARPVASD

SEQ ID NO: 9357 - protein, 25 aa, synthetic construct
  source 1..25: note = Seed: LNVIVHSATGFKQSSKALQRPVASD
LNVIVHSATGYKQHSVALIRPVASD

SEQ ID NO: 9358 - protein, 25 aa, synthetic construct
  source 1..25: note = Seed: LNVIVHSATGFKQSSKALQRPVASD
LNVIVHSATGYKQHSVALLRPVASD

SEQ ID NO: 9359 - protein, 25 aa, synthetic construct
  source 1..25: note = Seed: LNVIVHSATGFKQSSKALQRPVASD
LNVIVHSATGYKQHSVALMRPVASD

SEQ ID NO: 9360 - protein, 25 aa, synthetic construct
  source 1..25: note = Seed: LNVIVHSATGFKQSSKALQRPVASD
LNVIVHSATGYKQHSVALSRPVASD

SEQ ID NO: 9361 - protein, 25 aa, synthetic construct
  source 1..25: note = Seed: LNVIVHSATGFKQSSKALQRPVASD
LNVIVHSATGYKQISAALCRPVASD

SEQ ID NO: 9362 - protein, 25 aa, synthetic construct
  source 1..25: note = Seed: LNVIVHSATGFKQSSKALQRPVASD
LNVIVHSATGYKQISAALDRPVASD

SEQ ID NO: 9363 - protein, 25 aa, synthetic construct
  source 1..25: note = Seed: LNVIVHSATGFKQSSKALQRPVASD
LNVIVHSATGYKQISAALERPVASD

SEQ ID NO: 9364 - protein, 25 aa, synthetic construct
  source 1..25: note = Seed: LNVIVHSATGFKQSSKALQRPVASD
LNVIVHSATGYKQISAALFRPVASD

SEQ ID NO: 9365 - protein, 25 aa, synthetic construct
  source 1..25: note = Seed: LNVIVHSATGFKQSSKALQRPVASD
LNVIVHSATGYKQISAALGRPVASD

SEQ ID NO: 9366 - protein, 25 aa, synthetic construct
  source 1..25: note = Seed: LNVIVHSATGFKQSSKALQRPVASD
LNVIVHSATGYKQISAALHRPVASD

SEQ ID NO: 9367 - protein, 25 aa, synthetic construct
  source 1..25: note = Seed: LNVIVHSATGFKQSSKALQRPVASD
LNVIVHSATGYKQISAALIRPVASD

SEQ ID NO: 9368 - protein, 25 aa, synthetic construct
  source 1..25: note = Seed: LNVIVHSATGFKQSSKALQRPVASD
LNVIVHSATGYKQISAALKRPVASD

SEQ ID NO: 9369 - protein, 25 aa, synthetic construct
  source 1..25: note = Seed: LNVIVHSATGFKQSSKALQRPVASD
LNVIVHSATGYKQISAALLRPVASD

SEQ ID NO: 9370 - protein, 25 aa, synthetic construct
  source 1..25: note = Seed: LNVIVHSATGFKQSSKALQRPVASD
LNVIVHSATGYKQISAALMRPVASD

SEQ ID NO: 9371 - protein, 25 aa, synthetic construct
  source 1..25: note = Seed: LNVIVHSATGFKQSSKALQRPVASD
LNVIVHSATGYKQISAALNRPVASD

SEQ ID NO: 9372 - protein, 25 aa, synthetic construct
  source 1..25: note = Seed: LNVIVHSATGFKQSSKALQRPVASD
LNVIVHSATGYKQISAALPRPVASD

SEQ ID NO: 9373 - protein, 25 aa, synthetic construct
  source 1..25: note = Seed: LNVIVHSATGFKQSSKALQRPVASD
LNVIVHSATGYKQISAALQRPVASD

SEQ ID NO: 9374 - protein, 25 aa, synthetic construct
  source 1..25: note = Seed: LNVIVHSATGFKQSSKALQRPVASD
LNVIVHSATGYKQISAALRRPVASD

SEQ ID NO: 9375 - protein, 25 aa, synthetic construct
  source 1..25: note = Seed: LNVIVHSATGFKQSSKALQRPVASD
LNVIVHSATGYKQISAALSRPVASD

SEQ ID NO: 9376 - protein, 25 aa, synthetic construct
  source 1..25: note = Seed: LNVIVHSATGFKQSSKALQRPVASD
LNVIVHSATGYKQISAALTRPVASD

SEQ ID NO: 9377 - protein, 25 aa, synthetic construct
  source 1..25: note = Seed: LNVIVHSATGFKQSSKALQRPVASD
LNVIVHSATGYKQISAALVRPVASD

SEQ ID NO: 9378 - protein, 25 aa, synthetic construct
  source 1..25: note = Seed: LNVIVHSATGFKQSSKALQRPVASD
LNVIVHSATGYKQISAALWRPVASD

SEQ ID NO: 9379 - protein, 25 aa, synthetic construct
  source 1..25: note = Seed: LNVIVHSATGFKQSSKALQRPVASD
LNVIVHSATGYKQISAALYRPVASD

SEQ ID NO: 9380 - protein, 25 aa, synthetic construct
  source 1..25: note = Seed: LNVIVHSATGFKQSSKALQRPVASD
LNVIVHSATGYKQISCALARPVASD

SEQ ID NO: 9381 - protein, 25 aa, synthetic construct
  source 1..25: note = Seed: LNVIVHSATGFKQSSKALQRPVASD
LNVIVHSATGYKQISCALNRPVASD

SEQ ID NO: 9382 - protein, 25 aa, synthetic construct
  source 1..25: note = Seed: LNVIVHSATGFKQSSKALQRPVASD
LNVIVHSATGYKQISCALSRPVASD

SEQ ID NO: 9383 - protein, 25 aa, synthetic construct
  source 1..25: note = Seed: LNVIVHSATGFKQSSKALQRPVASD
LNVIVHSATGYKQISCALVRPVASD

SEQ ID NO: 9384 - protein, 25 aa, synthetic construct
  source 1..25: note = Seed: LNVIVHSATGFKQSSKALQRPVASD
LNVIVHSATGYKQISEALARPVASD

SEQ ID NO: 9385 - protein, 25 aa, synthetic construct
  source 1..25: note = Seed: LNVIVHSATGFKQSSKALQRPVASD
LNVIVHSATGYKQISEALSRPVASD

SEQ ID NO: 9386 - protein, 25 aa, synthetic construct
  source 1..25: note = Seed: LNVIVHSATGFKQSSKALQRPVASD
LNVIVHSATGYKQISEALVRPVASD

SEQ ID NO: 9387 - protein, 25 aa, synthetic construct
  source 1..25: note = Seed: LNVIVHSATGFKQSSKALQRPVASD
LNVIVHSATGYKQISFALARPVASD

SEQ ID NO: 9388 - protein, 25 aa, synthetic construct
  source 1..25: note = Seed: LNVIVHSATGFKQSSKALQRPVASD
LNVIVHSATGYKQISFALGRPVASD

SEQ ID NO: 9389 - protein, 25 aa, synthetic construct
  source 1..25: note = Seed: LNVIVHSATGFKQSSKALQRPVASD
LNVIVHSATGYKQISFALHRPVASD

SEQ ID NO: 9390 - protein, 25 aa, synthetic construct
  source 1..25: note = Seed: LNVIVHSATGFKQSSKALQRPVASD
LNVIVHSATGYKQISFALIRPVASD

SEQ ID NO: 9391 - protein, 25 aa, synthetic construct
  source 1..25: note = Seed: LNVIVHSATGFKQSSKALQRPVASD
LNVIVHSATGYKQISFALLRPVASD

SEQ ID NO: 9392 - protein, 25 aa, synthetic construct
  source 1..25: note = Seed: LNVIVHSATGFKQSSKALQRPVASD
LNVIVHSATGYKQISFALVRPVASD

SEQ ID NO: 9393 - protein, 25 aa, synthetic construct
  source 1..25: note = Seed: LNVIVHSATGFKQSSKALQRPVASD
LNVIVHSATGYKQISGALARPVASD

SEQ ID NO: 9394 - protein, 25 aa, synthetic construct
  source 1..25: note = Seed: LNVIVHSATGFKQSSKALQRPVASD
LNVIVHSATGYKQISGALCRPVASD

SEQ ID NO: 9395 - protein, 25 aa, synthetic construct
  source 1..25: note = Seed: LNVIVHSATGFKQSSKALQRPVASD
LNVIVHSATGYKQISGALDRPVASD

SEQ ID NO: 9396 - protein, 25 aa, synthetic construct
  source 1..25: note = Seed: LNVIVHSATGFKQSSKALQRPVASD
LNVIVHSATGYKQISGALERPVASD

SEQ ID NO: 9397 - protein, 25 aa, synthetic construct
  source 1..25: note = Seed: LNVIVHSATGFKQSSKALQRPVASD
LNVIVHSATGYKQISGALFRPVASD

SEQ ID NO: 9398 - protein, 25 aa, synthetic construct
  source 1..25: note = Seed: LNVIVHSATGFKQSSKALQRPVASD
LNVIVHSATGYKQISGALGRPVASD

SEQ ID NO: 9399 - protein, 25 aa, synthetic construct
  source 1..25: note = Seed: LNVIVHSATGFKQSSKALQRPVASD
LNVIVHSATGYKQISGALHRPVASD

SEQ ID NO: 9400 - protein, 25 aa, synthetic construct
  source 1..25: note = Seed: LNVIVHSATGFKQSSKALQRPVASD
LNVIVHSATGYKQISGALIRPVASD

SEQ ID NO: 9401 - protein, 25 aa, synthetic construct
  source 1..25: note = Seed: LNVIVHSATGFKQSSKALQRPVASD
LNVIVHSATGYKQISGALLRPVASD

SEQ ID NO: 9402 - protein, 25 aa, synthetic construct
  source 1..25: note = Seed: LNVIVHSATGFKQSSKALQRPVASD
LNVIVHSATGYKQISGALMRPVASD

SEQ ID NO: 9403 - protein, 25 aa, synthetic construct
  source 1..25: note = Seed: LNVIVHSATGFKQSSKALQRPVASD
LNVIVHSATGYKQISGALNRPVASD

SEQ ID NO: 9404 - protein, 25 aa, synthetic construct
  source 1..25: note = Seed: LNVIVHSATGFKQSSKALQRPVASD
LNVIVHSATGYKQISGALPRPVASD

SEQ ID NO: 9405 - protein, 25 aa, synthetic construct
  source 1..25: note = Seed: LNVIVHSATGFKQSSKALQRPVASD
LNVIVHSATGYKQISGALQRPVASD

SEQ ID NO: 9406 - protein, 25 aa, synthetic construct
  source 1..25: note = Seed: LNVIVHSATGFKQSSKALQRPVASD
LNVIVHSATGYKQISGALSRPVASD

SEQ ID NO: 9407 - protein, 25 aa, synthetic construct
  source 1..25: note = Seed: LNVIVHSATGFKQSSKALQRPVASD
LNVIVHSATGYKQISGALTRPVASD

SEQ ID NO: 9408 - protein, 25 aa, synthetic construct
  source 1..25: note = Seed: LNVIVHSATGFKQSSKALQRPVASD
LNVIVHSATGYKQISGALVRPVASD

SEQ ID NO: 9409 - protein, 25 aa, synthetic construct
  source 1..25: note = Seed: LNVIVHSATGFKQSSKALQRPVASD
LNVIVHSATGYKQISGALYRPVASD

SEQ ID NO: 9410 - protein, 25 aa, synthetic construct
  source 1..25: note = Seed: LNVIVHSATGFKQSSKALQRPVASD
LNVIVHSATGYKQISHALARPVASD

SEQ ID NO: 9411 - protein, 25 aa, synthetic construct
  source 1..25: note = Seed: LNVIVHSATGFKQSSKALQRPVASD
LNVIVHSATGYKQISHALGRPVASD

SEQ ID NO: 9412 - protein, 25 aa, synthetic construct
  source 1..25: note = Seed: LNVIVHSATGFKQSSKALQRPVASD
LNVIVHSATGYKQISHALIRPVASD

SEQ ID NO: 9413 - protein, 25 aa, synthetic construct
  source 1..25: note = Seed: LNVIVHSATGFKQSSKALQRPVASD
LNVIVHSATGYKQISHALLRPVASD

SEQ ID NO: 9414 - protein, 25 aa, synthetic construct
  source 1..25: note = Seed: LNVIVHSATGFKQSSKALQRPVASD
LNVIVHSATGYKQISHALMRPVASD

SEQ ID NO: 9415 - protein, 25 aa, synthetic construct
  source 1..25: note = Seed: LNVIVHSATGFKQSSKALQRPVASD
LNVIVHSATGYKQISHALNRPVASD

SEQ ID NO: 9416 - protein, 25 aa, synthetic construct
  source 1..25: note = Seed: LNVIVHSATGFKQSSKALQRPVASD
LNVIVHSATGYKQISHALPRPVASD

SEQ ID NO: 9417 - protein, 25 aa, synthetic construct
  source 1..25: note = Seed: LNVIVHSATGFKQSSKALQRPVASD
LNVIVHSATGYKQISHALSRPVASD

SEQ ID NO: 9418 - protein, 25 aa, synthetic construct
  source 1..25: note = Seed: LNVIVHSATGFKQSSKALQRPVASD
LNVIVHSATGYKQISHALTRPVASD

SEQ ID NO: 9419 - protein, 25 aa, synthetic construct
  source 1..25: note = Seed: LNVIVHSATGFKQSSKALQRPVASD
LNVIVHSATGYKQISHALVRPVASD

SEQ ID NO: 9420 - protein, 25 aa, synthetic construct
  source 1..25: note = Seed: LNVIVHSATGFKQSSKALQRPVASD
LNVIVHSATGYKQISIALARPVASD

SEQ ID NO: 9421 - protein, 25 aa, synthetic construct
  source 1..25: note = Seed: LNVIVHSATGFKQSSKALQRPVASD
LNVIVHSATGYKQISIALCRPVASD

SEQ ID NO: 9422 - protein, 25 aa, synthetic construct
  source 1..25: note = Seed: LNVIVHSATGFKQSSKALQRPVASD
LNVIVHSATGYKQISIALDRPVASD

SEQ ID NO: 9423 - protein, 25 aa, synthetic construct
  source 1..25: note = Seed: LNVIVHSATGFKQSSKALQRPVASD
LNVIVHSATGYKQISIALERPVASD

SEQ ID NO: 9424 - protein, 25 aa, synthetic construct
  source 1..25: note = Seed: LNVIVHSATGFKQSSKALQRPVASD
LNVIVHSATGYKQISIALFRPVASD

SEQ ID NO: 9425 - protein, 25 aa, synthetic construct
  source 1..25: note = Seed: LNVIVHSATGFKQSSKALQRPVASD
LNVIVHSATGYKQISIALGRPVASD

SEQ ID NO: 9426 - protein, 25 aa, synthetic construct
  source 1..25: note = Seed: LNVIVHSATGFKQSSKALQRPVASD
LNVIVHSATGYKQISIALHRPVASD

SEQ ID NO: 9427 - protein, 25 aa, synthetic construct
  source 1..25: note = Seed: LNVIVHSATGFKQSSKALQRPVASD
LNVIVHSATGYKQISIALIRPVASD

SEQ ID NO: 9428 - protein, 25 aa, synthetic construct
  source 1..25: note = Seed: LNVIVHSATGFKQSSKALQRPVASD
LNVIVHSATGYKQISIALLRPVASD

SEQ ID NO: 9429 - protein, 25 aa, synthetic construct
  source 1..25: note = Seed: LNVIVHSATGFKQSSKALQRPVASD
LNVIVHSATGYKQISIALMRPVASD

SEQ ID NO: 9430 - protein, 25 aa, synthetic construct
  source 1..25: note = Seed: LNVIVHSATGFKQSSKALQRPVASD
LNVIVHSATGYKQISIALNRPVASD

SEQ ID NO: 9431 - protein, 25 aa, synthetic construct
  source 1..25: note = Seed: LNVIVHSATGFKQSSKALQRPVASD
LNVIVHSATGYKQISIALPRPVASD

SEQ ID NO: 9432 - protein, 25 aa, synthetic construct
  source 1..25: note = Seed: LNVIVHSATGFKQSSKALQRPVASD
LNVIVHSATGYKQISIALQRPVASD

SEQ ID NO: 9433 - protein, 25 aa, synthetic construct
  source 1..25: note = Seed: LNVIVHSATGFKQSSKALQRPVASD
LNVIVHSATGYKQISIALSRPVASD

SEQ ID NO: 9434 - protein, 25 aa, synthetic construct
  source 1..25: note = Seed: LNVIVHSATGFKQSSKALQRPVASD
LNVIVHSATGYKQISIALTRPVASD

SEQ ID NO: 9435 - protein, 25 aa, synthetic construct
  source 1..25: note = Seed: LNVIVHSATGFKQSSKALQRPVASD
LNVIVHSATGYKQISIALVRPVASD

SEQ ID NO: 9436 - protein, 25 aa, synthetic construct
  source 1..25: note = Seed: LNVIVHSATGFKQSSKALQRPVASD
LNVIVHSATGYKQISIALYRPVASD

SEQ ID NO: 9437 - protein, 25 aa, synthetic construct
  source 1..25: note = Seed: LNVIVHSATGFKQSSKALQRPVASD
LNVIVHSATGYKQISKALARPVASD

SEQ ID NO: 9438 - protein, 25 aa, synthetic construct
  source 1..25: note = Seed: LNVIVHSATGFKQSSKALQRPVASD
LNVIVHSATGYKQISKALCRPVASD

SEQ ID NO: 9439 - protein, 25 aa, synthetic construct
  source 1..25: note = Seed: LNVIVHSATGFKQSSKALQRPVASD
LNVIVHSATGYKQISKALGRPVASD

SEQ ID NO: 9440 - protein, 25 aa, synthetic construct
  source 1..25: note = Seed: LNVIVHSATGFKQSSKALQRPVASD
LNVIVHSATGYKQISKALHRPVASD

SEQ ID NO: 9441 - protein, 25 aa, synthetic construct
  source 1..25: note = Seed: LNVIVHSATGFKQSSKALQRPVASD
LNVIVHSATGYKQISKALIRPVASD

SEQ ID NO: 9442 - protein, 25 aa, synthetic construct
  source 1..25: note = Seed: LNVIVHSATGFKQSSKALQRPVASD
LNVIVHSATGYKQISKALKRPVASD

SEQ ID NO: 9443 - protein, 25 aa, synthetic construct
  source 1..25: note = Seed: LNVIVHSATGFKQSSKALQRPVASD
LNVIVHSATGYKQISKALLRPVASD

SEQ ID NO: 9444 - protein, 25 aa, synthetic construct
  source 1..25: note = Seed: LNVIVHSATGFKQSSKALQRPVASD
LNVIVHSATGYKQISKALMRPVASD

SEQ ID NO: 9445 - protein, 25 aa, synthetic construct
  source 1..25: note = Seed: LNVIVHSATGFKQSSKALQRPVASD
LNVIVHSATGYKQISKALNRPVASD

SEQ ID NO: 9446 - protein, 25 aa, synthetic construct
  source 1..25: note = Seed: LNVIVHSATGFKQSSKALQRPVASD
LNVIVHSATGYKQISKALPRPVASD

SEQ ID NO: 9447 - protein, 25 aa, synthetic construct
  source 1..25: note = Seed: LNVIVHSATGFKQSSKALQRPVASD
LNVIVHSATGYKQISKALQRPVASD

SEQ ID NO: 9448 - protein, 25 aa, synthetic construct
  source 1..25: note = Seed: LNVIVHSATGFKQSSKALQRPVASD
LNVIVHSATGYKQISKALRRPVASD

SEQ ID NO: 9449 - protein, 25 aa, synthetic construct
  source 1..25: note = Seed: LNVIVHSATGFKQSSKALQRPVASD
LNVIVHSATGYKQISKALSRPVASD

SEQ ID NO: 9450 - protein, 25 aa, synthetic construct
  source 1..25: note = Seed: LNVIVHSATGFKQSSKALQRPVASD
LNVIVHSATGYKQISKALTRPVASD

SEQ ID NO: 9451 - protein, 25 aa, synthetic construct
  source 1..25: note = Seed: LNVIVHSATGFKQSSKALQRPVASD
LNVIVHSATGYKQISKALVRPVASD

SEQ ID NO: 9452 - protein, 25 aa, synthetic construct
  source 1..25: note = Seed: LNVIVHSATGFKQSSKALQRPVASD
LNVIVHSATGYKQISKALYRPVASD

SEQ ID NO: 9453 - protein, 25 aa, synthetic construct
  source 1..25: note = Seed: LNVIVHSATGFKQSSKALQRPVASD
LNVIVHSATGYKQISLALARPVASD

SEQ ID NO: 9454 - protein, 25 aa, synthetic construct
  source 1..25: note = Seed: LNVIVHSATGFKQSSKALQRPVASD
LNVIVHSATGYKQISLALDRPVASD

SEQ ID NO: 9455 - protein, 25 aa, synthetic construct
  source 1..25: note = Seed: LNVIVHSATGFKQSSKALQRPVASD
LNVIVHSATGYKQISLALFRPVASD

SEQ ID NO: 9456 - protein, 25 aa, synthetic construct
  source 1..25: note = Seed: LNVIVHSATGFKQSSKALQRPVASD
LNVIVHSATGYKQISLALGRPVASD

SEQ ID NO: 9457 - protein, 25 aa, synthetic construct
  source 1..25: note = Seed: LNVIVHSATGFKQSSKALQRPVASD
LNVIVHSATGYKQISLALHRPVASD

SEQ ID NO: 9458 - protein, 25 aa, synthetic construct
  source 1..25: note = Seed: LNVIVHSATGFKQSSKALQRPVASD
LNVIVHSATGYKQISLALIRPVASD

SEQ ID NO: 9459 - protein, 25 aa, synthetic construct
  source 1..25: note = Seed: LNVIVHSATGFKQSSKALQRPVASD
LNVIVHSATGYKQISLALLRPVASD

SEQ ID NO: 9460 - protein, 25 aa, synthetic construct
  source 1..25: note = Seed: LNVIVHSATGFKQSSKALQRPVASD
LNVIVHSATGYKQISLALMRPVASD

SEQ ID NO: 9461 - protein, 25 aa, synthetic construct
  source 1..25: note = Seed: LNVIVHSATGFKQSSKALQRPVASD
LNVIVHSATGYKQISLALNRPVASD

SEQ ID NO: 9462 - protein, 25 aa, synthetic construct
  source 1..25: note = Seed: LNVIVHSATGFKQSSKALQRPVASD
LNVIVHSATGYKQISLALQRPVASD

SEQ ID NO: 9463 - protein, 25 aa, synthetic construct
  source 1..25: note = Seed: LNVIVHSATGFKQSSKALQRPVASD
LNVIVHSATGYKQISLALSRPVASD

SEQ ID NO: 9464 - protein, 25 aa, synthetic construct
  source 1..25: note = Seed: LNVIVHSATGFKQSSKALQRPVASD
LNVIVHSATGYKQISLALTRPVASD

SEQ ID NO: 9465 - protein, 25 aa, synthetic construct
  source 1..25: note = Seed: LNVIVHSATGFKQSSKALQRPVASD
LNVIVHSATGYKQISLALVRPVASD

SEQ ID NO: 9466 - protein, 25 aa, synthetic construct
  source 1..25: note = Seed: LNVIVHSATGFKQSSKALQRPVASD
LNVIVHSATGYKQISMALARPVASD

SEQ ID NO: 9467 - protein, 25 aa, synthetic construct
  source 1..25: note = Seed: LNVIVHSATGFKQSSKALQRPVASD
LNVIVHSATGYKQISMALCRPVASD

SEQ ID NO: 9468 - protein, 25 aa, synthetic construct
  source 1..25: note = Seed: LNVIVHSATGFKQSSKALQRPVASD
LNVIVHSATGYKQISMALDRPVASD

SEQ ID NO: 9469 - protein, 25 aa, synthetic construct
  source 1..25: note = Seed: LNVIVHSATGFKQSSKALQRPVASD
LNVIVHSATGYKQISMALFRPVASD

SEQ ID NO: 9470 - protein, 25 aa, synthetic construct
  source 1..25: note = Seed: LNVIVHSATGFKQSSKALQRPVASD
LNVIVHSATGYKQISMALGRPVASD

SEQ ID NO: 9471 - protein, 25 aa, synthetic construct
  source 1..25: note = Seed: LNVIVHSATGFKQSSKALQRPVASD
LNVIVHSATGYKQISMALHRPVASD

SEQ ID NO: 9472 - protein, 25 aa, synthetic construct
  source 1..25: note = Seed: LNVIVHSATGFKQSSKALQRPVASD
LNVIVHSATGYKQISMALIRPVASD

SEQ ID NO: 9473 - protein, 25 aa, synthetic construct
  source 1..25: note = Seed: LNVIVHSATGFKQSSKALQRPVASD
LNVIVHSATGYKQISMALLRPVASD

SEQ ID NO: 9474 - protein, 25 aa, synthetic construct
  source 1..25: note = Seed: LNVIVHSATGFKQSSKALQRPVASD
LNVIVHSATGYKQISMALMRPVASD

SEQ ID NO: 9475 - protein, 25 aa, synthetic construct
  source 1..25: note = Seed: LNVIVHSATGFKQSSKALQRPVASD
LNVIVHSATGYKQISMALNRPVASD

SEQ ID NO: 9476 - protein, 25 aa, synthetic construct
  source 1..25: note = Seed: LNVIVHSATGFKQSSKALQRPVASD
LNVIVHSATGYKQISMALQRPVASD

SEQ ID NO: 9477 - protein, 25 aa, synthetic construct
  source 1..25: note = Seed: LNVIVHSATGFKQSSKALQRPVASD
LNVIVHSATGYKQISMALSRPVASD

SEQ ID NO: 9478 - protein, 25 aa, synthetic construct
  source 1..25: note = Seed: LNVIVHSATGFKQSSKALQRPVASD
LNVIVHSATGYKQISMALTRPVASD

SEQ ID NO: 9479 - protein, 25 aa, synthetic construct
  source 1..25: note = Seed: LNVIVHSATGFKQSSKALQRPVASD
LNVIVHSATGYKQISMALVRPVASD

SEQ ID NO: 9480 - protein, 25 aa, synthetic construct
  source 1..25: note = Seed: LNVIVHSATGFKQSSKALQRPVASD
LNVIVHSATGYKQISNALARPVASD

SEQ ID NO: 9481 - protein, 25 aa, synthetic construct
  source 1..25: note = Seed: LNVIVHSATGFKQSSKALQRPVASD
LNVIVHSATGYKQISNALCRPVASD

SEQ ID NO: 9482 - protein, 25 aa, synthetic construct
  source 1..25: note = Seed: LNVIVHSATGFKQSSKALQRPVASD
LNVIVHSATGYKQISNALGRPVASD

SEQ ID NO: 9483 - protein, 25 aa, synthetic construct
  source 1..25: note = Seed: LNVIVHSATGFKQSSKALQRPVASD
LNVIVHSATGYKQISNALHRPVASD

SEQ ID NO: 9484 - protein, 25 aa, synthetic construct
  source 1..25: note = Seed: LNVIVHSATGFKQSSKALQRPVASD
LNVIVHSATGYKQISNALIRPVASD

SEQ ID NO: 9485 - protein, 25 aa, synthetic construct
  source 1..25: note = Seed: LNVIVHSATGFKQSSKALQRPVASD
LNVIVHSATGYKQISNALLRPVASD

SEQ ID NO: 9486 - protein, 25 aa, synthetic construct
  source 1..25: note = Seed: LNVIVHSATGFKQSSKALQRPVASD
LNVIVHSATGYKQISNALMRPVASD

SEQ ID NO: 9487 - protein, 25 aa, synthetic construct
  source 1..25: note = Seed: LNVIVHSATGFKQSSKALQRPVASD
LNVIVHSATGYKQISNALNRPVASD

SEQ ID NO: 9488 - protein, 25 aa, synthetic construct
  source 1..25: note = Seed: LNVIVHSATGFKQSSKALQRPVASD
LNVIVHSATGYKQISNALPRPVASD

SEQ ID NO: 9489 - protein, 25 aa, synthetic construct
  source 1..25: note = Seed: LNVIVHSATGFKQSSKALQRPVASD
LNVIVHSATGYKQISNALQRPVASD

SEQ ID NO: 9490 - protein, 25 aa, synthetic construct
  source 1..25: note = Seed: LNVIVHSATGFKQSSKALQRPVASD
LNVIVHSATGYKQISNALSRPVASD

SEQ ID NO: 9491 - protein, 25 aa, synthetic construct
  source 1..25: note = Seed: LNVIVHSATGFKQSSKALQRPVASD
LNVIVHSATGYKQISNALTRPVASD

SEQ ID NO: 9492 - protein, 25 aa, synthetic construct
  source 1..25: note = Seed: LNVIVHSATGFKQSSKALQRPVASD
LNVIVHSATGYKQISNALVRPVASD

SEQ ID NO: 9493 - protein, 25 aa, synthetic construct
  source 1..25: note = Seed: LNVIVHSATGFKQSSKALQRPVASD
LNVIVHSATGYKQISPALARPVASD

SEQ ID NO: 9494 - protein, 25 aa, synthetic construct
  source 1..25: note = Seed: LNVIVHSATGFKQSSKALQRPVASD
LNVIVHSATGYKQISPALCRPVASD

SEQ ID NO: 9495 - protein, 25 aa, synthetic construct
  source 1..25: note = Seed: LNVIVHSATGFKQSSKALQRPVASD
LNVIVHSATGYKQISPALDRPVASD

SEQ ID NO: 9496 - protein, 25 aa, synthetic construct
  source 1..25: note = Seed: LNVIVHSATGFKQSSKALQRPVASD
LNVIVHSATGYKQISPALERPVASD

SEQ ID NO: 9497 - protein, 25 aa, synthetic construct
  source 1..25: note = Seed: LNVIVHSATGFKQSSKALQRPVASD
LNVIVHSATGYKQISPALFRPVASD

SEQ ID NO: 9498 - protein, 25 aa, synthetic construct
  source 1..25: note = Seed: LNVIVHSATGFKQSSKALQRPVASD
LNVIVHSATGYKQISPALGRPVASD

SEQ ID NO: 9499 - protein, 25 aa, synthetic construct
  source 1..25: note = Seed: LNVIVHSATGFKQSSKALQRPVASD
LNVIVHSATGYKQISPALHRPVASD

SEQ ID NO: 9500 - protein, 25 aa, synthetic construct
  source 1..25: note = Seed: LNVIVHSATGFKQSSKALQRPVASD
LNVIVHSATGYKQISPALIRPVASD

SEQ ID NO: 9501 - protein, 25 aa, synthetic construct
  source 1..25: note = Seed: LNVIVHSATGFKQSSKALQRPVASD
LNVIVHSATGYKQISPALLRPVASD

SEQ ID NO: 9502 - protein, 25 aa, synthetic construct
  source 1..25: note = Seed: LNVIVHSATGFKQSSKALQRPVASD
LNVIVHSATGYKQISPALMRPVASD

SEQ ID NO: 9503 - protein, 25 aa, synthetic construct
  source 1..25: note = Seed: LNVIVHSATGFKQSSKALQRPVASD
LNVIVHSATGYKQISPALNRPVASD

SEQ ID NO: 9504 - protein, 25 aa, synthetic construct
  source 1..25: note = Seed: LNVIVHSATGFKQSSKALQRPVASD
LNVIVHSATGYKQISPALPRPVASD

SEQ ID NO: 9505 - protein, 25 aa, synthetic construct
  source 1..25: note = Seed: LNVIVHSATGFKQSSKALQRPVASD
LNVIVHSATGYKQISPALQRPVASD

SEQ ID NO: 9506 - protein, 25 aa, synthetic construct
  source 1..25: note = Seed: LNVIVHSATGFKQSSKALQRPVASD
LNVIVHSATGYKQISPALSRPVASD

SEQ ID NO: 9507 - protein, 25 aa, synthetic construct
  source 1..25: note = Seed: LNVIVHSATGFKQSSKALQRPVASD
LNVIVHSATGYKQISPALTRPVASD

SEQ ID NO: 9508 - protein, 25 aa, synthetic construct
  source 1..25: note = Seed: LNVIVHSATGFKQSSKALQRPVASD
LNVIVHSATGYKQISPALVRPVASD

SEQ ID NO: 9509 - protein, 25 aa, synthetic construct
  source 1..25: note = Seed: LNVIVHSATGFKQSSKALQRPVASD
LNVIVHSATGYKQISPALWRPVASD

SEQ ID NO: 9510 - protein, 25 aa, synthetic construct
  source 1..25: note = Seed: LNVIVHSATGFKQSSKALQRPVASD
LNVIVHSATGYKQISPALYRPVASD

SEQ ID NO: 9511 - protein, 25 aa, synthetic construct
  source 1..25: note = Seed: LNVIVHSATGFKQSSKALQRPVASD
LNVIVHSATGYKQISQALARPVASD

SEQ ID NO: 9512 - protein, 25 aa, synthetic construct
  source 1..25: note = Seed: LNVIVHSATGFKQSSKALQRPVASD
LNVIVHSATGYKQISQALIRPVASD

SEQ ID NO: 9513 - protein, 25 aa, synthetic construct
  source 1..25: note = Seed: LNVIVHSATGFKQSSKALQRPVASD
LNVIVHSATGYKQISQALLRPVASD

SEQ ID NO: 9514 - protein, 25 aa, synthetic construct
  source 1..25: note = Seed: LNVIVHSATGFKQSSKALQRPVASD
LNVIVHSATGYKQISQALNRPVASD

SEQ ID NO: 9515 - protein, 25 aa, synthetic construct
  source 1..25: note = Seed: LNVIVHSATGFKQSSKALQRPVASD
LNVIVHSATGYKQISQALSRPVASD

SEQ ID NO: 9516 - protein, 25 aa, synthetic construct
  source 1..25: note = Seed: LNVIVHSATGFKQSSKALQRPVASD
LNVIVHSATGYKQISQALTRPVASD

SEQ ID NO: 9517 - protein, 25 aa, synthetic construct
  source 1..25: note = Seed: LNVIVHSATGFKQSSKALQRPVASD
LNVIVHSATGYKQISQALVRPVASD

SEQ ID NO: 9518 - protein, 25 aa, synthetic construct
  source 1..25: note = Seed: LNVIVHSATGFKQSSKALQRPVASD
LNVIVHSATGYKQISRALARPVASD

SEQ ID NO: 9519 - protein, 25 aa, synthetic construct
  source 1..25: note = Seed: LNVIVHSATGFKQSSKALQRPVASD
LNVIVHSATGYKQISRALCRPVASD

SEQ ID NO: 9520 - protein, 25 aa, synthetic construct
  source 1..25: note = Seed: LNVIVHSATGFKQSSKALQRPVASD
LNVIVHSATGYKQISRALERPVASD

SEQ ID NO: 9521 - protein, 25 aa, synthetic construct
  source 1..25: note = Seed: LNVIVHSATGFKQSSKALQRPVASD
LNVIVHSATGYKQISRALFRPVASD

SEQ ID NO: 9522 - protein, 25 aa, synthetic construct
  source 1..25: note = Seed: LNVIVHSATGFKQSSKALQRPVASD
LNVIVHSATGYKQISRALGRPVASD

SEQ ID NO: 9523 - protein, 25 aa, synthetic construct
  source 1..25: note = Seed: LNVIVHSATGFKQSSKALQRPVASD
LNVIVHSATGYKQISRALHRPVASD

SEQ ID NO: 9524 - protein, 25 aa, synthetic construct
  source 1..25: note = Seed: LNVIVHSATGFKQSSKALQRPVASD
LNVIVHSATGYKQISRALIRPVASD

SEQ ID NO: 9525 - protein, 25 aa, synthetic construct
  source 1..25: note = Seed: LNVIVHSATGFKQSSKALQRPVASD
LNVIVHSATGYKQISRALKRPVASD

SEQ ID NO: 9526 - protein, 25 aa, synthetic construct
  source 1..25: note = Seed: LNVIVHSATGFKQSSKALQRPVASD
LNVIVHSATGYKQISRALLRPVASD

SEQ ID NO: 9527 - protein, 25 aa, synthetic construct
  source 1..25: note = Seed: LNVIVHSATGFKQSSKALQRPVASD
LNVIVHSATGYKQISRALMRPVASD

SEQ ID NO: 9528 - protein, 25 aa, synthetic construct
  source 1..25: note = Seed: LNVIVHSATGFKQSSKALQRPVASD
LNVIVHSATGYKQISRALNRPVASD

SEQ ID NO: 9529 - protein, 25 aa, synthetic construct
  source 1..25: note = Seed: LNVIVHSATGFKQSSKALQRPVASD
LNVIVHSATGYKQISRALPRPVASD

SEQ ID NO: 9530 - protein, 25 aa, synthetic construct
  source 1..25: note = Seed: LNVIVHSATGFKQSSKALQRPVASD
LNVIVHSATGYKQISRALQRPVASD

SEQ ID NO: 9531 - protein, 25 aa, synthetic construct
  source 1..25: note = Seed: LNVIVHSATGFKQSSKALQRPVASD
LNVIVHSATGYKQISRALRRPVASD

SEQ ID NO: 9532 - protein, 25 aa, synthetic construct
  source 1..25: note = Seed: LNVIVHSATGFKQSSKALQRPVASD
LNVIVHSATGYKQISRALSRPVASD

SEQ ID NO: 9533 - protein, 25 aa, synthetic construct
  source 1..25: note = Seed: LNVIVHSATGFKQSSKALQRPVASD
LNVIVHSATGYKQISRALTRPVASD

SEQ ID NO: 9534 - protein, 25 aa, synthetic construct
  source 1..25: note = Seed: LNVIVHSATGFKQSSKALQRPVASD
LNVIVHSATGYKQISRALVRPVASD

SEQ ID NO: 9535 - protein, 25 aa, synthetic construct
  source 1..25: note = Seed: LNVIVHSATGFKQSSKALQRPVASD
LNVIVHSATGYKQISRALWRPVASD

SEQ ID NO: 9536 - protein, 25 aa, synthetic construct
  source 1..25: note = Seed: LNVIVHSATGFKQSSKALQRPVASD
LNVIVHSATGYKQISRALYRPVASD

SEQ ID NO: 9537 - protein, 25 aa, synthetic construct
  source 1..25: note = Seed: LNVIVHSATGFKQSSKALQRPVASD
LNVIVHSATGYKQISSALARPVASD

SEQ ID NO: 9538 - protein, 25 aa, synthetic construct
  source 1..25: note = Seed: LNVIVHSATGFKQSSKALQRPVASD
LNVIVHSATGYKQISSALCRPVASD

SEQ ID NO: 9539 - protein, 25 aa, synthetic construct
  source 1..25: note = Seed: LNVIVHSATGFKQSSKALQRPVASD
LNVIVHSATGYKQISSALDRPVASD

SEQ ID NO: 9540 - protein, 25 aa, synthetic construct
  source 1..25: note = Seed: LNVIVHSATGFKQSSKALQRPVASD
LNVIVHSATGYKQISSALERPVASD

SEQ ID NO: 9541 - protein, 25 aa, synthetic construct
  source 1..25: note = Seed: LNVIVHSATGFKQSSKALQRPVASD
LNVIVHSATGYKQISSALFRPVASD

SEQ ID NO: 9542 - protein, 25 aa, synthetic construct
  source 1..25: note = Seed: LNVIVHSATGFKQSSKALQRPVASD
LNVIVHSATGYKQISSALGRPVASD

SEQ ID NO: 9543 - protein, 25 aa, synthetic construct
  source 1..25: note = Seed: LNVIVHSATGFKQSSKALQRPVASD
LNVIVHSATGYKQISSALHRPVASD

SEQ ID NO: 9544 - protein, 25 aa, synthetic construct
  source 1..25: note = Seed: LNVIVHSATGFKQSSKALQRPVASD
LNVIVHSATGYKQISSALIRPVASD

SEQ ID NO: 9545 - protein, 25 aa, synthetic construct
  source 1..25: note = Seed: LNVIVHSATGFKQSSKALQRPVASD
LNVIVHSATGYKQISSALLRPVASD

SEQ ID NO: 9546 - protein, 25 aa, synthetic construct
  source 1..25: note = Seed: LNVIVHSATGFKQSSKALQRPVASD
LNVIVHSATGYKQISSALMRPVASD

SEQ ID NO: 9547 - protein, 25 aa, synthetic construct
  source 1..25: note = Seed: LNVIVHSATGFKQSSKALQRPVASD
LNVIVHSATGYKQISSALNRPVASD

SEQ ID NO: 9548 - protein, 25 aa, synthetic construct
  source 1..25: note = Seed: LNVIVHSATGFKQSSKALQRPVASD
LNVIVHSATGYKQISSALPRPVASD

SEQ ID NO: 9549 - protein, 25 aa, synthetic construct
  source 1..25: note = Seed: LNVIVHSATGFKQSSKALQRPVASD
LNVIVHSATGYKQISSALQRPVASD

SEQ ID NO: 9550 - protein, 25 aa, synthetic construct
  source 1..25: note = Seed: LNVIVHSATGFKQSSKALQRPVASD
LNVIVHSATGYKQISSALRRPVASD

SEQ ID NO: 9551 - protein, 25 aa, synthetic construct
  source 1..25: note = Seed: LNVIVHSATGFKQSSKALQRPVASD
LNVIVHSATGYKQISSALSRPVASD

SEQ ID NO: 9552 - protein, 25 aa, synthetic construct
  source 1..25: note = Seed: LNVIVHSATGFKQSSKALQRPVASD
LNVIVHSATGYKQISSALTRPVASD

SEQ ID NO: 9553 - protein, 25 aa, synthetic construct
  source 1..25: note = Seed: LNVIVHSATGFKQSSKALQRPVASD
LNVIVHSATGYKQISSALVRPVASD

SEQ ID NO: 9554 - protein, 25 aa, synthetic construct
  source 1..25: note = Seed: LNVIVHSATGFKQSSKALQRPVASD
LNVIVHSATGYKQISSALYRPVASD

SEQ ID NO: 9555 - protein, 25 aa, synthetic construct
  source 1..25: note = Seed: LNVIVHSATGFKQSSKALQRPVASD
LNVIVHSATGYKQISTALARPVASD

SEQ ID NO: 9556 - protein, 25 aa, synthetic construct
  source 1..25: note = Seed: LNVIVHSATGFKQSSKALQRPVASD
LNVIVHSATGYKQISTALCRPVASD

SEQ ID NO: 9557 - protein, 25 aa, synthetic construct
  source 1..25: note = Seed: LNVIVHSATGFKQSSKALQRPVASD
LNVIVHSATGYKQISTALDRPVASD

SEQ ID NO: 9558 - protein, 25 aa, synthetic construct
  source 1..25: note = Seed: LNVIVHSATGFKQSSKALQRPVASD
LNVIVHSATGYKQISTALERPVASD

SEQ ID NO: 9559 - protein, 25 aa, synthetic construct
  source 1..25: note = Seed: LNVIVHSATGFKQSSKALQRPVASD
LNVIVHSATGYKQISTALFRPVASD

SEQ ID NO: 9560 - protein, 25 aa, synthetic construct
  source 1..25: note = Seed: LNVIVHSATGFKQSSKALQRPVASD
LNVIVHSATGYKQISTALGRPVASD

SEQ ID NO: 9561 - protein, 25 aa, synthetic construct
  source 1..25: note = Seed: LNVIVHSATGFKQSSKALQRPVASD
LNVIVHSATGYKQISTALHRPVASD

SEQ ID NO: 9562 - protein, 25 aa, synthetic construct
  source 1..25: note = Seed: LNVIVHSATGFKQSSKALQRPVASD
LNVIVHSATGYKQISTALIRPVASD

SEQ ID NO: 9563 - protein, 25 aa, synthetic construct
  source 1..25: note = Seed: LNVIVHSATGFKQSSKALQRPVASD
LNVIVHSATGYKQISTALLRPVASD

SEQ ID NO: 9564 - protein, 25 aa, synthetic construct
  source 1..25: note = Seed: LNVIVHSATGFKQSSKALQRPVASD
LNVIVHSATGYKQISTALMRPVASD

SEQ ID NO: 9565 - protein, 25 aa, synthetic construct
  source 1..25: note = Seed: LNVIVHSATGFKQSSKALQRPVASD
LNVIVHSATGYKQISTALNRPVASD

SEQ ID NO: 9566 - protein, 25 aa, synthetic construct
  source 1..25: note = Seed: LNVIVHSATGFKQSSKALQRPVASD
LNVIVHSATGYKQISTALPRPVASD

SEQ ID NO: 9567 - protein, 25 aa, synthetic construct
  source 1..25: note = Seed: LNVIVHSATGFKQSSKALQRPVASD
LNVIVHSATGYKQISTALQRPVASD

SEQ ID NO: 9568 - protein, 25 aa, synthetic construct
  source 1..25: note = Seed: LNVIVHSATGFKQSSKALQRPVASD
LNVIVHSATGYKQISTALSRPVASD

SEQ ID NO: 9569 - protein, 25 aa, synthetic construct
  source 1..25: note = Seed: LNVIVHSATGFKQSSKALQRPVASD
LNVIVHSATGYKQISTALTRPVASD

SEQ ID NO: 9570 - protein, 25 aa, synthetic construct
  source 1..25: note = Seed: LNVIVHSATGFKQSSKALQRPVASD
LNVIVHSATGYKQISTALVRPVASD

SEQ ID NO: 9571 - protein, 25 aa, synthetic construct
  source 1..25: note = Seed: LNVIVHSATGFKQSSKALQRPVASD
LNVIVHSATGYKQISTALYRPVASD

SEQ ID NO: 9572 - protein, 25 aa, synthetic construct
  source 1..25: note = Seed: LNVIVHSATGFKQSSKALQRPVASD
LNVIVHSATGYKQISVALARPVASD

SEQ ID NO: 9573 - protein, 25 aa, synthetic construct
  source 1..25: note = Seed: LNVIVHSATGFKQSSKALQRPVASD
LNVIVHSATGYKQISVALCRPVASD

SEQ ID NO: 9574 - protein, 25 aa, synthetic construct
  source 1..25: note = Seed: LNVIVHSATGFKQSSKALQRPVASD
LNVIVHSATGYKQISVALDRPVASD

SEQ ID NO: 9575 - protein, 25 aa, synthetic construct
  source 1..25: note = Seed: LNVIVHSATGFKQSSKALQRPVASD
LNVIVHSATGYKQISVALERPVASD

SEQ ID NO: 9576 - protein, 25 aa, synthetic construct
  source 1..25: note = Seed: LNVIVHSATGFKQSSKALQRPVASD
LNVIVHSATGYKQISVALFRPVASD

SEQ ID NO: 9577 - protein, 25 aa, synthetic construct
  source 1..25: note = Seed: LNVIVHSATGFKQSSKALQRPVASD
LNVIVHSATGYKQISVALGRPVASD

SEQ ID NO: 9578 - protein, 25 aa, synthetic construct
  source 1..25: note = Seed: LNVIVHSATGFKQSSKALQRPVASD
LNVIVHSATGYKQISVALHRPVASD

SEQ ID NO: 9579 - protein, 25 aa, synthetic construct
  source 1..25: note = Seed: LNVIVHSATGFKQSSKALQRPVASD
LNVIVHSATGYKQISVALIRPVASD

SEQ ID NO: 9580 - protein, 25 aa, synthetic construct
  source 1..25: note = Seed: LNVIVHSATGFKQSSKALQRPVASD
LNVIVHSATGYKQISVALKRPVASD

SEQ ID NO: 9581 - protein, 25 aa, synthetic construct
  source 1..25: note = Seed: LNVIVHSATGFKQSSKALQRPVASD
LNVIVHSATGYKQISVALLRPVASD

SEQ ID NO: 9582 - protein, 25 aa, synthetic construct
  source 1..25: note = Seed: LNVIVHSATGFKQSSKALQRPVASD
LNVIVHSATGYKQISVALMRPVASD

SEQ ID NO: 9583 - protein, 25 aa, synthetic construct
  source 1..25: note = Seed: LNVIVHSATGFKQSSKALQRPVASD
LNVIVHSATGYKQISVALNRPVASD

SEQ ID NO: 9584 - protein, 25 aa, synthetic construct
  source 1..25: note = Seed: LNVIVHSATGFKQSSKALQRPVASD
LNVIVHSATGYKQISVALPRPVASD

SEQ ID NO: 9585 - protein, 25 aa, synthetic construct
  source 1..25: note = Seed: LNVIVHSATGFKQSSKALQRPVASD
LNVIVHSATGYKQISVALQRPVASD

SEQ ID NO: 9586 - protein, 25 aa, synthetic construct
  source 1..25: note = Seed: LNVIVHSATGFKQSSKALQRPVASD
LNVIVHSATGYKQISVALSRPVASD

SEQ ID NO: 9587 - protein, 25 aa, synthetic construct
  source 1..25: note = Seed: LNVIVHSATGFKQSSKALQRPVASD
LNVIVHSATGYKQISVALTRPVASD

SEQ ID NO: 9588 - protein, 25 aa, synthetic construct
  source 1..25: note = Seed: LNVIVHSATGFKQSSKALQRPVASD
LNVIVHSATGYKQISVALVRPVASD

SEQ ID NO: 9589 - protein, 25 aa, synthetic construct
  source 1..25: note = Seed: LNVIVHSATGFKQSSKALQRPVASD
LNVIVHSATGYKQISVALYRPVASD

SEQ ID NO: 9590 - protein, 25 aa, synthetic construct
  source 1..25: note = Seed: LNVIVHSATGFKQSSKALQRPVASD
LNVIVHSATGYKQISWALGRPVASD

SEQ ID NO: 9591 - protein, 25 aa, synthetic construct
  source 1..25: note = Seed: LNVIVHSATGFKQSSKALQRPVASD
LNVIVHSATGYKQISWALIRPVASD

SEQ ID NO: 9592 - protein, 25 aa, synthetic construct
  source 1..25: note = Seed: LNVIVHSATGFKQSSKALQRPVASD
LNVIVHSATGYKQISWALNRPVASD

SEQ ID NO: 9593 - protein, 25 aa, synthetic construct
  source 1..25: note = Seed: LNVIVHSATGFKQSSKALQRPVASD
LNVIVHSATGYKQISWALVRPVASD

SEQ ID NO: 9594 - protein, 25 aa, synthetic construct
  source 1..25: note = Seed: LNVIVHSATGFKQSSKALQRPVASD
LNVIVHSATGYKQISYALGRPVASD

SEQ ID NO: 9595 - protein, 25 aa, synthetic construct
  source 1..25: note = Seed: LNVIVHSATGFKQSSKALQRPVASD
LNVIVHSATGYKQISYALIRPVASD

SEQ ID NO: 9596 - protein, 25 aa, synthetic construct
  source 1..25: note = Seed: LNVIVHSATGFKQSSKALQRPVASD
LNVIVHSATGYKQISYALLRPVASD

SEQ ID NO: 9597 - protein, 25 aa, synthetic construct
  source 1..25: note = Seed: LNVIVHSATGFKQSSKALQRPVASD
LNVIVHSATGYKQKSAALARPVASD

SEQ ID NO: 9598 - protein, 25 aa, synthetic construct
  source 1..25: note = Seed: LNVIVHSATGFKQSSKALQRPVASD
LNVIVHSATGYKQKSAALIRPVASD

SEQ ID NO: 9599 - protein, 25 aa, synthetic construct
  source 1..25: note = Seed: LNVIVHSATGFKQSSKALQRPVASD
LNVIVHSATGYKQKSAALLRPVASD

SEQ ID NO: 9600 - protein, 25 aa, synthetic construct
  source 1..25: note = Seed: LNVIVHSATGFKQSSKALQRPVASD
LNVIVHSATGYKQKSAALVRPVASD

SEQ ID NO: 9601 - protein, 25 aa, synthetic construct
  source 1..25: note = Seed: LNVIVHSATGFKQSSKALQRPVASD
LNVIVHSATGYKQKSGALLRPVASD

SEQ ID NO: 9602 - protein, 25 aa, synthetic construct
  source 1..25: note = Seed: LNVIVHSATGFKQSSKALQRPVASD
LNVIVHSATGYKQKSGALVRPVASD

SEQ ID NO: 9603 - protein, 25 aa, synthetic construct
  source 1..25: note = Seed: LNVIVHSATGFKQSSKALQRPVASD
LNVIVHSATGYKQKSIALARPVASD

SEQ ID NO: 9604 - protein, 25 aa, synthetic construct
  source 1..25: note = Seed: LNVIVHSATGFKQSSKALQRPVASD
LNVIVHSATGYKQKSIALVRPVASD

SEQ ID NO: 9605 - protein, 25 aa, synthetic construct
  source 1..25: note = Seed: LNVIVHSATGFKQSSKALQRPVASD
LNVIVHSATGYKQKSMALARPVASD

SEQ ID NO: 9606 - protein, 25 aa, synthetic construct
  source 1..25: note = Seed: LNVIVHSATGFKQSSKALQRPVASD
LNVIVHSATGYKQKSSALARPVASD

SEQ ID NO: 9607 - protein, 25 aa, synthetic construct
  source 1..25: note = Seed: LNVIVHSATGFKQSSKALQRPVASD
LNVIVHSATGYKQKSSALIRPVASD

SEQ ID NO: 9608 - protein, 25 aa, synthetic construct
  source 1..25: note = Seed: LNVIVHSATGFKQSSKALQRPVASD
LNVIVHSATGYKQKSSALLRPVASD

SEQ ID NO: 9609 - protein, 25 aa, synthetic construct
  source 1..25: note = Seed: LNVIVHSATGFKQSSKALQRPVASD
LNVIVHSATGYKQKSSALVRPVASD

SEQ ID NO: 9610 - protein, 25 aa, synthetic construct
  source 1..25: note = Seed: LNVIVHSATGFKQSSKALQRPVASD
LNVIVHSATGYKQKSVALARPVASD

SEQ ID NO: 9611 - protein, 25 aa, synthetic construct
  source 1..25: note = Seed: LNVIVHSATGFKQSSKALQRPVASD
LNVIVHSATGYKQKSVALIRPVASD

SEQ ID NO: 9612 - protein, 25 aa, synthetic construct
  source 1..25: note = Seed: LNVIVHSATGFKQSSKALQRPVASD
LNVIVHSATGYKQKSVALLRPVASD

SEQ ID NO: 9613 - protein, 25 aa, synthetic construct
  source 1..25: note = Seed: LNVIVHSATGFKQSSKALQRPVASD
LNVIVHSATGYKQKSVALMRPVASD

SEQ ID NO: 9614 - protein, 25 aa, synthetic construct
  source 1..25: note = Seed: LNVIVHSATGFKQSSKALQRPVASD
LNVIVHSATGYKQLSAALARPVASD

SEQ ID NO: 9615 - protein, 25 aa, synthetic construct
  source 1..25: note = Seed: LNVIVHSATGFKQSSKALQRPVASD
LNVIVHSATGYKQLSAALCRPVASD

SEQ ID NO: 9616 - protein, 25 aa, synthetic construct
  source 1..25: note = Seed: LNVIVHSATGFKQSSKALQRPVASD
LNVIVHSATGYKQLSAALDRPVASD

SEQ ID NO: 9617 - protein, 25 aa, synthetic construct
  source 1..25: note = Seed: LNVIVHSATGFKQSSKALQRPVASD
LNVIVHSATGYKQLSAALERPVASD

SEQ ID NO: 9618 - protein, 25 aa, synthetic construct
  source 1..25: note = Seed: LNVIVHSATGFKQSSKALQRPVASD
LNVIVHSATGYKQLSAALFRPVASD

SEQ ID NO: 9619 - protein, 25 aa, synthetic construct
  source 1..25: note = Seed: LNVIVHSATGFKQSSKALQRPVASD
LNVIVHSATGYKQLSAALGRPVASD

SEQ ID NO: 9620 - protein, 25 aa, synthetic construct
  source 1..25: note = Seed: LNVIVHSATGFKQSSKALQRPVASD
LNVIVHSATGYKQLSAALHRPVASD

SEQ ID NO: 9621 - protein, 25 aa, synthetic construct
  source 1..25: note = Seed: LNVIVHSATGFKQSSKALQRPVASD
LNVIVHSATGYKQLSAALIRPVASD

SEQ ID NO: 9622 - protein, 25 aa, synthetic construct
  source 1..25: note = Seed: LNVIVHSATGFKQSSKALQRPVASD
LNVIVHSATGYKQLSAALKRPVASD

SEQ ID NO: 9623 - protein, 25 aa, synthetic construct
  source 1..25: note = Seed: LNVIVHSATGFKQSSKALQRPVASD
LNVIVHSATGYKQLSAALLRPVASD

SEQ ID NO: 9624 - protein, 25 aa, synthetic construct
  source 1..25: note = Seed: LNVIVHSATGFKQSSKALQRPVASD
LNVIVHSATGYKQLSAALMRPVASD

SEQ ID NO: 9625 - protein, 25 aa, synthetic construct
  source 1..25: note = Seed: LNVIVHSATGFKQSSKALQRPVASD
LNVIVHSATGYKQLSAALNRPVASD

SEQ ID NO: 9626 - protein, 25 aa, synthetic construct
  source 1..25: note = Seed: LNVIVHSATGFKQSSKALQRPVASD
LNVIVHSATGYKQLSAALPRPVASD

SEQ ID NO: 9627 - protein, 25 aa, synthetic construct
  source 1..25: note = Seed: LNVIVHSATGFKQSSKALQRPVASD
LNVIVHSATGYKQLSAALQRPVASD

SEQ ID NO: 9628 - protein, 25 aa, synthetic construct
  source 1..25: note = Seed: LNVIVHSATGFKQSSKALQRPVASD
LNVIVHSATGYKQLSAALRRPVASD

SEQ ID NO: 9629 - protein, 25 aa, synthetic construct
  source 1..25: note = Seed: LNVIVHSATGFKQSSKALQRPVASD
LNVIVHSATGYKQLSAALSRPVASD

SEQ ID NO: 9630 - protein, 25 aa, synthetic construct
  source 1..25: note = Seed: LNVIVHSATGFKQSSKALQRPVASD
LNVIVHSATGYKQLSAALTRPVASD

SEQ ID NO: 9631 - protein, 25 aa, synthetic construct
  source 1..25: note = Seed: LNVIVHSATGFKQSSKALQRPVASD
LNVIVHSATGYKQLSAALVRPVASD

SEQ ID NO: 9632 - protein, 25 aa, synthetic construct
  source 1..25: note = Seed: LNVIVHSATGFKQSSKALQRPVASD
LNVIVHSATGYKQLSAALWRPVASD

SEQ ID NO: 9633 - protein, 25 aa, synthetic construct
  source 1..25: note = Seed: LNVIVHSATGFKQSSKALQRPVASD
LNVIVHSATGYKQLSAALYRPVASD

SEQ ID NO: 9634 - protein, 25 aa, synthetic construct
  source 1..25: note = Seed: LNVIVHSATGFKQSSKALQRPVASD
LNVIVHSATGYKQLSCALARPVASD

SEQ ID NO: 9635 - protein, 25 aa, synthetic construct
  source 1..25: note = Seed: LNVIVHSATGFKQSSKALQRPVASD
LNVIVHSATGYKQLSCALGRPVASD

SEQ ID NO: 9636 - protein, 25 aa, synthetic construct
  source 1..25: note = Seed: LNVIVHSATGFKQSSKALQRPVASD
LNVIVHSATGYKQLSCALIRPVASD

SEQ ID NO: 9637 - protein, 25 aa, synthetic construct
  source 1..25: note = Seed: LNVIVHSATGFKQSSKALQRPVASD
LNVIVHSATGYKQLSCALLRPVASD

SEQ ID NO: 9638 - protein, 25 aa, synthetic construct
  source 1..25: note = Seed: LNVIVHSATGFKQSSKALQRPVASD
LNVIVHSATGYKQLSCALNRPVASD

SEQ ID NO: 9639 - protein, 25 aa, synthetic construct
  source 1..25: note = Seed: LNVIVHSATGFKQSSKALQRPVASD
LNVIVHSATGYKQLSCALSRPVASD

SEQ ID NO: 9640 - protein, 25 aa, synthetic construct
  source 1..25: note = Seed: LNVIVHSATGFKQSSKALQRPVASD
LNVIVHSATGYKQLSCALTRPVASD

SEQ ID NO: 9641 - protein, 25 aa, synthetic construct
  source 1..25: note = Seed: LNVIVHSATGFKQSSKALQRPVASD
LNVIVHSATGYKQLSCALVRPVASD

SEQ ID NO: 9642 - protein, 25 aa, synthetic construct
  source 1..25: note = Seed: LNVIVHSATGFKQSSKALQRPVASD
LNVIVHSATGYKQLSDALARPVASD

SEQ ID NO: 9643 - protein, 25 aa, synthetic construct
  source 1..25: note = Seed: LNVIVHSATGFKQSSKALQRPVASD
LNVIVHSATGYKQLSDALIRPVASD

SEQ ID NO: 9644 - protein, 25 aa, synthetic construct
  source 1..25: note = Seed: LNVIVHSATGFKQSSKALQRPVASD
LNVIVHSATGYKQLSDALLRPVASD

SEQ ID NO: 9645 - protein, 25 aa, synthetic construct
  source 1..25: note = Seed: LNVIVHSATGFKQSSKALQRPVASD
LNVIVHSATGYKQLSDALVRPVASD

SEQ ID NO: 9646 - protein, 25 aa, synthetic construct
  source 1..25: note = Seed: LNVIVHSATGFKQSSKALQRPVASD
LNVIVHSATGYKQLSEALARPVASD

SEQ ID NO: 9647 - protein, 25 aa, synthetic construct
  source 1..25: note = Seed: LNVIVHSATGFKQSSKALQRPVASD
LNVIVHSATGYKQLSEALIRPVASD

SEQ ID NO: 9648 - protein, 25 aa, synthetic construct
  source 1..25: note = Seed: LNVIVHSATGFKQSSKALQRPVASD
LNVIVHSATGYKQLSEALLRPVASD

SEQ ID NO: 9649 - protein, 25 aa, synthetic construct
  source 1..25: note = Seed: LNVIVHSATGFKQSSKALQRPVASD
LNVIVHSATGYKQLSEALNRPVASD

SEQ ID NO: 9650 - protein, 25 aa, synthetic construct
  source 1..25: note = Seed: LNVIVHSATGFKQSSKALQRPVASD
LNVIVHSATGYKQLSEALSRPVASD

SEQ ID NO: 9651 - protein, 25 aa, synthetic construct
  source 1..25: note = Seed: LNVIVHSATGFKQSSKALQRPVASD
LNVIVHSATGYKQLSEALTRPVASD

SEQ ID NO: 9652 - protein, 25 aa, synthetic construct
  source 1..25: note = Seed: LNVIVHSATGFKQSSKALQRPVASD
LNVIVHSATGYKQLSEALVRPVASD

SEQ ID NO: 9653 - protein, 25 aa, synthetic construct
  source 1..25: note = Seed: LNVIVHSATGFKQSSKALQRPVASD
LNVIVHSATGYKQLSFALGRPVASD

SEQ ID NO: 9654 - protein, 25 aa, synthetic construct
  source 1..25: note = Seed: LNVIVHSATGFKQSSKALQRPVASD
LNVIVHSATGYKQLSFALHRPVASD

SEQ ID NO: 9655 - protein, 25 aa, synthetic construct
  source 1..25: note = Seed: LNVIVHSATGFKQSSKALQRPVASD
LNVIVHSATGYKQLSFALIRPVASD

SEQ ID NO: 9656 - protein, 25 aa, synthetic construct
  source 1..25: note = Seed: LNVIVHSATGFKQSSKALQRPVASD
LNVIVHSATGYKQLSFALLRPVASD

SEQ ID NO: 9657 - protein, 25 aa, synthetic construct
  source 1..25: note = Seed: LNVIVHSATGFKQSSKALQRPVASD
LNVIVHSATGYKQLSFALMRPVASD

SEQ ID NO: 9658 - protein, 25 aa, synthetic construct
  source 1..25: note = Seed: LNVIVHSATGFKQSSKALQRPVASD
LNVIVHSATGYKQLSFALNRPVASD

SEQ ID NO: 9659 - protein, 25 aa, synthetic construct
  source 1..25: note = Seed: LNVIVHSATGFKQSSKALQRPVASD
LNVIVHSATGYKQLSFALSRPVASD

SEQ ID NO: 9660 - protein, 25 aa, synthetic construct
  source 1..25: note = Seed: LNVIVHSATGFKQSSKALQRPVASD
LNVIVHSATGYKQLSFALVRPVASD

SEQ ID NO: 9661 - protein, 25 aa, synthetic construct
  source 1..25: note = Seed: LNVIVHSATGFKQSSKALQRPVASD
LNVIVHSATGYKQLSGALARPVASD

SEQ ID NO: 9662 - protein, 25 aa, synthetic construct
  source 1..25: note = Seed: LNVIVHSATGFKQSSKALQRPVASD
LNVIVHSATGYKQLSGALCRPVASD

SEQ ID NO: 9663 - protein, 25 aa, synthetic construct
  source 1..25: note = Seed: LNVIVHSATGFKQSSKALQRPVASD
LNVIVHSATGYKQLSGALDRPVASD

SEQ ID NO: 9664 - protein, 25 aa, synthetic construct
  source 1..25: note = Seed: LNVIVHSATGFKQSSKALQRPVASD
LNVIVHSATGYKQLSGALERPVASD

SEQ ID NO: 9665 - protein, 25 aa, synthetic construct
  source 1..25: note = Seed: LNVIVHSATGFKQSSKALQRPVASD
LNVIVHSATGYKQLSGALFRPVASD

SEQ ID NO: 9666 - protein, 25 aa, synthetic construct
  source 1..25: note = Seed: LNVIVHSATGFKQSSKALQRPVASD
LNVIVHSATGYKQLSGALGRPVASD

SEQ ID NO: 9667 - protein, 25 aa, synthetic construct
  source 1..25: note = Seed: LNVIVHSATGFKQSSKALQRPVASD
LNVIVHSATGYKQLSGALHRPVASD

SEQ ID NO: 9668 - protein, 25 aa, synthetic construct
  source 1..25: note = Seed: LNVIVHSATGFKQSSKALQRPVASD
LNVIVHSATGYKQLSGALIRPVASD

SEQ ID NO: 9669 - protein, 25 aa, synthetic construct
  source 1..25: note = Seed: LNVIVHSATGFKQSSKALQRPVASD
LNVIVHSATGYKQLSGALKRPVASD

SEQ ID NO: 9670 - protein, 25 aa, synthetic construct
  source 1..25: note = Seed: LNVIVHSATGFKQSSKALQRPVASD
LNVIVHSATGYKQLSGALLRPVASD

SEQ ID NO: 9671 - protein, 25 aa, synthetic construct
  source 1..25: note = Seed: LNVIVHSATGFKQSSKALQRPVASD
LNVIVHSATGYKQLSGALMRPVASD

SEQ ID NO: 9672 - protein, 25 aa, synthetic construct
  source 1..25: note = Seed: LNVIVHSATGFKQSSKALQRPVASD
LNVIVHSATGYKQLSGALNRPVASD

SEQ ID NO: 9673 - protein, 25 aa, synthetic construct
  source 1..25: note = Seed: LNVIVHSATGFKQSSKALQRPVASD
LNVIVHSATGYKQLSGALPRPVASD

SEQ ID NO: 9674 - protein, 25 aa, synthetic construct
  source 1..25: note = Seed: LNVIVHSATGFKQSSKALQRPVASD
LNVIVHSATGYKQLSGALQRPVASD

SEQ ID NO: 9675 - protein, 25 aa, synthetic construct
  source 1..25: note = Seed: LNVIVHSATGFKQSSKALQRPVASD
LNVIVHSATGYKQLSGALRRPVASD

SEQ ID NO: 9676 - protein, 25 aa, synthetic construct
  source 1..25: note = Seed: LNVIVHSATGFKQSSKALQRPVASD
LNVIVHSATGYKQLSGALSRPVASD

SEQ ID NO: 9677 - protein, 25 aa, synthetic construct
  source 1..25: note = Seed: LNVIVHSATGFKQSSKALQRPVASD
LNVIVHSATGYKQLSGALTRPVASD

SEQ ID NO: 9678 - protein, 25 aa, synthetic construct
  source 1..25: note = Seed: LNVIVHSATGFKQSSKALQRPVASD
LNVIVHSATGYKQLSGALVRPVASD

SEQ ID NO: 9679 - protein, 25 aa, synthetic construct
  source 1..25: note = Seed: LNVIVHSATGFKQSSKALQRPVASD
LNVIVHSATGYKQLSGALWRPVASD

SEQ ID NO: 9680 - protein, 25 aa, synthetic construct
  source 1..25: note = Seed: LNVIVHSATGFKQSSKALQRPVASD
LNVIVHSATGYKQLSGALYRPVASD

SEQ ID NO: 9681 - protein, 25 aa, synthetic construct
  source 1..25: note = Seed: LNVIVHSATGFKQSSKALQRPVASD
LNVIVHSATGYKQLSHALARPVASD

SEQ ID NO: 9682 - protein, 25 aa, synthetic construct
  source 1..25: note = Seed: LNVIVHSATGFKQSSKALQRPVASD
LNVIVHSATGYKQLSHALGRPVASD

SEQ ID NO: 9683 - protein, 25 aa, synthetic construct
  source 1..25: note = Seed: LNVIVHSATGFKQSSKALQRPVASD
LNVIVHSATGYKQLSHALIRPVASD

SEQ ID NO: 9684 - protein, 25 aa, synthetic construct
  source 1..25: note = Seed: LNVIVHSATGFKQSSKALQRPVASD
LNVIVHSATGYKQLSHALKRPVASD

SEQ ID NO: 9685 - protein, 25 aa, synthetic construct
  source 1..25: note = Seed: LNVIVHSATGFKQSSKALQRPVASD
LNVIVHSATGYKQLSHALLRPVASD

SEQ ID NO: 9686 - protein, 25 aa, synthetic construct
  source 1..25: note = Seed: LNVIVHSATGFKQSSKALQRPVASD
LNVIVHSATGYKQLSHALMRPVASD

SEQ ID NO: 9687 - protein, 25 aa, synthetic construct
  source 1..25: note = Seed: LNVIVHSATGFKQSSKALQRPVASD
LNVIVHSATGYKQLSHALNRPVASD

SEQ ID NO: 9688 - protein, 25 aa, synthetic construct
  source 1..25: note = Seed: LNVIVHSATGFKQSSKALQRPVASD
LNVIVHSATGYKQLSHALRRPVASD

SEQ ID NO: 9689 - protein, 25 aa, synthetic construct
  source 1..25: note = Seed: LNVIVHSATGFKQSSKALQRPVASD
LNVIVHSATGYKQLSHALSRPVASD

SEQ ID NO: 9690 - protein, 25 aa, synthetic construct
  source 1..25: note = Seed: LNVIVHSATGFKQSSKALQRPVASD
LNVIVHSATGYKQLSHALTRPVASD

SEQ ID NO: 9691 - protein, 25 aa, synthetic construct
  source 1..25: note = Seed: LNVIVHSATGFKQSSKALQRPVASD
LNVIVHSATGYKQLSHALVRPVASD

SEQ ID NO: 9692 - protein, 25 aa, synthetic construct
  source 1..25: note = Seed: LNVIVHSATGFKQSSKALQRPVASD
LNVIVHSATGYKQLSIALARPVASD

SEQ ID NO: 9693 - protein, 25 aa, synthetic construct
  source 1..25: note = Seed: LNVIVHSATGFKQSSKALQRPVASD
LNVIVHSATGYKQLSIALCRPVASD

SEQ ID NO: 9694 - protein, 25 aa, synthetic construct
  source 1..25: note = Seed: LNVIVHSATGFKQSSKALQRPVASD
LNVIVHSATGYKQLSIALDRPVASD

SEQ ID NO: 9695 - protein, 25 aa, synthetic construct
  source 1..25: note = Seed: LNVIVHSATGFKQSSKALQRPVASD
LNVIVHSATGYKQLSIALERPVASD

SEQ ID NO: 9696 - protein, 25 aa, synthetic construct
  source 1..25: note = Seed: LNVIVHSATGFKQSSKALQRPVASD
LNVIVHSATGYKQLSIALFRPVASD

SEQ ID NO: 9697 - protein, 25 aa, synthetic construct
  source 1..25: note = Seed: LNVIVHSATGFKQSSKALQRPVASD
LNVIVHSATGYKQLSIALGRPVASD

SEQ ID NO: 9698 - protein, 25 aa, synthetic construct
  source 1..25: note = Seed: LNVIVHSATGFKQSSKALQRPVASD
LNVIVHSATGYKQLSIALHRPVASD

SEQ ID NO: 9699 - protein, 25 aa, synthetic construct
  source 1..25: note = Seed: LNVIVHSATGFKQSSKALQRPVASD
LNVIVHSATGYKQLSIALIRPVASD

SEQ ID NO: 9700 - protein, 25 aa, synthetic construct
  source 1..25: note = Seed: LNVIVHSATGFKQSSKALQRPVASD
LNVIVHSATGYKQLSIALKRPVASD

SEQ ID NO: 9701 - protein, 25 aa, synthetic construct
  source 1..25: note = Seed: LNVIVHSATGFKQSSKALQRPVASD
LNVIVHSATGYKQLSIALLRPVASD

SEQ ID NO: 9702 - protein, 25 aa, synthetic construct
  source 1..25: note = Seed: LNVIVHSATGFKQSSKALQRPVASD
LNVIVHSATGYKQLSIALMRPVASD

SEQ ID NO: 9703 - protein, 25 aa, synthetic construct
  source 1..25: note = Seed: LNVIVHSATGFKQSSKALQRPVASD
LNVIVHSATGYKQLSIALNRPVASD

SEQ ID NO: 9704 - protein, 25 aa, synthetic construct
  source 1..25: note = Seed: LNVIVHSATGFKQSSKALQRPVASD
LNVIVHSATGYKQLSIALPRPVASD

SEQ ID NO: 9705 - protein, 25 aa, synthetic construct
  source 1..25: note = Seed: LNVIVHSATGFKQSSKALQRPVASD
LNVIVHSATGYKQLSIALQRPVASD

SEQ ID NO: 9706 - protein, 25 aa, synthetic construct
  source 1..25: note = Seed: LNVIVHSATGFKQSSKALQRPVASD
LNVIVHSATGYKQLSIALSRPVASD

SEQ ID NO: 9707 - protein, 25 aa, synthetic construct
  source 1..25: note = Seed: LNVIVHSATGFKQSSKALQRPVASD
LNVIVHSATGYKQLSIALTRPVASD

SEQ ID NO: 9708 - protein, 25 aa, synthetic construct
  source 1..25: note = Seed: LNVIVHSATGFKQSSKALQRPVASD
LNVIVHSATGYKQLSIALVRPVASD

SEQ ID NO: 9709 - protein, 25 aa, synthetic construct
  source 1..25: note = Seed: LNVIVHSATGFKQSSKALQRPVASD
LNVIVHSATGYKQLSIALYRPVASD

SEQ ID NO: 9710 - protein, 25 aa, synthetic construct
  source 1..25: note = Seed: LNVIVHSATGFKQSSKALQRPVASD
LNVIVHSATGYKQLSKALARPVASD

SEQ ID NO: 9711 - protein, 25 aa, synthetic construct
  source 1..25: note = Seed: LNVIVHSATGFKQSSKALQRPVASD
LNVIVHSATGYKQLSKALGRPVASD

SEQ ID NO: 9712 - protein, 25 aa, synthetic construct
  source 1..25: note = Seed: LNVIVHSATGFKQSSKALQRPVASD
LNVIVHSATGYKQLSKALHRPVASD

SEQ ID NO: 9713 - protein, 25 aa, synthetic construct
  source 1..25: note = Seed: LNVIVHSATGFKQSSKALQRPVASD
LNVIVHSATGYKQLSKALIRPVASD

SEQ ID NO: 9714 - protein, 25 aa, synthetic construct
  source 1..25: note = Seed: LNVIVHSATGFKQSSKALQRPVASD
LNVIVHSATGYKQLSKALKRPVASD

SEQ ID NO: 9715 - protein, 25 aa, synthetic construct
  source 1..25: note = Seed: LNVIVHSATGFKQSSKALQRPVASD
LNVIVHSATGYKQLSKALLRPVASD

SEQ ID NO: 9716 - protein, 25 aa, synthetic construct
  source 1..25: note = Seed: LNVIVHSATGFKQSSKALQRPVASD
LNVIVHSATGYKQLSKALMRPVASD

SEQ ID NO: 9717 - protein, 25 aa, synthetic construct
  source 1..25: note = Seed: LNVIVHSATGFKQSSKALQRPVASD
LNVIVHSATGYKQLSKALNRPVASD

SEQ ID NO: 9718 - protein, 25 aa, synthetic construct
  source 1..25: note = Seed: LNVIVHSATGFKQSSKALQRPVASD
LNVIVHSATGYKQLSKALPRPVASD

SEQ ID NO: 9719 - protein, 25 aa, synthetic construct
  source 1..25: note = Seed: LNVIVHSATGFKQSSKALQRPVASD
LNVIVHSATGYKQLSKALQRPVASD

SEQ ID NO: 9720 - protein, 25 aa, synthetic construct
  source 1..25: note = Seed: LNVIVHSATGFKQSSKALQRPVASD
LNVIVHSATGYKQLSKALRRPVASD

SEQ ID NO: 9721 - protein, 25 aa, synthetic construct
  source 1..25: note = Seed: LNVIVHSATGFKQSSKALQRPVASD
LNVIVHSATGYKQLSKALSRPVASD

SEQ ID NO: 9722 - protein, 25 aa, synthetic construct
  source 1..25: note = Seed: LNVIVHSATGFKQSSKALQRPVASD
LNVIVHSATGYKQLSKALTRPVASD

SEQ ID NO: 9723 - protein, 25 aa, synthetic construct
  source 1..25: note = Seed: LNVIVHSATGFKQSSKALQRPVASD
LNVIVHSATGYKQLSKALVRPVASD

SEQ ID NO: 9724 - protein, 25 aa, synthetic construct
  source 1..25: note = Seed: LNVIVHSATGFKQSSKALQRPVASD
LNVIVHSATGYKQLSKALYRPVASD

SEQ ID NO: 9725 - protein, 25 aa, synthetic construct
  source 1..25: note = Seed: LNVIVHSATGFKQSSKALQRPVASD
LNVIVHSATGYKQLSLALARPVASD

SEQ ID NO: 9726 - protein, 25 aa, synthetic construct
  source 1..25: note = Seed: LNVIVHSATGFKQSSKALQRPVASD
LNVIVHSATGYKQLSLALCRPVASD

SEQ ID NO: 9727 - protein, 25 aa, synthetic construct
  source 1..25: note = Seed: LNVIVHSATGFKQSSKALQRPVASD
LNVIVHSATGYKQLSLALDRPVASD

SEQ ID NO: 9728 - protein, 25 aa, synthetic construct
  source 1..25: note = Seed: LNVIVHSATGFKQSSKALQRPVASD
LNVIVHSATGYKQLSLALERPVASD

SEQ ID NO: 9729 - protein, 25 aa, synthetic construct
  source 1..25: note = Seed: LNVIVHSATGFKQSSKALQRPVASD
LNVIVHSATGYKQLSLALFRPVASD

SEQ ID NO: 9730 - protein, 25 aa, synthetic construct
  source 1..25: note = Seed: LNVIVHSATGFKQSSKALQRPVASD
LNVIVHSATGYKQLSLALGRPVASD

SEQ ID NO: 9731 - protein, 25 aa, synthetic construct
  source 1..25: note = Seed: LNVIVHSATGFKQSSKALQRPVASD
LNVIVHSATGYKQLSLALHRPVASD

SEQ ID NO: 9732 - protein, 25 aa, synthetic construct
  source 1..25: note = Seed: LNVIVHSATGFKQSSKALQRPVASD
LNVIVHSATGYKQLSLALIRPVASD

SEQ ID NO: 9733 - protein, 25 aa, synthetic construct
  source 1..25: note = Seed: LNVIVHSATGFKQSSKALQRPVASD
LNVIVHSATGYKQLSLALLRPVASD

SEQ ID NO: 9734 - protein, 25 aa, synthetic construct
  source 1..25: note = Seed: LNVIVHSATGFKQSSKALQRPVASD
LNVIVHSATGYKQLSLALMRPVASD

SEQ ID NO: 9735 - protein, 25 aa, synthetic construct
  source 1..25: note = Seed: LNVIVHSATGFKQSSKALQRPVASD
LNVIVHSATGYKQLSLALNRPVASD

SEQ ID NO: 9736 - protein, 25 aa, synthetic construct
  source 1..25: note = Seed: LNVIVHSATGFKQSSKALQRPVASD
LNVIVHSATGYKQLSLALPRPVASD

SEQ ID NO: 9737 - protein, 25 aa, synthetic construct
  source 1..25: note = Seed: LNVIVHSATGFKQSSKALQRPVASD
LNVIVHSATGYKQLSLALQRPVASD

SEQ ID NO: 9738 - protein, 25 aa, synthetic construct
  source 1..25: note = Seed: LNVIVHSATGFKQSSKALQRPVASD
LNVIVHSATGYKQLSLALSRPVASD

SEQ ID NO: 9739 - protein, 25 aa, synthetic construct
  source 1..25: note = Seed: LNVIVHSATGFKQSSKALQRPVASD
LNVIVHSATGYKQLSLALTRPVASD

SEQ ID NO: 9740 - protein, 25 aa, synthetic construct
  source 1..25: note = Seed: LNVIVHSATGFKQSSKALQRPVASD
LNVIVHSATGYKQLSLALVRPVASD

SEQ ID NO: 9741 - protein, 25 aa, synthetic construct
  source 1..25: note = Seed: LNVIVHSATGFKQSSKALQRPVASD
LNVIVHSATGYKQLSMALARPVASD

SEQ ID NO: 9742 - protein, 25 aa, synthetic construct
  source 1..25: note = Seed: LNVIVHSATGFKQSSKALQRPVASD
LNVIVHSATGYKQLSMALCRPVASD

SEQ ID NO: 9743 - protein, 25 aa, synthetic construct
  source 1..25: note = Seed: LNVIVHSATGFKQSSKALQRPVASD
LNVIVHSATGYKQLSMALDRPVASD

SEQ ID NO: 9744 - protein, 25 aa, synthetic construct
  source 1..25: note = Seed: LNVIVHSATGFKQSSKALQRPVASD
LNVIVHSATGYKQLSMALERPVASD

SEQ ID NO: 9745 - protein, 25 aa, synthetic construct
  source 1..25: note = Seed: LNVIVHSATGFKQSSKALQRPVASD
LNVIVHSATGYKQLSMALFRPVASD

SEQ ID NO: 9746 - protein, 25 aa, synthetic construct
  source 1..25: note = Seed: LNVIVHSATGFKQSSKALQRPVASD
LNVIVHSATGYKQLSMALGRPVASD

SEQ ID NO: 9747 - protein, 25 aa, synthetic construct
  source 1..25: note = Seed: LNVIVHSATGFKQSSKALQRPVASD
LNVIVHSATGYKQLSMALHRPVASD

SEQ ID NO: 9748 - protein, 25 aa, synthetic construct
  source 1..25: note = Seed: LNVIVHSATGFKQSSKALQRPVASD
LNVIVHSATGYKQLSMALIRPVASD

SEQ ID NO: 9749 - protein, 25 aa, synthetic construct
  source 1..25: note = Seed: LNVIVHSATGFKQSSKALQRPVASD
LNVIVHSATGYKQLSMALLRPVASD

SEQ ID NO: 9750 - protein, 25 aa, synthetic construct
  source 1..25: note = Seed: LNVIVHSATGFKQSSKALQRPVASD
LNVIVHSATGYKQLSMALMRPVASD

SEQ ID NO: 9751 - protein, 25 aa, synthetic construct
  source 1..25: note = Seed: LNVIVHSATGFKQSSKALQRPVASD
LNVIVHSATGYKQLSMALNRPVASD

SEQ ID NO: 9752 - protein, 25 aa, synthetic construct
  source 1..25: note = Seed: LNVIVHSATGFKQSSKALQRPVASD
LNVIVHSATGYKQLSMALQRPVASD

SEQ ID NO: 9753 - protein, 25 aa, synthetic construct
  source 1..25: note = Seed: LNVIVHSATGFKQSSKALQRPVASD
LNVIVHSATGYKQLSMALSRPVASD

SEQ ID NO: 9754 - protein, 25 aa, synthetic construct
  source 1..25: note = Seed: LNVIVHSATGFKQSSKALQRPVASD
LNVIVHSATGYKQLSMALTRPVASD

SEQ ID NO: 9755 - protein, 25 aa, synthetic construct
  source 1..25: note = Seed: LNVIVHSATGFKQSSKALQRPVASD
LNVIVHSATGYKQLSMALVRPVASD

SEQ ID NO: 9756 - protein, 25 aa, synthetic construct
  source 1..25: note = Seed: LNVIVHSATGFKQSSKALQRPVASD
LNVIVHSATGYKQLSNALARPVASD

SEQ ID NO: 9757 - protein, 25 aa, synthetic construct
  source 1..25: note = Seed: LNVIVHSATGFKQSSKALQRPVASD
LNVIVHSATGYKQLSNALCRPVASD

SEQ ID NO: 9758 - protein, 25 aa, synthetic construct
  source 1..25: note = Seed: LNVIVHSATGFKQSSKALQRPVASD
LNVIVHSATGYKQLSNALDRPVASD

SEQ ID NO: 9759 - protein, 25 aa, synthetic construct
  source 1..25: note = Seed: LNVIVHSATGFKQSSKALQRPVASD
LNVIVHSATGYKQLSNALERPVASD

SEQ ID NO: 9760 - protein, 25 aa, synthetic construct
  source 1..25: note = Seed: LNVIVHSATGFKQSSKALQRPVASD
LNVIVHSATGYKQLSNALFRPVASD

SEQ ID NO: 9761 - protein, 25 aa, synthetic construct
  source 1..25: note = Seed: LNVIVHSATGFKQSSKALQRPVASD
LNVIVHSATGYKQLSNALGRPVASD

SEQ ID NO: 9762 - protein, 25 aa, synthetic construct
  source 1..25: note = Seed: LNVIVHSATGFKQSSKALQRPVASD
LNVIVHSATGYKQLSNALHRPVASD

SEQ ID NO: 9763 - protein, 25 aa, synthetic construct
  source 1..25: note = Seed: LNVIVHSATGFKQSSKALQRPVASD
LNVIVHSATGYKQLSNALIRPVASD

SEQ ID NO: 9764 - protein, 25 aa, synthetic construct
  source 1..25: note = Seed: LNVIVHSATGFKQSSKALQRPVASD
LNVIVHSATGYKQLSNALLRPVASD

SEQ ID NO: 9765 - protein, 25 aa, synthetic construct
  source 1..25: note = Seed: LNVIVHSATGFKQSSKALQRPVASD
LNVIVHSATGYKQLSNALMRPVASD

SEQ ID NO: 9766 - protein, 25 aa, synthetic construct
  source 1..25: note = Seed: LNVIVHSATGFKQSSKALQRPVASD
LNVIVHSATGYKQLSNALNRPVASD

SEQ ID NO: 9767 - protein, 25 aa, synthetic construct
  source 1..25: note = Seed: LNVIVHSATGFKQSSKALQRPVASD
LNVIVHSATGYKQLSNALPRPVASD

SEQ ID NO: 9768 - protein, 25 aa, synthetic construct
  source 1..25: note = Seed: LNVIVHSATGFKQSSKALQRPVASD
LNVIVHSATGYKQLSNALQRPVASD

SEQ ID NO: 9769 - protein, 25 aa, synthetic construct
  source 1..25: note = Seed: LNVIVHSATGFKQSSKALQRPVASD
LNVIVHSATGYKQLSNALSRPVASD

SEQ ID NO: 9770 - protein, 25 aa, synthetic construct
  source 1..25: note = Seed: LNVIVHSATGFKQSSKALQRPVASD
LNVIVHSATGYKQLSNALTRPVASD

SEQ ID NO: 9771 - protein, 25 aa, synthetic construct
  source 1..25: note = Seed: LNVIVHSATGFKQSSKALQRPVASD
LNVIVHSATGYKQLSNALVRPVASD

SEQ ID NO: 9772 - protein, 25 aa, synthetic construct
  source 1..25: note = Seed: LNVIVHSATGFKQSSKALQRPVASD
LNVIVHSATGYKQLSNALYRPVASD

SEQ ID NO: 9773 - protein, 25 aa, synthetic construct
  source 1..25: note = Seed: LNVIVHSATGFKQSSKALQRPVASD
LNVIVHSATGYKQLSPALARPVASD

SEQ ID NO: 9774 - protein, 25 aa, synthetic construct
  source 1..25: note = Seed: LNVIVHSATGFKQSSKALQRPVASD
LNVIVHSATGYKQLSPALCRPVASD

SEQ ID NO: 9775 - protein, 25 aa, synthetic construct
  source 1..25: note = Seed: LNVIVHSATGFKQSSKALQRPVASD
LNVIVHSATGYKQLSPALDRPVASD

SEQ ID NO: 9776 - protein, 25 aa, synthetic construct
  source 1..25: note = Seed: LNVIVHSATGFKQSSKALQRPVASD
LNVIVHSATGYKQLSPALERPVASD

SEQ ID NO: 9777 - protein, 25 aa, synthetic construct
  source 1..25: note = Seed: LNVIVHSATGFKQSSKALQRPVASD
LNVIVHSATGYKQLSPALFRPVASD

SEQ ID NO: 9778 - protein, 25 aa, synthetic construct
  source 1..25: note = Seed: LNVIVHSATGFKQSSKALQRPVASD
LNVIVHSATGYKQLSPALGRPVASD

SEQ ID NO: 9779 - protein, 25 aa, synthetic construct
  source 1..25: note = Seed: LNVIVHSATGFKQSSKALQRPVASD
LNVIVHSATGYKQLSPALHRPVASD

SEQ ID NO: 9780 - protein, 25 aa, synthetic construct
  source 1..25: note = Seed: LNVIVHSATGFKQSSKALQRPVASD
LNVIVHSATGYKQLSPALIRPVASD

SEQ ID NO: 9781 - protein, 25 aa, synthetic construct
  source 1..25: note = Seed: LNVIVHSATGFKQSSKALQRPVASD
LNVIVHSATGYKQLSPALKRPVASD

SEQ ID NO: 9782 - protein, 25 aa, synthetic construct
  source 1..25: note = Seed: LNVIVHSATGFKQSSKALQRPVASD
LNVIVHSATGYKQLSPALLRPVASD

SEQ ID NO: 9783 - protein, 25 aa, synthetic construct
  source 1..25: note = Seed: LNVIVHSATGFKQSSKALQRPVASD
LNVIVHSATGYKQLSPALMRPVASD

SEQ ID NO: 9784 - protein, 25 aa, synthetic construct
  source 1..25: note = Seed: LNVIVHSATGFKQSSKALQRPVASD
LNVIVHSATGYKQLSPALNRPVASD

SEQ ID NO: 9785 - protein, 25 aa, synthetic construct
  source 1..25: note = Seed: LNVIVHSATGFKQSSKALQRPVASD
LNVIVHSATGYKQLSPALPRPVASD

SEQ ID NO: 9786 - protein, 25 aa, synthetic construct
  source 1..25: note = Seed: LNVIVHSATGFKQSSKALQRPVASD
LNVIVHSATGYKQLSPALQRPVASD

SEQ ID NO: 9787 - protein, 25 aa, synthetic construct
  source 1..25: note = Seed: LNVIVHSATGFKQSSKALQRPVASD
LNVIVHSATGYKQLSPALRRPVASD

SEQ ID NO: 9788 - protein, 25 aa, synthetic construct
  source 1..25: note = Seed: LNVIVHSATGFKQSSKALQRPVASD
LNVIVHSATGYKQLSPALSRPVASD

SEQ ID NO: 9789 - protein, 25 aa, synthetic construct
  source 1..25: note = Seed: LNVIVHSATGFKQSSKALQRPVASD
LNVIVHSATGYKQLSPALTRPVASD

SEQ ID NO: 9790 - protein, 25 aa, synthetic construct
  source 1..25: note = Seed: LNVIVHSATGFKQSSKALQRPVASD
LNVIVHSATGYKQLSPALVRPVASD

SEQ ID NO: 9791 - protein, 25 aa, synthetic construct
  source 1..25: note = Seed: LNVIVHSATGFKQSSKALQRPVASD
LNVIVHSATGYKQLSPALWRPVASD

SEQ ID NO: 9792 - protein, 25 aa, synthetic construct
  source 1..25: note = Seed: LNVIVHSATGFKQSSKALQRPVASD
LNVIVHSATGYKQLSPALYRPVASD

SEQ ID NO: 9793 - protein, 25 aa, synthetic construct
  source 1..25: note = Seed: LNVIVHSATGFKQSSKALQRPVASD
LNVIVHSATGYKQLSQALARPVASD

SEQ ID NO: 9794 - protein, 25 aa, synthetic construct
  source 1..25: note = Seed: LNVIVHSATGFKQSSKALQRPVASD
LNVIVHSATGYKQLSQALGRPVASD

SEQ ID NO: 9795 - protein, 25 aa, synthetic construct
  source 1..25: note = Seed: LNVIVHSATGFKQSSKALQRPVASD
LNVIVHSATGYKQLSQALIRPVASD

SEQ ID NO: 9796 - protein, 25 aa, synthetic construct
  source 1..25: note = Seed: LNVIVHSATGFKQSSKALQRPVASD
LNVIVHSATGYKQLSQALLRPVASD

SEQ ID NO: 9797 - protein, 25 aa, synthetic construct
  source 1..25: note = Seed: LNVIVHSATGFKQSSKALQRPVASD
LNVIVHSATGYKQLSQALMRPVASD

SEQ ID NO: 9798 - protein, 25 aa, synthetic construct
  source 1..25: note = Seed: LNVIVHSATGFKQSSKALQRPVASD
LNVIVHSATGYKQLSQALNRPVASD

SEQ ID NO: 9799 - protein, 25 aa, synthetic construct
  source 1..25: note = Seed: LNVIVHSATGFKQSSKALQRPVASD
LNVIVHSATGYKQLSQALSRPVASD

SEQ ID NO: 9800 - protein, 25 aa, synthetic construct
  source 1..25: note = Seed: LNVIVHSATGFKQSSKALQRPVASD
LNVIVHSATGYKQLSQALTRPVASD

SEQ ID NO: 9801 - protein, 25 aa, synthetic construct
  source 1..25: note = Seed: LNVIVHSATGFKQSSKALQRPVASD
LNVIVHSATGYKQLSQALVRPVASD

SEQ ID NO: 9802 - protein, 25 aa, synthetic construct
  source 1..25: note = Seed: LNVIVHSATGFKQSSKALQRPVASD
LNVIVHSATGYKQLSRALARPVASD

SEQ ID NO: 9803 - protein, 25 aa, synthetic construct
  source 1..25: note = Seed: LNVIVHSATGFKQSSKALQRPVASD
LNVIVHSATGYKQLSRALCRPVASD

SEQ ID NO: 9804 - protein, 25 aa, synthetic construct
  source 1..25: note = Seed: LNVIVHSATGFKQSSKALQRPVASD
LNVIVHSATGYKQLSRALERPVASD

SEQ ID NO: 9805 - protein, 25 aa, synthetic construct
  source 1..25: note = Seed: LNVIVHSATGFKQSSKALQRPVASD
LNVIVHSATGYKQLSRALFRPVASD

SEQ ID NO: 9806 - protein, 25 aa, synthetic construct
  source 1..25: note = Seed: LNVIVHSATGFKQSSKALQRPVASD
LNVIVHSATGYKQLSRALGRPVASD

SEQ ID NO: 9807 - protein, 25 aa, synthetic construct
  source 1..25: note = Seed: LNVIVHSATGFKQSSKALQRPVASD
LNVIVHSATGYKQLSRALHRPVASD

SEQ ID NO: 9808 - protein, 25 aa, synthetic construct
  source 1..25: note = Seed: LNVIVHSATGFKQSSKALQRPVASD
LNVIVHSATGYKQLSRALIRPVASD

SEQ ID NO: 9809 - protein, 25 aa, synthetic construct
  source 1..25: note = Seed: LNVIVHSATGFKQSSKALQRPVASD
LNVIVHSATGYKQLSRALKRPVASD

SEQ ID NO: 9810 - protein, 25 aa, synthetic construct
  source 1..25: note = Seed: LNVIVHSATGFKQSSKALQRPVASD
LNVIVHSATGYKQLSRALLRPVASD

SEQ ID NO: 9811 - protein, 25 aa, synthetic construct
  source 1..25: note = Seed: LNVIVHSATGFKQSSKALQRPVASD
LNVIVHSATGYKQLSRALMRPVASD

SEQ ID NO: 9812 - protein, 25 aa, synthetic construct
  source 1..25: note = Seed: LNVIVHSATGFKQSSKALQRPVASD
LNVIVHSATGYKQLSRALNRPVASD

SEQ ID NO: 9813 - protein, 25 aa, synthetic construct
  source 1..25: note = Seed: LNVIVHSATGFKQSSKALQRPVASD
LNVIVHSATGYKQLSRALPRPVASD

SEQ ID NO: 9814 - protein, 25 aa, synthetic construct
  source 1..25: note = Seed: LNVIVHSATGFKQSSKALQRPVASD
LNVIVHSATGYKQLSRALQRPVASD

SEQ ID NO: 9815 - protein, 25 aa, synthetic construct
  source 1..25: note = Seed: LNVIVHSATGFKQSSKALQRPVASD
LNVIVHSATGYKQLSRALRRPVASD

SEQ ID NO: 9816 - protein, 25 aa, synthetic construct
  source 1..25: note = Seed: LNVIVHSATGFKQSSKALQRPVASD
LNVIVHSATGYKQLSRALSRPVASD

SEQ ID NO: 9817 - protein, 25 aa, synthetic construct
  source 1..25: note = Seed: LNVIVHSATGFKQSSKALQRPVASD
LNVIVHSATGYKQLSRALTRPVASD

SEQ ID NO: 9818 - protein, 25 aa, synthetic construct
  source 1..25: note = Seed: LNVIVHSATGFKQSSKALQRPVASD
LNVIVHSATGYKQLSRALVRPVASD

SEQ ID NO: 9819 - protein, 25 aa, synthetic construct
  source 1..25: note = Seed: LNVIVHSATGFKQSSKALQRPVASD
LNVIVHSATGYKQLSRALYRPVASD

SEQ ID NO: 9820 - protein, 25 aa, synthetic construct
  source 1..25: note = Seed: LNVIVHSATGFKQSSKALQRPVASD
LNVIVHSATGYKQLSSALARPVASD

SEQ ID NO: 9821 - protein, 25 aa, synthetic construct
  source 1..25: note = Seed: LNVIVHSATGFKQSSKALQRPVASD
LNVIVHSATGYKQLSSALCRPVASD

SEQ ID NO: 9822 - protein, 25 aa, synthetic construct
  source 1..25: note = Seed: LNVIVHSATGFKQSSKALQRPVASD
LNVIVHSATGYKQLSSALDRPVASD

SEQ ID NO: 9823 - protein, 25 aa, synthetic construct
  source 1..25: note = Seed: LNVIVHSATGFKQSSKALQRPVASD
LNVIVHSATGYKQLSSALERPVASD

SEQ ID NO: 9824 - protein, 25 aa, synthetic construct
  source 1..25: note = Seed: LNVIVHSATGFKQSSKALQRPVASD
LNVIVHSATGYKQLSSALFRPVASD

SEQ ID NO: 9825 - protein, 25 aa, synthetic construct
  source 1..25: note = Seed: LNVIVHSATGFKQSSKALQRPVASD
LNVIVHSATGYKQLSSALGRPVASD

SEQ ID NO: 9826 - protein, 25 aa, synthetic construct
  source 1..25: note = Seed: LNVIVHSATGFKQSSKALQRPVASD
LNVIVHSATGYKQLSSALHRPVASD

SEQ ID NO: 9827 - protein, 25 aa, synthetic construct
  source 1..25: note = Seed: LNVIVHSATGFKQSSKALQRPVASD
LNVIVHSATGYKQLSSALIRPVASD

SEQ ID NO: 9828 - protein, 25 aa, synthetic construct
  source 1..25: note = Seed: LNVIVHSATGFKQSSKALQRPVASD
LNVIVHSATGYKQLSSALKRPVASD

SEQ ID NO: 9829 - protein, 25 aa, synthetic construct
  source 1..25: note = Seed: LNVIVHSATGFKQSSKALQRPVASD
LNVIVHSATGYKQLSSALLRPVASD

SEQ ID NO: 9830 - protein, 25 aa, synthetic construct
  source 1..25: note = Seed: LNVIVHSATGFKQSSKALQRPVASD
LNVIVHSATGYKQLSSALMRPVASD

SEQ ID NO: 9831 - protein, 25 aa, synthetic construct
  source 1..25: note = Seed: LNVIVHSATGFKQSSKALQRPVASD
LNVIVHSATGYKQLSSALNRPVASD

SEQ ID NO: 9832 - protein, 25 aa, synthetic construct
  source 1..25: note = Seed: LNVIVHSATGFKQSSKALQRPVASD
LNVIVHSATGYKQLSSALPRPVASD

SEQ ID NO: 9833 - protein, 25 aa, synthetic construct
  source 1..25: note = Seed: LNVIVHSATGFKQSSKALQRPVASD
LNVIVHSATGYKQLSSALQRPVASD

SEQ ID NO: 9834 - protein, 25 aa, synthetic construct
  source 1..25: note = Seed: LNVIVHSATGFKQSSKALQRPVASD
LNVIVHSATGYKQLSSALRRPVASD

SEQ ID NO: 9835 - protein, 25 aa, synthetic construct
  source 1..25: note = Seed: LNVIVHSATGFKQSSKALQRPVASD
LNVIVHSATGYKQLSSALSRPVASD

SEQ ID NO: 9836 - protein, 25 aa, synthetic construct
  source 1..25: note = Seed: LNVIVHSATGFKQSSKALQRPVASD
LNVIVHSATGYKQLSSALTRPVASD

SEQ ID NO: 9837 - protein, 25 aa, synthetic construct
  source 1..25: note = Seed: LNVIVHSATGFKQSSKALQRPVASD
LNVIVHSATGYKQLSSALVRPVASD

SEQ ID NO: 9838 - protein, 25 aa, synthetic construct
  source 1..25: note = Seed: LNVIVHSATGFKQSSKALQRPVASD
LNVIVHSATGYKQLSSALWRPVASD

SEQ ID NO: 9839 - protein, 25 aa, synthetic construct
  source 1..25: note = Seed: LNVIVHSATGFKQSSKALQRPVASD
LNVIVHSATGYKQLSSALYRPVASD

SEQ ID NO: 9840 - protein, 25 aa, synthetic construct
  source 1..25: note = Seed: LNVIVHSATGFKQSSKALQRPVASD
LNVIVHSATGYKQLSTALARPVASD

SEQ ID NO: 9841 - protein, 25 aa, synthetic construct
  source 1..25: note = Seed: LNVIVHSATGFKQSSKALQRPVASD
LNVIVHSATGYKQLSTALCRPVASD

SEQ ID NO: 9842 - protein, 25 aa, synthetic construct
  source 1..25: note = Seed: LNVIVHSATGFKQSSKALQRPVASD
LNVIVHSATGYKQLSTALDRPVASD

SEQ ID NO: 9843 - protein, 25 aa, synthetic construct
  source 1..25: note = Seed: LNVIVHSATGFKQSSKALQRPVASD
LNVIVHSATGYKQLSTALERPVASD

SEQ ID NO: 9844 - protein, 25 aa, synthetic construct
  source 1..25: note = Seed: LNVIVHSATGFKQSSKALQRPVASD
LNVIVHSATGYKQLSTALFRPVASD

SEQ ID NO: 9845 - protein, 25 aa, synthetic construct
  source 1..25: note = Seed: LNVIVHSATGFKQSSKALQRPVASD
LNVIVHSATGYKQLSTALGRPVASD

SEQ ID NO: 9846 - protein, 25 aa, synthetic construct
  source 1..25: note = Seed: LNVIVHSATGFKQSSKALQRPVASD
LNVIVHSATGYKQLSTALHRPVASD

SEQ ID NO: 9847 - protein, 25 aa, synthetic construct
  source 1..25: note = Seed: LNVIVHSATGFKQSSKALQRPVASD
LNVIVHSATGYKQLSTALIRPVASD

SEQ ID NO: 9848 - protein, 25 aa, synthetic construct
  source 1..25: note = Seed: LNVIVHSATGFKQSSKALQRPVASD
LNVIVHSATGYKQLSTALKRPVASD

SEQ ID NO: 9849 - protein, 25 aa, synthetic construct
  source 1..25: note = Seed: LNVIVHSATGFKQSSKALQRPVASD
LNVIVHSATGYKQLSTALLRPVASD

SEQ ID NO: 9850 - protein, 25 aa, synthetic construct
  source 1..25: note = Seed: LNVIVHSATGFKQSSKALQRPVASD
LNVIVHSATGYKQLSTALMRPVASD

SEQ ID NO: 9851 - protein, 25 aa, synthetic construct
  source 1..25: note = Seed: LNVIVHSATGFKQSSKALQRPVASD
LNVIVHSATGYKQLSTALNRPVASD

SEQ ID NO: 9852 - protein, 25 aa, synthetic construct
  source 1..25: note = Seed: LNVIVHSATGFKQSSKALQRPVASD
LNVIVHSATGYKQLSTALPRPVASD

SEQ ID NO: 9853 - protein, 25 aa, synthetic construct
  source 1..25: note = Seed: LNVIVHSATGFKQSSKALQRPVASD
LNVIVHSATGYKQLSTALQRPVASD

SEQ ID NO: 9854 - protein, 25 aa, synthetic construct
  source 1..25: note = Seed: LNVIVHSATGFKQSSKALQRPVASD
LNVIVHSATGYKQLSTALRRPVASD

SEQ ID NO: 9855 - protein, 25 aa, synthetic construct
  source 1..25: note = Seed: LNVIVHSATGFKQSSKALQRPVASD
LNVIVHSATGYKQLSTALSRPVASD

SEQ ID NO: 9856 - protein, 25 aa, synthetic construct
  source 1..25: note = Seed: LNVIVHSATGFKQSSKALQRPVASD
LNVIVHSATGYKQLSTALTRPVASD

SEQ ID NO: 9857 - protein, 25 aa, synthetic construct
  source 1..25: note = Seed: LNVIVHSATGFKQSSKALQRPVASD
LNVIVHSATGYKQLSTALVRPVASD

SEQ ID NO: 9858 - protein, 25 aa, synthetic construct
  source 1..25: note = Seed: LNVIVHSATGFKQSSKALQRPVASD
LNVIVHSATGYKQLSTALYRPVASD

SEQ ID NO: 9859 - protein, 25 aa, synthetic construct
  source 1..25: note = Seed: LNVIVHSATGFKQSSKALQRPVASD
LNVIVHSATGYKQLSVALARPVASD

SEQ ID NO: 9860 - protein, 25 aa, synthetic construct
  source 1..25: note = Seed: LNVIVHSATGFKQSSKALQRPVASD
LNVIVHSATGYKQLSVALCRPVASD

SEQ ID NO: 9861 - protein, 25 aa, synthetic construct
  source 1..25: note = Seed: LNVIVHSATGFKQSSKALQRPVASD
LNVIVHSATGYKQLSVALDRPVASD

SEQ ID NO: 9862 - protein, 25 aa, synthetic construct
  source 1..25: note = Seed: LNVIVHSATGFKQSSKALQRPVASD
LNVIVHSATGYKQLSVALERPVASD

SEQ ID NO: 9863 - protein, 25 aa, synthetic construct
  source 1..25: note = Seed: LNVIVHSATGFKQSSKALQRPVASD
LNVIVHSATGYKQLSVALFRPVASD

SEQ ID NO: 9864 - protein, 25 aa, synthetic construct
  source 1..25: note = Seed: LNVIVHSATGFKQSSKALQRPVASD
LNVIVHSATGYKQLSVALGRPVASD

SEQ ID NO: 9865 - protein, 25 aa, synthetic construct
  source 1..25: note = Seed: LNVIVHSATGFKQSSKALQRPVASD
LNVIVHSATGYKQLSVALHRPVASD

SEQ ID NO: 9866 - protein, 25 aa, synthetic construct
  source 1..25: note = Seed: LNVIVHSATGFKQSSKALQRPVASD
LNVIVHSATGYKQLSVALIRPVASD

SEQ ID NO: 9867 - protein, 25 aa, synthetic construct
  source 1..25: note = Seed: LNVIVHSATGFKQSSKALQRPVASD
LNVIVHSATGYKQLSVALKRPVASD

SEQ ID NO: 9868 - protein, 25 aa, synthetic construct
  source 1..25: note = Seed: LNVIVHSATGFKQSSKALQRPVASD
LNVIVHSATGYKQLSVALLRPVASD

SEQ ID NO: 9869 - protein, 25 aa, synthetic construct
  source 1..25: note = Seed: LNVIVHSATGFKQSSKALQRPVASD
LNVIVHSATGYKQLSVALMRPVASD

SEQ ID NO: 9870 - protein, 25 aa, synthetic construct
  source 1..25: note = Seed: LNVIVHSATGFKQSSKALQRPVASD
LNVIVHSATGYKQLSVALNRPVASD

SEQ ID NO: 9871 - protein, 25 aa, synthetic construct
  source 1..25: note = Seed: LNVIVHSATGFKQSSKALQRPVASD
LNVIVHSATGYKQLSVALPRPVASD

SEQ ID NO: 9872 - protein, 25 aa, synthetic construct
  source 1..25: note = Seed: LNVIVHSATGFKQSSKALQRPVASD
LNVIVHSATGYKQLSVALQRPVASD

SEQ ID NO: 9873 - protein, 25 aa, synthetic construct
  source 1..25: note = Seed: LNVIVHSATGFKQSSKALQRPVASD
LNVIVHSATGYKQLSVALRRPVASD

SEQ ID NO: 9874 - protein, 25 aa, synthetic construct
  source 1..25: note = Seed: LNVIVHSATGFKQSSKALQRPVASD
LNVIVHSATGYKQLSVALSRPVASD

SEQ ID NO: 9875 - protein, 25 aa, synthetic construct
  source 1..25: note = Seed: LNVIVHSATGFKQSSKALQRPVASD
LNVIVHSATGYKQLSVALTRPVASD

SEQ ID NO: 9876 - protein, 25 aa, synthetic construct
  source 1..25: note = Seed: LNVIVHSATGFKQSSKALQRPVASD
LNVIVHSATGYKQLSVALVRPVASD

SEQ ID NO: 9877 - protein, 25 aa, synthetic construct
  source 1..25: note = Seed: LNVIVHSATGFKQSSKALQRPVASD
LNVIVHSATGYKQLSVALYRPVASD

SEQ ID NO: 9878 - protein, 25 aa, synthetic construct
  source 1..25: note = Seed: LNVIVHSATGFKQSSKALQRPVASD
LNVIVHSATGYKQLSWALGRPVASD

SEQ ID NO: 9879 - protein, 25 aa, synthetic construct
  source 1..25: note = Seed: LNVIVHSATGFKQSSKALQRPVASD
LNVIVHSATGYKQLSWALIRPVASD

SEQ ID NO: 9880 - protein, 25 aa, synthetic construct
  source 1..25: note = Seed: LNVIVHSATGFKQSSKALQRPVASD
LNVIVHSATGYKQLSWALLRPVASD

SEQ ID NO: 9881 - protein, 25 aa, synthetic construct
  source 1..25: note = Seed: LNVIVHSATGFKQSSKALQRPVASD
LNVIVHSATGYKQLSWALMRPVASD

SEQ ID NO: 9882 - protein, 25 aa, synthetic construct
  source 1..25: note = Seed: LNVIVHSATGFKQSSKALQRPVASD
LNVIVHSATGYKQLSWALNRPVASD

SEQ ID NO: 9883 - protein, 25 aa, synthetic construct
  source 1..25: note = Seed: LNVIVHSATGFKQSSKALQRPVASD
LNVIVHSATGYKQLSWALSRPVASD

SEQ ID NO: 9884 - protein, 25 aa, synthetic construct
  source 1..25: note = Seed: LNVIVHSATGFKQSSKALQRPVASD
LNVIVHSATGYKQLSWALTRPVASD

SEQ ID NO: 9885 - protein, 25 aa, synthetic construct
  source 1..25: note = Seed: LNVIVHSATGFKQSSKALQRPVASD
LNVIVHSATGYKQLSWALVRPVASD

SEQ ID NO: 9886 - protein, 25 aa, synthetic construct
  source 1..25: note = Seed: LNVIVHSATGFKQSSKALQRPVASD
LNVIVHSATGYKQLSYALGRPVASD

SEQ ID NO: 9887 - protein, 25 aa, synthetic construct
  source 1..25: note = Seed: LNVIVHSATGFKQSSKALQRPVASD
LNVIVHSATGYKQLSYALIRPVASD

SEQ ID NO: 9888 - protein, 25 aa, synthetic construct
  source 1..25: note = Seed: LNVIVHSATGFKQSSKALQRPVASD
LNVIVHSATGYKQLSYALNRPVASD

SEQ ID NO: 9889 - protein, 25 aa, synthetic construct
  source 1..25: note = Seed: LNVIVHSATGFKQSSKALQRPVASD
LNVIVHSATGYKQLSYALSRPVASD

SEQ ID NO: 9890 - protein, 25 aa, synthetic construct
  source 1..25: note = Seed: LNVIVHSATGFKQSSKALQRPVASD
LNVIVHSATGYKQLSYALVRPVASD

SEQ ID NO: 9891 - protein, 25 aa, synthetic construct
  source 1..25: note = Seed: LNVIVHSATGFKQSSKALQRPVASD
LNVIVHSATGYKQMSAALARPVASD

SEQ ID NO: 9892 - protein, 25 aa, synthetic construct
  source 1..25: note = Seed: LNVIVHSATGFKQSSKALQRPVASD
LNVIVHSATGYKQMSAALCRPVASD

SEQ ID NO: 9893 - protein, 25 aa, synthetic construct
  source 1..25: note = Seed: LNVIVHSATGFKQSSKALQRPVASD
LNVIVHSATGYKQMSAALDRPVASD

SEQ ID NO: 9894 - protein, 25 aa, synthetic construct
  source 1..25: note = Seed: LNVIVHSATGFKQSSKALQRPVASD
LNVIVHSATGYKQMSAALERPVASD

SEQ ID NO: 9895 - protein, 25 aa, synthetic construct
  source 1..25: note = Seed: LNVIVHSATGFKQSSKALQRPVASD
LNVIVHSATGYKQMSAALFRPVASD

SEQ ID NO: 9896 - protein, 25 aa, synthetic construct
  source 1..25: note = Seed: LNVIVHSATGFKQSSKALQRPVASD
LNVIVHSATGYKQMSAALGRPVASD

SEQ ID NO: 9897 - protein, 25 aa, synthetic construct
  source 1..25: note = Seed: LNVIVHSATGFKQSSKALQRPVASD
LNVIVHSATGYKQMSAALHRPVASD

SEQ ID NO: 9898 - protein, 25 aa, synthetic construct
  source 1..25: note = Seed: LNVIVHSATGFKQSSKALQRPVASD
LNVIVHSATGYKQMSAALIRPVASD

SEQ ID NO: 9899 - protein, 25 aa, synthetic construct
  source 1..25: note = Seed: LNVIVHSATGFKQSSKALQRPVASD
LNVIVHSATGYKQMSAALKRPVASD

SEQ ID NO: 9900 - protein, 25 aa, synthetic construct
  source 1..25: note = Seed: LNVIVHSATGFKQSSKALQRPVASD
LNVIVHSATGYKQMSAALLRPVASD

SEQ ID NO: 9901 - protein, 25 aa, synthetic construct
  source 1..25: note = Seed: LNVIVHSATGFKQSSKALQRPVASD
LNVIVHSATGYKQMSAALMRPVASD

SEQ ID NO: 9902 - protein, 25 aa, synthetic construct
  source 1..25: note = Seed: LNVIVHSATGFKQSSKALQRPVASD
LNVIVHSATGYKQMSAALNRPVASD

SEQ ID NO: 9903 - protein, 25 aa, synthetic construct
  source 1..25: note = Seed: LNVIVHSATGFKQSSKALQRPVASD
LNVIVHSATGYKQMSAALPRPVASD

SEQ ID NO: 9904 - protein, 25 aa, synthetic construct
  source 1..25: note = Seed: LNVIVHSATGFKQSSKALQRPVASD
LNVIVHSATGYKQMSAALQRPVASD

SEQ ID NO: 9905 - protein, 25 aa, synthetic construct
  source 1..25: note = Seed: LNVIVHSATGFKQSSKALQRPVASD
LNVIVHSATGYKQMSAALRRPVASD

SEQ ID NO: 9906 - protein, 25 aa, synthetic construct
  source 1..25: note = Seed: LNVIVHSATGFKQSSKALQRPVASD
LNVIVHSATGYKQMSAALSRPVASD

SEQ ID NO: 9907 - protein, 25 aa, synthetic construct
  source 1..25: note = Seed: LNVIVHSATGFKQSSKALQRPVASD
LNVIVHSATGYKQMSAALTRPVASD

SEQ ID NO: 9908 - protein, 25 aa, synthetic construct
  source 1..25: note = Seed: LNVIVHSATGFKQSSKALQRPVASD
LNVIVHSATGYKQMSAALVRPVASD

SEQ ID NO: 9909 - protein, 25 aa, synthetic construct
  source 1..25: note = Seed: LNVIVHSATGFKQSSKALQRPVASD
LNVIVHSATGYKQMSAALWRPVASD

SEQ ID NO: 9910 - protein, 25 aa, synthetic construct
  source 1..25: note = Seed: LNVIVHSATGFKQSSKALQRPVASD
LNVIVHSATGYKQMSAALYRPVASD

SEQ ID NO: 9911 - protein, 25 aa, synthetic construct
  source 1..25: note = Seed: LNVIVHSATGFKQSSKALQRPVASD
LNVIVHSATGYKQMSCALARPVASD

SEQ ID NO: 9912 - protein, 25 aa, synthetic construct
  source 1..25: note = Seed: LNVIVHSATGFKQSSKALQRPVASD
LNVIVHSATGYKQMSCALIRPVASD

SEQ ID NO: 9913 - protein, 25 aa, synthetic construct
  source 1..25: note = Seed: LNVIVHSATGFKQSSKALQRPVASD
LNVIVHSATGYKQMSCALLRPVASD

SEQ ID NO: 9914 - protein, 25 aa, synthetic construct
  source 1..25: note = Seed: LNVIVHSATGFKQSSKALQRPVASD
LNVIVHSATGYKQMSCALNRPVASD

SEQ ID NO: 9915 - protein, 25 aa, synthetic construct
  source 1..25: note = Seed: LNVIVHSATGFKQSSKALQRPVASD
LNVIVHSATGYKQMSCALSRPVASD

SEQ ID NO: 9916 - protein, 25 aa, synthetic construct
  source 1..25: note = Seed: LNVIVHSATGFKQSSKALQRPVASD
LNVIVHSATGYKQMSCALVRPVASD

SEQ ID NO: 9917 - protein, 25 aa, synthetic construct
  source 1..25: note = Seed: LNVIVHSATGFKQSSKALQRPVASD
LNVIVHSATGYKQMSDALARPVASD

SEQ ID NO: 9918 - protein, 25 aa, synthetic construct
  source 1..25: note = Seed: LNVIVHSATGFKQSSKALQRPVASD
LNVIVHSATGYKQMSDALIRPVASD

SEQ ID NO: 9919 - protein, 25 aa, synthetic construct
  source 1..25: note = Seed: LNVIVHSATGFKQSSKALQRPVASD
LNVIVHSATGYKQMSDALLRPVASD

SEQ ID NO: 9920 - protein, 25 aa, synthetic construct
  source 1..25: note = Seed: LNVIVHSATGFKQSSKALQRPVASD
LNVIVHSATGYKQMSDALVRPVASD

SEQ ID NO: 9921 - protein, 25 aa, synthetic construct
  source 1..25: note = Seed: LNVIVHSATGFKQSSKALQRPVASD
LNVIVHSATGYKQMSEALARPVASD

SEQ ID NO: 9922 - protein, 25 aa, synthetic construct
  source 1..25: note = Seed: LNVIVHSATGFKQSSKALQRPVASD
LNVIVHSATGYKQMSEALIRPVASD

SEQ ID NO: 9923 - protein, 25 aa, synthetic construct
  source 1..25: note = Seed: LNVIVHSATGFKQSSKALQRPVASD
LNVIVHSATGYKQMSEALLRPVASD

SEQ ID NO: 9924 - protein, 25 aa, synthetic construct
  source 1..25: note = Seed: LNVIVHSATGFKQSSKALQRPVASD
LNVIVHSATGYKQMSEALNRPVASD

SEQ ID NO: 9925 - protein, 25 aa, synthetic construct
  source 1..25: note = Seed: LNVIVHSATGFKQSSKALQRPVASD
LNVIVHSATGYKQMSEALSRPVASD

SEQ ID NO: 9926 - protein, 25 aa, synthetic construct
  source 1..25: note = Seed: LNVIVHSATGFKQSSKALQRPVASD
LNVIVHSATGYKQMSEALTRPVASD

SEQ ID NO: 9927 - protein, 25 aa, synthetic construct
  source 1..25: note = Seed: LNVIVHSATGFKQSSKALQRPVASD
LNVIVHSATGYKQMSEALVRPVASD

SEQ ID NO: 9928 - protein, 25 aa, synthetic construct
  source 1..25: note = Seed: LNVIVHSATGFKQSSKALQRPVASD
LNVIVHSATGYKQMSFALGRPVASD

SEQ ID NO: 9929 - protein, 25 aa, synthetic construct
  source 1..25: note = Seed: LNVIVHSATGFKQSSKALQRPVASD
LNVIVHSATGYKQMSFALHRPVASD

SEQ ID NO: 9930 - protein, 25 aa, synthetic construct
  source 1..25: note = Seed: LNVIVHSATGFKQSSKALQRPVASD
LNVIVHSATGYKQMSFALIRPVASD

SEQ ID NO: 9931 - protein, 25 aa, synthetic construct
  source 1..25: note = Seed: LNVIVHSATGFKQSSKALQRPVASD
LNVIVHSATGYKQMSFALLRPVASD

SEQ ID NO: 9932 - protein, 25 aa, synthetic construct
  source 1..25: note = Seed: LNVIVHSATGFKQSSKALQRPVASD
LNVIVHSATGYKQMSFALNRPVASD

SEQ ID NO: 9933 - protein, 25 aa, synthetic construct
  source 1..25: note = Seed: LNVIVHSATGFKQSSKALQRPVASD
LNVIVHSATGYKQMSFALSRPVASD

SEQ ID NO: 9934 - protein, 25 aa, synthetic construct
  source 1..25: note = Seed: LNVIVHSATGFKQSSKALQRPVASD
LNVIVHSATGYKQMSFALVRPVASD

SEQ ID NO: 9935 - protein, 25 aa, synthetic construct
  source 1..25: note = Seed: LNVIVHSATGFKQSSKALQRPVASD
LNVIVHSATGYKQMSGALARPVASD

SEQ ID NO: 9936 - protein, 25 aa, synthetic construct
  source 1..25: note = Seed: LNVIVHSATGFKQSSKALQRPVASD
LNVIVHSATGYKQMSGALCRPVASD

SEQ ID NO: 9937 - protein, 25 aa, synthetic construct
  source 1..25: note = Seed: LNVIVHSATGFKQSSKALQRPVASD
LNVIVHSATGYKQMSGALDRPVASD

SEQ ID NO: 9938 - protein, 25 aa, synthetic construct
  source 1..25: note = Seed: LNVIVHSATGFKQSSKALQRPVASD
LNVIVHSATGYKQMSGALERPVASD

SEQ ID NO: 9939 - protein, 25 aa, synthetic construct
  source 1..25: note = Seed: LNVIVHSATGFKQSSKALQRPVASD
LNVIVHSATGYKQMSGALFRPVASD

SEQ ID NO: 9940 - protein, 25 aa, synthetic construct
  source 1..25: note = Seed: LNVIVHSATGFKQSSKALQRPVASD
LNVIVHSATGYKQMSGALGRPVASD

SEQ ID NO: 9941 - protein, 25 aa, synthetic construct
  source 1..25: note = Seed: LNVIVHSATGFKQSSKALQRPVASD
LNVIVHSATGYKQMSGALHRPVASD

SEQ ID NO: 9942 - protein, 25 aa, synthetic construct
  source 1..25: note = Seed: LNVIVHSATGFKQSSKALQRPVASD
LNVIVHSATGYKQMSGALIRPVASD

SEQ ID NO: 9943 - protein, 25 aa, synthetic construct
  source 1..25: note = Seed: LNVIVHSATGFKQSSKALQRPVASD
LNVIVHSATGYKQMSGALKRPVASD

SEQ ID NO: 9944 - protein, 25 aa, synthetic construct
  source 1..25: note = Seed: LNVIVHSATGFKQSSKALQRPVASD
LNVIVHSATGYKQMSGALLRPVASD

SEQ ID NO: 9945 - protein, 25 aa, synthetic construct
  source 1..25: note = Seed: LNVIVHSATGFKQSSKALQRPVASD
LNVIVHSATGYKQMSGALMRPVASD

SEQ ID NO: 9946 - protein, 25 aa, synthetic construct
  source 1..25: note = Seed: LNVIVHSATGFKQSSKALQRPVASD
LNVIVHSATGYKQMSGALNRPVASD

SEQ ID NO: 9947 - protein, 25 aa, synthetic construct
  source 1..25: note = Seed: LNVIVHSATGFKQSSKALQRPVASD
LNVIVHSATGYKQMSGALPRPVASD

SEQ ID NO: 9948 - protein, 25 aa, synthetic construct
  source 1..25: note = Seed: LNVIVHSATGFKQSSKALQRPVASD
LNVIVHSATGYKQMSGALQRPVASD

SEQ ID NO: 9949 - protein, 25 aa, synthetic construct
  source 1..25: note = Seed: LNVIVHSATGFKQSSKALQRPVASD
LNVIVHSATGYKQMSGALRRPVASD

SEQ ID NO: 9950 - protein, 25 aa, synthetic construct
  source 1..25: note = Seed: LNVIVHSATGFKQSSKALQRPVASD
LNVIVHSATGYKQMSGALSRPVASD

SEQ ID NO: 9951 - protein, 25 aa, synthetic construct
  source 1..25: note = Seed: LNVIVHSATGFKQSSKALQRPVASD
LNVIVHSATGYKQMSGALTRPVASD

SEQ ID NO: 9952 - protein, 25 aa, synthetic construct
  source 1..25: note = Seed: LNVIVHSATGFKQSSKALQRPVASD
LNVIVHSATGYKQMSGALVRPVASD

SEQ ID NO: 9953 - protein, 25 aa, synthetic construct
  source 1..25: note = Seed: LNVIVHSATGFKQSSKALQRPVASD
LNVIVHSATGYKQMSGALWRPVASD

SEQ ID NO: 9954 - protein, 25 aa, synthetic construct
  source 1..25: note = Seed: LNVIVHSATGFKQSSKALQRPVASD
LNVIVHSATGYKQMSGALYRPVASD

SEQ ID NO: 9955 - protein, 25 aa, synthetic construct
  source 1..25: note = Seed: LNVIVHSATGFKQSSKALQRPVASD
LNVIVHSATGYKQMSHALARPVASD

SEQ ID NO: 9956 - protein, 25 aa, synthetic construct
  source 1..25: note = Seed: LNVIVHSATGFKQSSKALQRPVASD
LNVIVHSATGYKQMSHALGRPVASD

SEQ ID NO: 9957 - protein, 25 aa, synthetic construct
  source 1..25: note = Seed: LNVIVHSATGFKQSSKALQRPVASD
LNVIVHSATGYKQMSHALIRPVASD

SEQ ID NO: 9958 - protein, 25 aa, synthetic construct
  source 1..25: note = Seed: LNVIVHSATGFKQSSKALQRPVASD
LNVIVHSATGYKQMSHALKRPVASD

SEQ ID NO: 9959 - protein, 25 aa, synthetic construct
  source 1..25: note = Seed: LNVIVHSATGFKQSSKALQRPVASD
LNVIVHSATGYKQMSHALLRPVASD

SEQ ID NO: 9960 - protein, 25 aa, synthetic construct
  source 1..25: note = Seed: LNVIVHSATGFKQSSKALQRPVASD
LNVIVHSATGYKQMSHALMRPVASD

SEQ ID NO: 9961 - protein, 25 aa, synthetic construct
  source 1..25: note = Seed: LNVIVHSATGFKQSSKALQRPVASD
LNVIVHSATGYKQMSHALNRPVASD

SEQ ID NO: 9962 - protein, 25 aa, synthetic construct
  source 1..25: note = Seed: LNVIVHSATGFKQSSKALQRPVASD
LNVIVHSATGYKQMSHALRRPVASD

SEQ ID NO: 9963 - protein, 25 aa, synthetic construct
  source 1..25: note = Seed: LNVIVHSATGFKQSSKALQRPVASD
LNVIVHSATGYKQMSHALSRPVASD

SEQ ID NO: 9964 - protein, 25 aa, synthetic construct
  source 1..25: note = Seed: LNVIVHSATGFKQSSKALQRPVASD
LNVIVHSATGYKQMSHALTRPVASD

SEQ ID NO: 9965 - protein, 25 aa, synthetic construct
  source 1..25: note = Seed: LNVIVHSATGFKQSSKALQRPVASD
LNVIVHSATGYKQMSHALVRPVASD

SEQ ID NO: 9966 - protein, 25 aa, synthetic construct
  source 1..25: note = Seed: LNVIVHSATGFKQSSKALQRPVASD
LNVIVHSATGYKQMSIALARPVASD

SEQ ID NO: 9967 - protein, 25 aa, synthetic construct
  source 1..25: note = Seed: LNVIVHSATGFKQSSKALQRPVASD
LNVIVHSATGYKQMSIALCRPVASD

SEQ ID NO: 9968 - protein, 25 aa, synthetic construct
  source 1..25: note = Seed: LNVIVHSATGFKQSSKALQRPVASD
LNVIVHSATGYKQMSIALDRPVASD

SEQ ID NO: 9969 - protein, 25 aa, synthetic construct
  source 1..25: note = Seed: LNVIVHSATGFKQSSKALQRPVASD
LNVIVHSATGYKQMSIALERPVASD

SEQ ID NO: 9970 - protein, 25 aa, synthetic construct
  source 1..25: note = Seed: LNVIVHSATGFKQSSKALQRPVASD
LNVIVHSATGYKQMSIALFRPVASD

SEQ ID NO: 9971 - protein, 25 aa, synthetic construct
  source 1..25: note = Seed: LNVIVHSATGFKQSSKALQRPVASD
LNVIVHSATGYKQMSIALGRPVASD

SEQ ID NO: 9972 - protein, 25 aa, synthetic construct
  source 1..25: note = Seed: LNVIVHSATGFKQSSKALQRPVASD
LNVIVHSATGYKQMSIALHRPVASD

SEQ ID NO: 9973 - protein, 25 aa, synthetic construct
  source 1..25: note = Seed: LNVIVHSATGFKQSSKALQRPVASD
LNVIVHSATGYKQMSIALIRPVASD

SEQ ID NO: 9974 - protein, 25 aa, synthetic construct
  source 1..25: note = Seed: LNVIVHSATGFKQSSKALQRPVASD
LNVIVHSATGYKQMSIALKRPVASD

SEQ ID NO: 9975 - protein, 25 aa, synthetic construct
  source 1..25: note = Seed: LNVIVHSATGFKQSSKALQRPVASD
LNVIVHSATGYKQMSIALLRPVASD

SEQ ID NO: 9976 - protein, 25 aa, synthetic construct
  source 1..25: note = Seed: LNVIVHSATGFKQSSKALQRPVASD
LNVIVHSATGYKQMSIALMRPVASD

SEQ ID NO: 9977 - protein, 25 aa, synthetic construct
  source 1..25: note = Seed: LNVIVHSATGFKQSSKALQRPVASD
LNVIVHSATGYKQMSIALNRPVASD

SEQ ID NO: 9978 - protein, 25 aa, synthetic construct
  source 1..25: note = Seed: LNVIVHSATGFKQSSKALQRPVASD
LNVIVHSATGYKQMSIALPRPVASD

SEQ ID NO: 9979 - protein, 25 aa, synthetic construct
  source 1..25: note = Seed: LNVIVHSATGFKQSSKALQRPVASD
LNVIVHSATGYKQMSIALQRPVASD

SEQ ID NO: 9980 - protein, 25 aa, synthetic construct
  source 1..25: note = Seed: LNVIVHSATGFKQSSKALQRPVASD
LNVIVHSATGYKQMSIALRRPVASD

SEQ ID NO: 9981 - protein, 25 aa, synthetic construct
  source 1..25: note = Seed: LNVIVHSATGFKQSSKALQRPVASD
LNVIVHSATGYKQMSIALSRPVASD

SEQ ID NO: 9982 - protein, 25 aa, synthetic construct
  source 1..25: note = Seed: LNVIVHSATGFKQSSKALQRPVASD
LNVIVHSATGYKQMSIALTRPVASD

SEQ ID NO: 9983 - protein, 25 aa, synthetic construct
  source 1..25: note = Seed: LNVIVHSATGFKQSSKALQRPVASD
LNVIVHSATGYKQMSIALVRPVASD

SEQ ID NO: 9984 - protein, 25 aa, synthetic construct
  source 1..25: note = Seed: LNVIVHSATGFKQSSKALQRPVASD
LNVIVHSATGYKQMSIALYRPVASD

SEQ ID NO: 9985 - protein, 25 aa, synthetic construct
  source 1..25: note = Seed: LNVIVHSATGFKQSSKALQRPVASD
LNVIVHSATGYKQMSKALARPVASD

SEQ ID NO: 9986 - protein, 25 aa, synthetic construct
  source 1..25: note = Seed: LNVIVHSATGFKQSSKALQRPVASD
LNVIVHSATGYKQMSKALCRPVASD

SEQ ID NO: 9987 - protein, 25 aa, synthetic construct
  source 1..25: note = Seed: LNVIVHSATGFKQSSKALQRPVASD
LNVIVHSATGYKQMSKALGRPVASD

SEQ ID NO: 9988 - protein, 25 aa, synthetic construct
  source 1..25: note = Seed: LNVIVHSATGFKQSSKALQRPVASD
LNVIVHSATGYKQMSKALHRPVASD

SEQ ID NO: 9989 - protein, 25 aa, synthetic construct
  source 1..25: note = Seed: LNVIVHSATGFKQSSKALQRPVASD
LNVIVHSATGYKQMSKALIRPVASD

SEQ ID NO: 9990 - protein, 25 aa, synthetic construct
  source 1..25: note = Seed: LNVIVHSATGFKQSSKALQRPVASD
LNVIVHSATGYKQMSKALKRPVASD

SEQ ID NO: 9991 - protein, 25 aa, synthetic construct
  source 1..25: note = Seed: LNVIVHSATGFKQSSKALQRPVASD
LNVIVHSATGYKQMSKALLRPVASD

SEQ ID NO: 9992 - protein, 25 aa, synthetic construct
  source 1..25: note = Seed: LNVIVHSATGFKQSSKALQRPVASD
LNVIVHSATGYKQMSKALMRPVASD

SEQ ID NO: 9993 - protein, 25 aa, synthetic construct
  source 1..25: note = Seed: LNVIVHSATGFKQSSKALQRPVASD
LNVIVHSATGYKQMSKALNRPVASD

SEQ ID NO: 9994 - protein, 25 aa, synthetic construct
  source 1..25: note = Seed: LNVIVHSATGFKQSSKALQRPVASD
LNVIVHSATGYKQMSKALPRPVASD

SEQ ID NO: 9995 - protein, 25 aa, synthetic construct
  source 1..25: note = Seed: LNVIVHSATGFKQSSKALQRPVASD
LNVIVHSATGYKQMSKALQRPVASD

SEQ ID NO: 9996 - protein, 25 aa, synthetic construct
  source 1..25: note = Seed: LNVIVHSATGFKQSSKALQRPVASD
LNVIVHSATGYKQMSKALRRPVASD

SEQ ID NO: 9997 - protein, 25 aa, synthetic construct
  source 1..25: note = Seed: LNVIVHSATGFKQSSKALQRPVASD
LNVIVHSATGYKQMSKALSRPVASD

SEQ ID NO: 9998 - protein, 25 aa, synthetic construct
  source 1..25: note = Seed: LNVIVHSATGFKQSSKALQRPVASD
LNVIVHSATGYKQMSKALTRPVASD

SEQ ID NO: 9999 - protein, 25 aa, synthetic construct
  source 1..25: note = Seed: LNVIVHSATGFKQSSKALQRPVASD
LNVIVHSATGYKQMSKALVRPVASD

SEQ ID NO: 10000 - protein, 25 aa, synthetic construct
  source 1..25: note = Seed: LNVIVHSATGFKQSSKALQRPVASD
LNVIVHSATGYKQMSKALYRPVASD

SEQ ID NO: 10001 - protein, 25 aa, synthetic construct
  source 1..25: note = Seed: LNVIVHSATGFKQSSKALQRPVASD
LNVIVHSATGYKQMSLALARPVASD

SEQ ID NO: 10002 - protein, 25 aa, synthetic construct
  source 1..25: note = Seed: LNVIVHSATGFKQSSKALQRPVASD
LNVIVHSATGYKQMSLALCRPVASD

SEQ ID NO: 10003 - protein, 25 aa, synthetic construct
  source 1..25: note = Seed: LNVIVHSATGFKQSSKALQRPVASD
LNVIVHSATGYKQMSLALDRPVASD

SEQ ID NO: 10004 - protein, 25 aa, synthetic construct
  source 1..25: note = Seed: LNVIVHSATGFKQSSKALQRPVASD
LNVIVHSATGYKQMSLALERPVASD

SEQ ID NO: 10005 - protein, 25 aa, synthetic construct
  source 1..25: note = Seed: LNVIVHSATGFKQSSKALQRPVASD
LNVIVHSATGYKQMSLALFRPVASD

SEQ ID NO: 10006 - protein, 25 aa, synthetic construct
  source 1..25: note = Seed: LNVIVHSATGFKQSSKALQRPVASD
LNVIVHSATGYKQMSLALGRPVASD

SEQ ID NO: 10007 - protein, 25 aa, synthetic construct
  source 1..25: note = Seed: LNVIVHSATGFKQSSKALQRPVASD
LNVIVHSATGYKQMSLALHRPVASD

SEQ ID NO: 10008 - protein, 25 aa, synthetic construct
  source 1..25: note = Seed: LNVIVHSATGFKQSSKALQRPVASD
LNVIVHSATGYKQMSLALIRPVASD

SEQ ID NO: 10009 - protein, 25 aa, synthetic construct
  source 1..25: note = Seed: LNVIVHSATGFKQSSKALQRPVASD
LNVIVHSATGYKQMSLALKRPVASD

SEQ ID NO: 10010 - protein, 25 aa, synthetic construct
  source 1..25: note = Seed: LNVIVHSATGFKQSSKALQRPVASD
LNVIVHSATGYKQMSLALLRPVASD

SEQ ID NO: 10011 - protein, 25 aa, synthetic construct
  source 1..25: note = Seed: LNVIVHSATGFKQSSKALQRPVASD
LNVIVHSATGYKQMSLALMRPVASD

SEQ ID NO: 10012 - protein, 25 aa, synthetic construct
  source 1..25: note = Seed: LNVIVHSATGFKQSSKALQRPVASD
LNVIVHSATGYKQMSLALNRPVASD

SEQ ID NO: 10013 - protein, 25 aa, synthetic construct
  source 1..25: note = Seed: LNVIVHSATGFKQSSKALQRPVASD
LNVIVHSATGYKQMSLALPRPVASD

SEQ ID NO: 10014 - protein, 25 aa, synthetic construct
  source 1..25: note = Seed: LNVIVHSATGFKQSSKALQRPVASD
LNVIVHSATGYKQMSLALQRPVASD

SEQ ID NO: 10015 - protein, 25 aa, synthetic construct
  source 1..25: note = Seed: LNVIVHSATGFKQSSKALQRPVASD
LNVIVHSATGYKQMSLALRRPVASD

SEQ ID NO: 10016 - protein, 25 aa, synthetic construct
  source 1..25: note = Seed: LNVIVHSATGFKQSSKALQRPVASD
LNVIVHSATGYKQMSLALSRPVASD

SEQ ID NO: 10017 - protein, 25 aa, synthetic construct
  source 1..25: note = Seed: LNVIVHSATGFKQSSKALQRPVASD
LNVIVHSATGYKQMSLALTRPVASD

SEQ ID NO: 10018 - protein, 25 aa, synthetic construct
  source 1..25: note = Seed: LNVIVHSATGFKQSSKALQRPVASD
LNVIVHSATGYKQMSLALVRPVASD

SEQ ID NO: 10019 - protein, 25 aa, synthetic construct
  source 1..25: note = Seed: LNVIVHSATGFKQSSKALQRPVASD
LNVIVHSATGYKQMSMALARPVASD

SEQ ID NO: 10020 - protein, 25 aa, synthetic construct
  source 1..25: note = Seed: LNVIVHSATGFKQSSKALQRPVASD
LNVIVHSATGYKQMSMALCRPVASD

SEQ ID NO: 10021 - protein, 25 aa, synthetic construct
  source 1..25: note = Seed: LNVIVHSATGFKQSSKALQRPVASD
LNVIVHSATGYKQMSMALDRPVASD

SEQ ID NO: 10022 - protein, 25 aa, synthetic construct
  source 1..25: note = Seed: LNVIVHSATGFKQSSKALQRPVASD
LNVIVHSATGYKQMSMALERPVASD

SEQ ID NO: 10023 - protein, 25 aa, synthetic construct
  source 1..25: note = Seed: LNVIVHSATGFKQSSKALQRPVASD
LNVIVHSATGYKQMSMALFRPVASD

SEQ ID NO: 10024 - protein, 25 aa, synthetic construct
  source 1..25: note = Seed: LNVIVHSATGFKQSSKALQRPVASD
LNVIVHSATGYKQMSMALGRPVASD

SEQ ID NO: 10025 - protein, 25 aa, synthetic construct
  source 1..25: note = Seed: LNVIVHSATGFKQSSKALQRPVASD
LNVIVHSATGYKQMSMALHRPVASD

SEQ ID NO: 10026 - protein, 25 aa, synthetic construct
  source 1..25: note = Seed: LNVIVHSATGFKQSSKALQRPVASD
LNVIVHSATGYKQMSMALIRPVASD

SEQ ID NO: 10027 - protein, 25 aa, synthetic construct
  source 1..25: note = Seed: LNVIVHSATGFKQSSKALQRPVASD
LNVIVHSATGYKQMSMALKRPVASD

SEQ ID NO: 10028 - protein, 25 aa, synthetic construct
  source 1..25: note = Seed: LNVIVHSATGFKQSSKALQRPVASD
LNVIVHSATGYKQMSMALLRPVASD

SEQ ID NO: 10029 - protein, 25 aa, synthetic construct
  source 1..25: note = Seed: LNVIVHSATGFKQSSKALQRPVASD
LNVIVHSATGYKQMSMALMRPVASD

SEQ ID NO: 10030 - protein, 25 aa, synthetic construct
  source 1..25: note = Seed: LNVIVHSATGFKQSSKALQRPVASD
LNVIVHSATGYKQMSMALNRPVASD

SEQ ID NO: 10031 - protein, 25 aa, synthetic construct
  source 1..25: note = Seed: LNVIVHSATGFKQSSKALQRPVASD
LNVIVHSATGYKQMSMALPRPVASD

SEQ ID NO: 10032 - protein, 25 aa, synthetic construct
  source 1..25: note = Seed: LNVIVHSATGFKQSSKALQRPVASD
LNVIVHSATGYKQMSMALQRPVASD

SEQ ID NO: 10033 - protein, 25 aa, synthetic construct
  source 1..25: note = Seed: LNVIVHSATGFKQSSKALQRPVASD
LNVIVHSATGYKQMSMALRRPVASD

SEQ ID NO: 10034 - protein, 25 aa, synthetic construct
  source 1..25: note = Seed: LNVIVHSATGFKQSSKALQRPVASD
LNVIVHSATGYKQMSMALSRPVASD

SEQ ID NO: 10035 - protein, 25 aa, synthetic construct
  source 1..25: note = Seed: LNVIVHSATGFKQSSKALQRPVASD
LNVIVHSATGYKQMSMALTRPVASD

SEQ ID NO: 10036 - protein, 25 aa, synthetic construct
  source 1..25: note = Seed: LNVIVHSATGFKQSSKALQRPVASD
LNVIVHSATGYKQMSMALVRPVASD

SEQ ID NO: 10037 - protein, 25 aa, synthetic construct
  source 1..25: note = Seed: LNVIVHSATGFKQSSKALQRPVASD
LNVIVHSATGYKQMSMALYRPVASD

SEQ ID NO: 10038 - protein, 25 aa, synthetic construct
  source 1..25: note = Seed: LNVIVHSATGFKQSSKALQRPVASD
LNVIVHSATGYKQMSNALARPVASD

SEQ ID NO: 10039 - protein, 25 aa, synthetic construct
  source 1..25: note = Seed: LNVIVHSATGFKQSSKALQRPVASD
LNVIVHSATGYKQMSNALCRPVASD

SEQ ID NO: 10040 - protein, 25 aa, synthetic construct
  source 1..25: note = Seed: LNVIVHSATGFKQSSKALQRPVASD
LNVIVHSATGYKQMSNALDRPVASD

SEQ ID NO: 10041 - protein, 25 aa, synthetic construct
  source 1..25: note = Seed: LNVIVHSATGFKQSSKALQRPVASD
LNVIVHSATGYKQMSNALERPVASD

SEQ ID NO: 10042 - protein, 25 aa, synthetic construct
  source 1..25: note = Seed: LNVIVHSATGFKQSSKALQRPVASD
LNVIVHSATGYKQMSNALFRPVASD

SEQ ID NO: 10043 - protein, 25 aa, synthetic construct
  source 1..25: note = Seed: LNVIVHSATGFKQSSKALQRPVASD
LNVIVHSATGYKQMSNALGRPVASD

SEQ ID NO: 10044 - protein, 25 aa, synthetic construct
  source 1..25: note = Seed: LNVIVHSATGFKQSSKALQRPVASD
LNVIVHSATGYKQMSNALHRPVASD

SEQ ID NO: 10045 - protein, 25 aa, synthetic construct
  source 1..25: note = Seed: LNVIVHSATGFKQSSKALQRPVASD
LNVIVHSATGYKQMSNALIRPVASD

SEQ ID NO: 10046 - protein, 25 aa, synthetic construct
  source 1..25: note = Seed: LNVIVHSATGFKQSSKALQRPVASD
LNVIVHSATGYKQMSNALLRPVASD

SEQ ID NO: 10047 - protein, 25 aa, synthetic construct
  source 1..25: note = Seed: LNVIVHSATGFKQSSKALQRPVASD
LNVIVHSATGYKQMSNALMRPVASD

SEQ ID NO: 10048 - protein, 25 aa, synthetic construct
  source 1..25: note = Seed: LNVIVHSATGFKQSSKALQRPVASD
LNVIVHSATGYKQMSNALNRPVASD

SEQ ID NO: 10049 - protein, 25 aa, synthetic construct
  source 1..25: note = Seed: LNVIVHSATGFKQSSKALQRPVASD
LNVIVHSATGYKQMSNALPRPVASD

SEQ ID NO: 10050 - protein, 25 aa, synthetic construct
  source 1..25: note = Seed: LNVIVHSATGFKQSSKALQRPVASD
LNVIVHSATGYKQMSNALQRPVASD

SEQ ID NO: 10051 - protein, 25 aa, synthetic construct
  source 1..25: note = Seed: LNVIVHSATGFKQSSKALQRPVASD
LNVIVHSATGYKQMSNALSRPVASD

SEQ ID NO: 10052 - protein, 25 aa, synthetic construct
  source 1..25: note = Seed: LNVIVHSATGFKQSSKALQRPVASD
LNVIVHSATGYKQMSNALTRPVASD

SEQ ID NO: 10053 - protein, 25 aa, synthetic construct
  source 1..25: note = Seed: LNVIVHSATGFKQSSKALQRPVASD
LNVIVHSATGYKQMSNALVRPVASD

SEQ ID NO: 10054 - protein, 25 aa, synthetic construct
  source 1..25: note = Seed: LNVIVHSATGFKQSSKALQRPVASD
LNVIVHSATGYKQMSNALYRPVASD

SEQ ID NO: 10055 - protein, 25 aa, synthetic construct
  source 1..25: note = Seed: LNVIVHSATGFKQSSKALQRPVASD
LNVIVHSATGYKQMSPALARPVASD

SEQ ID NO: 10056 - protein, 25 aa, synthetic construct
  source 1..25: note = Seed: LNVIVHSATGFKQSSKALQRPVASD
LNVIVHSATGYKQMSPALCRPVASD

SEQ ID NO: 10057 - protein, 25 aa, synthetic construct
  source 1..25: note = Seed: LNVIVHSATGFKQSSKALQRPVASD
LNVIVHSATGYKQMSPALDRPVASD

SEQ ID NO: 10058 - protein, 25 aa, synthetic construct
  source 1..25: note = Seed: LNVIVHSATGFKQSSKALQRPVASD
LNVIVHSATGYKQMSPALERPVASD

SEQ ID NO: 10059 - protein, 25 aa, synthetic construct
  source 1..25: note = Seed: LNVIVHSATGFKQSSKALQRPVASD
LNVIVHSATGYKQMSPALFRPVASD

SEQ ID NO: 10060 - protein, 25 aa, synthetic construct
  source 1..25: note = Seed: LNVIVHSATGFKQSSKALQRPVASD
LNVIVHSATGYKQMSPALGRPVASD

SEQ ID NO: 10061 - protein, 25 aa, synthetic construct
  source 1..25: note = Seed: LNVIVHSATGFKQSSKALQRPVASD
LNVIVHSATGYKQMSPALHRPVASD

SEQ ID NO: 10062 - protein, 25 aa, synthetic construct
  source 1..25: note = Seed: LNVIVHSATGFKQSSKALQRPVASD
LNVIVHSATGYKQMSPALIRPVASD

SEQ ID NO: 10063 - protein, 25 aa, synthetic construct
  source 1..25: note = Seed: LNVIVHSATGFKQSSKALQRPVASD
LNVIVHSATGYKQMSPALKRPVASD

SEQ ID NO: 10064 - protein, 25 aa, synthetic construct
  source 1..25: note = Seed: LNVIVHSATGFKQSSKALQRPVASD
LNVIVHSATGYKQMSPALLRPVASD

SEQ ID NO: 10065 - protein, 25 aa, synthetic construct
  source 1..25: note = Seed: LNVIVHSATGFKQSSKALQRPVASD
LNVIVHSATGYKQMSPALMRPVASD

SEQ ID NO: 10066 - protein, 25 aa, synthetic construct
  source 1..25: note = Seed: LNVIVHSATGFKQSSKALQRPVASD
LNVIVHSATGYKQMSPALNRPVASD

SEQ ID NO: 10067 - protein, 25 aa, synthetic construct
  source 1..25: note = Seed: LNVIVHSATGFKQSSKALQRPVASD
LNVIVHSATGYKQMSPALPRPVASD

SEQ ID NO: 10068 - protein, 25 aa, synthetic construct
  source 1..25: note = Seed: LNVIVHSATGFKQSSKALQRPVASD
LNVIVHSATGYKQMSPALQRPVASD

SEQ ID NO: 10069 - protein, 25 aa, synthetic construct
  source 1..25: note = Seed: LNVIVHSATGFKQSSKALQRPVASD
LNVIVHSATGYKQMSPALRRPVASD

SEQ ID NO: 10070 - protein, 25 aa, synthetic construct
  source 1..25: note = Seed: LNVIVHSATGFKQSSKALQRPVASD
LNVIVHSATGYKQMSPALSRPVASD

SEQ ID NO: 10071 - protein, 25 aa, synthetic construct
  source 1..25: note = Seed: LNVIVHSATGFKQSSKALQRPVASD
LNVIVHSATGYKQMSPALTRPVASD

SEQ ID NO: 10072 - protein, 25 aa, synthetic construct
  source 1..25: note = Seed: LNVIVHSATGFKQSSKALQRPVASD
LNVIVHSATGYKQMSPALVRPVASD

SEQ ID NO: 10073 - protein, 25 aa, synthetic construct
  source 1..25: note = Seed: LNVIVHSATGFKQSSKALQRPVASD
LNVIVHSATGYKQMSPALWRPVASD

SEQ ID NO: 10074 - protein, 25 aa, synthetic construct
  source 1..25: note = Seed: LNVIVHSATGFKQSSKALQRPVASD
LNVIVHSATGYKQMSPALYRPVASD

SEQ ID NO: 10075 - protein, 25 aa, synthetic construct
  source 1..25: note = Seed: LNVIVHSATGFKQSSKALQRPVASD
LNVIVHSATGYKQMSQALARPVASD

SEQ ID NO: 10076 - protein, 25 aa, synthetic construct
  source 1..25: note = Seed: LNVIVHSATGFKQSSKALQRPVASD
LNVIVHSATGYKQMSQALGRPVASD

SEQ ID NO: 10077 - protein, 25 aa, synthetic construct
  source 1..25: note = Seed: LNVIVHSATGFKQSSKALQRPVASD
LNVIVHSATGYKQMSQALIRPVASD

SEQ ID NO: 10078 - protein, 25 aa, synthetic construct
  source 1..25: note = Seed: LNVIVHSATGFKQSSKALQRPVASD
LNVIVHSATGYKQMSQALLRPVASD

SEQ ID NO: 10079 - protein, 25 aa, synthetic construct
  source 1..25: note = Seed: LNVIVHSATGFKQSSKALQRPVASD
LNVIVHSATGYKQMSQALMRPVASD

SEQ ID NO: 10080 - protein, 25 aa, synthetic construct
  source 1..25: note = Seed: LNVIVHSATGFKQSSKALQRPVASD
LNVIVHSATGYKQMSQALNRPVASD

SEQ ID NO: 10081 - protein, 25 aa, synthetic construct
  source 1..25: note = Seed: LNVIVHSATGFKQSSKALQRPVASD
LNVIVHSATGYKQMSQALSRPVASD

SEQ ID NO: 10082 - protein, 25 aa, synthetic construct
  source 1..25: note = Seed: LNVIVHSATGFKQSSKALQRPVASD
LNVIVHSATGYKQMSQALTRPVASD

SEQ ID NO: 10083 - protein, 25 aa, synthetic construct
  source 1..25: note = Seed: LNVIVHSATGFKQSSKALQRPVASD
LNVIVHSATGYKQMSQALVRPVASD

SEQ ID NO: 10084 - protein, 25 aa, synthetic construct
  source 1..25: note = Seed: LNVIVHSATGFKQSSKALQRPVASD
LNVIVHSATGYKQMSRALARPVASD

SEQ ID NO: 10085 - protein, 25 aa, synthetic construct
  source 1..25: note = Seed: LNVIVHSATGFKQSSKALQRPVASD
LNVIVHSATGYKQMSRALCRPVASD

SEQ ID NO: 10086 - protein, 25 aa, synthetic construct
  source 1..25: note = Seed: LNVIVHSATGFKQSSKALQRPVASD
LNVIVHSATGYKQMSRALERPVASD

SEQ ID NO: 10087 - protein, 25 aa, synthetic construct
  source 1..25: note = Seed: LNVIVHSATGFKQSSKALQRPVASD
LNVIVHSATGYKQMSRALFRPVASD

SEQ ID NO: 10088 - protein, 25 aa, synthetic construct
  source 1..25: note = Seed: LNVIVHSATGFKQSSKALQRPVASD
LNVIVHSATGYKQMSRALGRPVASD

SEQ ID NO: 10089 - protein, 25 aa, synthetic construct
  source 1..25: note = Seed: LNVIVHSATGFKQSSKALQRPVASD
LNVIVHSATGYKQMSRALHRPVASD

SEQ ID NO: 10090 - protein, 25 aa, synthetic construct
  source 1..25: note = Seed: LNVIVHSATGFKQSSKALQRPVASD
LNVIVHSATGYKQMSRALIRPVASD

SEQ ID NO: 10091 - protein, 25 aa, synthetic construct
  source 1..25: note = Seed: LNVIVHSATGFKQSSKALQRPVASD
LNVIVHSATGYKQMSRALKRPVASD

SEQ ID NO: 10092 - protein, 25 aa, synthetic construct
  source 1..25: note = Seed: LNVIVHSATGFKQSSKALQRPVASD
LNVIVHSATGYKQMSRALLRPVASD

SEQ ID NO: 10093 - protein, 25 aa, synthetic construct
  source 1..25: note = Seed: LNVIVHSATGFKQSSKALQRPVASD
LNVIVHSATGYKQMSRALMRPVASD

SEQ ID NO: 10094 - protein, 25 aa, synthetic construct
  source 1..25: note = Seed: LNVIVHSATGFKQSSKALQRPVASD
LNVIVHSATGYKQMSRALNRPVASD

SEQ ID NO: 10095 - protein, 25 aa, synthetic construct
  source 1..25: note = Seed: LNVIVHSATGFKQSSKALQRPVASD
LNVIVHSATGYKQMSRALPRPVASD

SEQ ID NO: 10096 - protein, 25 aa, synthetic construct
  source 1..25: note = Seed: LNVIVHSATGFKQSSKALQRPVASD
LNVIVHSATGYKQMSRALQRPVASD

SEQ ID NO: 10097 - protein, 25 aa, synthetic construct
  source 1..25: note = Seed: LNVIVHSATGFKQSSKALQRPVASD
LNVIVHSATGYKQMSRALRRPVASD

SEQ ID NO: 10098 - protein, 25 aa, synthetic construct
  source 1..25: note = Seed: LNVIVHSATGFKQSSKALQRPVASD
LNVIVHSATGYKQMSRALSRPVASD

SEQ ID NO: 10099 - protein, 25 aa, synthetic construct
  source 1..25: note = Seed: LNVIVHSATGFKQSSKALQRPVASD
LNVIVHSATGYKQMSRALTRPVASD

SEQ ID NO: 10100 - protein, 25 aa, synthetic construct
  source 1..25: note = Seed: LNVIVHSATGFKQSSKALQRPVASD
LNVIVHSATGYKQMSRALVRPVASD

SEQ ID NO: 10101 - protein, 25 aa, synthetic construct
  source 1..25: note = Seed: LNVIVHSATGFKQSSKALQRPVASD
LNVIVHSATGYKQMSRALWRPVASD

SEQ ID NO: 10102 - protein, 25 aa, synthetic construct
  source 1..25: note = Seed: LNVIVHSATGFKQSSKALQRPVASD
LNVIVHSATGYKQMSRALYRPVASD

SEQ ID NO: 10103 - protein, 25 aa, synthetic construct
  source 1..25: note = Seed: LNVIVHSATGFKQSSKALQRPVASD
LNVIVHSATGYKQMSSALARPVASD

SEQ ID NO: 10104 - protein, 25 aa, synthetic construct
  source 1..25: note = Seed: LNVIVHSATGFKQSSKALQRPVASD
LNVIVHSATGYKQMSSALCRPVASD

SEQ ID NO: 10105 - protein, 25 aa, synthetic construct
  source 1..25: note = Seed: LNVIVHSATGFKQSSKALQRPVASD
LNVIVHSATGYKQMSSALDRPVASD

SEQ ID NO: 10106 - protein, 25 aa, synthetic construct
  source 1..25: note = Seed: LNVIVHSATGFKQSSKALQRPVASD
LNVIVHSATGYKQMSSALERPVASD

SEQ ID NO: 10107 - protein, 25 aa, synthetic construct
  source 1..25: note = Seed: LNVIVHSATGFKQSSKALQRPVASD
LNVIVHSATGYKQMSSALFRPVASD

SEQ ID NO: 10108 - protein, 25 aa, synthetic construct
  source 1..25: note = Seed: LNVIVHSATGFKQSSKALQRPVASD
LNVIVHSATGYKQMSSALGRPVASD

SEQ ID NO: 10109 - protein, 25 aa, synthetic construct
  source 1..25: note = Seed: LNVIVHSATGFKQSSKALQRPVASD
LNVIVHSATGYKQMSSALHRPVASD

SEQ ID NO: 10110 - protein, 25 aa, synthetic construct
  source 1..25: note = Seed: LNVIVHSATGFKQSSKALQRPVASD
LNVIVHSATGYKQMSSALIRPVASD

SEQ ID NO: 10111 - protein, 25 aa, synthetic construct
  source 1..25: note = Seed: LNVIVHSATGFKQSSKALQRPVASD
LNVIVHSATGYKQMSSALKRPVASD

SEQ ID NO: 10112 - protein, 25 aa, synthetic construct
  source 1..25: note = Seed: LNVIVHSATGFKQSSKALQRPVASD
LNVIVHSATGYKQMSSALLRPVASD

SEQ ID NO: 10113 - protein, 25 aa, synthetic construct
  source 1..25: note = Seed: LNVIVHSATGFKQSSKALQRPVASD
LNVIVHSATGYKQMSSALMRPVASD

SEQ ID NO: 10114 - protein, 25 aa, synthetic construct
  source 1..25: note = Seed: LNVIVHSATGFKQSSKALQRPVASD
LNVIVHSATGYKQMSSALNRPVASD

SEQ ID NO: 10115 - protein, 25 aa, synthetic construct
  source 1..25: note = Seed: LNVIVHSATGFKQSSKALQRPVASD
LNVIVHSATGYKQMSSALPRPVASD

SEQ ID NO: 10116 - protein, 25 aa, synthetic construct
  source 1..25: note = Seed: LNVIVHSATGFKQSSKALQRPVASD
LNVIVHSATGYKQMSSALQRPVASD

SEQ ID NO: 10117 - protein, 25 aa, synthetic construct
  source 1..25: note = Seed: LNVIVHSATGFKQSSKALQRPVASD
LNVIVHSATGYKQMSSALRRPVASD

SEQ ID NO: 10118 - protein, 25 aa, synthetic construct
  source 1..25: note = Seed: LNVIVHSATGFKQSSKALQRPVASD
LNVIVHSATGYKQMSSALSRPVASD

SEQ ID NO: 10119 - protein, 25 aa, synthetic construct
  source 1..25: note = Seed: LNVIVHSATGFKQSSKALQRPVASD
LNVIVHSATGYKQMSSALTRPVASD

SEQ ID NO: 10120 - protein, 25 aa, synthetic construct
  source 1..25: note = Seed: LNVIVHSATGFKQSSKALQRPVASD
LNVIVHSATGYKQMSSALVRPVASD

SEQ ID NO: 10121 - protein, 25 aa, synthetic construct
  source 1..25: note = Seed: LNVIVHSATGFKQSSKALQRPVASD
LNVIVHSATGYKQMSSALWRPVASD

SEQ ID NO: 10122 - protein, 25 aa, synthetic construct
  source 1..25: note = Seed: LNVIVHSATGFKQSSKALQRPVASD
LNVIVHSATGYKQMSSALYRPVASD

SEQ ID NO: 10123 - protein, 25 aa, synthetic construct
  source 1..25: note = Seed: LNVIVHSATGFKQSSKALQRPVASD
LNVIVHSATGYKQMSTALARPVASD

SEQ ID NO: 10124 - protein, 25 aa, synthetic construct
  source 1..25: note = Seed: LNVIVHSATGFKQSSKALQRPVASD
LNVIVHSATGYKQMSTALCRPVASD

SEQ ID NO: 10125 - protein, 25 aa, synthetic construct
  source 1..25: note = Seed: LNVIVHSATGFKQSSKALQRPVASD
LNVIVHSATGYKQMSTALDRPVASD

SEQ ID NO: 10126 - protein, 25 aa, synthetic construct
  source 1..25: note = Seed: LNVIVHSATGFKQSSKALQRPVASD
LNVIVHSATGYKQMSTALERPVASD

SEQ ID NO: 10127 - protein, 25 aa, synthetic construct
  source 1..25: note = Seed: LNVIVHSATGFKQSSKALQRPVASD
LNVIVHSATGYKQMSTALFRPVASD

SEQ ID NO: 10128 - protein, 25 aa, synthetic construct
  source 1..25: note = Seed: LNVIVHSATGFKQSSKALQRPVASD
LNVIVHSATGYKQMSTALGRPVASD

SEQ ID NO: 10129 - protein, 25 aa, synthetic construct
  source 1..25: note = Seed: LNVIVHSATGFKQSSKALQRPVASD
LNVIVHSATGYKQMSTALHRPVASD

SEQ ID NO: 10130 - protein, 25 aa, synthetic construct
  source 1..25: note = Seed: LNVIVHSATGFKQSSKALQRPVASD
LNVIVHSATGYKQMSTALIRPVASD

SEQ ID NO: 10131 - protein, 25 aa, synthetic construct
  source 1..25: note = Seed: LNVIVHSATGFKQSSKALQRPVASD
LNVIVHSATGYKQMSTALKRPVASD

SEQ ID NO: 10132 - protein, 25 aa, synthetic construct
  source 1..25: note = Seed: LNVIVHSATGFKQSSKALQRPVASD
LNVIVHSATGYKQMSTALLRPVASD

SEQ ID NO: 10133 - protein, 25 aa, synthetic construct
  source 1..25: note = Seed: LNVIVHSATGFKQSSKALQRPVASD
LNVIVHSATGYKQMSTALMRPVASD

SEQ ID NO: 10134 - protein, 25 aa, synthetic construct
  source 1..25: note = Seed: LNVIVHSATGFKQSSKALQRPVASD
LNVIVHSATGYKQMSTALNRPVASD

SEQ ID NO: 10135 - protein, 25 aa, synthetic construct
  source 1..25: note = Seed: LNVIVHSATGFKQSSKALQRPVASD
LNVIVHSATGYKQMSTALPRPVASD

SEQ ID NO: 10136 - protein, 25 aa, synthetic construct
  source 1..25: note = Seed: LNVIVHSATGFKQSSKALQRPVASD
LNVIVHSATGYKQMSTALQRPVASD

SEQ ID NO: 10137 - protein, 25 aa, synthetic construct
  source 1..25: note = Seed: LNVIVHSATGFKQSSKALQRPVASD
LNVIVHSATGYKQMSTALRRPVASD

SEQ ID NO: 10138 - protein, 25 aa, synthetic construct
  source 1..25: note = Seed: LNVIVHSATGFKQSSKALQRPVASD
LNVIVHSATGYKQMSTALSRPVASD

SEQ ID NO: 10139 - protein, 25 aa, synthetic construct
  source 1..25: note = Seed: LNVIVHSATGFKQSSKALQRPVASD
LNVIVHSATGYKQMSTALTRPVASD

SEQ ID NO: 10140 - protein, 25 aa, synthetic construct
  source 1..25: note = Seed: LNVIVHSATGFKQSSKALQRPVASD
LNVIVHSATGYKQMSTALVRPVASD

SEQ ID NO: 10141 - protein, 25 aa, synthetic construct
  source 1..25: note = Seed: LNVIVHSATGFKQSSKALQRPVASD
LNVIVHSATGYKQMSTALYRPVASD

SEQ ID NO: 10142 - protein, 25 aa, synthetic construct
  source 1..25: note = Seed: LNVIVHSATGFKQSSKALQRPVASD
LNVIVHSATGYKQMSVALARPVASD

SEQ ID NO: 10143 - protein, 25 aa, synthetic construct
  source 1..25: note = Seed: LNVIVHSATGFKQSSKALQRPVASD
LNVIVHSATGYKQMSVALCRPVASD

SEQ ID NO: 10144 - protein, 25 aa, synthetic construct
  source 1..25: note = Seed: LNVIVHSATGFKQSSKALQRPVASD
LNVIVHSATGYKQMSVALDRPVASD

SEQ ID NO: 10145 - protein, 25 aa, synthetic construct
  source 1..25: note = Seed: LNVIVHSATGFKQSSKALQRPVASD
LNVIVHSATGYKQMSVALERPVASD

SEQ ID NO: 10146 - protein, 25 aa, synthetic construct
  source 1..25: note = Seed: LNVIVHSATGFKQSSKALQRPVASD
LNVIVHSATGYKQMSVALFRPVASD

SEQ ID NO: 10147 - protein, 25 aa, synthetic construct
  source 1..25: note = Seed: LNVIVHSATGFKQSSKALQRPVASD
LNVIVHSATGYKQMSVALGRPVASD

SEQ ID NO: 10148 - protein, 25 aa, synthetic construct
  source 1..25: note = Seed: LNVIVHSATGFKQSSKALQRPVASD
LNVIVHSATGYKQMSVALHRPVASD

SEQ ID NO: 10149 - protein, 25 aa, synthetic construct
  source 1..25: note = Seed: LNVIVHSATGFKQSSKALQRPVASD
LNVIVHSATGYKQMSVALIRPVASD

SEQ ID NO: 10150 - protein, 25 aa, synthetic construct
  source 1..25: note = Seed: LNVIVHSATGFKQSSKALQRPVASD
LNVIVHSATGYKQMSVALKRPVASD

SEQ ID NO: 10151 - protein, 25 aa, synthetic construct
  source 1..25: note = Seed: LNVIVHSATGFKQSSKALQRPVASD
LNVIVHSATGYKQMSVALLRPVASD

SEQ ID NO: 10152 - protein, 25 aa, synthetic construct
  source 1..25: note = Seed: LNVIVHSATGFKQSSKALQRPVASD
LNVIVHSATGYKQMSVALMRPVASD

SEQ ID NO: 10153 - protein, 25 aa, synthetic construct
  source 1..25: note = Seed: LNVIVHSATGFKQSSKALQRPVASD
LNVIVHSATGYKQMSVALNRPVASD

SEQ ID NO: 10154 - protein, 25 aa, synthetic construct
  source 1..25: note = Seed: LNVIVHSATGFKQSSKALQRPVASD
LNVIVHSATGYKQMSVALPRPVASD

SEQ ID NO: 10155 - protein, 25 aa, synthetic construct
  source 1..25: note = Seed: LNVIVHSATGFKQSSKALQRPVASD
LNVIVHSATGYKQMSVALQRPVASD

SEQ ID NO: 10156 - protein, 25 aa, synthetic construct
  source 1..25: note = Seed: LNVIVHSATGFKQSSKALQRPVASD
LNVIVHSATGYKQMSVALRRPVASD

SEQ ID NO: 10157 - protein, 25 aa, synthetic construct
  source 1..25: note = Seed: LNVIVHSATGFKQSSKALQRPVASD
LNVIVHSATGYKQMSVALSRPVASD

SEQ ID NO: 10158 - protein, 25 aa, synthetic construct
  source 1..25: note = Seed: LNVIVHSATGFKQSSKALQRPVASD
LNVIVHSATGYKQMSVALTRPVASD

SEQ ID NO: 10159 - protein, 25 aa, synthetic construct
  source 1..25: note = Seed: LNVIVHSATGFKQSSKALQRPVASD
LNVIVHSATGYKQMSVALVRPVASD

SEQ ID NO: 10160 - protein, 25 aa, synthetic construct
  source 1..25: note = Seed: LNVIVHSATGFKQSSKALQRPVASD
LNVIVHSATGYKQMSVALYRPVASD

SEQ ID NO: 10161 - protein, 25 aa, synthetic construct
  source 1..25: note = Seed: LNVIVHSATGFKQSSKALQRPVASD
LNVIVHSATGYKQMSWALGRPVASD

SEQ ID NO: 10162 - protein, 25 aa, synthetic construct
  source 1..25: note = Seed: LNVIVHSATGFKQSSKALQRPVASD
LNVIVHSATGYKQMSWALIRPVASD

SEQ ID NO: 10163 - protein, 25 aa, synthetic construct
  source 1..25: note = Seed: LNVIVHSATGFKQSSKALQRPVASD
LNVIVHSATGYKQMSWALNRPVASD

SEQ ID NO: 10164 - protein, 25 aa, synthetic construct
  source 1..25: note = Seed: LNVIVHSATGFKQSSKALQRPVASD
LNVIVHSATGYKQMSWALSRPVASD

SEQ ID NO: 10165 - protein, 25 aa, synthetic construct
  source 1..25: note = Seed: LNVIVHSATGFKQSSKALQRPVASD
LNVIVHSATGYKQMSWALTRPVASD

SEQ ID NO: 10166 - protein, 25 aa, synthetic construct
  source 1..25: note = Seed: LNVIVHSATGFKQSSKALQRPVASD
LNVIVHSATGYKQMSWALVRPVASD

SEQ ID NO: 10167 - protein, 25 aa, synthetic construct
  source 1..25: note = Seed: LNVIVHSATGFKQSSKALQRPVASD
LNVIVHSATGYKQMSYALGRPVASD

SEQ ID NO: 10168 - protein, 25 aa, synthetic construct
  source 1..25: note = Seed: LNVIVHSATGFKQSSKALQRPVASD
LNVIVHSATGYKQMSYALHRPVASD

SEQ ID NO: 10169 - protein, 25 aa, synthetic construct
  source 1..25: note = Seed: LNVIVHSATGFKQSSKALQRPVASD
LNVIVHSATGYKQMSYALIRPVASD

SEQ ID NO: 10170 - protein, 25 aa, synthetic construct
  source 1..25: note = Seed: LNVIVHSATGFKQSSKALQRPVASD
LNVIVHSATGYKQMSYALNRPVASD

SEQ ID NO: 10171 - protein, 25 aa, synthetic construct
  source 1..25: note = Seed: LNVIVHSATGFKQSSKALQRPVASD
LNVIVHSATGYKQMSYALSRPVASD

SEQ ID NO: 10172 - protein, 25 aa, synthetic construct
  source 1..25: note = Seed: LNVIVHSATGFKQSSKALQRPVASD
LNVIVHSATGYKQMSYALVRPVASD

SEQ ID NO: 10173 - protein, 25 aa, synthetic construct
  source 1..25: note = Seed: LNVIVHSATGFKQSSKALQRPVASD
LNVIVHSATGYKQNSAALARPVASD

SEQ ID NO: 10174 - protein, 25 aa, synthetic construct
  source 1..25: note = Seed: LNVIVHSATGFKQSSKALQRPVASD
LNVIVHSATGYKQNSAALFRPVASD

SEQ ID NO: 10175 - protein, 25 aa, synthetic construct
  source 1..25: note = Seed: LNVIVHSATGFKQSSKALQRPVASD
LNVIVHSATGYKQNSAALIRPVASD

SEQ ID NO: 10176 - protein, 25 aa, synthetic construct
  source 1..25: note = Seed: LNVIVHSATGFKQSSKALQRPVASD
LNVIVHSATGYKQNSAALLRPVASD

SEQ ID NO: 10177 - protein, 25 aa, synthetic construct
  source 1..25: note = Seed: LNVIVHSATGFKQSSKALQRPVASD
LNVIVHSATGYKQNSAALMRPVASD

SEQ ID NO: 10178 - protein, 25 aa, synthetic construct
  source 1..25: note = Seed: LNVIVHSATGFKQSSKALQRPVASD
LNVIVHSATGYKQNSAALSRPVASD

SEQ ID NO: 10179 - protein, 25 aa, synthetic construct
  source 1..25: note = Seed: LNVIVHSATGFKQSSKALQRPVASD
LNVIVHSATGYKQNSAALTRPVASD

SEQ ID NO: 10180 - protein, 25 aa, synthetic construct
  source 1..25: note = Seed: LNVIVHSATGFKQSSKALQRPVASD
LNVIVHSATGYKQNSAALVRPVASD

SEQ ID NO: 10181 - protein, 25 aa, synthetic construct
  source 1..25: note = Seed: LNVIVHSATGFKQSSKALQRPVASD
LNVIVHSATGYKQNSAALYRPVASD

SEQ ID NO: 10182 - protein, 25 aa, synthetic construct
  source 1..25: note = Seed: LNVIVHSATGFKQSSKALQRPVASD
LNVIVHSATGYKQNSGALARPVASD

SEQ ID NO: 10183 - protein, 25 aa, synthetic construct
  source 1..25: note = Seed: LNVIVHSATGFKQSSKALQRPVASD
LNVIVHSATGYKQNSGALFRPVASD

SEQ ID NO: 10184 - protein, 25 aa, synthetic construct
  source 1..25: note = Seed: LNVIVHSATGFKQSSKALQRPVASD
LNVIVHSATGYKQNSGALIRPVASD

SEQ ID NO: 10185 - protein, 25 aa, synthetic construct
  source 1..25: note = Seed: LNVIVHSATGFKQSSKALQRPVASD
LNVIVHSATGYKQNSGALLRPVASD

SEQ ID NO: 10186 - protein, 25 aa, synthetic construct
  source 1..25: note = Seed: LNVIVHSATGFKQSSKALQRPVASD
LNVIVHSATGYKQNSGALMRPVASD

SEQ ID NO: 10187 - protein, 25 aa, synthetic construct
  source 1..25: note = Seed: LNVIVHSATGFKQSSKALQRPVASD
LNVIVHSATGYKQNSGALVRPVASD

SEQ ID NO: 10188 - protein, 25 aa, synthetic construct
  source 1..25: note = Seed: LNVIVHSATGFKQSSKALQRPVASD
LNVIVHSATGYKQNSIALARPVASD

SEQ ID NO: 10189 - protein, 25 aa, synthetic construct
  source 1..25: note = Seed: LNVIVHSATGFKQSSKALQRPVASD
LNVIVHSATGYKQNSIALFRPVASD

SEQ ID NO: 10190 - protein, 25 aa, synthetic construct
  source 1..25: note = Seed: LNVIVHSATGFKQSSKALQRPVASD
LNVIVHSATGYKQNSIALIRPVASD

SEQ ID NO: 10191 - protein, 25 aa, synthetic construct
  source 1..25: note = Seed: LNVIVHSATGFKQSSKALQRPVASD
LNVIVHSATGYKQNSIALLRPVASD

SEQ ID NO: 10192 - protein, 25 aa, synthetic construct
  source 1..25: note = Seed: LNVIVHSATGFKQSSKALQRPVASD
LNVIVHSATGYKQNSIALVRPVASD

SEQ ID NO: 10193 - protein, 25 aa, synthetic construct
  source 1..25: note = Seed: LNVIVHSATGFKQSSKALQRPVASD
LNVIVHSATGYKQNSIALYRPVASD

SEQ ID NO: 10194 - protein, 25 aa, synthetic construct
  source 1..25: note = Seed: LNVIVHSATGFKQSSKALQRPVASD
LNVIVHSATGYKQNSLALARPVASD

SEQ ID NO: 10195 - protein, 25 aa, synthetic construct
  source 1..25: note = Seed: LNVIVHSATGFKQSSKALQRPVASD
LNVIVHSATGYKQNSLALLRPVASD

SEQ ID NO: 10196 - protein, 25 aa, synthetic construct
  source 1..25: note = Seed: LNVIVHSATGFKQSSKALQRPVASD
LNVIVHSATGYKQNSLALNRPVASD

SEQ ID NO: 10197 - protein, 25 aa, synthetic construct
  source 1..25: note = Seed: LNVIVHSATGFKQSSKALQRPVASD
LNVIVHSATGYKQNSMALIRPVASD

SEQ ID NO: 10198 - protein, 25 aa, synthetic construct
  source 1..25: note = Seed: LNVIVHSATGFKQSSKALQRPVASD
LNVIVHSATGYKQNSNALFRPVASD

SEQ ID NO: 10199 - protein, 25 aa, synthetic construct
  source 1..25: note = Seed: LNVIVHSATGFKQSSKALQRPVASD
LNVIVHSATGYKQNSNALIRPVASD

SEQ ID NO: 10200 - protein, 25 aa, synthetic construct
  source 1..25: note = Seed: LNVIVHSATGFKQSSKALQRPVASD
LNVIVHSATGYKQNSNALLRPVASD

SEQ ID NO: 10201 - protein, 25 aa, synthetic construct
  source 1..25: note = Seed: LNVIVHSATGFKQSSKALQRPVASD
LNVIVHSATGYKQNSNALVRPVASD

SEQ ID NO: 10202 - protein, 25 aa, synthetic construct
  source 1..25: note = Seed: LNVIVHSATGFKQSSKALQRPVASD
LNVIVHSATGYKQNSNALYRPVASD

SEQ ID NO: 10203 - protein, 25 aa, synthetic construct
  source 1..25: note = Seed: LNVIVHSATGFKQSSKALQRPVASD
LNVIVHSATGYKQNSPALARPVASD

SEQ ID NO: 10204 - protein, 25 aa, synthetic construct
  source 1..25: note = Seed: LNVIVHSATGFKQSSKALQRPVASD
LNVIVHSATGYKQNSPALFRPVASD

SEQ ID NO: 10205 - protein, 25 aa, synthetic construct
  source 1..25: note = Seed: LNVIVHSATGFKQSSKALQRPVASD
LNVIVHSATGYKQNSPALIRPVASD

SEQ ID NO: 10206 - protein, 25 aa, synthetic construct
  source 1..25: note = Seed: LNVIVHSATGFKQSSKALQRPVASD
LNVIVHSATGYKQNSPALLRPVASD

SEQ ID NO: 10207 - protein, 25 aa, synthetic construct
  source 1..25: note = Seed: LNVIVHSATGFKQSSKALQRPVASD
LNVIVHSATGYKQNSPALMRPVASD

SEQ ID NO: 10208 - protein, 25 aa, synthetic construct
  source 1..25: note = Seed: LNVIVHSATGFKQSSKALQRPVASD
LNVIVHSATGYKQNSPALVRPVASD

SEQ ID NO: 10209 - protein, 25 aa, synthetic construct
  source 1..25: note = Seed: LNVIVHSATGFKQSSKALQRPVASD
LNVIVHSATGYKQNSPALYRPVASD

SEQ ID NO: 10210 - protein, 25 aa, synthetic construct
  source 1..25: note = Seed: LNVIVHSATGFKQSSKALQRPVASD
LNVIVHSATGYKQNSSALARPVASD

SEQ ID NO: 10211 - protein, 25 aa, synthetic construct
  source 1..25: note = Seed: LNVIVHSATGFKQSSKALQRPVASD
LNVIVHSATGYKQNSSALFRPVASD

SEQ ID NO: 10212 - protein, 25 aa, synthetic construct
  source 1..25: note = Seed: LNVIVHSATGFKQSSKALQRPVASD
LNVIVHSATGYKQNSSALIRPVASD

SEQ ID NO: 10213 - protein, 25 aa, synthetic construct
  source 1..25: note = Seed: LNVIVHSATGFKQSSKALQRPVASD
LNVIVHSATGYKQNSSALLRPVASD

SEQ ID NO: 10214 - protein, 25 aa, synthetic construct
  source 1..25: note = Seed: LNVIVHSATGFKQSSKALQRPVASD
LNVIVHSATGYKQNSSALMRPVASD

SEQ ID NO: 10215 - protein, 25 aa, synthetic construct
  source 1..25: note = Seed: LNVIVHSATGFKQSSKALQRPVASD
LNVIVHSATGYKQNSSALVRPVASD

SEQ ID NO: 10216 - protein, 25 aa, synthetic construct
  source 1..25: note = Seed: LNVIVHSATGFKQSSKALQRPVASD
LNVIVHSATGYKQNSSALYRPVASD

SEQ ID NO: 10217 - protein, 25 aa, synthetic construct
  source 1..25: note = Seed: LNVIVHSATGFKQSSKALQRPVASD
LNVIVHSATGYKQNSTALFRPVASD

SEQ ID NO: 10218 - protein, 25 aa, synthetic construct
  source 1..25: note = Seed: LNVIVHSATGFKQSSKALQRPVASD
LNVIVHSATGYKQNSTALIRPVASD

SEQ ID NO: 10219 - protein, 25 aa, synthetic construct
  source 1..25: note = Seed: LNVIVHSATGFKQSSKALQRPVASD
LNVIVHSATGYKQNSTALLRPVASD

SEQ ID NO: 10220 - protein, 25 aa, synthetic construct
  source 1..25: note = Seed: LNVIVHSATGFKQSSKALQRPVASD
LNVIVHSATGYKQNSTALVRPVASD

SEQ ID NO: 10221 - protein, 25 aa, synthetic construct
  source 1..25: note = Seed: LNVIVHSATGFKQSSKALQRPVASD
LNVIVHSATGYKQNSTALYRPVASD

SEQ ID NO: 10222 - protein, 25 aa, synthetic construct
  source 1..25: note = Seed: LNVIVHSATGFKQSSKALQRPVASD
LNVIVHSATGYKQNSVALARPVASD

SEQ ID NO: 10223 - protein, 25 aa, synthetic construct
  source 1..25: note = Seed: LNVIVHSATGFKQSSKALQRPVASD
LNVIVHSATGYKQNSVALFRPVASD

SEQ ID NO: 10224 - protein, 25 aa, synthetic construct
  source 1..25: note = Seed: LNVIVHSATGFKQSSKALQRPVASD
LNVIVHSATGYKQNSVALIRPVASD

SEQ ID NO: 10225 - protein, 25 aa, synthetic construct
  source 1..25: note = Seed: LNVIVHSATGFKQSSKALQRPVASD
LNVIVHSATGYKQNSVALLRPVASD

SEQ ID NO: 10226 - protein, 25 aa, synthetic construct
  source 1..25: note = Seed: LNVIVHSATGFKQSSKALQRPVASD
LNVIVHSATGYKQNSVALMRPVASD

SEQ ID NO: 10227 - protein, 25 aa, synthetic construct
  source 1..25: note = Seed: LNVIVHSATGFKQSSKALQRPVASD
LNVIVHSATGYKQNSVALVRPVASD

SEQ ID NO: 10228 - protein, 25 aa, synthetic construct
  source 1..25: note = Seed: LNVIVHSATGFKQSSKALQRPVASD
LNVIVHSATGYKQNSVALYRPVASD

SEQ ID NO: 10229 - protein, 25 aa, synthetic construct
  source 1..25: note = Seed: LNVIVHSATGFKQSSKALQRPVASD
LNVIVHSATGYKQQSAALARPVASD

SEQ ID NO: 10230 - protein, 25 aa, synthetic construct
  source 1..25: note = Seed: LNVIVHSATGFKQSSKALQRPVASD
LNVIVHSATGYKQQSAALCRPVASD

SEQ ID NO: 10231 - protein, 25 aa, synthetic construct
  source 1..25: note = Seed: LNVIVHSATGFKQSSKALQRPVASD
LNVIVHSATGYKQQSAALDRPVASD

SEQ ID NO: 10232 - protein, 25 aa, synthetic construct
  source 1..25: note = Seed: LNVIVHSATGFKQSSKALQRPVASD
LNVIVHSATGYKQQSAALFRPVASD

SEQ ID NO: 10233 - protein, 25 aa, synthetic construct
  source 1..25: note = Seed: LNVIVHSATGFKQSSKALQRPVASD
LNVIVHSATGYKQQSAALGRPVASD

SEQ ID NO: 10234 - protein, 25 aa, synthetic construct
  source 1..25: note = Seed: LNVIVHSATGFKQSSKALQRPVASD
LNVIVHSATGYKQQSAALHRPVASD

SEQ ID NO: 10235 - protein, 25 aa, synthetic construct
  source 1..25: note = Seed: LNVIVHSATGFKQSSKALQRPVASD
LNVIVHSATGYKQQSAALIRPVASD

SEQ ID NO: 10236 - protein, 25 aa, synthetic construct
  source 1..25: note = Seed: LNVIVHSATGFKQSSKALQRPVASD
LNVIVHSATGYKQQSAALLRPVASD

SEQ ID NO: 10237 - protein, 25 aa, synthetic construct
  source 1..25: note = Seed: LNVIVHSATGFKQSSKALQRPVASD
LNVIVHSATGYKQQSAALMRPVASD

SEQ ID NO: 10238 - protein, 25 aa, synthetic construct
  source 1..25: note = Seed: LNVIVHSATGFKQSSKALQRPVASD
LNVIVHSATGYKQQSAALNRPVASD

SEQ ID NO: 10239 - protein, 25 aa, synthetic construct
  source 1..25: note = Seed: LNVIVHSATGFKQSSKALQRPVASD
LNVIVHSATGYKQQSAALPRPVASD

SEQ ID NO: 10240 - protein, 25 aa, synthetic construct
  source 1..25: note = Seed: LNVIVHSATGFKQSSKALQRPVASD
LNVIVHSATGYKQQSAALQRPVASD

SEQ ID NO: 10241 - protein, 25 aa, synthetic construct
  source 1..25: note = Seed: LNVIVHSATGFKQSSKALQRPVASD
LNVIVHSATGYKQQSAALSRPVASD

SEQ ID NO: 10242 - protein, 25 aa, synthetic construct
  source 1..25: note = Seed: LNVIVHSATGFKQSSKALQRPVASD
LNVIVHSATGYKQQSAALTRPVASD

SEQ ID NO: 10243 - protein, 25 aa, synthetic construct
  source 1..25: note = Seed: LNVIVHSATGFKQSSKALQRPVASD
LNVIVHSATGYKQQSAALVRPVASD

SEQ ID NO: 10244 - protein, 25 aa, synthetic construct
  source 1..25: note = Seed: LNVIVHSATGFKQSSKALQRPVASD
LNVIVHSATGYKQQSGALARPVASD

SEQ ID NO: 10245 - protein, 25 aa, synthetic construct
  source 1..25: note = Seed: LNVIVHSATGFKQSSKALQRPVASD
LNVIVHSATGYKQQSGALCRPVASD

SEQ ID NO: 10246 - protein, 25 aa, synthetic construct
  source 1..25: note = Seed: LNVIVHSATGFKQSSKALQRPVASD
LNVIVHSATGYKQQSGALFRPVASD

SEQ ID NO: 10247 - protein, 25 aa, synthetic construct
  source 1..25: note = Seed: LNVIVHSATGFKQSSKALQRPVASD
LNVIVHSATGYKQQSGALGRPVASD

SEQ ID NO: 10248 - protein, 25 aa, synthetic construct
  source 1..25: note = Seed: LNVIVHSATGFKQSSKALQRPVASD
LNVIVHSATGYKQQSGALIRPVASD

SEQ ID NO: 10249 - protein, 25 aa, synthetic construct
  source 1..25: note = Seed: LNVIVHSATGFKQSSKALQRPVASD
LNVIVHSATGYKQQSGALLRPVASD

SEQ ID NO: 10250 - protein, 25 aa, synthetic construct
  source 1..25: note = Seed: LNVIVHSATGFKQSSKALQRPVASD
LNVIVHSATGYKQQSGALMRPVASD

SEQ ID NO: 10251 - protein, 25 aa, synthetic construct
  source 1..25: note = Seed: LNVIVHSATGFKQSSKALQRPVASD
LNVIVHSATGYKQQSGALNRPVASD

SEQ ID NO: 10252 - protein, 25 aa, synthetic construct
  source 1..25: note = Seed: LNVIVHSATGFKQSSKALQRPVASD
LNVIVHSATGYKQQSGALSRPVASD

SEQ ID NO: 10253 - protein, 25 aa, synthetic construct
  source 1..25: note = Seed: LNVIVHSATGFKQSSKALQRPVASD
LNVIVHSATGYKQQSGALTRPVASD

SEQ ID NO: 10254 - protein, 25 aa, synthetic construct
  source 1..25: note = Seed: LNVIVHSATGFKQSSKALQRPVASD
LNVIVHSATGYKQQSGALVRPVASD

SEQ ID NO: 10255 - protein, 25 aa, synthetic construct
  source 1..25: note = Seed: LNVIVHSATGFKQSSKALQRPVASD
LNVIVHSATGYKQQSIALARPVASD

SEQ ID NO: 10256 - protein, 25 aa, synthetic construct
  source 1..25: note = Seed: LNVIVHSATGFKQSSKALQRPVASD
LNVIVHSATGYKQQSIALFRPVASD

SEQ ID NO: 10257 - protein, 25 aa, synthetic construct
  source 1..25: note = Seed: LNVIVHSATGFKQSSKALQRPVASD
LNVIVHSATGYKQQSIALGRPVASD

SEQ ID NO: 10258 - protein, 25 aa, synthetic construct
  source 1..25: note = Seed: LNVIVHSATGFKQSSKALQRPVASD
LNVIVHSATGYKQQSIALHRPVASD

SEQ ID NO: 10259 - protein, 25 aa, synthetic construct
  source 1..25: note = Seed: LNVIVHSATGFKQSSKALQRPVASD
LNVIVHSATGYKQQSIALIRPVASD

SEQ ID NO: 10260 - protein, 25 aa, synthetic construct
  source 1..25: note = Seed: LNVIVHSATGFKQSSKALQRPVASD
LNVIVHSATGYKQQSIALLRPVASD

SEQ ID NO: 10261 - protein, 25 aa, synthetic construct
  source 1..25: note = Seed: LNVIVHSATGFKQSSKALQRPVASD
LNVIVHSATGYKQQSIALMRPVASD

SEQ ID NO: 10262 - protein, 25 aa, synthetic construct
  source 1..25: note = Seed: LNVIVHSATGFKQSSKALQRPVASD
LNVIVHSATGYKQQSIALNRPVASD

SEQ ID NO: 10263 - protein, 25 aa, synthetic construct
  source 1..25: note = Seed: LNVIVHSATGFKQSSKALQRPVASD
LNVIVHSATGYKQQSIALQRPVASD

SEQ ID NO: 10264 - protein, 25 aa, synthetic construct
  source 1..25: note = Seed: LNVIVHSATGFKQSSKALQRPVASD
LNVIVHSATGYKQQSIALSRPVASD

SEQ ID NO: 10265 - protein, 25 aa, synthetic construct
  source 1..25: note = Seed: LNVIVHSATGFKQSSKALQRPVASD
LNVIVHSATGYKQQSIALTRPVASD

SEQ ID NO: 10266 - protein, 25 aa, synthetic construct
  source 1..25: note = Seed: LNVIVHSATGFKQSSKALQRPVASD
LNVIVHSATGYKQQSIALVRPVASD

SEQ ID NO: 10267 - protein, 25 aa, synthetic construct
  source 1..25: note = Seed: LNVIVHSATGFKQSSKALQRPVASD
LNVIVHSATGYKQQSKALARPVASD

SEQ ID NO: 10268 - protein, 25 aa, synthetic construct
  source 1..25: note = Seed: LNVIVHSATGFKQSSKALQRPVASD
LNVIVHSATGYKQQSKALSRPVASD

SEQ ID NO: 10269 - protein, 25 aa, synthetic construct
  source 1..25: note = Seed: LNVIVHSATGFKQSSKALQRPVASD
LNVIVHSATGYKQQSLALARPVASD

SEQ ID NO: 10270 - protein, 25 aa, synthetic construct
  source 1..25: note = Seed: LNVIVHSATGFKQSSKALQRPVASD
LNVIVHSATGYKQQSLALIRPVASD

SEQ ID NO: 10271 - protein, 25 aa, synthetic construct
  source 1..25: note = Seed: LNVIVHSATGFKQSSKALQRPVASD
LNVIVHSATGYKQQSLALLRPVASD

SEQ ID NO: 10272 - protein, 25 aa, synthetic construct
  source 1..25: note = Seed: LNVIVHSATGFKQSSKALQRPVASD
LNVIVHSATGYKQQSLALMRPVASD

SEQ ID NO: 10273 - protein, 25 aa, synthetic construct
  source 1..25: note = Seed: LNVIVHSATGFKQSSKALQRPVASD
LNVIVHSATGYKQQSLALNRPVASD

SEQ ID NO: 10274 - protein, 25 aa, synthetic construct
  source 1..25: note = Seed: LNVIVHSATGFKQSSKALQRPVASD
LNVIVHSATGYKQQSLALSRPVASD

SEQ ID NO: 10275 - protein, 25 aa, synthetic construct
  source 1..25: note = Seed: LNVIVHSATGFKQSSKALQRPVASD
LNVIVHSATGYKQQSLALTRPVASD

SEQ ID NO: 10276 - protein, 25 aa, synthetic construct
  source 1..25: note = Seed: LNVIVHSATGFKQSSKALQRPVASD
LNVIVHSATGYKQQSLALVRPVASD

SEQ ID NO: 10277 - protein, 25 aa, synthetic construct
  source 1..25: note = Seed: LNVIVHSATGFKQSSKALQRPVASD
LNVIVHSATGYKQQSMALARPVASD

SEQ ID NO: 10278 - protein, 25 aa, synthetic construct
  source 1..25: note = Seed: LNVIVHSATGFKQSSKALQRPVASD
LNVIVHSATGYKQQSMALIRPVASD

SEQ ID NO: 10279 - protein, 25 aa, synthetic construct
  source 1..25: note = Seed: LNVIVHSATGFKQSSKALQRPVASD
LNVIVHSATGYKQQSMALLRPVASD

SEQ ID NO: 10280 - protein, 25 aa, synthetic construct
  source 1..25: note = Seed: LNVIVHSATGFKQSSKALQRPVASD
LNVIVHSATGYKQQSMALMRPVASD

SEQ ID NO: 10281 - protein, 25 aa, synthetic construct
  source 1..25: note = Seed: LNVIVHSATGFKQSSKALQRPVASD
LNVIVHSATGYKQQSMALNRPVASD

SEQ ID NO: 10282 - protein, 25 aa, synthetic construct
  source 1..25: note = Seed: LNVIVHSATGFKQSSKALQRPVASD
LNVIVHSATGYKQQSMALSRPVASD

SEQ ID NO: 10283 - protein, 25 aa, synthetic construct
  source 1..25: note = Seed: LNVIVHSATGFKQSSKALQRPVASD
LNVIVHSATGYKQQSMALTRPVASD

SEQ ID NO: 10284 - protein, 25 aa, synthetic construct
  source 1..25: note = Seed: LNVIVHSATGFKQSSKALQRPVASD
LNVIVHSATGYKQQSMALVRPVASD

SEQ ID NO: 10285 - protein, 25 aa, synthetic construct
  source 1..25: note = Seed: LNVIVHSATGFKQSSKALQRPVASD
LNVIVHSATGYKQQSNALARPVASD

SEQ ID NO: 10286 - protein, 25 aa, synthetic construct
  source 1..25: note = Seed: LNVIVHSATGFKQSSKALQRPVASD
LNVIVHSATGYKQQSNALIRPVASD

SEQ ID NO: 10287 - protein, 25 aa, synthetic construct
  source 1..25: note = Seed: LNVIVHSATGFKQSSKALQRPVASD
LNVIVHSATGYKQQSNALLRPVASD

SEQ ID NO: 10288 - protein, 25 aa, synthetic construct
  source 1..25: note = Seed: LNVIVHSATGFKQSSKALQRPVASD
LNVIVHSATGYKQQSNALMRPVASD

SEQ ID NO: 10289 - protein, 25 aa, synthetic construct
  source 1..25: note = Seed: LNVIVHSATGFKQSSKALQRPVASD
LNVIVHSATGYKQQSNALNRPVASD

SEQ ID NO: 10290 - protein, 25 aa, synthetic construct
  source 1..25: note = Seed: LNVIVHSATGFKQSSKALQRPVASD
LNVIVHSATGYKQQSNALSRPVASD

SEQ ID NO: 10291 - protein, 25 aa, synthetic construct
  source 1..25: note = Seed: LNVIVHSATGFKQSSKALQRPVASD
LNVIVHSATGYKQQSNALTRPVASD

SEQ ID NO: 10292 - protein, 25 aa, synthetic construct
  source 1..25: note = Seed: LNVIVHSATGFKQSSKALQRPVASD
LNVIVHSATGYKQQSNALVRPVASD

SEQ ID NO: 10293 - protein, 25 aa, synthetic construct
  source 1..25: note = Seed: LNVIVHSATGFKQSSKALQRPVASD
LNVIVHSATGYKQQSPALARPVASD

SEQ ID NO: 10294 - protein, 25 aa, synthetic construct
  source 1..25: note = Seed: LNVIVHSATGFKQSSKALQRPVASD
LNVIVHSATGYKQQSPALGRPVASD

SEQ ID NO: 10295 - protein, 25 aa, synthetic construct
  source 1..25: note = Seed: LNVIVHSATGFKQSSKALQRPVASD
LNVIVHSATGYKQQSPALIRPVASD

SEQ ID NO: 10296 - protein, 25 aa, synthetic construct
  source 1..25: note = Seed: LNVIVHSATGFKQSSKALQRPVASD
LNVIVHSATGYKQQSPALLRPVASD

SEQ ID NO: 10297 - protein, 25 aa, synthetic construct
  source 1..25: note = Seed: LNVIVHSATGFKQSSKALQRPVASD
LNVIVHSATGYKQQSPALMRPVASD

SEQ ID NO: 10298 - protein, 25 aa, synthetic construct
  source 1..25: note = Seed: LNVIVHSATGFKQSSKALQRPVASD
LNVIVHSATGYKQQSPALNRPVASD

SEQ ID NO: 10299 - protein, 25 aa, synthetic construct
  source 1..25: note = Seed: LNVIVHSATGFKQSSKALQRPVASD
LNVIVHSATGYKQQSPALQRPVASD

SEQ ID NO: 10300 - protein, 25 aa, synthetic construct
  source 1..25: note = Seed: LNVIVHSATGFKQSSKALQRPVASD
LNVIVHSATGYKQQSPALSRPVASD

SEQ ID NO: 10301 - protein, 25 aa, synthetic construct
  source 1..25: note = Seed: LNVIVHSATGFKQSSKALQRPVASD
LNVIVHSATGYKQQSPALTRPVASD

SEQ ID NO: 10302 - protein, 25 aa, synthetic construct
  source 1..25: note = Seed: LNVIVHSATGFKQSSKALQRPVASD
LNVIVHSATGYKQQSPALVRPVASD

SEQ ID NO: 10303 - protein, 25 aa, synthetic construct
  source 1..25: note = Seed: LNVIVHSATGFKQSSKALQRPVASD
LNVIVHSATGYKQQSRALARPVASD

SEQ ID NO: 10304 - protein, 25 aa, synthetic construct
  source 1..25: note = Seed: LNVIVHSATGFKQSSKALQRPVASD
LNVIVHSATGYKQQSRALGRPVASD

SEQ ID NO: 10305 - protein, 25 aa, synthetic construct
  source 1..25: note = Seed: LNVIVHSATGFKQSSKALQRPVASD
LNVIVHSATGYKQQSRALSRPVASD

SEQ ID NO: 10306 - protein, 25 aa, synthetic construct
  source 1..25: note = Seed: LNVIVHSATGFKQSSKALQRPVASD
LNVIVHSATGYKQQSRALTRPVASD

SEQ ID NO: 10307 - protein, 25 aa, synthetic construct
  source 1..25: note = Seed: LNVIVHSATGFKQSSKALQRPVASD
LNVIVHSATGYKQQSSALARPVASD

SEQ ID NO: 10308 - protein, 25 aa, synthetic construct
  source 1..25: note = Seed: LNVIVHSATGFKQSSKALQRPVASD
LNVIVHSATGYKQQSSALCRPVASD

SEQ ID NO: 10309 - protein, 25 aa, synthetic construct
  source 1..25: note = Seed: LNVIVHSATGFKQSSKALQRPVASD
LNVIVHSATGYKQQSSALFRPVASD

SEQ ID NO: 10310 - protein, 25 aa, synthetic construct
  source 1..25: note = Seed: LNVIVHSATGFKQSSKALQRPVASD
LNVIVHSATGYKQQSSALGRPVASD

SEQ ID NO: 10311 - protein, 25 aa, synthetic construct
  source 1..25: note = Seed: LNVIVHSATGFKQSSKALQRPVASD
LNVIVHSATGYKQQSSALIRPVASD

SEQ ID NO: 10312 - protein, 25 aa, synthetic construct
  source 1..25: note = Seed: LNVIVHSATGFKQSSKALQRPVASD
LNVIVHSATGYKQQSSALLRPVASD

SEQ ID NO: 10313 - protein, 25 aa, synthetic construct
  source 1..25: note = Seed: LNVIVHSATGFKQSSKALQRPVASD
LNVIVHSATGYKQQSSALMRPVASD

SEQ ID NO: 10314 - protein, 25 aa, synthetic construct
  source 1..25: note = Seed: LNVIVHSATGFKQSSKALQRPVASD
LNVIVHSATGYKQQSSALNRPVASD

SEQ ID NO: 10315 - protein, 25 aa, synthetic construct
  source 1..25: note = Seed: LNVIVHSATGFKQSSKALQRPVASD
LNVIVHSATGYKQQSSALSRPVASD

SEQ ID NO: 10316 - protein, 25 aa, synthetic construct
  source 1..25: note = Seed: LNVIVHSATGFKQSSKALQRPVASD
LNVIVHSATGYKQQSSALTRPVASD

SEQ ID NO: 10317 - protein, 25 aa, synthetic construct
  source 1..25: note = Seed: LNVIVHSATGFKQSSKALQRPVASD
LNVIVHSATGYKQQSSALVRPVASD

SEQ ID NO: 10318 - protein, 25 aa, synthetic construct
  source 1..25: note = Seed: LNVIVHSATGFKQSSKALQRPVASD
LNVIVHSATGYKQQSTALARPVASD

SEQ ID NO: 10319 - protein, 25 aa, synthetic construct
  source 1..25: note = Seed: LNVIVHSATGFKQSSKALQRPVASD
LNVIVHSATGYKQQSTALIRPVASD

SEQ ID NO: 10320 - protein, 25 aa, synthetic construct
  source 1..25: note = Seed: LNVIVHSATGFKQSSKALQRPVASD
LNVIVHSATGYKQQSTALLRPVASD

SEQ ID NO: 10321 - protein, 25 aa, synthetic construct
  source 1..25: note = Seed: LNVIVHSATGFKQSSKALQRPVASD
LNVIVHSATGYKQQSTALMRPVASD

SEQ ID NO: 10322 - protein, 25 aa, synthetic construct
  source 1..25: note = Seed: LNVIVHSATGFKQSSKALQRPVASD
LNVIVHSATGYKQQSTALNRPVASD

SEQ ID NO: 10323 - protein, 25 aa, synthetic construct
  source 1..25: note = Seed: LNVIVHSATGFKQSSKALQRPVASD
LNVIVHSATGYKQQSTALSRPVASD

SEQ ID NO: 10324 - protein, 25 aa, synthetic construct
  source 1..25: note = Seed: LNVIVHSATGFKQSSKALQRPVASD
LNVIVHSATGYKQQSTALTRPVASD

SEQ ID NO: 10325 - protein, 25 aa, synthetic construct
  source 1..25: note = Seed: LNVIVHSATGFKQSSKALQRPVASD
LNVIVHSATGYKQQSTALVRPVASD

SEQ ID NO: 10326 - protein, 25 aa, synthetic construct
  source 1..25: note = Seed: LNVIVHSATGFKQSSKALQRPVASD
LNVIVHSATGYKQQSVALARPVASD

SEQ ID NO: 10327 - protein, 25 aa, synthetic construct
  source 1..25: note = Seed: LNVIVHSATGFKQSSKALQRPVASD
LNVIVHSATGYKQQSVALGRPVASD

SEQ ID NO: 10328 - protein, 25 aa, synthetic construct
  source 1..25: note = Seed: LNVIVHSATGFKQSSKALQRPVASD
LNVIVHSATGYKQQSVALHRPVASD

SEQ ID NO: 10329 - protein, 25 aa, synthetic construct
  source 1..25: note = Seed: LNVIVHSATGFKQSSKALQRPVASD
LNVIVHSATGYKQQSVALIRPVASD

SEQ ID NO: 10330 - protein, 25 aa, synthetic construct
  source 1..25: note = Seed: LNVIVHSATGFKQSSKALQRPVASD
LNVIVHSATGYKQQSVALLRPVASD

SEQ ID NO: 10331 - protein, 25 aa, synthetic construct
  source 1..25: note = Seed: LNVIVHSATGFKQSSKALQRPVASD
LNVIVHSATGYKQQSVALMRPVASD

SEQ ID NO: 10332 - protein, 25 aa, synthetic construct
  source 1..25: note = Seed: LNVIVHSATGFKQSSKALQRPVASD
LNVIVHSATGYKQQSVALNRPVASD

SEQ ID NO: 10333 - protein, 25 aa, synthetic construct
  source 1..25: note = Seed: LNVIVHSATGFKQSSKALQRPVASD
LNVIVHSATGYKQQSVALQRPVASD

SEQ ID NO: 10334 - protein, 25 aa, synthetic construct
  source 1..25: note = Seed: LNVIVHSATGFKQSSKALQRPVASD
LNVIVHSATGYKQQSVALSRPVASD

SEQ ID NO: 10335 - protein, 25 aa, synthetic construct
  source 1..25: note = Seed: LNVIVHSATGFKQSSKALQRPVASD
LNVIVHSATGYKQQSVALTRPVASD

SEQ ID NO: 10336 - protein, 25 aa, synthetic construct
  source 1..25: note = Seed: LNVIVHSATGFKQSSKALQRPVASD
LNVIVHSATGYKQQSVALVRPVASD

SEQ ID NO: 10337 - protein, 25 aa, synthetic construct
  source 1..25: note = Seed: LNVIVHSATGFKQSSKALQRPVASD
LNVIVHSATGYKQQSWALIRPVASD

SEQ ID NO: 10338 - protein, 25 aa, synthetic construct
  source 1..25: note = Seed: LNVIVHSATGFKQSSKALQRPVASD
LNVIVHSATGYKQRSAALIRPVASD

SEQ ID NO: 10339 - protein, 25 aa, synthetic construct
  source 1..25: note = Seed: LNVIVHSATGFKQSSKALQRPVASD
LNVIVHSATGYKQRSAALLRPVASD

SEQ ID NO: 10340 - protein, 25 aa, synthetic construct
  source 1..25: note = Seed: LNVIVHSATGFKQSSKALQRPVASD
LNVIVHSATGYKQRSAALVRPVASD

SEQ ID NO: 10341 - protein, 25 aa, synthetic construct
  source 1..25: note = Seed: LNVIVHSATGFKQSSKALQRPVASD
LNVIVHSATGYKQSSAALARPVASD

SEQ ID NO: 10342 - protein, 25 aa, synthetic construct
  source 1..25: note = Seed: LNVIVHSATGFKQSSKALQRPVASD
LNVIVHSATGYKQSSAALCRPVASD

SEQ ID NO: 10343 - protein, 25 aa, synthetic construct
  source 1..25: note = Seed: LNVIVHSATGFKQSSKALQRPVASD
LNVIVHSATGYKQSSAALFRPVASD

SEQ ID NO: 10344 - protein, 25 aa, synthetic construct
  source 1..25: note = Seed: LNVIVHSATGFKQSSKALQRPVASD
LNVIVHSATGYKQSSAALGRPVASD

SEQ ID NO: 10345 - protein, 25 aa, synthetic construct
  source 1..25: note = Seed: LNVIVHSATGFKQSSKALQRPVASD
LNVIVHSATGYKQSSAALHRPVASD

SEQ ID NO: 10346 - protein, 25 aa, synthetic construct
  source 1..25: note = Seed: LNVIVHSATGFKQSSKALQRPVASD
LNVIVHSATGYKQSSAALIRPVASD

SEQ ID NO: 10347 - protein, 25 aa, synthetic construct
  source 1..25: note = Seed: LNVIVHSATGFKQSSKALQRPVASD
LNVIVHSATGYKQSSAALLRPVASD

SEQ ID NO: 10348 - protein, 25 aa, synthetic construct
  source 1..25: note = Seed: LNVIVHSATGFKQSSKALQRPVASD
LNVIVHSATGYKQSSAALMRPVASD

SEQ ID NO: 10349 - protein, 25 aa, synthetic construct
  source 1..25: note = Seed: LNVIVHSATGFKQSSKALQRPVASD
LNVIVHSATGYKQSSAALNRPVASD

SEQ ID NO: 10350 - protein, 25 aa, synthetic construct
  source 1..25: note = Seed: LNVIVHSATGFKQSSKALQRPVASD
LNVIVHSATGYKQSSAALQRPVASD

SEQ ID NO: 10351 - protein, 25 aa, synthetic construct
  source 1..25: note = Seed: LNVIVHSATGFKQSSKALQRPVASD
LNVIVHSATGYKQSSAALSRPVASD

SEQ ID NO: 10352 - protein, 25 aa, synthetic construct
  source 1..25: note = Seed: LNVIVHSATGFKQSSKALQRPVASD
LNVIVHSATGYKQSSAALTRPVASD

SEQ ID NO: 10353 - protein, 25 aa, synthetic construct
  source 1..25: note = Seed: LNVIVHSATGFKQSSKALQRPVASD
LNVIVHSATGYKQSSAALVRPVASD

SEQ ID NO: 10354 - protein, 25 aa, synthetic construct
  source 1..25: note = Seed: LNVIVHSATGFKQSSKALQRPVASD
LNVIVHSATGYKQSSAALYRPVASD

SEQ ID NO: 10355 - protein, 25 aa, synthetic construct
  source 1..25: note = Seed: LNVIVHSATGFKQSSKALQRPVASD
LNVIVHSATGYKQSSFALFRPVASD

SEQ ID NO: 10356 - protein, 25 aa, synthetic construct
  source 1..25: note = Seed: LNVIVHSATGFKQSSKALQRPVASD
LNVIVHSATGYKQSSFALIRPVASD

SEQ ID NO: 10357 - protein, 25 aa, synthetic construct
  source 1..25: note = Seed: LNVIVHSATGFKQSSKALQRPVASD
LNVIVHSATGYKQSSFALLRPVASD

SEQ ID NO: 10358 - protein, 25 aa, synthetic construct
  source 1..25: note = Seed: LNVIVHSATGFKQSSKALQRPVASD
LNVIVHSATGYKQSSFALVRPVASD

SEQ ID NO: 10359 - protein, 25 aa, synthetic construct
  source 1..25: note = Seed: LNVIVHSATGFKQSSKALQRPVASD
LNVIVHSATGYKQSSGALARPVASD

SEQ ID NO: 10360 - protein, 25 aa, synthetic construct
  source 1..25: note = Seed: LNVIVHSATGFKQSSKALQRPVASD
LNVIVHSATGYKQSSGALFRPVASD

SEQ ID NO: 10361 - protein, 25 aa, synthetic construct
  source 1..25: note = Seed: LNVIVHSATGFKQSSKALQRPVASD
LNVIVHSATGYKQSSGALGRPVASD

SEQ ID NO: 10362 - protein, 25 aa, synthetic construct
  source 1..25: note = Seed: LNVIVHSATGFKQSSKALQRPVASD
LNVIVHSATGYKQSSGALIRPVASD

SEQ ID NO: 10363 - protein, 25 aa, synthetic construct
  source 1..25: note = Seed: LNVIVHSATGFKQSSKALQRPVASD
LNVIVHSATGYKQSSGALLRPVASD

SEQ ID NO: 10364 - protein, 25 aa, synthetic construct
  source 1..25: note = Seed: LNVIVHSATGFKQSSKALQRPVASD
LNVIVHSATGYKQSSGALMRPVASD

SEQ ID NO: 10365 - protein, 25 aa, synthetic construct
  source 1..25: note = Seed: LNVIVHSATGFKQSSKALQRPVASD
LNVIVHSATGYKQSSGALNRPVASD

SEQ ID NO: 10366 - protein, 25 aa, synthetic construct
  source 1..25: note = Seed: LNVIVHSATGFKQSSKALQRPVASD
LNVIVHSATGYKQSSGALSRPVASD

SEQ ID NO: 10367 - protein, 25 aa, synthetic construct
  source 1..25: note = Seed: LNVIVHSATGFKQSSKALQRPVASD
LNVIVHSATGYKQSSGALTRPVASD

SEQ ID NO: 10368 - protein, 25 aa, synthetic construct
  source 1..25: note = Seed: LNVIVHSATGFKQSSKALQRPVASD
LNVIVHSATGYKQSSGALVRPVASD

SEQ ID NO: 10369 - protein, 25 aa, synthetic construct
  source 1..25: note = Seed: LNVIVHSATGFKQSSKALQRPVASD
LNVIVHSATGYKQSSIALARPVASD

SEQ ID NO: 10370 - protein, 25 aa, synthetic construct
  source 1..25: note = Seed: LNVIVHSATGFKQSSKALQRPVASD
LNVIVHSATGYKQSSIALIRPVASD

SEQ ID NO: 10371 - protein, 25 aa, synthetic construct
  source 1..25: note = Seed: LNVIVHSATGFKQSSKALQRPVASD
LNVIVHSATGYKQSSIALLRPVASD

SEQ ID NO: 10372 - protein, 25 aa, synthetic construct
  source 1..25: note = Seed: LNVIVHSATGFKQSSKALQRPVASD
LNVIVHSATGYKQSSIALMRPVASD

SEQ ID NO: 10373 - protein, 25 aa, synthetic construct
  source 1..25: note = Seed: LNVIVHSATGFKQSSKALQRPVASD
LNVIVHSATGYKQSSIALNRPVASD

SEQ ID NO: 10374 - protein, 25 aa, synthetic construct
  source 1..25: note = Seed: LNVIVHSATGFKQSSKALQRPVASD
LNVIVHSATGYKQSSIALQRPVASD

SEQ ID NO: 10375 - protein, 25 aa, synthetic construct
  source 1..25: note = Seed: LNVIVHSATGFKQSSKALQRPVASD
LNVIVHSATGYKQSSIALSRPVASD

SEQ ID NO: 10376 - protein, 25 aa, synthetic construct
  source 1..25: note = Seed: LNVIVHSATGFKQSSKALQRPVASD
LNVIVHSATGYKQSSIALTRPVASD

SEQ ID NO: 10377 - protein, 25 aa, synthetic construct
  source 1..25: note = Seed: LNVIVHSATGFKQSSKALQRPVASD
LNVIVHSATGYKQSSIALVRPVASD

SEQ ID NO: 10378 - protein, 25 aa, synthetic construct
  source 1..25: note = Seed: LNVIVHSATGFKQSSKALQRPVASD
LNVIVHSATGYKQSSKALARPVASD

SEQ ID NO: 10379 - protein, 25 aa, synthetic construct
  source 1..25: note = Seed: LNVIVHSATGFKQSSKALQRPVASD
LNVIVHSATGYKQSSKALGRPVASD

SEQ ID NO: 10380 - protein, 25 aa, synthetic construct
  source 1..25: note = Seed: LNVIVHSATGFKQSSKALQRPVASD
LNVIVHSATGYKQSSKALSRPVASD

SEQ ID NO: 10381 - protein, 25 aa, synthetic construct
  source 1..25: note = Seed: LNVIVHSATGFKQSSKALQRPVASD
LNVIVHSATGYKQSSLALARPVASD

SEQ ID NO: 10382 - protein, 25 aa, synthetic construct
  source 1..25: note = Seed: LNVIVHSATGFKQSSKALQRPVASD
LNVIVHSATGYKQSSLALLRPVASD

SEQ ID NO: 10383 - protein, 25 aa, synthetic construct
  source 1..25: note = Seed: LNVIVHSATGFKQSSKALQRPVASD
LNVIVHSATGYKQSSLALMRPVASD

SEQ ID NO: 10384 - protein, 25 aa, synthetic construct
  source 1..25: note = Seed: LNVIVHSATGFKQSSKALQRPVASD
LNVIVHSATGYKQSSLALNRPVASD

SEQ ID NO: 10385 - protein, 25 aa, synthetic construct
  source 1..25: note = Seed: LNVIVHSATGFKQSSKALQRPVASD
LNVIVHSATGYKQSSLALSRPVASD

SEQ ID NO: 10386 - protein, 25 aa, synthetic construct
  source 1..25: note = Seed: LNVIVHSATGFKQSSKALQRPVASD
LNVIVHSATGYKQSSLALVRPVASD

SEQ ID NO: 10387 - protein, 25 aa, synthetic construct
  source 1..25: note = Seed: LNVIVHSATGFKQSSKALQRPVASD
LNVIVHSATGYKQSSMALARPVASD

SEQ ID NO: 10388 - protein, 25 aa, synthetic construct
  source 1..25: note = Seed: LNVIVHSATGFKQSSKALQRPVASD
LNVIVHSATGYKQSSMALIRPVASD

SEQ ID NO: 10389 - protein, 25 aa, synthetic construct
  source 1..25: note = Seed: LNVIVHSATGFKQSSKALQRPVASD
LNVIVHSATGYKQSSMALLRPVASD

SEQ ID NO: 10390 - protein, 25 aa, synthetic construct
  source 1..25: note = Seed: LNVIVHSATGFKQSSKALQRPVASD
LNVIVHSATGYKQSSMALNRPVASD

SEQ ID NO: 10391 - protein, 25 aa, synthetic construct
  source 1..25: note = Seed: LNVIVHSATGFKQSSKALQRPVASD
LNVIVHSATGYKQSSMALSRPVASD

SEQ ID NO: 10392 - protein, 25 aa, synthetic construct
  source 1..25: note = Seed: LNVIVHSATGFKQSSKALQRPVASD
LNVIVHSATGYKQSSMALVRPVASD

SEQ ID NO: 10393 - protein, 25 aa, synthetic construct
  source 1..25: note = Seed: LNVIVHSATGFKQSSKALQRPVASD
LNVIVHSATGYKQSSNALARPVASD

SEQ ID NO: 10394 - protein, 25 aa, synthetic construct
  source 1..25: note = Seed: LNVIVHSATGFKQSSKALQRPVASD
LNVIVHSATGYKQSSNALFRPVASD

SEQ ID NO: 10395 - protein, 25 aa, synthetic construct
  source 1..25: note = Seed: LNVIVHSATGFKQSSKALQRPVASD
LNVIVHSATGYKQSSNALIRPVASD

SEQ ID NO: 10396 - protein, 25 aa, synthetic construct
  source 1..25: note = Seed: LNVIVHSATGFKQSSKALQRPVASD
LNVIVHSATGYKQSSNALLRPVASD

SEQ ID NO: 10397 - protein, 25 aa, synthetic construct
  source 1..25: note = Seed: LNVIVHSATGFKQSSKALQRPVASD
LNVIVHSATGYKQSSNALVRPVASD

SEQ ID NO: 10398 - protein, 25 aa, synthetic construct
  source 1..25: note = Seed: LNVIVHSATGFKQSSKALQRPVASD
LNVIVHSATGYKQSSPALARPVASD

SEQ ID NO: 10399 - protein, 25 aa, synthetic construct
  source 1..25: note = Seed: LNVIVHSATGFKQSSKALQRPVASD
LNVIVHSATGYKQSSPALFRPVASD

SEQ ID NO: 10400 - protein, 25 aa, synthetic construct
  source 1..25: note = Seed: LNVIVHSATGFKQSSKALQRPVASD
LNVIVHSATGYKQSSPALIRPVASD

SEQ ID NO: 10401 - protein, 25 aa, synthetic construct
  source 1..25: note = Seed: LNVIVHSATGFKQSSKALQRPVASD
LNVIVHSATGYKQSSPALLRPVASD

SEQ ID NO: 10402 - protein, 25 aa, synthetic construct
  source 1..25: note = Seed: LNVIVHSATGFKQSSKALQRPVASD
LNVIVHSATGYKQSSPALMRPVASD

SEQ ID NO: 10403 - protein, 25 aa, synthetic construct
  source 1..25: note = Seed: LNVIVHSATGFKQSSKALQRPVASD
LNVIVHSATGYKQSSPALNRPVASD

SEQ ID NO: 10404 - protein, 25 aa, synthetic construct
  source 1..25: note = Seed: LNVIVHSATGFKQSSKALQRPVASD
LNVIVHSATGYKQSSPALQRPVASD

SEQ ID NO: 10405 - protein, 25 aa, synthetic construct
  source 1..25: note = Seed: LNVIVHSATGFKQSSKALQRPVASD
LNVIVHSATGYKQSSPALSRPVASD

SEQ ID NO: 10406 - protein, 25 aa, synthetic construct
  source 1..25: note = Seed: LNVIVHSATGFKQSSKALQRPVASD
LNVIVHSATGYKQSSPALTRPVASD

SEQ ID NO: 10407 - protein, 25 aa, synthetic construct
  source 1..25: note = Seed: LNVIVHSATGFKQSSKALQRPVASD
LNVIVHSATGYKQSSPALVRPVASD

SEQ ID NO: 10408 - protein, 25 aa, synthetic construct
  source 1..25: note = Seed: LNVIVHSATGFKQSSKALQRPVASD
LNVIVHSATGYKQSSQALIRPVASD

SEQ ID NO: 10409 - protein, 25 aa, synthetic construct
  source 1..25: note = Seed: LNVIVHSATGFKQSSKALQRPVASD
LNVIVHSATGYKQSSRALARPVASD

SEQ ID NO: 10410 - protein, 25 aa, synthetic construct
  source 1..25: note = Seed: LNVIVHSATGFKQSSKALQRPVASD
LNVIVHSATGYKQSSRALGRPVASD

SEQ ID NO: 10411 - protein, 25 aa, synthetic construct
  source 1..25: note = Seed: LNVIVHSATGFKQSSKALQRPVASD
LNVIVHSATGYKQSSRALQRPVASD

SEQ ID NO: 10412 - protein, 25 aa, synthetic construct
  source 1..25: note = Seed: LNVIVHSATGFKQSSKALQRPVASD
LNVIVHSATGYKQSSRALSRPVASD

SEQ ID NO: 10413 - protein, 25 aa, synthetic construct
  source 1..25: note = Seed: LNVIVHSATGFKQSSKALQRPVASD
LNVIVHSATGYKQSSRALTRPVASD

SEQ ID NO: 10414 - protein, 25 aa, synthetic construct
  source 1..25: note = Seed: LNVIVHSATGFKQSSKALQRPVASD
LNVIVHSATGYKQSSSALARPVASD

SEQ ID NO: 10415 - protein, 25 aa, synthetic construct
  source 1..25: note = Seed: LNVIVHSATGFKQSSKALQRPVASD
LNVIVHSATGYKQSSSALFRPVASD

SEQ ID NO: 10416 - protein, 25 aa, synthetic construct
  source 1..25: note = Seed: LNVIVHSATGFKQSSKALQRPVASD
LNVIVHSATGYKQSSSALGRPVASD

SEQ ID NO: 10417 - protein, 25 aa, synthetic construct
  source 1..25: note = Seed: LNVIVHSATGFKQSSKALQRPVASD
LNVIVHSATGYKQSSSALIRPVASD

SEQ ID NO: 10418 - protein, 25 aa, synthetic construct
  source 1..25: note = Seed: LNVIVHSATGFKQSSKALQRPVASD
LNVIVHSATGYKQSSSALLRPVASD

SEQ ID NO: 10419 - protein, 25 aa, synthetic construct
  source 1..25: note = Seed: LNVIVHSATGFKQSSKALQRPVASD
LNVIVHSATGYKQSSSALMRPVASD

SEQ ID NO: 10420 - protein, 25 aa, synthetic construct
  source 1..25: note = Seed: LNVIVHSATGFKQSSKALQRPVASD
LNVIVHSATGYKQSSSALNRPVASD

SEQ ID NO: 10421 - protein, 25 aa, synthetic construct
  source 1..25: note = Seed: LNVIVHSATGFKQSSKALQRPVASD
LNVIVHSATGYKQSSSALSRPVASD

SEQ ID NO: 10422 - protein, 25 aa, synthetic construct
  source 1..25: note = Seed: LNVIVHSATGFKQSSKALQRPVASD
LNVIVHSATGYKQSSSALTRPVASD

SEQ ID NO: 10423 - protein, 25 aa, synthetic construct
  source 1..25: note = Seed: LNVIVHSATGFKQSSKALQRPVASD
LNVIVHSATGYKQSSSALVRPVASD

SEQ ID NO: 10424 - protein, 25 aa, synthetic construct
  source 1..25: note = Seed: LNVIVHSATGFKQSSKALQRPVASD
LNVIVHSATGYKQSSSALYRPVASD

SEQ ID NO: 10425 - protein, 25 aa, synthetic construct
  source 1..25: note = Seed: LNVIVHSATGFKQSSKALQRPVASD
LNVIVHSATGYKQSSTALARPVASD

SEQ ID NO: 10426 - protein, 25 aa, synthetic construct
  source 1..25: note = Seed: LNVIVHSATGFKQSSKALQRPVASD
LNVIVHSATGYKQSSTALFRPVASD

SEQ ID NO: 10427 - protein, 25 aa, synthetic construct
  source 1..25: note = Seed: LNVIVHSATGFKQSSKALQRPVASD
LNVIVHSATGYKQSSTALIRPVASD

SEQ ID NO: 10428 - protein, 25 aa, synthetic construct
  source 1..25: note = Seed: LNVIVHSATGFKQSSKALQRPVASD
LNVIVHSATGYKQSSTALLRPVASD

SEQ ID NO: 10429 - protein, 25 aa, synthetic construct
  source 1..25: note = Seed: LNVIVHSATGFKQSSKALQRPVASD
LNVIVHSATGYKQSSTALMRPVASD

SEQ ID NO: 10430 - protein, 25 aa, synthetic construct
  source 1..25: note = Seed: LNVIVHSATGFKQSSKALQRPVASD
LNVIVHSATGYKQSSTALNRPVASD

SEQ ID NO: 10431 - protein, 25 aa, synthetic construct
  source 1..25: note = Seed: LNVIVHSATGFKQSSKALQRPVASD
LNVIVHSATGYKQSSTALSRPVASD

SEQ ID NO: 10432 - protein, 25 aa, synthetic construct
  source 1..25: note = Seed: LNVIVHSATGFKQSSKALQRPVASD
LNVIVHSATGYKQSSTALTRPVASD

SEQ ID NO: 10433 - protein, 25 aa, synthetic construct
  source 1..25: note = Seed: LNVIVHSATGFKQSSKALQRPVASD
LNVIVHSATGYKQSSTALVRPVASD

SEQ ID NO: 10434 - protein, 25 aa, synthetic construct
  source 1..25: note = Seed: LNVIVHSATGFKQSSKALQRPVASD
LNVIVHSATGYKQSSVALARPVASD

SEQ ID NO: 10435 - protein, 25 aa, synthetic construct
  source 1..25: note = Seed: LNVIVHSATGFKQSSKALQRPVASD
LNVIVHSATGYKQSSVALFRPVASD

SEQ ID NO: 10436 - protein, 25 aa, synthetic construct
  source 1..25: note = Seed: LNVIVHSATGFKQSSKALQRPVASD
LNVIVHSATGYKQSSVALGRPVASD

SEQ ID NO: 10437 - protein, 25 aa, synthetic construct
  source 1..25: note = Seed: LNVIVHSATGFKQSSKALQRPVASD
LNVIVHSATGYKQSSVALHRPVASD

SEQ ID NO: 10438 - protein, 25 aa, synthetic construct
  source 1..25: note = Seed: LNVIVHSATGFKQSSKALQRPVASD
LNVIVHSATGYKQSSVALIRPVASD

SEQ ID NO: 10439 - protein, 25 aa, synthetic construct
  source 1..25: note = Seed: LNVIVHSATGFKQSSKALQRPVASD
LNVIVHSATGYKQSSVALLRPVASD

SEQ ID NO: 10440 - protein, 25 aa, synthetic construct
  source 1..25: note = Seed: LNVIVHSATGFKQSSKALQRPVASD
LNVIVHSATGYKQSSVALMRPVASD

SEQ ID NO: 10441 - protein, 25 aa, synthetic construct
  source 1..25: note = Seed: LNVIVHSATGFKQSSKALQRPVASD
LNVIVHSATGYKQSSVALNRPVASD

SEQ ID NO: 10442 - protein, 25 aa, synthetic construct
  source 1..25: note = Seed: LNVIVHSATGFKQSSKALQRPVASD
LNVIVHSATGYKQSSVALQRPVASD

SEQ ID NO: 10443 - protein, 25 aa, synthetic construct
  source 1..25: note = Seed: LNVIVHSATGFKQSSKALQRPVASD
LNVIVHSATGYKQSSVALSRPVASD

SEQ ID NO: 10444 - protein, 25 aa, synthetic construct
  source 1..25: note = Seed: LNVIVHSATGFKQSSKALQRPVASD
LNVIVHSATGYKQSSVALTRPVASD

SEQ ID NO: 10445 - protein, 25 aa, synthetic construct
  source 1..25: note = Seed: LNVIVHSATGFKQSSKALQRPVASD
LNVIVHSATGYKQSSVALVRPVASD

SEQ ID NO: 10446 - protein, 25 aa, synthetic construct
  source 1..25: note = Seed: LNVIVHSATGFKQSSKALQRPVASD
LNVIVHSATGYKQTSAALARPVASD

SEQ ID NO: 10447 - protein, 25 aa, synthetic construct
  source 1..25: note = Seed: LNVIVHSATGFKQSSKALQRPVASD
LNVIVHSATGYKQTSAALFRPVASD

SEQ ID NO: 10448 - protein, 25 aa, synthetic construct
  source 1..25: note = Seed: LNVIVHSATGFKQSSKALQRPVASD
LNVIVHSATGYKQTSAALGRPVASD

SEQ ID NO: 10449 - protein, 25 aa, synthetic construct
  source 1..25: note = Seed: LNVIVHSATGFKQSSKALQRPVASD
LNVIVHSATGYKQTSAALHRPVASD

SEQ ID NO: 10450 - protein, 25 aa, synthetic construct
  source 1..25: note = Seed: LNVIVHSATGFKQSSKALQRPVASD
LNVIVHSATGYKQTSAALIRPVASD

SEQ ID NO: 10451 - protein, 25 aa, synthetic construct
  source 1..25: note = Seed: LNVIVHSATGFKQSSKALQRPVASD
LNVIVHSATGYKQTSAALLRPVASD

SEQ ID NO: 10452 - protein, 25 aa, synthetic construct
  source 1..25: note = Seed: LNVIVHSATGFKQSSKALQRPVASD
LNVIVHSATGYKQTSAALMRPVASD

SEQ ID NO: 10453 - protein, 25 aa, synthetic construct
  source 1..25: note = Seed: LNVIVHSATGFKQSSKALQRPVASD
LNVIVHSATGYKQTSAALNRPVASD

SEQ ID NO: 10454 - protein, 25 aa, synthetic construct
  source 1..25: note = Seed: LNVIVHSATGFKQSSKALQRPVASD
LNVIVHSATGYKQTSAALQRPVASD

SEQ ID NO: 10455 - protein, 25 aa, synthetic construct
  source 1..25: note = Seed: LNVIVHSATGFKQSSKALQRPVASD
LNVIVHSATGYKQTSAALSRPVASD

SEQ ID NO: 10456 - protein, 25 aa, synthetic construct
  source 1..25: note = Seed: LNVIVHSATGFKQSSKALQRPVASD
LNVIVHSATGYKQTSAALTRPVASD

SEQ ID NO: 10457 - protein, 25 aa, synthetic construct
  source 1..25: note = Seed: LNVIVHSATGFKQSSKALQRPVASD
LNVIVHSATGYKQTSAALVRPVASD

SEQ ID NO: 10458 - protein, 25 aa, synthetic construct
  source 1..25: note = Seed: LNVIVHSATGFKQSSKALQRPVASD
LNVIVHSATGYKQTSAALYRPVASD

SEQ ID NO: 10459 - protein, 25 aa, synthetic construct
  source 1..25: note = Seed: LNVIVHSATGFKQSSKALQRPVASD
LNVIVHSATGYKQTSFALFRPVASD

SEQ ID NO: 10460 - protein, 25 aa, synthetic construct
  source 1..25: note = Seed: LNVIVHSATGFKQSSKALQRPVASD
LNVIVHSATGYKQTSFALIRPVASD

SEQ ID NO: 10461 - protein, 25 aa, synthetic construct
  source 1..25: note = Seed: LNVIVHSATGFKQSSKALQRPVASD
LNVIVHSATGYKQTSFALLRPVASD

SEQ ID NO: 10462 - protein, 25 aa, synthetic construct
  source 1..25: note = Seed: LNVIVHSATGFKQSSKALQRPVASD
LNVIVHSATGYKQTSFALMRPVASD

SEQ ID NO: 10463 - protein, 25 aa, synthetic construct
  source 1..25: note = Seed: LNVIVHSATGFKQSSKALQRPVASD
LNVIVHSATGYKQTSFALVRPVASD

SEQ ID NO: 10464 - protein, 25 aa, synthetic construct
  source 1..25: note = Seed: LNVIVHSATGFKQSSKALQRPVASD
LNVIVHSATGYKQTSGALARPVASD

SEQ ID NO: 10465 - protein, 25 aa, synthetic construct
  source 1..25: note = Seed: LNVIVHSATGFKQSSKALQRPVASD
LNVIVHSATGYKQTSGALFRPVASD

SEQ ID NO: 10466 - protein, 25 aa, synthetic construct
  source 1..25: note = Seed: LNVIVHSATGFKQSSKALQRPVASD
LNVIVHSATGYKQTSGALIRPVASD

SEQ ID NO: 10467 - protein, 25 aa, synthetic construct
  source 1..25: note = Seed: LNVIVHSATGFKQSSKALQRPVASD
LNVIVHSATGYKQTSGALLRPVASD

SEQ ID NO: 10468 - protein, 25 aa, synthetic construct
  source 1..25: note = Seed: LNVIVHSATGFKQSSKALQRPVASD
LNVIVHSATGYKQTSGALMRPVASD

SEQ ID NO: 10469 - protein, 25 aa, synthetic construct
  source 1..25: note = Seed: LNVIVHSATGFKQSSKALQRPVASD
LNVIVHSATGYKQTSGALSRPVASD

SEQ ID NO: 10470 - protein, 25 aa, synthetic construct
  source 1..25: note = Seed: LNVIVHSATGFKQSSKALQRPVASD
LNVIVHSATGYKQTSGALTRPVASD

SEQ ID NO: 10471 - protein, 25 aa, synthetic construct
  source 1..25: note = Seed: LNVIVHSATGFKQSSKALQRPVASD
LNVIVHSATGYKQTSGALVRPVASD

SEQ ID NO: 10472 - protein, 25 aa, synthetic construct
  source 1..25: note = Seed: LNVIVHSATGFKQSSKALQRPVASD
LNVIVHSATGYKQTSIALARPVASD

SEQ ID NO: 10473 - protein, 25 aa, synthetic construct
  source 1..25: note = Seed: LNVIVHSATGFKQSSKALQRPVASD
LNVIVHSATGYKQTSIALIRPVASD

SEQ ID NO: 10474 - protein, 25 aa, synthetic construct
  source 1..25: note = Seed: LNVIVHSATGFKQSSKALQRPVASD
LNVIVHSATGYKQTSIALLRPVASD

SEQ ID NO: 10475 - protein, 25 aa, synthetic construct
  source 1..25: note = Seed: LNVIVHSATGFKQSSKALQRPVASD
LNVIVHSATGYKQTSIALMRPVASD

SEQ ID NO: 10476 - protein, 25 aa, synthetic construct
  source 1..25: note = Seed: LNVIVHSATGFKQSSKALQRPVASD
LNVIVHSATGYKQTSIALNRPVASD

SEQ ID NO: 10477 - protein, 25 aa, synthetic construct
  source 1..25: note = Seed: LNVIVHSATGFKQSSKALQRPVASD
LNVIVHSATGYKQTSIALQRPVASD

SEQ ID NO: 10478 - protein, 25 aa, synthetic construct
  source 1..25: note = Seed: LNVIVHSATGFKQSSKALQRPVASD
LNVIVHSATGYKQTSIALSRPVASD

SEQ ID NO: 10479 - protein, 25 aa, synthetic construct
  source 1..25: note = Seed: LNVIVHSATGFKQSSKALQRPVASD
LNVIVHSATGYKQTSIALTRPVASD

SEQ ID NO: 10480 - protein, 25 aa, synthetic construct
  source 1..25: note = Seed: LNVIVHSATGFKQSSKALQRPVASD
LNVIVHSATGYKQTSIALVRPVASD

SEQ ID NO: 10481 - protein, 25 aa, synthetic construct
  source 1..25: note = Seed: LNVIVHSATGFKQSSKALQRPVASD
LNVIVHSATGYKQTSKALARPVASD

SEQ ID NO: 10482 - protein, 25 aa, synthetic construct
  source 1..25: note = Seed: LNVIVHSATGFKQSSKALQRPVASD
LNVIVHSATGYKQTSKALSRPVASD

SEQ ID NO: 10483 - protein, 25 aa, synthetic construct
  source 1..25: note = Seed: LNVIVHSATGFKQSSKALQRPVASD
LNVIVHSATGYKQTSLALARPVASD

SEQ ID NO: 10484 - protein, 25 aa, synthetic construct
  source 1..25: note = Seed: LNVIVHSATGFKQSSKALQRPVASD
LNVIVHSATGYKQTSLALIRPVASD

SEQ ID NO: 10485 - protein, 25 aa, synthetic construct
  source 1..25: note = Seed: LNVIVHSATGFKQSSKALQRPVASD
LNVIVHSATGYKQTSLALLRPVASD

SEQ ID NO: 10486 - protein, 25 aa, synthetic construct
  source 1..25: note = Seed: LNVIVHSATGFKQSSKALQRPVASD
LNVIVHSATGYKQTSLALMRPVASD

SEQ ID NO: 10487 - protein, 25 aa, synthetic construct
  source 1..25: note = Seed: LNVIVHSATGFKQSSKALQRPVASD
LNVIVHSATGYKQTSLALNRPVASD

SEQ ID NO: 10488 - protein, 25 aa, synthetic construct
  source 1..25: note = Seed: LNVIVHSATGFKQSSKALQRPVASD
LNVIVHSATGYKQTSLALSRPVASD

SEQ ID NO: 10489 - protein, 25 aa, synthetic construct
  source 1..25: note = Seed: LNVIVHSATGFKQSSKALQRPVASD
LNVIVHSATGYKQTSLALVRPVASD

SEQ ID NO: 10490 - protein, 25 aa, synthetic construct
  source 1..25: note = Seed: LNVIVHSATGFKQSSKALQRPVASD
LNVIVHSATGYKQTSMALARPVASD

SEQ ID NO: 10491 - protein, 25 aa, synthetic construct
  source 1..25: note = Seed: LNVIVHSATGFKQSSKALQRPVASD
LNVIVHSATGYKQTSMALIRPVASD

SEQ ID NO: 10492 - protein, 25 aa, synthetic construct
  source 1..25: note = Seed: LNVIVHSATGFKQSSKALQRPVASD
LNVIVHSATGYKQTSMALSRPVASD

SEQ ID NO: 10493 - protein, 25 aa, synthetic construct
  source 1..25: note = Seed: LNVIVHSATGFKQSSKALQRPVASD
LNVIVHSATGYKQTSMALVRPVASD

SEQ ID NO: 10494 - protein, 25 aa, synthetic construct
  source 1..25: note = Seed: LNVIVHSATGFKQSSKALQRPVASD
LNVIVHSATGYKQTSNALARPVASD

SEQ ID NO: 10495 - protein, 25 aa, synthetic construct
  source 1..25: note = Seed: LNVIVHSATGFKQSSKALQRPVASD
LNVIVHSATGYKQTSNALFRPVASD

SEQ ID NO: 10496 - protein, 25 aa, synthetic construct
  source 1..25: note = Seed: LNVIVHSATGFKQSSKALQRPVASD
LNVIVHSATGYKQTSNALIRPVASD

SEQ ID NO: 10497 - protein, 25 aa, synthetic construct
  source 1..25: note = Seed: LNVIVHSATGFKQSSKALQRPVASD
LNVIVHSATGYKQTSNALLRPVASD

SEQ ID NO: 10498 - protein, 25 aa, synthetic construct
  source 1..25: note = Seed: LNVIVHSATGFKQSSKALQRPVASD
LNVIVHSATGYKQTSNALVRPVASD

SEQ ID NO: 10499 - protein, 25 aa, synthetic construct
  source 1..25: note = Seed: LNVIVHSATGFKQSSKALQRPVASD
LNVIVHSATGYKQTSPALARPVASD

SEQ ID NO: 10500 - protein, 25 aa, synthetic construct
  source 1..25: note = Seed: LNVIVHSATGFKQSSKALQRPVASD
LNVIVHSATGYKQTSPALFRPVASD

SEQ ID NO: 10501 - protein, 25 aa, synthetic construct
  source 1..25: note = Seed: LNVIVHSATGFKQSSKALQRPVASD
LNVIVHSATGYKQTSPALIRPVASD

SEQ ID NO: 10502 - protein, 25 aa, synthetic construct
  source 1..25: note = Seed: LNVIVHSATGFKQSSKALQRPVASD
LNVIVHSATGYKQTSPALLRPVASD

SEQ ID NO: 10503 - protein, 25 aa, synthetic construct
  source 1..25: note = Seed: LNVIVHSATGFKQSSKALQRPVASD
LNVIVHSATGYKQTSPALMRPVASD

SEQ ID NO: 10504 - protein, 25 aa, synthetic construct
  source 1..25: note = Seed: LNVIVHSATGFKQSSKALQRPVASD
LNVIVHSATGYKQTSPALNRPVASD

SEQ ID NO: 10505 - protein, 25 aa, synthetic construct
  source 1..25: note = Seed: LNVIVHSATGFKQSSKALQRPVASD
LNVIVHSATGYKQTSPALSRPVASD

SEQ ID NO: 10506 - protein, 25 aa, synthetic construct
  source 1..25: note = Seed: LNVIVHSATGFKQSSKALQRPVASD
LNVIVHSATGYKQTSPALTRPVASD

SEQ ID NO: 10507 - protein, 25 aa, synthetic construct
  source 1..25: note = Seed: LNVIVHSATGFKQSSKALQRPVASD
LNVIVHSATGYKQTSPALVRPVASD

SEQ ID NO: 10508 - protein, 25 aa, synthetic construct
  source 1..25: note = Seed: LNVIVHSATGFKQSSKALQRPVASD
LNVIVHSATGYKQTSQALIRPVASD

SEQ ID NO: 10509 - protein, 25 aa, synthetic construct
  source 1..25: note = Seed: LNVIVHSATGFKQSSKALQRPVASD
LNVIVHSATGYKQTSRALARPVASD

SEQ ID NO: 10510 - protein, 25 aa, synthetic construct
  source 1..25: note = Seed: LNVIVHSATGFKQSSKALQRPVASD
LNVIVHSATGYKQTSRALGRPVASD

SEQ ID NO: 10511 - protein, 25 aa, synthetic construct
  source 1..25: note = Seed: LNVIVHSATGFKQSSKALQRPVASD
LNVIVHSATGYKQTSRALHRPVASD

SEQ ID NO: 10512 - protein, 25 aa, synthetic construct
  source 1..25: note = Seed: LNVIVHSATGFKQSSKALQRPVASD
LNVIVHSATGYKQTSRALSRPVASD

SEQ ID NO: 10513 - protein, 25 aa, synthetic construct
  source 1..25: note = Seed: LNVIVHSATGFKQSSKALQRPVASD
LNVIVHSATGYKQTSRALTRPVASD

SEQ ID NO: 10514 - protein, 25 aa, synthetic construct
  source 1..25: note = Seed: LNVIVHSATGFKQSSKALQRPVASD
LNVIVHSATGYKQTSSALARPVASD

SEQ ID NO: 10515 - protein, 25 aa, synthetic construct
  source 1..25: note = Seed: LNVIVHSATGFKQSSKALQRPVASD
LNVIVHSATGYKQTSSALFRPVASD

SEQ ID NO: 10516 - protein, 25 aa, synthetic construct
  source 1..25: note = Seed: LNVIVHSATGFKQSSKALQRPVASD
LNVIVHSATGYKQTSSALIRPVASD

SEQ ID NO: 10517 - protein, 25 aa, synthetic construct
  source 1..25: note = Seed: LNVIVHSATGFKQSSKALQRPVASD
LNVIVHSATGYKQTSSALLRPVASD

SEQ ID NO: 10518 - protein, 25 aa, synthetic construct
  source 1..25: note = Seed: LNVIVHSATGFKQSSKALQRPVASD
LNVIVHSATGYKQTSSALMRPVASD

SEQ ID NO: 10519 - protein, 25 aa, synthetic construct
  source 1..25: note = Seed: LNVIVHSATGFKQSSKALQRPVASD
LNVIVHSATGYKQTSSALNRPVASD

SEQ ID NO: 10520 - protein, 25 aa, synthetic construct
  source 1..25: note = Seed: LNVIVHSATGFKQSSKALQRPVASD
LNVIVHSATGYKQTSSALSRPVASD

SEQ ID NO: 10521 - protein, 25 aa, synthetic construct
  source 1..25: note = Seed: LNVIVHSATGFKQSSKALQRPVASD
LNVIVHSATGYKQTSSALTRPVASD

SEQ ID NO: 10522 - protein, 25 aa, synthetic construct
  source 1..25: note = Seed: LNVIVHSATGFKQSSKALQRPVASD
LNVIVHSATGYKQTSSALVRPVASD

SEQ ID NO: 10523 - protein, 25 aa, synthetic construct
  source 1..25: note = Seed: LNVIVHSATGFKQSSKALQRPVASD
LNVIVHSATGYKQTSSALYRPVASD

SEQ ID NO: 10524 - protein, 25 aa, synthetic construct
  source 1..25: note = Seed: LNVIVHSATGFKQSSKALQRPVASD
LNVIVHSATGYKQTSTALARPVASD

SEQ ID NO: 10525 - protein, 25 aa, synthetic construct
  source 1..25: note = Seed: LNVIVHSATGFKQSSKALQRPVASD
LNVIVHSATGYKQTSTALFRPVASD

SEQ ID NO: 10526 - protein, 25 aa, synthetic construct
  source 1..25: note = Seed: LNVIVHSATGFKQSSKALQRPVASD
LNVIVHSATGYKQTSTALIRPVASD

SEQ ID NO: 10527 - protein, 25 aa, synthetic construct
  source 1..25: note = Seed: LNVIVHSATGFKQSSKALQRPVASD
LNVIVHSATGYKQTSTALLRPVASD

SEQ ID NO: 10528 - protein, 25 aa, synthetic construct
  source 1..25: note = Seed: LNVIVHSATGFKQSSKALQRPVASD
LNVIVHSATGYKQTSTALMRPVASD

SEQ ID NO: 10529 - protein, 25 aa, synthetic construct
  source 1..25: note = Seed: LNVIVHSATGFKQSSKALQRPVASD
LNVIVHSATGYKQTSTALNRPVASD

SEQ ID NO: 10530 - protein, 25 aa, synthetic construct
  source 1..25: note = Seed: LNVIVHSATGFKQSSKALQRPVASD
LNVIVHSATGYKQTSTALSRPVASD

SEQ ID NO: 10531 - protein, 25 aa, synthetic construct
  source 1..25: note = Seed: LNVIVHSATGFKQSSKALQRPVASD
LNVIVHSATGYKQTSTALTRPVASD

SEQ ID NO: 10532 - protein, 25 aa, synthetic construct
  source 1..25: note = Seed: LNVIVHSATGFKQSSKALQRPVASD
LNVIVHSATGYKQTSTALVRPVASD

SEQ ID NO: 10533 - protein, 25 aa, synthetic construct
  source 1..25: note = Seed: LNVIVHSATGFKQSSKALQRPVASD
LNVIVHSATGYKQTSVALARPVASD

SEQ ID NO: 10534 - protein, 25 aa, synthetic construct
  source 1..25: note = Seed: LNVIVHSATGFKQSSKALQRPVASD
LNVIVHSATGYKQTSVALFRPVASD

SEQ ID NO: 10535 - protein, 25 aa, synthetic construct
  source 1..25: note = Seed: LNVIVHSATGFKQSSKALQRPVASD
LNVIVHSATGYKQTSVALIRPVASD

SEQ ID NO: 10536 - protein, 25 aa, synthetic construct
  source 1..25: note = Seed: LNVIVHSATGFKQSSKALQRPVASD
LNVIVHSATGYKQTSVALLRPVASD

SEQ ID NO: 10537 - protein, 25 aa, synthetic construct
  source 1..25: note = Seed: LNVIVHSATGFKQSSKALQRPVASD
LNVIVHSATGYKQTSVALMRPVASD

SEQ ID NO: 10538 - protein, 25 aa, synthetic construct
  source 1..25: note = Seed: LNVIVHSATGFKQSSKALQRPVASD
LNVIVHSATGYKQTSVALNRPVASD

SEQ ID NO: 10539 - protein, 25 aa, synthetic construct
  source 1..25: note = Seed: LNVIVHSATGFKQSSKALQRPVASD
LNVIVHSATGYKQTSVALSRPVASD

SEQ ID NO: 10540 - protein, 25 aa, synthetic construct
  source 1..25: note = Seed: LNVIVHSATGFKQSSKALQRPVASD
LNVIVHSATGYKQTSVALTRPVASD

SEQ ID NO: 10541 - protein, 25 aa, synthetic construct
  source 1..25: note = Seed: LNVIVHSATGFKQSSKALQRPVASD
LNVIVHSATGYKQTSVALVRPVASD

SEQ ID NO: 10542 - protein, 25 aa, synthetic construct
  source 1..25: note = Seed: LNVIVHSATGFKQSSKALQRPVASD
LNVIVHSATGYKQVSAALARPVASD

SEQ ID NO: 10543 - protein, 25 aa, synthetic construct
  source 1..25: note = Seed: LNVIVHSATGFKQSSKALQRPVASD
LNVIVHSATGYKQVSAALCRPVASD

SEQ ID NO: 10544 - protein, 25 aa, synthetic construct
  source 1..25: note = Seed: LNVIVHSATGFKQSSKALQRPVASD
LNVIVHSATGYKQVSAALDRPVASD

SEQ ID NO: 10545 - protein, 25 aa, synthetic construct
  source 1..25: note = Seed: LNVIVHSATGFKQSSKALQRPVASD
LNVIVHSATGYKQVSAALERPVASD

SEQ ID NO: 10546 - protein, 25 aa, synthetic construct
  source 1..25: note = Seed: LNVIVHSATGFKQSSKALQRPVASD
LNVIVHSATGYKQVSAALFRPVASD

SEQ ID NO: 10547 - protein, 25 aa, synthetic construct
  source 1..25: note = Seed: LNVIVHSATGFKQSSKALQRPVASD
LNVIVHSATGYKQVSAALGRPVASD

SEQ ID NO: 10548 - protein, 25 aa, synthetic construct
  source 1..25: note = Seed: LNVIVHSATGFKQSSKALQRPVASD
LNVIVHSATGYKQVSAALHRPVASD

SEQ ID NO: 10549 - protein, 25 aa, synthetic construct
  source 1..25: note = Seed: LNVIVHSATGFKQSSKALQRPVASD
LNVIVHSATGYKQVSAALIRPVASD

SEQ ID NO: 10550 - protein, 25 aa, synthetic construct
  source 1..25: note = Seed: LNVIVHSATGFKQSSKALQRPVASD
LNVIVHSATGYKQVSAALLRPVASD

SEQ ID NO: 10551 - protein, 25 aa, synthetic construct
  source 1..25: note = Seed: LNVIVHSATGFKQSSKALQRPVASD
LNVIVHSATGYKQVSAALMRPVASD

SEQ ID NO: 10552 - protein, 25 aa, synthetic construct
  source 1..25: note = Seed: LNVIVHSATGFKQSSKALQRPVASD
LNVIVHSATGYKQVSAALNRPVASD

SEQ ID NO: 10553 - protein, 25 aa, synthetic construct
  source 1..25: note = Seed: LNVIVHSATGFKQSSKALQRPVASD
LNVIVHSATGYKQVSAALPRPVASD

SEQ ID NO: 10554 - protein, 25 aa, synthetic construct
  source 1..25: note = Seed: LNVIVHSATGFKQSSKALQRPVASD
LNVIVHSATGYKQVSAALQRPVASD

SEQ ID NO: 10555 - protein, 25 aa, synthetic construct
  source 1..25: note = Seed: LNVIVHSATGFKQSSKALQRPVASD
LNVIVHSATGYKQVSAALSRPVASD

SEQ ID NO: 10556 - protein, 25 aa, synthetic construct
  source 1..25: note = Seed: LNVIVHSATGFKQSSKALQRPVASD
LNVIVHSATGYKQVSAALTRPVASD

SEQ ID NO: 10557 - protein, 25 aa, synthetic construct
  source 1..25: note = Seed: LNVIVHSATGFKQSSKALQRPVASD
LNVIVHSATGYKQVSAALVRPVASD

SEQ ID NO: 10558 - protein, 25 aa, synthetic construct
  source 1..25: note = Seed: LNVIVHSATGFKQSSKALQRPVASD
LNVIVHSATGYKQVSAALYRPVASD

SEQ ID NO: 10559 - protein, 25 aa, synthetic construct
  source 1..25: note = Seed: LNVIVHSATGFKQSSKALQRPVASD
LNVIVHSATGYKQVSCALARPVASD

SEQ ID NO: 10560 - protein, 25 aa, synthetic construct
  source 1..25: note = Seed: LNVIVHSATGFKQSSKALQRPVASD
LNVIVHSATGYKQVSFALGRPVASD

SEQ ID NO: 10561 - protein, 25 aa, synthetic construct
  source 1..25: note = Seed: LNVIVHSATGFKQSSKALQRPVASD
LNVIVHSATGYKQVSFALIRPVASD

SEQ ID NO: 10562 - protein, 25 aa, synthetic construct
  source 1..25: note = Seed: LNVIVHSATGFKQSSKALQRPVASD
LNVIVHSATGYKQVSFALLRPVASD

SEQ ID NO: 10563 - protein, 25 aa, synthetic construct
  source 1..25: note = Seed: LNVIVHSATGFKQSSKALQRPVASD
LNVIVHSATGYKQVSFALMRPVASD

SEQ ID NO: 10564 - protein, 25 aa, synthetic construct
  source 1..25: note = Seed: LNVIVHSATGFKQSSKALQRPVASD
LNVIVHSATGYKQVSFALVRPVASD

SEQ ID NO: 10565 - protein, 25 aa, synthetic construct
  source 1..25: note = Seed: LNVIVHSATGFKQSSKALQRPVASD
LNVIVHSATGYKQVSGALARPVASD

SEQ ID NO: 10566 - protein, 25 aa, synthetic construct
  source 1..25: note = Seed: LNVIVHSATGFKQSSKALQRPVASD
LNVIVHSATGYKQVSGALCRPVASD

SEQ ID NO: 10567 - protein, 25 aa, synthetic construct
  source 1..25: note = Seed: LNVIVHSATGFKQSSKALQRPVASD
LNVIVHSATGYKQVSGALFRPVASD

SEQ ID NO: 10568 - protein, 25 aa, synthetic construct
  source 1..25: note = Seed: LNVIVHSATGFKQSSKALQRPVASD
LNVIVHSATGYKQVSGALGRPVASD

SEQ ID NO: 10569 - protein, 25 aa, synthetic construct
  source 1..25: note = Seed: LNVIVHSATGFKQSSKALQRPVASD
LNVIVHSATGYKQVSGALIRPVASD

SEQ ID NO: 10570 - protein, 25 aa, synthetic construct
  source 1..25: note = Seed: LNVIVHSATGFKQSSKALQRPVASD
LNVIVHSATGYKQVSGALLRPVASD

SEQ ID NO: 10571 - protein, 25 aa, synthetic construct
  source 1..25: note = Seed: LNVIVHSATGFKQSSKALQRPVASD
LNVIVHSATGYKQVSGALMRPVASD

SEQ ID NO: 10572 - protein, 25 aa, synthetic construct
  source 1..25: note = Seed: LNVIVHSATGFKQSSKALQRPVASD
LNVIVHSATGYKQVSGALNRPVASD

SEQ ID NO: 10573 - protein, 25 aa, synthetic construct
  source 1..25: note = Seed: LNVIVHSATGFKQSSKALQRPVASD
LNVIVHSATGYKQVSGALPRPVASD

SEQ ID NO: 10574 - protein, 25 aa, synthetic construct
  source 1..25: note = Seed: LNVIVHSATGFKQSSKALQRPVASD
LNVIVHSATGYKQVSGALQRPVASD

SEQ ID NO: 10575 - protein, 25 aa, synthetic construct
  source 1..25: note = Seed: LNVIVHSATGFKQSSKALQRPVASD
LNVIVHSATGYKQVSGALSRPVASD

SEQ ID NO: 10576 - protein, 25 aa, synthetic construct
  source 1..25: note = Seed: LNVIVHSATGFKQSSKALQRPVASD
LNVIVHSATGYKQVSGALTRPVASD

SEQ ID NO: 10577 - protein, 25 aa, synthetic construct
  source 1..25: note = Seed: LNVIVHSATGFKQSSKALQRPVASD
LNVIVHSATGYKQVSGALVRPVASD

SEQ ID NO: 10578 - protein, 25 aa, synthetic construct
  source 1..25: note = Seed: LNVIVHSATGFKQSSKALQRPVASD
LNVIVHSATGYKQVSHALARPVASD

SEQ ID NO: 10579 - protein, 25 aa, synthetic construct
  source 1..25: note = Seed: LNVIVHSATGFKQSSKALQRPVASD
LNVIVHSATGYKQVSHALGRPVASD

SEQ ID NO: 10580 - protein, 25 aa, synthetic construct
  source 1..25: note = Seed: LNVIVHSATGFKQSSKALQRPVASD
LNVIVHSATGYKQVSHALIRPVASD

SEQ ID NO: 10581 - protein, 25 aa, synthetic construct
  source 1..25: note = Seed: LNVIVHSATGFKQSSKALQRPVASD
LNVIVHSATGYKQVSHALLRPVASD

SEQ ID NO: 10582 - protein, 25 aa, synthetic construct
  source 1..25: note = Seed: LNVIVHSATGFKQSSKALQRPVASD
LNVIVHSATGYKQVSHALRRPVASD

SEQ ID NO: 10583 - protein, 25 aa, synthetic construct
  source 1..25: note = Seed: LNVIVHSATGFKQSSKALQRPVASD
LNVIVHSATGYKQVSHALSRPVASD

SEQ ID NO: 10584 - protein, 25 aa, synthetic construct
  source 1..25: note = Seed: LNVIVHSATGFKQSSKALQRPVASD
LNVIVHSATGYKQVSHALVRPVASD

SEQ ID NO: 10585 - protein, 25 aa, synthetic construct
  source 1..25: note = Seed: LNVIVHSATGFKQSSKALQRPVASD
LNVIVHSATGYKQVSIALARPVASD

SEQ ID NO: 10586 - protein, 25 aa, synthetic construct
  source 1..25: note = Seed: LNVIVHSATGFKQSSKALQRPVASD
LNVIVHSATGYKQVSIALERPVASD

SEQ ID NO: 10587 - protein, 25 aa, synthetic construct
  source 1..25: note = Seed: LNVIVHSATGFKQSSKALQRPVASD
LNVIVHSATGYKQVSIALFRPVASD

SEQ ID NO: 10588 - protein, 25 aa, synthetic construct
  source 1..25: note = Seed: LNVIVHSATGFKQSSKALQRPVASD
LNVIVHSATGYKQVSIALGRPVASD

SEQ ID NO: 10589 - protein, 25 aa, synthetic construct
  source 1..25: note = Seed: LNVIVHSATGFKQSSKALQRPVASD
LNVIVHSATGYKQVSIALHRPVASD

SEQ ID NO: 10590 - protein, 25 aa, synthetic construct
  source 1..25: note = Seed: LNVIVHSATGFKQSSKALQRPVASD
LNVIVHSATGYKQVSIALIRPVASD

SEQ ID NO: 10591 - protein, 25 aa, synthetic construct
  source 1..25: note = Seed: LNVIVHSATGFKQSSKALQRPVASD
LNVIVHSATGYKQVSIALLRPVASD

SEQ ID NO: 10592 - protein, 25 aa, synthetic construct
  source 1..25: note = Seed: LNVIVHSATGFKQSSKALQRPVASD
LNVIVHSATGYKQVSIALMRPVASD

SEQ ID NO: 10593 - protein, 25 aa, synthetic construct
  source 1..25: note = Seed: LNVIVHSATGFKQSSKALQRPVASD
LNVIVHSATGYKQVSIALNRPVASD

SEQ ID NO: 10594 - protein, 25 aa, synthetic construct
  source 1..25: note = Seed: LNVIVHSATGFKQSSKALQRPVASD
LNVIVHSATGYKQVSIALPRPVASD

SEQ ID NO: 10595 - protein, 25 aa, synthetic construct
  source 1..25: note = Seed: LNVIVHSATGFKQSSKALQRPVASD
LNVIVHSATGYKQVSIALQRPVASD

SEQ ID NO: 10596 - protein, 25 aa, synthetic construct
  source 1..25: note = Seed: LNVIVHSATGFKQSSKALQRPVASD
LNVIVHSATGYKQVSIALSRPVASD

SEQ ID NO: 10597 - protein, 25 aa, synthetic construct
  source 1..25: note = Seed: LNVIVHSATGFKQSSKALQRPVASD
LNVIVHSATGYKQVSIALTRPVASD

SEQ ID NO: 10598 - protein, 25 aa, synthetic construct
  source 1..25: note = Seed: LNVIVHSATGFKQSSKALQRPVASD
LNVIVHSATGYKQVSIALVRPVASD

SEQ ID NO: 10599 - protein, 25 aa, synthetic construct
  source 1..25: note = Seed: LNVIVHSATGFKQSSKALQRPVASD
LNVIVHSATGYKQVSKALARPVASD

SEQ ID NO: 10600 - protein, 25 aa, synthetic construct
  source 1..25: note = Seed: LNVIVHSATGFKQSSKALQRPVASD
LNVIVHSATGYKQVSKALGRPVASD

SEQ ID NO: 10601 - protein, 25 aa, synthetic construct
  source 1..25: note = Seed: LNVIVHSATGFKQSSKALQRPVASD
LNVIVHSATGYKQVSKALHRPVASD

SEQ ID NO: 10602 - protein, 25 aa, synthetic construct
  source 1..25: note = Seed: LNVIVHSATGFKQSSKALQRPVASD
LNVIVHSATGYKQVSKALIRPVASD

SEQ ID NO: 10603 - protein, 25 aa, synthetic construct
  source 1..25: note = Seed: LNVIVHSATGFKQSSKALQRPVASD
LNVIVHSATGYKQVSKALKRPVASD

SEQ ID NO: 10604 - protein, 25 aa, synthetic construct
  source 1..25: note = Seed: LNVIVHSATGFKQSSKALQRPVASD
LNVIVHSATGYKQVSKALLRPVASD

SEQ ID NO: 10605 - protein, 25 aa, synthetic construct
  source 1..25: note = Seed: LNVIVHSATGFKQSSKALQRPVASD
LNVIVHSATGYKQVSKALMRPVASD

SEQ ID NO: 10606 - protein, 25 aa, synthetic construct
  source 1..25: note = Seed: LNVIVHSATGFKQSSKALQRPVASD
LNVIVHSATGYKQVSKALNRPVASD

SEQ ID NO: 10607 - protein, 25 aa, synthetic construct
  source 1..25: note = Seed: LNVIVHSATGFKQSSKALQRPVASD
LNVIVHSATGYKQVSKALPRPVASD

SEQ ID NO: 10608 - protein, 25 aa, synthetic construct
  source 1..25: note = Seed: LNVIVHSATGFKQSSKALQRPVASD
LNVIVHSATGYKQVSKALQRPVASD

SEQ ID NO: 10609 - protein, 25 aa, synthetic construct
  source 1..25: note = Seed: LNVIVHSATGFKQSSKALQRPVASD
LNVIVHSATGYKQVSKALRRPVASD

SEQ ID NO: 10610 - protein, 25 aa, synthetic construct
  source 1..25: note = Seed: LNVIVHSATGFKQSSKALQRPVASD
LNVIVHSATGYKQVSKALSRPVASD

SEQ ID NO: 10611 - protein, 25 aa, synthetic construct
  source 1..25: note = Seed: LNVIVHSATGFKQSSKALQRPVASD
LNVIVHSATGYKQVSKALTRPVASD

SEQ ID NO: 10612 - protein, 25 aa, synthetic construct
  source 1..25: note = Seed: LNVIVHSATGFKQSSKALQRPVASD
LNVIVHSATGYKQVSKALVRPVASD

SEQ ID NO: 10613 - protein, 25 aa, synthetic construct
  source 1..25: note = Seed: LNVIVHSATGFKQSSKALQRPVASD
LNVIVHSATGYKQVSLALARPVASD

SEQ ID NO: 10614 - protein, 25 aa, synthetic construct
  source 1..25: note = Seed: LNVIVHSATGFKQSSKALQRPVASD
LNVIVHSATGYKQVSLALGRPVASD

SEQ ID NO: 10615 - protein, 25 aa, synthetic construct
  source 1..25: note = Seed: LNVIVHSATGFKQSSKALQRPVASD
LNVIVHSATGYKQVSLALHRPVASD

SEQ ID NO: 10616 - protein, 25 aa, synthetic construct
  source 1..25: note = Seed: LNVIVHSATGFKQSSKALQRPVASD
LNVIVHSATGYKQVSLALIRPVASD

SEQ ID NO: 10617 - protein, 25 aa, synthetic construct
  source 1..25: note = Seed: LNVIVHSATGFKQSSKALQRPVASD
LNVIVHSATGYKQVSLALLRPVASD

SEQ ID NO: 10618 - protein, 25 aa, synthetic construct
  source 1..25: note = Seed: LNVIVHSATGFKQSSKALQRPVASD
LNVIVHSATGYKQVSLALMRPVASD

SEQ ID NO: 10619 - protein, 25 aa, synthetic construct
  source 1..25: note = Seed: LNVIVHSATGFKQSSKALQRPVASD
LNVIVHSATGYKQVSLALNRPVASD

SEQ ID NO: 10620 - protein, 25 aa, synthetic construct
  source 1..25: note = Seed: LNVIVHSATGFKQSSKALQRPVASD
LNVIVHSATGYKQVSLALQRPVASD

SEQ ID NO: 10621 - protein, 25 aa, synthetic construct
  source 1..25: note = Seed: LNVIVHSATGFKQSSKALQRPVASD
LNVIVHSATGYKQVSLALSRPVASD

SEQ ID NO: 10622 - protein, 25 aa, synthetic construct
  source 1..25: note = Seed: LNVIVHSATGFKQSSKALQRPVASD
LNVIVHSATGYKQVSLALTRPVASD

SEQ ID NO: 10623 - protein, 25 aa, synthetic construct
  source 1..25: note = Seed: LNVIVHSATGFKQSSKALQRPVASD
LNVIVHSATGYKQVSLALVRPVASD

SEQ ID NO: 10624 - protein, 25 aa, synthetic construct
  source 1..25: note = Seed: LNVIVHSATGFKQSSKALQRPVASD
LNVIVHSATGYKQVSMALARPVASD

SEQ ID NO: 10625 - protein, 25 aa, synthetic construct
  source 1..25: note = Seed: LNVIVHSATGFKQSSKALQRPVASD
LNVIVHSATGYKQVSMALGRPVASD

SEQ ID NO: 10626 - protein, 25 aa, synthetic construct
  source 1..25: note = Seed: LNVIVHSATGFKQSSKALQRPVASD
LNVIVHSATGYKQVSMALHRPVASD

SEQ ID NO: 10627 - protein, 25 aa, synthetic construct
  source 1..25: note = Seed: LNVIVHSATGFKQSSKALQRPVASD
LNVIVHSATGYKQVSMALIRPVASD

SEQ ID NO: 10628 - protein, 25 aa, synthetic construct
  source 1..25: note = Seed: LNVIVHSATGFKQSSKALQRPVASD
LNVIVHSATGYKQVSMALLRPVASD

SEQ ID NO: 10629 - protein, 25 aa, synthetic construct
  source 1..25: note = Seed: LNVIVHSATGFKQSSKALQRPVASD
LNVIVHSATGYKQVSMALMRPVASD

SEQ ID NO: 10630 - protein, 25 aa, synthetic construct
  source 1..25: note = Seed: LNVIVHSATGFKQSSKALQRPVASD
LNVIVHSATGYKQVSMALNRPVASD

SEQ ID NO: 10631 - protein, 25 aa, synthetic construct
  source 1..25: note = Seed: LNVIVHSATGFKQSSKALQRPVASD
LNVIVHSATGYKQVSMALSRPVASD

SEQ ID NO: 10632 - protein, 25 aa, synthetic construct
  source 1..25: note = Seed: LNVIVHSATGFKQSSKALQRPVASD
LNVIVHSATGYKQVSMALTRPVASD

SEQ ID NO: 10633 - protein, 25 aa, synthetic construct
  source 1..25: note = Seed: LNVIVHSATGFKQSSKALQRPVASD
LNVIVHSATGYKQVSMALVRPVASD

SEQ ID NO: 10634 - protein, 25 aa, synthetic construct
  source 1..25: note = Seed: LNVIVHSATGFKQSSKALQRPVASD
LNVIVHSATGYKQVSNALARPVASD

SEQ ID NO: 10635 - protein, 25 aa, synthetic construct
  source 1..25: note = Seed: LNVIVHSATGFKQSSKALQRPVASD
LNVIVHSATGYKQVSNALGRPVASD

SEQ ID NO: 10636 - protein, 25 aa, synthetic construct
  source 1..25: note = Seed: LNVIVHSATGFKQSSKALQRPVASD
LNVIVHSATGYKQVSNALIRPVASD

SEQ ID NO: 10637 - protein, 25 aa, synthetic construct
  source 1..25: note = Seed: LNVIVHSATGFKQSSKALQRPVASD
LNVIVHSATGYKQVSNALLRPVASD

SEQ ID NO: 10638 - protein, 25 aa, synthetic construct
  source 1..25: note = Seed: LNVIVHSATGFKQSSKALQRPVASD
LNVIVHSATGYKQVSNALMRPVASD

SEQ ID NO: 10639 - protein, 25 aa, synthetic construct
  source 1..25: note = Seed: LNVIVHSATGFKQSSKALQRPVASD
LNVIVHSATGYKQVSNALNRPVASD

SEQ ID NO: 10640 - protein, 25 aa, synthetic construct
  source 1..25: note = Seed: LNVIVHSATGFKQSSKALQRPVASD
LNVIVHSATGYKQVSNALSRPVASD

SEQ ID NO: 10641 - protein, 25 aa, synthetic construct
  source 1..25: note = Seed: LNVIVHSATGFKQSSKALQRPVASD
LNVIVHSATGYKQVSNALTRPVASD

SEQ ID NO: 10642 - protein, 25 aa, synthetic construct
  source 1..25: note = Seed: LNVIVHSATGFKQSSKALQRPVASD
LNVIVHSATGYKQVSNALVRPVASD

SEQ ID NO: 10643 - protein, 25 aa, synthetic construct
  source 1..25: note = Seed: LNVIVHSATGFKQSSKALQRPVASD
LNVIVHSATGYKQVSPALARPVASD

SEQ ID NO: 10644 - protein, 25 aa, synthetic construct
  source 1..25: note = Seed: LNVIVHSATGFKQSSKALQRPVASD
LNVIVHSATGYKQVSPALCRPVASD

SEQ ID NO: 10645 - protein, 25 aa, synthetic construct
  source 1..25: note = Seed: LNVIVHSATGFKQSSKALQRPVASD
LNVIVHSATGYKQVSPALDRPVASD

SEQ ID NO: 10646 - protein, 25 aa, synthetic construct
  source 1..25: note = Seed: LNVIVHSATGFKQSSKALQRPVASD
LNVIVHSATGYKQVSPALERPVASD

SEQ ID NO: 10647 - protein, 25 aa, synthetic construct
  source 1..25: note = Seed: LNVIVHSATGFKQSSKALQRPVASD
LNVIVHSATGYKQVSPALFRPVASD

SEQ ID NO: 10648 - protein, 25 aa, synthetic construct
  source 1..25: note = Seed: LNVIVHSATGFKQSSKALQRPVASD
LNVIVHSATGYKQVSPALGRPVASD

SEQ ID NO: 10649 - protein, 25 aa, synthetic construct
  source 1..25: note = Seed: LNVIVHSATGFKQSSKALQRPVASD
LNVIVHSATGYKQVSPALHRPVASD

SEQ ID NO: 10650 - protein, 25 aa, synthetic construct
  source 1..25: note = Seed: LNVIVHSATGFKQSSKALQRPVASD
LNVIVHSATGYKQVSPALIRPVASD

SEQ ID NO: 10651 - protein, 25 aa, synthetic construct
  source 1..25: note = Seed: LNVIVHSATGFKQSSKALQRPVASD
LNVIVHSATGYKQVSPALLRPVASD

SEQ ID NO: 10652 - protein, 25 aa, synthetic construct
  source 1..25: note = Seed: LNVIVHSATGFKQSSKALQRPVASD
LNVIVHSATGYKQVSPALMRPVASD

SEQ ID NO: 10653 - protein, 25 aa, synthetic construct
  source 1..25: note = Seed: LNVIVHSATGFKQSSKALQRPVASD
LNVIVHSATGYKQVSPALNRPVASD

SEQ ID NO: 10654 - protein, 25 aa, synthetic construct
  source 1..25: note = Seed: LNVIVHSATGFKQSSKALQRPVASD
LNVIVHSATGYKQVSPALPRPVASD

SEQ ID NO: 10655 - protein, 25 aa, synthetic construct
  source 1..25: note = Seed: LNVIVHSATGFKQSSKALQRPVASD
LNVIVHSATGYKQVSPALQRPVASD

SEQ ID NO: 10656 - protein, 25 aa, synthetic construct
  source 1..25: note = Seed: LNVIVHSATGFKQSSKALQRPVASD
LNVIVHSATGYKQVSPALSRPVASD

SEQ ID NO: 10657 - protein, 25 aa, synthetic construct
  source 1..25: note = Seed: LNVIVHSATGFKQSSKALQRPVASD
LNVIVHSATGYKQVSPALTRPVASD

SEQ ID NO: 10658 - protein, 25 aa, synthetic construct
  source 1..25: note = Seed: LNVIVHSATGFKQSSKALQRPVASD
LNVIVHSATGYKQVSPALVRPVASD

SEQ ID NO: 10659 - protein, 25 aa, synthetic construct
  source 1..25: note = Seed: LNVIVHSATGFKQSSKALQRPVASD
LNVIVHSATGYKQVSQALARPVASD

SEQ ID NO: 10660 - protein, 25 aa, synthetic construct
  source 1..25: note = Seed: LNVIVHSATGFKQSSKALQRPVASD
LNVIVHSATGYKQVSQALSRPVASD

SEQ ID NO: 10661 - protein, 25 aa, synthetic construct
  source 1..25: note = Seed: LNVIVHSATGFKQSSKALQRPVASD
LNVIVHSATGYKQVSQALVRPVASD

SEQ ID NO: 10662 - protein, 25 aa, synthetic construct
  source 1..25: note = Seed: LNVIVHSATGFKQSSKALQRPVASD
LNVIVHSATGYKQVSRALARPVASD

SEQ ID NO: 10663 - protein, 25 aa, synthetic construct
  source 1..25: note = Seed: LNVIVHSATGFKQSSKALQRPVASD
LNVIVHSATGYKQVSRALGRPVASD

SEQ ID NO: 10664 - protein, 25 aa, synthetic construct
  source 1..25: note = Seed: LNVIVHSATGFKQSSKALQRPVASD
LNVIVHSATGYKQVSRALHRPVASD

SEQ ID NO: 10665 - protein, 25 aa, synthetic construct
  source 1..25: note = Seed: LNVIVHSATGFKQSSKALQRPVASD
LNVIVHSATGYKQVSRALIRPVASD

SEQ ID NO: 10666 - protein, 25 aa, synthetic construct
  source 1..25: note = Seed: LNVIVHSATGFKQSSKALQRPVASD
LNVIVHSATGYKQVSRALKRPVASD

SEQ ID NO: 10667 - protein, 25 aa, synthetic construct
  source 1..25: note = Seed: LNVIVHSATGFKQSSKALQRPVASD
LNVIVHSATGYKQVSRALLRPVASD

SEQ ID NO: 10668 - protein, 25 aa, synthetic construct
  source 1..25: note = Seed: LNVIVHSATGFKQSSKALQRPVASD
LNVIVHSATGYKQVSRALMRPVASD

SEQ ID NO: 10669 - protein, 25 aa, synthetic construct
  source 1..25: note = Seed: LNVIVHSATGFKQSSKALQRPVASD
LNVIVHSATGYKQVSRALNRPVASD

SEQ ID NO: 10670 - protein, 25 aa, synthetic construct
  source 1..25: note = Seed: LNVIVHSATGFKQSSKALQRPVASD
LNVIVHSATGYKQVSRALPRPVASD

SEQ ID NO: 10671 - protein, 25 aa, synthetic construct
  source 1..25: note = Seed: LNVIVHSATGFKQSSKALQRPVASD
LNVIVHSATGYKQVSRALQRPVASD

SEQ ID NO: 10672 - protein, 25 aa, synthetic construct
  source 1..25: note = Seed: LNVIVHSATGFKQSSKALQRPVASD
LNVIVHSATGYKQVSRALRRPVASD

SEQ ID NO: 10673 - protein, 25 aa, synthetic construct
  source 1..25: note = Seed: LNVIVHSATGFKQSSKALQRPVASD
LNVIVHSATGYKQVSRALSRPVASD

SEQ ID NO: 10674 - protein, 25 aa, synthetic construct
  source 1..25: note = Seed: LNVIVHSATGFKQSSKALQRPVASD
LNVIVHSATGYKQVSRALTRPVASD

SEQ ID NO: 10675 - protein, 25 aa, synthetic construct
  source 1..25: note = Seed: LNVIVHSATGFKQSSKALQRPVASD
LNVIVHSATGYKQVSRALVRPVASD

SEQ ID NO: 10676 - protein, 25 aa, synthetic construct
  source 1..25: note = Seed: LNVIVHSATGFKQSSKALQRPVASD
LNVIVHSATGYKQVSRALYRPVASD

SEQ ID NO: 10677 - protein, 25 aa, synthetic construct
  source 1..25: note = Seed: LNVIVHSATGFKQSSKALQRPVASD
LNVIVHSATGYKQVSSALARPVASD

SEQ ID NO: 10678 - protein, 25 aa, synthetic construct
  source 1..25: note = Seed: LNVIVHSATGFKQSSKALQRPVASD
LNVIVHSATGYKQVSSALCRPVASD

SEQ ID NO: 10679 - protein, 25 aa, synthetic construct
  source 1..25: note = Seed: LNVIVHSATGFKQSSKALQRPVASD
LNVIVHSATGYKQVSSALFRPVASD

SEQ ID NO: 10680 - protein, 25 aa, synthetic construct
  source 1..25: note = Seed: LNVIVHSATGFKQSSKALQRPVASD
LNVIVHSATGYKQVSSALGRPVASD

SEQ ID NO: 10681 - protein, 25 aa, synthetic construct
  source 1..25: note = Seed: LNVIVHSATGFKQSSKALQRPVASD
LNVIVHSATGYKQVSSALHRPVASD

SEQ ID NO: 10682 - protein, 25 aa, synthetic construct
  source 1..25: note = Seed: LNVIVHSATGFKQSSKALQRPVASD
LNVIVHSATGYKQVSSALIRPVASD

SEQ ID NO: 10683 - protein, 25 aa, synthetic construct
  source 1..25: note = Seed: LNVIVHSATGFKQSSKALQRPVASD
LNVIVHSATGYKQVSSALLRPVASD

SEQ ID NO: 10684 - protein, 25 aa, synthetic construct
  source 1..25: note = Seed: LNVIVHSATGFKQSSKALQRPVASD
LNVIVHSATGYKQVSSALMRPVASD

SEQ ID NO: 10685 - protein, 25 aa, synthetic construct
  source 1..25: note = Seed: LNVIVHSATGFKQSSKALQRPVASD
LNVIVHSATGYKQVSSALNRPVASD

SEQ ID NO: 10686 - protein, 25 aa, synthetic construct
  source 1..25: note = Seed: LNVIVHSATGFKQSSKALQRPVASD
LNVIVHSATGYKQVSSALPRPVASD

SEQ ID NO: 10687 - protein, 25 aa, synthetic construct
  source 1..25: note = Seed: LNVIVHSATGFKQSSKALQRPVASD
LNVIVHSATGYKQVSSALQRPVASD

SEQ ID NO: 10688 - protein, 25 aa, synthetic construct
  source 1..25: note = Seed: LNVIVHSATGFKQSSKALQRPVASD
LNVIVHSATGYKQVSSALSRPVASD

SEQ ID NO: 10689 - protein, 25 aa, synthetic construct
  source 1..25: note = Seed: LNVIVHSATGFKQSSKALQRPVASD
LNVIVHSATGYKQVSSALTRPVASD

SEQ ID NO: 10690 - protein, 25 aa, synthetic construct
  source 1..25: note = Seed: LNVIVHSATGFKQSSKALQRPVASD
LNVIVHSATGYKQVSSALVRPVASD

SEQ ID NO: 10691 - protein, 25 aa, synthetic construct
  source 1..25: note = Seed: LNVIVHSATGFKQSSKALQRPVASD
LNVIVHSATGYKQVSSALYRPVASD

SEQ ID NO: 10692 - protein, 25 aa, synthetic construct
  source 1..25: note = Seed: LNVIVHSATGFKQSSKALQRPVASD
LNVIVHSATGYKQVSTALARPVASD

SEQ ID NO: 10693 - protein, 25 aa, synthetic construct
  source 1..25: note = Seed: LNVIVHSATGFKQSSKALQRPVASD
LNVIVHSATGYKQVSTALFRPVASD

SEQ ID NO: 10694 - protein, 25 aa, synthetic construct
  source 1..25: note = Seed: LNVIVHSATGFKQSSKALQRPVASD
LNVIVHSATGYKQVSTALGRPVASD

SEQ ID NO: 10695 - protein, 25 aa, synthetic construct
  source 1..25: note = Seed: LNVIVHSATGFKQSSKALQRPVASD
LNVIVHSATGYKQVSTALHRPVASD

SEQ ID NO: 10696 - protein, 25 aa, synthetic construct
  source 1..25: note = Seed: LNVIVHSATGFKQSSKALQRPVASD
LNVIVHSATGYKQVSTALIRPVASD

SEQ ID NO: 10697 - protein, 25 aa, synthetic construct
  source 1..25: note = Seed: LNVIVHSATGFKQSSKALQRPVASD
LNVIVHSATGYKQVSTALLRPVASD

SEQ ID NO: 10698 - protein, 25 aa, synthetic construct
  source 1..25: note = Seed: LNVIVHSATGFKQSSKALQRPVASD
LNVIVHSATGYKQVSTALMRPVASD

SEQ ID NO: 10699 - protein, 25 aa, synthetic construct
  source 1..25: note = Seed: LNVIVHSATGFKQSSKALQRPVASD
LNVIVHSATGYKQVSTALNRPVASD

SEQ ID NO: 10700 - protein, 25 aa, synthetic construct
  source 1..25: note = Seed: LNVIVHSATGFKQSSKALQRPVASD
LNVIVHSATGYKQVSTALPRPVASD

SEQ ID NO: 10701 - protein, 25 aa, synthetic construct
  source 1..25: note = Seed: LNVIVHSATGFKQSSKALQRPVASD
LNVIVHSATGYKQVSTALQRPVASD

SEQ ID NO: 10702 - protein, 25 aa, synthetic construct
  source 1..25: note = Seed: LNVIVHSATGFKQSSKALQRPVASD
LNVIVHSATGYKQVSTALSRPVASD

SEQ ID NO: 10703 - protein, 25 aa, synthetic construct
  source 1..25: note = Seed: LNVIVHSATGFKQSSKALQRPVASD
LNVIVHSATGYKQVSTALTRPVASD

SEQ ID NO: 10704 - protein, 25 aa, synthetic construct
  source 1..25: note = Seed: LNVIVHSATGFKQSSKALQRPVASD
LNVIVHSATGYKQVSTALVRPVASD

SEQ ID NO: 10705 - protein, 25 aa, synthetic construct
  source 1..25: note = Seed: LNVIVHSATGFKQSSKALQRPVASD
LNVIVHSATGYKQVSVALARPVASD

SEQ ID NO: 10706 - protein, 25 aa, synthetic construct
  source 1..25: note = Seed: LNVIVHSATGFKQSSKALQRPVASD
LNVIVHSATGYKQVSVALDRPVASD

SEQ ID NO: 10707 - protein, 25 aa, synthetic construct
  source 1..25: note = Seed: LNVIVHSATGFKQSSKALQRPVASD
LNVIVHSATGYKQVSVALERPVASD

SEQ ID NO: 10708 - protein, 25 aa, synthetic construct
  source 1..25: note = Seed: LNVIVHSATGFKQSSKALQRPVASD
LNVIVHSATGYKQVSVALGRPVASD

SEQ ID NO: 10709 - protein, 25 aa, synthetic construct
  source 1..25: note = Seed: LNVIVHSATGFKQSSKALQRPVASD
LNVIVHSATGYKQVSVALHRPVASD

SEQ ID NO: 10710 - protein, 25 aa, synthetic construct
  source 1..25: note = Seed: LNVIVHSATGFKQSSKALQRPVASD
LNVIVHSATGYKQVSVALIRPVASD

SEQ ID NO: 10711 - protein, 25 aa, synthetic construct
  source 1..25: note = Seed: LNVIVHSATGFKQSSKALQRPVASD
LNVIVHSATGYKQVSVALLRPVASD

SEQ ID NO: 10712 - protein, 25 aa, synthetic construct
  source 1..25: note = Seed: LNVIVHSATGFKQSSKALQRPVASD
LNVIVHSATGYKQVSVALMRPVASD

SEQ ID NO: 10713 - protein, 25 aa, synthetic construct
  source 1..25: note = Seed: LNVIVHSATGFKQSSKALQRPVASD
LNVIVHSATGYKQVSVALNRPVASD

SEQ ID NO: 10714 - protein, 25 aa, synthetic construct
  source 1..25: note = Seed: LNVIVHSATGFKQSSKALQRPVASD
LNVIVHSATGYKQVSVALPRPVASD

SEQ ID NO: 10715 - protein, 25 aa, synthetic construct
  source 1..25: note = Seed: LNVIVHSATGFKQSSKALQRPVASD
LNVIVHSATGYKQVSVALQRPVASD

SEQ ID NO: 10716 - protein, 25 aa, synthetic construct
  source 1..25: note = Seed: LNVIVHSATGFKQSSKALQRPVASD
LNVIVHSATGYKQVSVALSRPVASD

SEQ ID NO: 10717 - protein, 25 aa, synthetic construct
  source 1..25: note = Seed: LNVIVHSATGFKQSSKALQRPVASD
LNVIVHSATGYKQVSVALTRPVASD

SEQ ID NO: 10718 - protein, 25 aa, synthetic construct
  source 1..25: note = Seed: LNVIVHSATGFKQSSKALQRPVASD
LNVIVHSATGYKQVSVALVRPVASD

SEQ ID NO: 10719 - protein, 25 aa, synthetic construct
  source 1..25: note = Seed: LNVIVHSATGFKQSSKALQRPVASD
LNVIVHSATGYKQVSWALVRPVASD

SEQ ID NO: 10720 - protein, 25 aa, synthetic construct
  source 1..25: note = Seed: LNVIVHSATGFKQSSKALQRPVASD
LNVIVHSATGYKQVSYALGRPVASD

SEQ ID NO: 10721 - protein, 25 aa, synthetic construct
  source 1..25: note = Seed: LNVIVHSATGFKQSSKALQRPVASD
LNVIVHSATGYKQVSYALIRPVASD

SEQ ID NO: 10722 - protein, 25 aa, synthetic construct
  source 1..25: note = Seed: LNVIVHSATGFKQSSKALQRPVASD
LNVIVHSATGYKQVSYALVRPVASD

SEQ ID NO: 10723 - protein, 25 aa, synthetic construct
  source 1..25: note = Seed: LNVIVHSATGFKQSSKALQRPVASD
LNVIVHSATGYKQWSAALARPVASD

SEQ ID NO: 10724 - protein, 25 aa, synthetic construct
  source 1..25: note = Seed: LNVIVHSATGFKQSSKALQRPVASD
LNVIVHSATGYKQWSAALGRPVASD

SEQ ID NO: 10725 - protein, 25 aa, synthetic construct
  source 1..25: note = Seed: LNVIVHSATGFKQSSKALQRPVASD
LNVIVHSATGYKQWSAALIRPVASD

SEQ ID NO: 10726 - protein, 25 aa, synthetic construct
  source 1..25: note = Seed: LNVIVHSATGFKQSSKALQRPVASD
LNVIVHSATGYKQWSAALLRPVASD

SEQ ID NO: 10727 - protein, 25 aa, synthetic construct
  source 1..25: note = Seed: LNVIVHSATGFKQSSKALQRPVASD
LNVIVHSATGYKQWSAALMRPVASD

SEQ ID NO: 10728 - protein, 25 aa, synthetic construct
  source 1..25: note = Seed: LNVIVHSATGFKQSSKALQRPVASD
LNVIVHSATGYKQWSAALNRPVASD

SEQ ID NO: 10729 - protein, 25 aa, synthetic construct
  source 1..25: note = Seed: LNVIVHSATGFKQSSKALQRPVASD
LNVIVHSATGYKQWSAALSRPVASD

SEQ ID NO: 10730 - protein, 25 aa, synthetic construct
  source 1..25: note = Seed: LNVIVHSATGFKQSSKALQRPVASD
LNVIVHSATGYKQWSAALTRPVASD

SEQ ID NO: 10731 - protein, 25 aa, synthetic construct
  source 1..25: note = Seed: LNVIVHSATGFKQSSKALQRPVASD
LNVIVHSATGYKQWSAALVRPVASD

SEQ ID NO: 10732 - protein, 25 aa, synthetic construct
  source 1..25: note = Seed: LNVIVHSATGFKQSSKALQRPVASD
LNVIVHSATGYKQWSFALIRPVASD

SEQ ID NO: 10733 - protein, 25 aa, synthetic construct
  source 1..25: note = Seed: LNVIVHSATGFKQSSKALQRPVASD
LNVIVHSATGYKQWSGALARPVASD

SEQ ID NO: 10734 - protein, 25 aa, synthetic construct
  source 1..25: note = Seed: LNVIVHSATGFKQSSKALQRPVASD
LNVIVHSATGYKQWSGALGRPVASD

SEQ ID NO: 10735 - protein, 25 aa, synthetic construct
  source 1..25: note = Seed: LNVIVHSATGFKQSSKALQRPVASD
LNVIVHSATGYKQWSGALIRPVASD

SEQ ID NO: 10736 - protein, 25 aa, synthetic construct
  source 1..25: note = Seed: LNVIVHSATGFKQSSKALQRPVASD
LNVIVHSATGYKQWSGALLRPVASD

SEQ ID NO: 10737 - protein, 25 aa, synthetic construct
  source 1..25: note = Seed: LNVIVHSATGFKQSSKALQRPVASD
LNVIVHSATGYKQWSGALSRPVASD

SEQ ID NO: 10738 - protein, 25 aa, synthetic construct
  source 1..25: note = Seed: LNVIVHSATGFKQSSKALQRPVASD
LNVIVHSATGYKQWSGALTRPVASD

SEQ ID NO: 10739 - protein, 25 aa, synthetic construct
  source 1..25: note = Seed: LNVIVHSATGFKQSSKALQRPVASD
LNVIVHSATGYKQWSGALVRPVASD

SEQ ID NO: 10740 - protein, 25 aa, synthetic construct
  source 1..25: note = Seed: LNVIVHSATGFKQSSKALQRPVASD
LNVIVHSATGYKQWSIALGRPVASD

SEQ ID NO: 10741 - protein, 25 aa, synthetic construct
  source 1..25: note = Seed: LNVIVHSATGFKQSSKALQRPVASD
LNVIVHSATGYKQWSIALHRPVASD

SEQ ID NO: 10742 - protein, 25 aa, synthetic construct
  source 1..25: note = Seed: LNVIVHSATGFKQSSKALQRPVASD
LNVIVHSATGYKQWSIALIRPVASD

SEQ ID NO: 10743 - protein, 25 aa, synthetic construct
  source 1..25: note = Seed: LNVIVHSATGFKQSSKALQRPVASD
LNVIVHSATGYKQWSIALLRPVASD

SEQ ID NO: 10744 - protein, 25 aa, synthetic construct
  source 1..25: note = Seed: LNVIVHSATGFKQSSKALQRPVASD
LNVIVHSATGYKQWSIALNRPVASD

SEQ ID NO: 10745 - protein, 25 aa, synthetic construct
  source 1..25: note = Seed: LNVIVHSATGFKQSSKALQRPVASD
LNVIVHSATGYKQWSIALQRPVASD

SEQ ID NO: 10746 - protein, 25 aa, synthetic construct
  source 1..25: note = Seed: LNVIVHSATGFKQSSKALQRPVASD
LNVIVHSATGYKQWSIALRRPVASD

SEQ ID NO: 10747 - protein, 25 aa, synthetic construct
  source 1..25: note = Seed: LNVIVHSATGFKQSSKALQRPVASD
LNVIVHSATGYKQWSKALRRPVASD

SEQ ID NO: 10748 - protein, 25 aa, synthetic construct
  source 1..25: note = Seed: LNVIVHSATGFKQSSKALQRPVASD
LNVIVHSATGYKQWSLALNRPVASD

SEQ ID NO: 10749 - protein, 25 aa, synthetic construct
  source 1..25: note = Seed: LNVIVHSATGFKQSSKALQRPVASD
LNVIVHSATGYKQWSLALQRPVASD

SEQ ID NO: 10750 - protein, 25 aa, synthetic construct
  source 1..25: note = Seed: LNVIVHSATGFKQSSKALQRPVASD
LNVIVHSATGYKQWSLALRRPVASD

SEQ ID NO: 10751 - protein, 25 aa, synthetic construct
  source 1..25: note = Seed: LNVIVHSATGFKQSSKALQRPVASD
LNVIVHSATGYKQWSMALRRPVASD

SEQ ID NO: 10752 - protein, 25 aa, synthetic construct
  source 1..25: note = Seed: LNVIVHSATGFKQSSKALQRPVASD
LNVIVHSATGYKQWSNALARPVASD

SEQ ID NO: 10753 - protein, 25 aa, synthetic construct
  source 1..25: note = Seed: LNVIVHSATGFKQSSKALQRPVASD
LNVIVHSATGYKQWSNALSRPVASD

SEQ ID NO: 10754 - protein, 25 aa, synthetic construct
  source 1..25: note = Seed: LNVIVHSATGFKQSSKALQRPVASD
LNVIVHSATGYKQWSNALVRPVASD

SEQ ID NO: 10755 - protein, 25 aa, synthetic construct
  source 1..25: note = Seed: LNVIVHSATGFKQSSKALQRPVASD
LNVIVHSATGYKQWSPALARPVASD

SEQ ID NO: 10756 - protein, 25 aa, synthetic construct
  source 1..25: note = Seed: LNVIVHSATGFKQSSKALQRPVASD
LNVIVHSATGYKQWSPALIRPVASD

SEQ ID NO: 10757 - protein, 25 aa, synthetic construct
  source 1..25: note = Seed: LNVIVHSATGFKQSSKALQRPVASD
LNVIVHSATGYKQWSPALLRPVASD

SEQ ID NO: 10758 - protein, 25 aa, synthetic construct
  source 1..25: note = Seed: LNVIVHSATGFKQSSKALQRPVASD
LNVIVHSATGYKQWSPALMRPVASD

SEQ ID NO: 10759 - protein, 25 aa, synthetic construct
  source 1..25: note = Seed: LNVIVHSATGFKQSSKALQRPVASD
LNVIVHSATGYKQWSPALNRPVASD

SEQ ID NO: 10760 - protein, 25 aa, synthetic construct
  source 1..25: note = Seed: LNVIVHSATGFKQSSKALQRPVASD
LNVIVHSATGYKQWSPALSRPVASD

SEQ ID NO: 10761 - protein, 25 aa, synthetic construct
  source 1..25: note = Seed: LNVIVHSATGFKQSSKALQRPVASD
LNVIVHSATGYKQWSPALTRPVASD

SEQ ID NO: 10762 - protein, 25 aa, synthetic construct
  source 1..25: note = Seed: LNVIVHSATGFKQSSKALQRPVASD
LNVIVHSATGYKQWSPALVRPVASD

SEQ ID NO: 10763 - protein, 25 aa, synthetic construct
  source 1..25: note = Seed: LNVIVHSATGFKQSSKALQRPVASD
LNVIVHSATGYKQWSRALARPVASD

SEQ ID NO: 10764 - protein, 25 aa, synthetic construct
  source 1..25: note = Seed: LNVIVHSATGFKQSSKALQRPVASD
LNVIVHSATGYKQWSRALKRPVASD

SEQ ID NO: 10765 - protein, 25 aa, synthetic construct
  source 1..25: note = Seed: LNVIVHSATGFKQSSKALQRPVASD
LNVIVHSATGYKQWSRALRRPVASD

SEQ ID NO: 10766 - protein, 25 aa, synthetic construct
  source 1..25: note = Seed: LNVIVHSATGFKQSSKALQRPVASD
LNVIVHSATGYKQWSSALARPVASD

SEQ ID NO: 10767 - protein, 25 aa, synthetic construct
  source 1..25: note = Seed: LNVIVHSATGFKQSSKALQRPVASD
LNVIVHSATGYKQWSSALGRPVASD

SEQ ID NO: 10768 - protein, 25 aa, synthetic construct
  source 1..25: note = Seed: LNVIVHSATGFKQSSKALQRPVASD
LNVIVHSATGYKQWSSALIRPVASD

SEQ ID NO: 10769 - protein, 25 aa, synthetic construct
  source 1..25: note = Seed: LNVIVHSATGFKQSSKALQRPVASD
LNVIVHSATGYKQWSSALLRPVASD

SEQ ID NO: 10770 - protein, 25 aa, synthetic construct
  source 1..25: note = Seed: LNVIVHSATGFKQSSKALQRPVASD
LNVIVHSATGYKQWSSALMRPVASD

SEQ ID NO: 10771 - protein, 25 aa, synthetic construct
  source 1..25: note = Seed: LNVIVHSATGFKQSSKALQRPVASD
LNVIVHSATGYKQWSSALNRPVASD

SEQ ID NO: 10772 - protein, 25 aa, synthetic construct
  source 1..25: note = Seed: LNVIVHSATGFKQSSKALQRPVASD
LNVIVHSATGYKQWSSALSRPVASD

SEQ ID NO: 10773 - protein, 25 aa, synthetic construct
  source 1..25: note = Seed: LNVIVHSATGFKQSSKALQRPVASD
LNVIVHSATGYKQWSSALVRPVASD

SEQ ID NO: 10774 - protein, 25 aa, synthetic construct
  source 1..25: note = Seed: LNVIVHSATGFKQSSKALQRPVASD
LNVIVHSATGYKQWSTALARPVASD

SEQ ID NO: 10775 - protein, 25 aa, synthetic construct
  source 1..25: note = Seed: LNVIVHSATGFKQSSKALQRPVASD
LNVIVHSATGYKQWSTALGRPVASD

SEQ ID NO: 10776 - protein, 25 aa, synthetic construct
  source 1..25: note = Seed: LNVIVHSATGFKQSSKALQRPVASD
LNVIVHSATGYKQWSTALIRPVASD

SEQ ID NO: 10777 - protein, 25 aa, synthetic construct
  source 1..25: note = Seed: LNVIVHSATGFKQSSKALQRPVASD
LNVIVHSATGYKQWSTALLRPVASD

SEQ ID NO: 10778 - protein, 25 aa, synthetic construct
  source 1..25: note = Seed: LNVIVHSATGFKQSSKALQRPVASD
LNVIVHSATGYKQWSTALMRPVASD

SEQ ID NO: 10779 - protein, 25 aa, synthetic construct
  source 1..25: note = Seed: LNVIVHSATGFKQSSKALQRPVASD
LNVIVHSATGYKQWSTALNRPVASD

SEQ ID NO: 10780 - protein, 25 aa, synthetic construct
  source 1..25: note = Seed: LNVIVHSATGFKQSSKALQRPVASD
LNVIVHSATGYKQWSTALSRPVASD

SEQ ID NO: 10781 - protein, 25 aa, synthetic construct
  source 1..25: note = Seed: LNVIVHSATGFKQSSKALQRPVASD
LNVIVHSATGYKQWSTALTRPVASD

SEQ ID NO: 10782 - protein, 25 aa, synthetic construct
  source 1..25: note = Seed: LNVIVHSATGFKQSSKALQRPVASD
LNVIVHSATGYKQWSTALVRPVASD

SEQ ID NO: 10783 - protein, 25 aa, synthetic construct
  source 1..25: note = Seed: LNVIVHSATGFKQSSKALQRPVASD
LNVIVHSATGYKQWSVALARPVASD

SEQ ID NO: 10784 - protein, 25 aa, synthetic construct
  source 1..25: note = Seed: LNVIVHSATGFKQSSKALQRPVASD
LNVIVHSATGYKQWSVALGRPVASD

SEQ ID NO: 10785 - protein, 25 aa, synthetic construct
  source 1..25: note = Seed: LNVIVHSATGFKQSSKALQRPVASD
LNVIVHSATGYKQWSVALIRPVASD

SEQ ID NO: 10786 - protein, 25 aa, synthetic construct
  source 1..25: note = Seed: LNVIVHSATGFKQSSKALQRPVASD
LNVIVHSATGYKQWSVALLRPVASD

SEQ ID NO: 10787 - protein, 25 aa, synthetic construct
  source 1..25: note = Seed: LNVIVHSATGFKQSSKALQRPVASD
LNVIVHSATGYKQWSVALMRPVASD

SEQ ID NO: 10788 - protein, 25 aa, synthetic construct
  source 1..25: note = Seed: LNVIVHSATGFKQSSKALQRPVASD
LNVIVHSATGYKQWSVALNRPVASD

SEQ ID NO: 10789 - protein, 25 aa, synthetic construct
  source 1..25: note = Seed: LNVIVHSATGFKQSSKALQRPVASD
LNVIVHSATGYKQWSVALQRPVASD

SEQ ID NO: 10790 - protein, 25 aa, synthetic construct
  source 1..25: note = Seed: LNVIVHSATGFKQSSKALQRPVASD
LNVIVHSATGYKQWSVALSRPVASD

SEQ ID NO: 10791 - protein, 25 aa, synthetic construct
  source 1..25: note = Seed: LNVIVHSATGFKQSSKALQRPVASD
LNVIVHSATGYKQWSVALVRPVASD

SEQ ID NO: 10792 - protein, 25 aa, synthetic construct
  source 1..25: note = Seed: LNVIVHSATGFKQSSKALQRPVASD
LNVIVHSATGYKQYSAALARPVASD

SEQ ID NO: 10793 - protein, 25 aa, synthetic construct
  source 1..25: note = Seed: LNVIVHSATGFKQSSKALQRPVASD
LNVIVHSATGYKQYSAALCRPVASD

SEQ ID NO: 10794 - protein, 25 aa, synthetic construct
  source 1..25: note = Seed: LNVIVHSATGFKQSSKALQRPVASD
LNVIVHSATGYKQYSAALFRPVASD

SEQ ID NO: 10795 - protein, 25 aa, synthetic construct
  source 1..25: note = Seed: LNVIVHSATGFKQSSKALQRPVASD
LNVIVHSATGYKQYSAALGRPVASD

SEQ ID NO: 10796 - protein, 25 aa, synthetic construct
  source 1..25: note = Seed: LNVIVHSATGFKQSSKALQRPVASD
LNVIVHSATGYKQYSAALIRPVASD

SEQ ID NO: 10797 - protein, 25 aa, synthetic construct
  source 1..25: note = Seed: LNVIVHSATGFKQSSKALQRPVASD
LNVIVHSATGYKQYSAALLRPVASD

SEQ ID NO: 10798 - protein, 25 aa, synthetic construct
  source 1..25: note = Seed: LNVIVHSATGFKQSSKALQRPVASD
LNVIVHSATGYKQYSAALMRPVASD

SEQ ID NO: 10799 - protein, 25 aa, synthetic construct
  source 1..25: note = Seed: LNVIVHSATGFKQSSKALQRPVASD
LNVIVHSATGYKQYSAALQRPVASD

SEQ ID NO: 10800 - protein, 25 aa, synthetic construct
  source 1..25: note = Seed: LNVIVHSATGFKQSSKALQRPVASD
LNVIVHSATGYKQYSAALTRPVASD

SEQ ID NO: 10801 - protein, 25 aa, synthetic construct
  source 1..25: note = Seed: LNVIVHSATGFKQSSKALQRPVASD
LNVIVHSATGYKQYSAALVRPVASD

SEQ ID NO: 10802 - protein, 25 aa, synthetic construct
  source 1..25: note = Seed: LNVIVHSATGFKQSSKALQRPVASD
LNVIVHSATGYKQYSGALARPVASD

SEQ ID NO: 10803 - protein, 25 aa, synthetic construct
  source 1..25: note = Seed: LNVIVHSATGFKQSSKALQRPVASD
LNVIVHSATGYKQYSGALIRPVASD

SEQ ID NO: 10804 - protein, 25 aa, synthetic construct
  source 1..25: note = Seed: LNVIVHSATGFKQSSKALQRPVASD
LNVIVHSATGYKQYSGALSRPVASD

SEQ ID NO: 10805 - protein, 25 aa, synthetic construct
  source 1..25: note = Seed: LNVIVHSATGFKQSSKALQRPVASD
LNVIVHSATGYKQYSGALVRPVASD

SEQ ID NO: 10806 - protein, 25 aa, synthetic construct
  source 1..25: note = Seed: LNVIVHSATGFKQSSKALQRPVASD
LNVIVHSATGYKQYSIALQRPVASD

SEQ ID NO: 10807 - protein, 25 aa, synthetic construct
  source 1..25: note = Seed: LNVIVHSATGFKQSSKALQRPVASD
LNVIVHSATGYKQYSIALRRPVASD

SEQ ID NO: 10808 - protein, 25 aa, synthetic construct
  source 1..25: note = Seed: LNVIVHSATGFKQSSKALQRPVASD
LNVIVHSATGYKQYSKALKRPVASD

SEQ ID NO: 10809 - protein, 25 aa, synthetic construct
  source 1..25: note = Seed: LNVIVHSATGFKQSSKALQRPVASD
LNVIVHSATGYKQYSKALRRPVASD

SEQ ID NO: 10810 - protein, 25 aa, synthetic construct
  source 1..25: note = Seed: LNVIVHSATGFKQSSKALQRPVASD
LNVIVHSATGYKQYSLALRRPVASD

SEQ ID NO: 10811 - protein, 25 aa, synthetic construct
  source 1..25: note = Seed: LNVIVHSATGFKQSSKALQRPVASD
LNVIVHSATGYKQYSMALRRPVASD

SEQ ID NO: 10812 - protein, 25 aa, synthetic construct
  source 1..25: note = Seed: LNVIVHSATGFKQSSKALQRPVASD
LNVIVHSATGYKQYSNALARPVASD

SEQ ID NO: 10813 - protein, 25 aa, synthetic construct
  source 1..25: note = Seed: LNVIVHSATGFKQSSKALQRPVASD
LNVIVHSATGYKQYSNALIRPVASD

SEQ ID NO: 10814 - protein, 25 aa, synthetic construct
  source 1..25: note = Seed: LNVIVHSATGFKQSSKALQRPVASD
LNVIVHSATGYKQYSNALSRPVASD

SEQ ID NO: 10815 - protein, 25 aa, synthetic construct
  source 1..25: note = Seed: LNVIVHSATGFKQSSKALQRPVASD
LNVIVHSATGYKQYSNALVRPVASD

SEQ ID NO: 10816 - protein, 25 aa, synthetic construct
  source 1..25: note = Seed: LNVIVHSATGFKQSSKALQRPVASD
LNVIVHSATGYKQYSPALARPVASD

SEQ ID NO: 10817 - protein, 25 aa, synthetic construct
  source 1..25: note = Seed: LNVIVHSATGFKQSSKALQRPVASD
LNVIVHSATGYKQYSPALGRPVASD

SEQ ID NO: 10818 - protein, 25 aa, synthetic construct
  source 1..25: note = Seed: LNVIVHSATGFKQSSKALQRPVASD
LNVIVHSATGYKQYSPALIRPVASD

SEQ ID NO: 10819 - protein, 25 aa, synthetic construct
  source 1..25: note = Seed: LNVIVHSATGFKQSSKALQRPVASD
LNVIVHSATGYKQYSPALMRPVASD

SEQ ID NO: 10820 - protein, 25 aa, synthetic construct
  source 1..25: note = Seed: LNVIVHSATGFKQSSKALQRPVASD
LNVIVHSATGYKQYSPALNRPVASD

SEQ ID NO: 10821 - protein, 25 aa, synthetic construct
  source 1..25: note = Seed: LNVIVHSATGFKQSSKALQRPVASD
LNVIVHSATGYKQYSPALVRPVASD

SEQ ID NO: 10822 - protein, 25 aa, synthetic construct
  source 1..25: note = Seed: LNVIVHSATGFKQSSKALQRPVASD
LNVIVHSATGYKQYSRALARPVASD

SEQ ID NO: 10823 - protein, 25 aa, synthetic construct
  source 1..25: note = Seed: LNVIVHSATGFKQSSKALQRPVASD
LNVIVHSATGYKQYSRALKRPVASD

SEQ ID NO: 10824 - protein, 25 aa, synthetic construct
  source 1..25: note = Seed: LNVIVHSATGFKQSSKALQRPVASD
LNVIVHSATGYKQYSRALRRPVASD

SEQ ID NO: 10825 - protein, 25 aa, synthetic construct
  source 1..25: note = Seed: LNVIVHSATGFKQSSKALQRPVASD
LNVIVHSATGYKQYSRALSRPVASD

SEQ ID NO: 10826 - protein, 25 aa, synthetic construct
  source 1..25: note = Seed: LNVIVHSATGFKQSSKALQRPVASD
LNVIVHSATGYKQYSSALARPVASD

SEQ ID NO: 10827 - protein, 25 aa, synthetic construct
  source 1..25: note = Seed: LNVIVHSATGFKQSSKALQRPVASD
LNVIVHSATGYKQYSSALGRPVASD

SEQ ID NO: 10828 - protein, 25 aa, synthetic construct
  source 1..25: note = Seed: LNVIVHSATGFKQSSKALQRPVASD
LNVIVHSATGYKQYSSALIRPVASD

SEQ ID NO: 10829 - protein, 25 aa, synthetic construct
  source 1..25: note = Seed: LNVIVHSATGFKQSSKALQRPVASD
LNVIVHSATGYKQYSSALLRPVASD

SEQ ID NO: 10830 - protein, 25 aa, synthetic construct
  source 1..25: note = Seed: LNVIVHSATGFKQSSKALQRPVASD
LNVIVHSATGYKQYSSALMRPVASD

SEQ ID NO: 10831 - protein, 25 aa, synthetic construct
  source 1..25: note = Seed: LNVIVHSATGFKQSSKALQRPVASD
LNVIVHSATGYKQYSSALNRPVASD

SEQ ID NO: 10832 - protein, 25 aa, synthetic construct
  source 1..25: note = Seed: LNVIVHSATGFKQSSKALQRPVASD
LNVIVHSATGYKQYSSALSRPVASD

SEQ ID NO: 10833 - protein, 25 aa, synthetic construct
  source 1..25: note = Seed: LNVIVHSATGFKQSSKALQRPVASD
LNVIVHSATGYKQYSSALTRPVASD

SEQ ID NO: 10834 - protein, 25 aa, synthetic construct
  source 1..25: note = Seed: LNVIVHSATGFKQSSKALQRPVASD
LNVIVHSATGYKQYSSALVRPVASD

SEQ ID NO: 10835 - protein, 25 aa, synthetic construct
  source 1..25: note = Seed: LNVIVHSATGFKQSSKALQRPVASD
LNVIVHSATGYKQYSTALARPVASD

SEQ ID NO: 10836 - protein, 25 aa, synthetic construct
  source 1..25: note = Seed: LNVIVHSATGFKQSSKALQRPVASD
LNVIVHSATGYKQYSTALGRPVASD

SEQ ID NO: 10837 - protein, 25 aa, synthetic construct
  source 1..25: note = Seed: LNVIVHSATGFKQSSKALQRPVASD
LNVIVHSATGYKQYSTALIRPVASD

SEQ ID NO: 10838 - protein, 25 aa, synthetic construct
  source 1..25: note = Seed: LNVIVHSATGFKQSSKALQRPVASD
LNVIVHSATGYKQYSTALLRPVASD

SEQ ID NO: 10839 - protein, 25 aa, synthetic construct
  source 1..25: note = Seed: LNVIVHSATGFKQSSKALQRPVASD
LNVIVHSATGYKQYSTALMRPVASD

SEQ ID NO: 10840 - protein, 25 aa, synthetic construct
  source 1..25: note = Seed: LNVIVHSATGFKQSSKALQRPVASD
LNVIVHSATGYKQYSTALNRPVASD

SEQ ID NO: 10841 - protein, 25 aa, synthetic construct
  source 1..25: note = Seed: LNVIVHSATGFKQSSKALQRPVASD
LNVIVHSATGYKQYSTALTRPVASD

SEQ ID NO: 10842 - protein, 25 aa, synthetic construct
  source 1..25: note = Seed: LNVIVHSATGFKQSSKALQRPVASD
LNVIVHSATGYKQYSTALVRPVASD

SEQ ID NO: 10843 - protein, 25 aa, synthetic construct
  source 1..25: note = Seed: LNVIVHSATGFKQSSKALQRPVASD
LNVIVHSATGYKQYSVALHRPVASD

SEQ ID NO: 10844 - protein, 25 aa, synthetic construct
  source 1..25: note = Seed: LNVIVHSATGFKQSSKALQRPVASD
LNVIVHSATGYKQYSVALLRPVASD

SEQ ID NO: 10845 - protein, 25 aa, synthetic construct
  source 1..25: note = Seed: LNVIVHSATGFKQSSKALQRPVASD
LNVIVHSATGYKQYSVALQRPVASD

SEQ ID NO: 10846 - protein, 25 aa, synthetic construct
  source 1..25: note = Seed: LNVIVHSATGFKQSSKALQRPVASD
LNVIVHSATGFFQSAKFLQIPVASD

SEQ ID NO: 10847 - protein, 25 aa, synthetic construct
  source 1..25: note = Seed: LNVIVHSATGFKQSSKALQRPVASD
LNVIVHSATGFFQSAKFLQLPVASD

SEQ ID NO: 10848 - protein, 25 aa, synthetic construct
  source 1..25: note = Seed: LNVIVHSATGFKQSSKALQRPVASD
LNVIVHSATGFFQSAKFLQNPVASD

SEQ ID NO: 10849 - protein, 25 aa, synthetic construct
  source 1..25: note = Seed: LNVIVHSATGFKQSSKALQRPVASD
LNVIVHSATGFFQSAKFLQVPVASD

SEQ ID NO: 10850 - protein, 25 aa, synthetic construct
  source 1..25: note = Seed: LNVIVHSATGFKQSSKALQRPVASD
LNVIVHSATGFFQSEKFLQIPVASD

SEQ ID NO: 10851 - protein, 25 aa, synthetic construct
  source 1..25: note = Seed: LNVIVHSATGFKQSSKALQRPVASD
LNVIVHSATGFFQSEKFLQLPVASD

SEQ ID NO: 10852 - protein, 25 aa, synthetic construct
  source 1..25: note = Seed: LNVIVHSATGFKQSSKALQRPVASD
LNVIVHSATGFFQSEKFLQVPVASD

SEQ ID NO: 10853 - protein, 25 aa, synthetic construct
  source 1..25: note = Seed: LNVIVHSATGFKQSSKALQRPVASD
LNVIVHSATGFFQSHKFLQAPVASD

SEQ ID NO: 10854 - protein, 25 aa, synthetic construct
  source 1..25: note = Seed: LNVIVHSATGFKQSSKALQRPVASD
LNVIVHSATGFFQSHKFLQDPVASD

SEQ ID NO: 10855 - protein, 25 aa, synthetic construct
  source 1..25: note = Seed: LNVIVHSATGFKQSSKALQRPVASD
LNVIVHSATGFFQSHKFLQEPVASD

SEQ ID NO: 10856 - protein, 25 aa, synthetic construct
  source 1..25: note = Seed: LNVIVHSATGFKQSSKALQRPVASD
LNVIVHSATGFFQSHKFLQFPVASD

SEQ ID NO: 10857 - protein, 25 aa, synthetic construct
  source 1..25: note = Seed: LNVIVHSATGFKQSSKALQRPVASD
LNVIVHSATGFFQSHKFLQHPVASD

SEQ ID NO: 10858 - protein, 25 aa, synthetic construct
  source 1..25: note = Seed: LNVIVHSATGFKQSSKALQRPVASD
LNVIVHSATGFFQSHKFLQIPVASD

SEQ ID NO: 10859 - protein, 25 aa, synthetic construct
  source 1..25: note = Seed: LNVIVHSATGFKQSSKALQRPVASD
LNVIVHSATGFFQSHKFLQKPVASD

SEQ ID NO: 10860 - protein, 25 aa, synthetic construct
  source 1..25: note = Seed: LNVIVHSATGFKQSSKALQRPVASD
LNVIVHSATGFFQSHKFLQLPVASD

SEQ ID NO: 10861 - protein, 25 aa, synthetic construct
  source 1..25: note = Seed: LNVIVHSATGFKQSSKALQRPVASD
LNVIVHSATGFFQSHKFLQMPVASD

SEQ ID NO: 10862 - protein, 25 aa, synthetic construct
  source 1..25: note = Seed: LNVIVHSATGFKQSSKALQRPVASD
LNVIVHSATGFFQSHKFLQNPVASD

SEQ ID NO: 10863 - protein, 25 aa, synthetic construct
  source 1..25: note = Seed: LNVIVHSATGFKQSSKALQRPVASD
LNVIVHSATGFFQSHKFLQQPVASD

SEQ ID NO: 10864 - protein, 25 aa, synthetic construct
  source 1..25: note = Seed: LNVIVHSATGFKQSSKALQRPVASD
LNVIVHSATGFFQSHKFLQRPVASD

SEQ ID NO: 10865 - protein, 25 aa, synthetic construct
  source 1..25: note = Seed: LNVIVHSATGFKQSSKALQRPVASD
LNVIVHSATGFFQSHKFLQSPVASD

SEQ ID NO: 10866 - protein, 25 aa, synthetic construct
  source 1..25: note = Seed: LNVIVHSATGFKQSSKALQRPVASD
LNVIVHSATGFFQSHKFLQTPVASD

SEQ ID NO: 10867 - protein, 25 aa, synthetic construct
  source 1..25: note = Seed: LNVIVHSATGFKQSSKALQRPVASD
LNVIVHSATGFFQSHKFLQVPVASD

SEQ ID NO: 10868 - protein, 25 aa, synthetic construct
  source 1..25: note = Seed: LNVIVHSATGFKQSSKALQRPVASD
LNVIVHSATGFFQSHKFLQYPVASD

SEQ ID NO: 10869 - protein, 25 aa, synthetic construct
  source 1..25: note = Seed: LNVIVHSATGFKQSSKALQRPVASD
LNVIVHSATGFFQSHKILQFPVASD

SEQ ID NO: 10870 - protein, 25 aa, synthetic construct
  source 1..25: note = Seed: LNVIVHSATGFKQSSKALQRPVASD
LNVIVHSATGFFQSHKILQIPVASD

SEQ ID NO: 10871 - protein, 25 aa, synthetic construct
  source 1..25: note = Seed: LNVIVHSATGFKQSSKALQRPVASD
LNVIVHSATGFFQSHKILQLPVASD

SEQ ID NO: 10872 - protein, 25 aa, synthetic construct
  source 1..25: note = Seed: LNVIVHSATGFKQSSKALQRPVASD
LNVIVHSATGFFQSHKILQVPVASD

SEQ ID NO: 10873 - protein, 25 aa, synthetic construct
  source 1..25: note = Seed: LNVIVHSATGFKQSSKALQRPVASD
LNVIVHSATGFFQSHKLLQFPVASD

SEQ ID NO: 10874 - protein, 25 aa, synthetic construct
  source 1..25: note = Seed: LNVIVHSATGFKQSSKALQRPVASD
LNVIVHSATGFFQSHKLLQIPVASD

SEQ ID NO: 10875 - protein, 25 aa, synthetic construct
  source 1..25: note = Seed: LNVIVHSATGFKQSSKALQRPVASD
LNVIVHSATGFFQSHKLLQLPVASD

SEQ ID NO: 10876 - protein, 25 aa, synthetic construct
  source 1..25: note = Seed: LNVIVHSATGFKQSSKALQRPVASD
LNVIVHSATGFFQSHKLLQMPVASD

SEQ ID NO: 10877 - protein, 25 aa, synthetic construct
  source 1..25: note = Seed: LNVIVHSATGFKQSSKALQRPVASD
LNVIVHSATGFFQSHKLLQVPVASD

SEQ ID NO: 10878 - protein, 25 aa, synthetic construct
  source 1..25: note = Seed: LNVIVHSATGFKQSSKALQRPVASD
LNVIVHSATGFFQSHKLLQYPVASD

SEQ ID NO: 10879 - protein, 25 aa, synthetic construct
  source 1..25: note = Seed: LNVIVHSATGFKQSSKALQRPVASD
LNVIVHSATGFFQSHKMLQIPVASD

SEQ ID NO: 10880 - protein, 25 aa, synthetic construct
  source 1..25: note = Seed: LNVIVHSATGFKQSSKALQRPVASD
LNVIVHSATGFFQSHKMLQLPVASD

SEQ ID NO: 10881 - protein, 25 aa, synthetic construct
  source 1..25: note = Seed: LNVIVHSATGFKQSSKALQRPVASD
LNVIVHSATGFFQSHKMLQVPVASD

SEQ ID NO: 10882 - protein, 25 aa, synthetic construct
  source 1..25: note = Seed: LNVIVHSATGFKQSSKALQRPVASD
LNVIVHSATGFFQSHKWLQFPVASD

SEQ ID NO: 10883 - protein, 25 aa, synthetic construct
  source 1..25: note = Seed: LNVIVHSATGFKQSSKALQRPVASD
LNVIVHSATGFFQSHKWLQIPVASD

SEQ ID NO: 10884 - protein, 25 aa, synthetic construct
  source 1..25: note = Seed: LNVIVHSATGFKQSSKALQRPVASD
LNVIVHSATGFFQSHKWLQLPVASD

SEQ ID NO: 10885 - protein, 25 aa, synthetic construct
  source 1..25: note = Seed: LNVIVHSATGFKQSSKALQRPVASD
LNVIVHSATGFFQSHKWLQMPVASD

SEQ ID NO: 10886 - protein, 25 aa, synthetic construct
  source 1..25: note = Seed: LNVIVHSATGFKQSSKALQRPVASD
LNVIVHSATGFFQSHKWLQVPVASD

SEQ ID NO: 10887 - protein, 25 aa, synthetic construct
  source 1..25: note = Seed: LNVIVHSATGFKQSSKALQRPVASD
LNVIVHSATGFFQSHKYLQFPVASD

SEQ ID NO: 10888 - protein, 25 aa, synthetic construct
  source 1..25: note = Seed: LNVIVHSATGFKQSSKALQRPVASD
LNVIVHSATGFFQSHKYLQIPVASD

SEQ ID NO: 10889 - protein, 25 aa, synthetic construct
  source 1..25: note = Seed: LNVIVHSATGFKQSSKALQRPVASD
LNVIVHSATGFFQSHKYLQLPVASD

SEQ ID NO: 10890 - protein, 25 aa, synthetic construct
  source 1..25: note = Seed: LNVIVHSATGFKQSSKALQRPVASD
LNVIVHSATGFFQSHKYLQMPVASD

SEQ ID NO: 10891 - protein, 25 aa, synthetic construct
  source 1..25: note = Seed: LNVIVHSATGFKQSSKALQRPVASD
LNVIVHSATGFFQSHKYLQVPVASD

SEQ ID NO: 10892 - protein, 25 aa, synthetic construct
  source 1..25: note = Seed: LNVIVHSATGFKQSSKALQRPVASD
LNVIVHSATGFFQSKKFLQFPVASD

SEQ ID NO: 10893 - protein, 25 aa, synthetic construct
  source 1..25: note = Seed: LNVIVHSATGFKQSSKALQRPVASD
LNVIVHSATGFFQSKKFLQIPVASD

SEQ ID NO: 10894 - protein, 25 aa, synthetic construct
  source 1..25: note = Seed: LNVIVHSATGFKQSSKALQRPVASD
LNVIVHSATGFFQSKKFLQLPVASD

SEQ ID NO: 10895 - protein, 25 aa, synthetic construct
  source 1..25: note = Seed: LNVIVHSATGFKQSSKALQRPVASD
LNVIVHSATGFFQSKKFLQMPVASD

SEQ ID NO: 10896 - protein, 25 aa, synthetic construct
  source 1..25: note = Seed: LNVIVHSATGFKQSSKALQRPVASD
LNVIVHSATGFFQSKKFLQTPVASD

SEQ ID NO: 10897 - protein, 25 aa, synthetic construct
  source 1..25: note = Seed: LNVIVHSATGFKQSSKALQRPVASD
LNVIVHSATGFFQSKKFLQVPVASD

SEQ ID NO: 10898 - protein, 25 aa, synthetic construct
  source 1..25: note = Seed: LNVIVHSATGFKQSSKALQRPVASD
LNVIVHSATGFFQSKKFLQYPVASD

SEQ ID NO: 10899 - protein, 25 aa, synthetic construct
  source 1..25: note = Seed: LNVIVHSATGFKQSSKALQRPVASD
LNVIVHSATGFFQSNKFLQFPVASD

SEQ ID NO: 10900 - protein, 25 aa, synthetic construct
  source 1..25: note = Seed: LNVIVHSATGFKQSSKALQRPVASD
LNVIVHSATGFFQSNKFLQIPVASD

SEQ ID NO: 10901 - protein, 25 aa, synthetic construct
  source 1..25: note = Seed: LNVIVHSATGFKQSSKALQRPVASD
LNVIVHSATGFFQSNKFLQLPVASD

SEQ ID NO: 10902 - protein, 25 aa, synthetic construct
  source 1..25: note = Seed: LNVIVHSATGFKQSSKALQRPVASD
LNVIVHSATGFFQSNKFLQMPVASD

SEQ ID NO: 10903 - protein, 25 aa, synthetic construct
  source 1..25: note = Seed: LNVIVHSATGFKQSSKALQRPVASD
LNVIVHSATGFFQSNKFLQVPVASD

SEQ ID NO: 10904 - protein, 25 aa, synthetic construct
  source 1..25: note = Seed: LNVIVHSATGFKQSSKALQRPVASD
LNVIVHSATGFFQSQKFLQIPVASD

SEQ ID NO: 10905 - protein, 25 aa, synthetic construct
  source 1..25: note = Seed: LNVIVHSATGFKQSSKALQRPVASD
LNVIVHSATGFFQSQKFLQLPVASD

SEQ ID NO: 10906 - protein, 25 aa, synthetic construct
  source 1..25: note = Seed: LNVIVHSATGFKQSSKALQRPVASD
LNVIVHSATGFFQSQKFLQVPVASD

SEQ ID NO: 10907 - protein, 25 aa, synthetic construct
  source 1..25: note = Seed: LNVIVHSATGFKQSSKALQRPVASD
LNVIVHSATGFFQSRKFLQIPVASD

SEQ ID NO: 10908 - protein, 25 aa, synthetic construct
  source 1..25: note = Seed: LNVIVHSATGFKQSSKALQRPVASD
LNVIVHSATGFFQSRKFLQLPVASD

SEQ ID NO: 10909 - protein, 25 aa, synthetic construct
  source 1..25: note = Seed: LNVIVHSATGFKQSSKALQRPVASD
LNVIVHSATGFFQSRKFLQVPVASD

SEQ ID NO: 10910 - protein, 25 aa, synthetic construct
  source 1..25: note = Seed: LNVIVHSATGFKQSSKALQRPVASD
LNVIVHSATGFFQSSKFLQAPVASD

SEQ ID NO: 10911 - protein, 25 aa, synthetic construct
  source 1..25: note = Seed: LNVIVHSATGFKQSSKALQRPVASD
LNVIVHSATGFFQSSKFLQFPVASD

SEQ ID NO: 10912 - protein, 25 aa, synthetic construct
  source 1..25: note = Seed: LNVIVHSATGFKQSSKALQRPVASD
LNVIVHSATGFFQSSKFLQHPVASD

SEQ ID NO: 10913 - protein, 25 aa, synthetic construct
  source 1..25: note = Seed: LNVIVHSATGFKQSSKALQRPVASD
LNVIVHSATGFFQSSKFLQIPVASD

SEQ ID NO: 10914 - protein, 25 aa, synthetic construct
  source 1..25: note = Seed: LNVIVHSATGFKQSSKALQRPVASD
LNVIVHSATGFFQSSKFLQLPVASD

SEQ ID NO: 10915 - protein, 25 aa, synthetic construct
  source 1..25: note = Seed: LNVIVHSATGFKQSSKALQRPVASD
LNVIVHSATGFFQSSKFLQMPVASD

SEQ ID NO: 10916 - protein, 25 aa, synthetic construct
  source 1..25: note = Seed: LNVIVHSATGFKQSSKALQRPVASD
LNVIVHSATGFFQSSKFLQNPVASD

SEQ ID NO: 10917 - protein, 25 aa, synthetic construct
  source 1..25: note = Seed: LNVIVHSATGFKQSSKALQRPVASD
LNVIVHSATGFFQSSKFLQSPVASD

SEQ ID NO: 10918 - protein, 25 aa, synthetic construct
  source 1..25: note = Seed: LNVIVHSATGFKQSSKALQRPVASD
LNVIVHSATGFFQSSKFLQTPVASD

SEQ ID NO: 10919 - protein, 25 aa, synthetic construct
  source 1..25: note = Seed: LNVIVHSATGFKQSSKALQRPVASD
LNVIVHSATGFFQSSKFLQVPVASD

SEQ ID NO: 10920 - protein, 25 aa, synthetic construct
  source 1..25: note = Seed: LNVIVHSATGFKQSSKALQRPVASD
LNVIVHSATGFFQSSKFLQYPVASD

SEQ ID NO: 10921 - protein, 25 aa, synthetic construct
  source 1..25: note = Seed: LNVIVHSATGFKQSSKALQRPVASD
LNVIVHSATGFFQSSKYLQIPVASD

SEQ ID NO: 10922 - protein, 25 aa, synthetic construct
  source 1..25: note = Seed: LNVIVHSATGFKQSSKALQRPVASD
LNVIVHSATGFFQSSKYLQLPVASD

SEQ ID NO: 10923 - protein, 25 aa, synthetic construct
  source 1..25: note = Seed: LNVIVHSATGFKQSSKALQRPVASD
LNVIVHSATGFFQSSKYLQVPVASD

SEQ ID NO: 10924 - protein, 25 aa, synthetic construct
  source 1..25: note = Seed: LNVIVHSATGFKQSSKALQRPVASD
LNVIVHSATGFFQSTKFLQAPVASD

SEQ ID NO: 10925 - protein, 25 aa, synthetic construct
  source 1..25: note = Seed: LNVIVHSATGFKQSSKALQRPVASD
LNVIVHSATGFFQSTKFLQFPVASD

SEQ ID NO: 10926 - protein, 25 aa, synthetic construct
  source 1..25: note = Seed: LNVIVHSATGFKQSSKALQRPVASD
LNVIVHSATGFFQSTKFLQHPVASD

SEQ ID NO: 10927 - protein, 25 aa, synthetic construct
  source 1..25: note = Seed: LNVIVHSATGFKQSSKALQRPVASD
LNVIVHSATGFFQSTKFLQIPVASD

SEQ ID NO: 10928 - protein, 25 aa, synthetic construct
  source 1..25: note = Seed: LNVIVHSATGFKQSSKALQRPVASD
LNVIVHSATGFFQSTKFLQLPVASD

SEQ ID NO: 10929 - protein, 25 aa, synthetic construct
  source 1..25: note = Seed: LNVIVHSATGFKQSSKALQRPVASD
LNVIVHSATGFFQSTKFLQMPVASD

SEQ ID NO: 10930 - protein, 25 aa, synthetic construct
  source 1..25: note = Seed: LNVIVHSATGFKQSSKALQRPVASD
LNVIVHSATGFFQSTKFLQNPVASD

SEQ ID NO: 10931 - protein, 25 aa, synthetic construct
  source 1..25: note = Seed: LNVIVHSATGFKQSSKALQRPVASD
LNVIVHSATGFFQSTKFLQRPVASD

SEQ ID NO: 10932 - protein, 25 aa, synthetic construct
  source 1..25: note = Seed: LNVIVHSATGFKQSSKALQRPVASD
LNVIVHSATGFFQSTKFLQSPVASD

SEQ ID NO: 10933 - protein, 25 aa, synthetic construct
  source 1..25: note = Seed: LNVIVHSATGFKQSSKALQRPVASD
LNVIVHSATGFFQSTKFLQTPVASD

SEQ ID NO: 10934 - protein, 25 aa, synthetic construct
  source 1..25: note = Seed: LNVIVHSATGFKQSSKALQRPVASD
LNVIVHSATGFFQSTKFLQVPVASD

SEQ ID NO: 10935 - protein, 25 aa, synthetic construct
  source 1..25: note = Seed: LNVIVHSATGFKQSSKALQRPVASD
LNVIVHSATGFFQSTKFLQYPVASD

SEQ ID NO: 10936 - protein, 25 aa, synthetic construct
  source 1..25: note = Seed: LNVIVHSATGFKQSSKALQRPVASD
LNVIVHSATGFFQSTKYLQIPVASD

SEQ ID NO: 10937 - protein, 25 aa, synthetic construct
  source 1..25: note = Seed: LNVIVHSATGFKQSSKALQRPVASD
LNVIVHSATGFFQSTKYLQLPVASD

SEQ ID NO: 10938 - protein, 25 aa, synthetic construct
  source 1..25: note = Seed: LNVIVHSATGFKQSSKALQRPVASD
LNVIVHSATGFFQSTKYLQVPVASD

SEQ ID NO: 10939 - protein, 25 aa, synthetic construct
  source 1..25: note = Seed: LNVIVHSATGFKQSSKALQRPVASD
LNVIVHSATGFIQSHKFLQAPVASD

SEQ ID NO: 10940 - protein, 25 aa, synthetic construct
  source 1..25: note = Seed: LNVIVHSATGFKQSSKALQRPVASD
LNVIVHSATGFIQSHKFLQFPVASD

SEQ ID NO: 10941 - protein, 25 aa, synthetic construct
  source 1..25: note = Seed: LNVIVHSATGFKQSSKALQRPVASD
LNVIVHSATGFIQSHKFLQIPVASD

SEQ ID NO: 10942 - protein, 25 aa, synthetic construct
  source 1..25: note = Seed: LNVIVHSATGFKQSSKALQRPVASD
LNVIVHSATGFIQSHKFLQLPVASD

SEQ ID NO: 10943 - protein, 25 aa, synthetic construct
  source 1..25: note = Seed: LNVIVHSATGFKQSSKALQRPVASD
LNVIVHSATGFIQSHKFLQMPVASD

SEQ ID NO: 10944 - protein, 25 aa, synthetic construct
  source 1..25: note = Seed: LNVIVHSATGFKQSSKALQRPVASD
LNVIVHSATGFIQSHKFLQNPVASD

SEQ ID NO: 10945 - protein, 25 aa, synthetic construct
  source 1..25: note = Seed: LNVIVHSATGFKQSSKALQRPVASD
LNVIVHSATGFIQSHKFLQSPVASD

SEQ ID NO: 10946 - protein, 25 aa, synthetic construct
  source 1..25: note = Seed: LNVIVHSATGFKQSSKALQRPVASD
LNVIVHSATGFIQSHKFLQTPVASD

SEQ ID NO: 10947 - protein, 25 aa, synthetic construct
  source 1..25: note = Seed: LNVIVHSATGFKQSSKALQRPVASD
LNVIVHSATGFIQSHKFLQVPVASD

SEQ ID NO: 10948 - protein, 25 aa, synthetic construct
  source 1..25: note = Seed: LNVIVHSATGFKQSSKALQRPVASD
LNVIVHSATGFIQSHKFLQYPVASD

SEQ ID NO: 10949 - protein, 25 aa, synthetic construct
  source 1..25: note = Seed: LNVIVHSATGFKQSSKALQRPVASD
LNVIVHSATGFIQSHKYLQIPVASD

SEQ ID NO: 10950 - protein, 25 aa, synthetic construct
  source 1..25: note = Seed: LNVIVHSATGFKQSSKALQRPVASD
LNVIVHSATGFIQSNKFLQIPVASD

SEQ ID NO: 10951 - protein, 25 aa, synthetic construct
  source 1..25: note = Seed: LNVIVHSATGFKQSSKALQRPVASD
LNVIVHSATGFIQSSKFLQIPVASD

SEQ ID NO: 10952 - protein, 25 aa, synthetic construct
  source 1..25: note = Seed: LNVIVHSATGFKQSSKALQRPVASD
LNVIVHSATGFIQSSKFLQLPVASD

SEQ ID NO: 10953 - protein, 25 aa, synthetic construct
  source 1..25: note = Seed: LNVIVHSATGFKQSSKALQRPVASD
LNVIVHSATGFIQSSKFLQVPVASD

SEQ ID NO: 10954 - protein, 25 aa, synthetic construct
  source 1..25: note = Seed: LNVIVHSATGFKQSSKALQRPVASD
LNVIVHSATGFIQSTKFLQVPVASD

SEQ ID NO: 10955 - protein, 25 aa, synthetic construct
  source 1..25: note = Seed: LNVIVHSATGFKQSSKALQRPVASD
LNVIVHSATGFLQSHKFLQAPVASD

SEQ ID NO: 10956 - protein, 25 aa, synthetic construct
  source 1..25: note = Seed: LNVIVHSATGFKQSSKALQRPVASD
LNVIVHSATGFLQSHKFLQFPVASD

SEQ ID NO: 10957 - protein, 25 aa, synthetic construct
  source 1..25: note = Seed: LNVIVHSATGFKQSSKALQRPVASD
LNVIVHSATGFLQSHKFLQIPVASD

SEQ ID NO: 10958 - protein, 25 aa, synthetic construct
  source 1..25: note = Seed: LNVIVHSATGFKQSSKALQRPVASD
LNVIVHSATGFLQSHKFLQLPVASD

SEQ ID NO: 10959 - protein, 25 aa, synthetic construct
  source 1..25: note = Seed: LNVIVHSATGFKQSSKALQRPVASD
LNVIVHSATGFLQSHKFLQMPVASD

SEQ ID NO: 10960 - protein, 25 aa, synthetic construct
  source 1..25: note = Seed: LNVIVHSATGFKQSSKALQRPVASD
LNVIVHSATGFLQSHKFLQNPVASD

SEQ ID NO: 10961 - protein, 25 aa, synthetic construct
  source 1..25: note = Seed: LNVIVHSATGFKQSSKALQRPVASD
LNVIVHSATGFLQSHKFLQSPVASD

SEQ ID NO: 10962 - protein, 25 aa, synthetic construct
  source 1..25: note = Seed: LNVIVHSATGFKQSSKALQRPVASD
LNVIVHSATGFLQSHKFLQTPVASD

SEQ ID NO: 10963 - protein, 25 aa, synthetic construct
  source 1..25: note = Seed: LNVIVHSATGFKQSSKALQRPVASD
LNVIVHSATGFLQSHKFLQVPVASD

SEQ ID NO: 10964 - protein, 25 aa, synthetic construct
  source 1..25: note = Seed: LNVIVHSATGFKQSSKALQRPVASD
LNVIVHSATGFLQSHKFLQYPVASD

SEQ ID NO: 10965 - protein, 25 aa, synthetic construct
  source 1..25: note = Seed: LNVIVHSATGFKQSSKALQRPVASD
LNVIVHSATGFLQSHKYLQIPVASD

SEQ ID NO: 10966 - protein, 25 aa, synthetic construct
  source 1..25: note = Seed: LNVIVHSATGFKQSSKALQRPVASD
LNVIVHSATGFLQSHKYLQLPVASD

SEQ ID NO: 10967 - protein, 25 aa, synthetic construct
  source 1..25: note = Seed: LNVIVHSATGFKQSSKALQRPVASD
LNVIVHSATGFLQSHKYLQVPVASD

SEQ ID NO: 10968 - protein, 25 aa, synthetic construct
  source 1..25: note = Seed: LNVIVHSATGFKQSSKALQRPVASD
LNVIVHSATGFLQSKKFLQIPVASD

SEQ ID NO: 10969 - protein, 25 aa, synthetic construct
  source 1..25: note = Seed: LNVIVHSATGFKQSSKALQRPVASD
LNVIVHSATGFLQSKKFLQLPVASD

SEQ ID NO: 10970 - protein, 25 aa, synthetic construct
  source 1..25: note = Seed: LNVIVHSATGFKQSSKALQRPVASD
LNVIVHSATGFLQSKKFLQVPVASD

SEQ ID NO: 10971 - protein, 25 aa, synthetic construct
  source 1..25: note = Seed: LNVIVHSATGFKQSSKALQRPVASD
LNVIVHSATGFLQSNKFLQIPVASD

SEQ ID NO: 10972 - protein, 25 aa, synthetic construct
  source 1..25: note = Seed: LNVIVHSATGFKQSSKALQRPVASD
LNVIVHSATGFLQSNKFLQLPVASD

SEQ ID NO: 10973 - protein, 25 aa, synthetic construct
  source 1..25: note = Seed: LNVIVHSATGFKQSSKALQRPVASD
LNVIVHSATGFLQSNKFLQVPVASD

SEQ ID NO: 10974 - protein, 25 aa, synthetic construct
  source 1..25: note = Seed: LNVIVHSATGFKQSSKALQRPVASD
LNVIVHSATGFLQSSKFLQIPVASD

SEQ ID NO: 10975 - protein, 25 aa, synthetic construct
  source 1..25: note = Seed: LNVIVHSATGFKQSSKALQRPVASD
LNVIVHSATGFLQSSKFLQLPVASD

SEQ ID NO: 10976 - protein, 25 aa, synthetic construct
  source 1..25: note = Seed: LNVIVHSATGFKQSSKALQRPVASD
LNVIVHSATGFLQSSKFLQVPVASD

SEQ ID NO: 10977 - protein, 25 aa, synthetic construct
  source 1..25: note = Seed: LNVIVHSATGFKQSSKALQRPVASD
LNVIVHSATGFLQSTKFLQIPVASD

SEQ ID NO: 10978 - protein, 25 aa, synthetic construct
  source 1..25: note = Seed: LNVIVHSATGFKQSSKALQRPVASD
LNVIVHSATGFLQSTKFLQLPVASD

SEQ ID NO: 10979 - protein, 25 aa, synthetic construct
  source 1..25: note = Seed: LNVIVHSATGFKQSSKALQRPVASD
LNVIVHSATGFLQSTKFLQVPVASD

SEQ ID NO: 10980 - protein, 25 aa, synthetic construct
  source 1..25: note = Seed: LNVIVHSATGFKQSSKALQRPVASD
LNVIVHSATGFMQSHKFLQFPVASD

SEQ ID NO: 10981 - protein, 25 aa, synthetic construct
  source 1..25: note = Seed: LNVIVHSATGFKQSSKALQRPVASD
LNVIVHSATGFMQSHKFLQIPVASD

SEQ ID NO: 10982 - protein, 25 aa, synthetic construct
  source 1..25: note = Seed: LNVIVHSATGFKQSSKALQRPVASD
LNVIVHSATGFMQSHKFLQLPVASD

SEQ ID NO: 10983 - protein, 25 aa, synthetic construct
  source 1..25: note = Seed: LNVIVHSATGFKQSSKALQRPVASD
LNVIVHSATGFMQSHKFLQVPVASD

SEQ ID NO: 10984 - protein, 25 aa, synthetic construct
  source 1..25: note = Seed: LNVIVHSATGFKQSSKALQRPVASD
LNVIVHSATGFVQSHKFLQIPVASD

SEQ ID NO: 10985 - protein, 25 aa, synthetic construct
  source 1..25: note = Seed: LNVIVHSATGFKQSSKALQRPVASD
LNVIVHSATGFVQSHKFLQLPVASD

SEQ ID NO: 10986 - protein, 25 aa, synthetic construct
  source 1..25: note = Seed: LNVIVHSATGFKQSSKALQRPVASD
LNVIVHSATGFVQSHKFLQMPVASD

SEQ ID NO: 10987 - protein, 25 aa, synthetic construct
  source 1..25: note = Seed: LNVIVHSATGFKQSSKALQRPVASD
LNVIVHSATGFVQSHKFLQVPVASD

SEQ ID NO: 10988 - protein, 25 aa, synthetic construct
  source 1..25: note = Seed: LNVIVHSATGFKQSSKALQRPVASD
LNVIVHSATGFWQSHKFLQIPVASD

SEQ ID NO: 10989 - protein, 25 aa, synthetic construct
  source 1..25: note = Seed: LNVIVHSATGFKQSSKALQRPVASD
LNVIVHSATGFWQSHKFLQLPVASD

SEQ ID NO: 10990 - protein, 25 aa, synthetic construct
  source 1..25: note = Seed: LNVIVHSATGFKQSSKALQRPVASD
LNVIVHSATGFWQSHKFLQVPVASD

SEQ ID NO: 10991 - protein, 25 aa, synthetic construct
  source 1..25: note = Seed: LNVIVHSATGFKQSSKALQRPVASD
LNVIVHSATGFYQSHKFLQFPVASD

SEQ ID NO: 10992 - protein, 25 aa, synthetic construct
  source 1..25: note = Seed: LNVIVHSATGFKQSSKALQRPVASD
LNVIVHSATGFYQSHKFLQIPVASD

SEQ ID NO: 10993 - protein, 25 aa, synthetic construct
  source 1..25: note = Seed: LNVIVHSATGFKQSSKALQRPVASD
LNVIVHSATGFYQSHKFLQLPVASD

SEQ ID NO: 10994 - protein, 25 aa, synthetic construct
  source 1..25: note = Seed: LNVIVHSATGFKQSSKALQRPVASD
LNVIVHSATGFYQSHKFLQMPVASD

SEQ ID NO: 10995 - protein, 25 aa, synthetic construct
  source 1..25: note = Seed: LNVIVHSATGFKQSSKALQRPVASD
LNVIVHSATGFYQSHKFLQVPVASD

SEQ ID NO: 10996 - protein, 25 aa, synthetic construct
  source 1..25: note = Seed: LNVIVHSATGFKQSSKALQRPVASD
LNVIVHSATGFYQSKKFLQLPVASD

SEQ ID NO: 10997 - protein, 25 aa, synthetic construct
  source 1..25: note = Seed: LNVIVHSATGFKQSSKALQRPVASD
LNVIVHSATGFYQSNKFLQIPVASD

SEQ ID NO: 10998 - protein, 25 aa, synthetic construct
  source 1..25: note = Seed: LNVIVHSATGFKQSSKALQRPVASD
LNVIVHSATGFYQSSKFLQIPVASD

SEQ ID NO: 10999 - protein, 25 aa, synthetic construct
  source 1..25: note = Seed: LNVIVHSATGFKQSSKALQRPVASD
LNVIVHSATGFYQSSKFLQLPVASD

SEQ ID NO: 11000 - protein, 25 aa, synthetic construct
  source 1..25: note = Seed: LNVIVHSATGFKQSSKALQRPVASD
LNVIVHSATGFYQSSKFLQVPVASD

SEQ ID NO: 11001 - protein, 25 aa, synthetic construct
  source 1..25: note = Seed: LNVIVHSATGFKQSSKALQRPVASD
LNVIVHSATGFYQSTKFLQIPVASD

SEQ ID NO: 11002 - protein, 25 aa, synthetic construct
  source 1..25: note = Seed: LNVIVHSATGFKQSSKALQRPVASD
LNVIVHSATGFYQSTKFLQLPVASD

SEQ ID NO: 11003 - protein, 25 aa, synthetic construct
  source 1..25: note = Seed: LNVIVHSATGFKQSSKALQRPVASD
LNVIVHSATGFYQSTKFLQVPVASD

SEQ ID NO: 11004 - protein, 20 aa, synthetic construct
  source 1..20: note = Seed: SATGFKQSSKALQRPVASDF
SATGAKQFSIALARPVASDF

SEQ ID NO: 11005 - protein, 20 aa, synthetic construct
  source 1..20: note = Seed: SATGFKQSSKALQRPVASDF
SATGAKQFSLALARPVASDF

SEQ ID NO: 11006 - protein, 20 aa, synthetic construct
  source 1..20: note = Seed: SATGFKQSSKALQRPVASDF
SATGAKQFSRALRRPVASDF

SEQ ID NO: 11007 - protein, 20 aa, synthetic construct
  source 1..20: note = Seed: SATGFKQSSKALQRPVASDF
SATGAKQFSVALARPVASDF

SEQ ID NO: 11008 - protein, 20 aa, synthetic construct
  source 1..20: note = Seed: SATGFKQSSKALQRPVASDF
SATGAKQLSAALIRPVASDF

SEQ ID NO: 11009 - protein, 20 aa, synthetic construct
  source 1..20: note = Seed: SATGFKQSSKALQRPVASDF
SATGAKQLSAALLRPVASDF

SEQ ID NO: 11010 - protein, 20 aa, synthetic construct
  source 1..20: note = Seed: SATGFKQSSKALQRPVASDF
SATGAKQLSAALMRPVASDF

SEQ ID NO: 11011 - protein, 20 aa, synthetic construct
  source 1..20: note = Seed: SATGFKQSSKALQRPVASDF
SATGAKQLSAALVRPVASDF

SEQ ID NO: 11012 - protein, 20 aa, synthetic construct
  source 1..20: note = Seed: SATGFKQSSKALQRPVASDF
SATGAKQLSGALIRPVASDF

SEQ ID NO: 11013 - protein, 20 aa, synthetic construct
  source 1..20: note = Seed: SATGFKQSSKALQRPVASDF
SATGAKQLSGALLRPVASDF

SEQ ID NO: 11014 - protein, 20 aa, synthetic construct
  source 1..20: note = Seed: SATGFKQSSKALQRPVASDF
SATGAKQLSGALVRPVASDF

SEQ ID NO: 11015 - protein, 20 aa, synthetic construct
  source 1..20: note = Seed: SATGFKQSSKALQRPVASDF
SATGAKQLSPALVRPVASDF

SEQ ID NO: 11016 - protein, 20 aa, synthetic construct
  source 1..20: note = Seed: SATGFKQSSKALQRPVASDF
SATGAKQLSSALLRPVASDF

SEQ ID NO: 11017 - protein, 20 aa, synthetic construct
  source 1..20: note = Seed: SATGFKQSSKALQRPVASDF
SATGAKQMSAALIRPVASDF

SEQ ID NO: 11018 - protein, 20 aa, synthetic construct
  source 1..20: note = Seed: SATGFKQSSKALQRPVASDF
SATGAKQMSAALLRPVASDF

SEQ ID NO: 11019 - protein, 20 aa, synthetic construct
  source 1..20: note = Seed: SATGFKQSSKALQRPVASDF
SATGAKQMSAALMRPVASDF

SEQ ID NO: 11020 - protein, 20 aa, synthetic construct
  source 1..20: note = Seed: SATGFKQSSKALQRPVASDF
SATGAKQMSAALVRPVASDF

SEQ ID NO: 11021 - protein, 20 aa, synthetic construct
  source 1..20: note = Seed: SATGFKQSSKALQRPVASDF
SATGAKQMSGALIRPVASDF

SEQ ID NO: 11022 - protein, 20 aa, synthetic construct
  source 1..20: note = Seed: SATGFKQSSKALQRPVASDF
SATGAKQMSGALLRPVASDF

SEQ ID NO: 11023 - protein, 20 aa, synthetic construct
  source 1..20: note = Seed: SATGFKQSSKALQRPVASDF
SATGAKQMSGALVRPVASDF

SEQ ID NO: 11024 - protein, 20 aa, synthetic construct
  source 1..20: note = Seed: SATGFKQSSKALQRPVASDF
SATGAKQMSSALIRPVASDF

SEQ ID NO: 11025 - protein, 20 aa, synthetic construct
  source 1..20: note = Seed: SATGFKQSSKALQRPVASDF
SATGAKQMSVALNRPVASDF

SEQ ID NO: 11026 - protein, 20 aa, synthetic construct
  source 1..20: note = Seed: SATGFKQSSKALQRPVASDF
SATGAKQYSIALARPVASDF

SEQ ID NO: 11027 - protein, 20 aa, synthetic construct
  source 1..20: note = Seed: SATGFKQSSKALQRPVASDF
SATGAKQYSLALARPVASDF

SEQ ID NO: 11028 - protein, 20 aa, synthetic construct
  source 1..20: note = Seed: SATGFKQSSKALQRPVASDF
SATGCKQASAALIRPVASDF

SEQ ID NO: 11029 - protein, 20 aa, synthetic construct
  source 1..20: note = Seed: SATGFKQSSKALQRPVASDF
SATGCKQASAALVRPVASDF

SEQ ID NO: 11030 - protein, 20 aa, synthetic construct
  source 1..20: note = Seed: SATGFKQSSKALQRPVASDF
SATGCKQISAALLRPVASDF

SEQ ID NO: 11031 - protein, 20 aa, synthetic construct
  source 1..20: note = Seed: SATGFKQSSKALQRPVASDF
SATGCKQISAALMRPVASDF

SEQ ID NO: 11032 - protein, 20 aa, synthetic construct
  source 1..20: note = Seed: SATGFKQSSKALQRPVASDF
SATGCKQISGALIRPVASDF

SEQ ID NO: 11033 - protein, 20 aa, synthetic construct
  source 1..20: note = Seed: SATGFKQSSKALQRPVASDF
SATGCKQISGALLRPVASDF

SEQ ID NO: 11034 - protein, 20 aa, synthetic construct
  source 1..20: note = Seed: SATGFKQSSKALQRPVASDF
SATGCKQISGALVRPVASDF

SEQ ID NO: 11035 - protein, 20 aa, synthetic construct
  source 1..20: note = Seed: SATGFKQSSKALQRPVASDF
SATGCKQISSALLRPVASDF

SEQ ID NO: 11036 - protein, 20 aa, synthetic construct
  source 1..20: note = Seed: SATGFKQSSKALQRPVASDF
SATGCKQLSAALIRPVASDF

SEQ ID NO: 11037 - protein, 20 aa, synthetic construct
  source 1..20: note = Seed: SATGFKQSSKALQRPVASDF
SATGCKQLSAALLRPVASDF

SEQ ID NO: 11038 - protein, 20 aa, synthetic construct
  source 1..20: note = Seed: SATGFKQSSKALQRPVASDF
SATGCKQLSAALMRPVASDF

SEQ ID NO: 11039 - protein, 20 aa, synthetic construct
  source 1..20: note = Seed: SATGFKQSSKALQRPVASDF
SATGCKQLSAALVRPVASDF

SEQ ID NO: 11040 - protein, 20 aa, synthetic construct
  source 1..20: note = Seed: SATGFKQSSKALQRPVASDF
SATGCKQLSGALIRPVASDF

SEQ ID NO: 11041 - protein, 20 aa, synthetic construct
  source 1..20: note = Seed: SATGFKQSSKALQRPVASDF
SATGCKQLSGALLRPVASDF

SEQ ID NO: 11042 - protein, 20 aa, synthetic construct
  source 1..20: note = Seed: SATGFKQSSKALQRPVASDF
SATGCKQLSGALMRPVASDF

SEQ ID NO: 11043 - protein, 20 aa, synthetic construct
  source 1..20: note = Seed: SATGFKQSSKALQRPVASDF
SATGCKQLSGALTRPVASDF

SEQ ID NO: 11044 - protein, 20 aa, synthetic construct
  source 1..20: note = Seed: SATGFKQSSKALQRPVASDF
SATGCKQLSGALVRPVASDF

SEQ ID NO: 11045 - protein, 20 aa, synthetic construct
  source 1..20: note = Seed: SATGFKQSSKALQRPVASDF
SATGCKQLSNALIRPVASDF

SEQ ID NO: 11046 - protein, 20 aa, synthetic construct
  source 1..20: note = Seed: SATGFKQSSKALQRPVASDF
SATGCKQLSNALVRPVASDF

SEQ ID NO: 11047 - protein, 20 aa, synthetic construct
  source 1..20: note = Seed: SATGFKQSSKALQRPVASDF
SATGCKQLSPALIRPVASDF

SEQ ID NO: 11048 - protein, 20 aa, synthetic construct
  source 1..20: note = Seed: SATGFKQSSKALQRPVASDF
SATGCKQLSPALLRPVASDF

SEQ ID NO: 11049 - protein, 20 aa, synthetic construct
  source 1..20: note = Seed: SATGFKQSSKALQRPVASDF
SATGCKQLSPALVRPVASDF

SEQ ID NO: 11050 - protein, 20 aa, synthetic construct
  source 1..20: note = Seed: SATGFKQSSKALQRPVASDF
SATGCKQLSSALIRPVASDF

SEQ ID NO: 11051 - protein, 20 aa, synthetic construct
  source 1..20: note = Seed: SATGFKQSSKALQRPVASDF
SATGCKQLSSALLRPVASDF

SEQ ID NO: 11052 - protein, 20 aa, synthetic construct
  source 1..20: note = Seed: SATGFKQSSKALQRPVASDF
SATGCKQLSSALMRPVASDF

SEQ ID NO: 11053 - protein, 20 aa, synthetic construct
  source 1..20: note = Seed: SATGFKQSSKALQRPVASDF
SATGCKQLSSALVRPVASDF

SEQ ID NO: 11054 - protein, 20 aa, synthetic construct
  source 1..20: note = Seed: SATGFKQSSKALQRPVASDF
SATGCKQLSTALIRPVASDF

SEQ ID NO: 11055 - protein, 20 aa, synthetic construct
  source 1..20: note = Seed: SATGFKQSSKALQRPVASDF
SATGCKQLSTALLRPVASDF

SEQ ID NO: 11056 - protein, 20 aa, synthetic construct
  source 1..20: note = Seed: SATGFKQSSKALQRPVASDF
SATGCKQLSTALVRPVASDF

SEQ ID NO: 11057 - protein, 20 aa, synthetic construct
  source 1..20: note = Seed: SATGFKQSSKALQRPVASDF
SATGCKQMSAALIRPVASDF

SEQ ID NO: 11058 - protein, 20 aa, synthetic construct
  source 1..20: note = Seed: SATGFKQSSKALQRPVASDF
SATGCKQMSAALLRPVASDF

SEQ ID NO: 11059 - protein, 20 aa, synthetic construct
  source 1..20: note = Seed: SATGFKQSSKALQRPVASDF
SATGCKQMSAALMRPVASDF

SEQ ID NO: 11060 - protein, 20 aa, synthetic construct
  source 1..20: note = Seed: SATGFKQSSKALQRPVASDF
SATGCKQMSAALTRPVASDF

SEQ ID NO: 11061 - protein, 20 aa, synthetic construct
  source 1..20: note = Seed: SATGFKQSSKALQRPVASDF
SATGCKQMSAALVRPVASDF

SEQ ID NO: 11062 - protein, 20 aa, synthetic construct
  source 1..20: note = Seed: SATGFKQSSKALQRPVASDF
SATGCKQMSGALARPVASDF

SEQ ID NO: 11063 - protein, 20 aa, synthetic construct
  source 1..20: note = Seed: SATGFKQSSKALQRPVASDF
SATGCKQMSGALIRPVASDF

SEQ ID NO: 11064 - protein, 20 aa, synthetic construct
  source 1..20: note = Seed: SATGFKQSSKALQRPVASDF
SATGCKQMSGALLRPVASDF

SEQ ID NO: 11065 - protein, 20 aa, synthetic construct
  source 1..20: note = Seed: SATGFKQSSKALQRPVASDF
SATGCKQMSGALMRPVASDF

SEQ ID NO: 11066 - protein, 20 aa, synthetic construct
  source 1..20: note = Seed: SATGFKQSSKALQRPVASDF
SATGCKQMSGALTRPVASDF

SEQ ID NO: 11067 - protein, 20 aa, synthetic construct
  source 1..20: note = Seed: SATGFKQSSKALQRPVASDF
SATGCKQMSGALVRPVASDF

SEQ ID NO: 11068 - protein, 20 aa, synthetic construct
  source 1..20: note = Seed: SATGFKQSSKALQRPVASDF
SATGCKQMSNALIRPVASDF

SEQ ID NO: 11069 - protein, 20 aa, synthetic construct
  source 1..20: note = Seed: SATGFKQSSKALQRPVASDF
SATGCKQMSNALVRPVASDF

SEQ ID NO: 11070 - protein, 20 aa, synthetic construct
  source 1..20: note = Seed: SATGFKQSSKALQRPVASDF
SATGCKQMSPALIRPVASDF

SEQ ID NO: 11071 - protein, 20 aa, synthetic construct
  source 1..20: note = Seed: SATGFKQSSKALQRPVASDF
SATGCKQMSPALLRPVASDF

SEQ ID NO: 11072 - protein, 20 aa, synthetic construct
  source 1..20: note = Seed: SATGFKQSSKALQRPVASDF
SATGCKQMSPALVRPVASDF

SEQ ID NO: 11073 - protein, 20 aa, synthetic construct
  source 1..20: note = Seed: SATGFKQSSKALQRPVASDF
SATGCKQMSSALIRPVASDF

SEQ ID NO: 11074 - protein, 20 aa, synthetic construct
  source 1..20: note = Seed: SATGFKQSSKALQRPVASDF
SATGCKQMSSALLRPVASDF

SEQ ID NO: 11075 - protein, 20 aa, synthetic construct
  source 1..20: note = Seed: SATGFKQSSKALQRPVASDF
SATGCKQMSSALMRPVASDF

SEQ ID NO: 11076 - protein, 20 aa, synthetic construct
  source 1..20: note = Seed: SATGFKQSSKALQRPVASDF
SATGCKQMSSALVRPVASDF

SEQ ID NO: 11077 - protein, 20 aa, synthetic construct
  source 1..20: note = Seed: SATGFKQSSKALQRPVASDF
SATGCKQMSTALIRPVASDF

SEQ ID NO: 11078 - protein, 20 aa, synthetic construct
  source 1..20: note = Seed: SATGFKQSSKALQRPVASDF
SATGCKQMSTALLRPVASDF

SEQ ID NO: 11079 - protein, 20 aa, synthetic construct
  source 1..20: note = Seed: SATGFKQSSKALQRPVASDF
SATGCKQMSTALVRPVASDF

SEQ ID NO: 11080 - protein, 20 aa, synthetic construct
  source 1..20: note = Seed: SATGFKQSSKALQRPVASDF
SATGCKQVSAALIRPVASDF

SEQ ID NO: 11081 - protein, 20 aa, synthetic construct
  source 1..20: note = Seed: SATGFKQSSKALQRPVASDF
SATGDKQLSAALIRPVASDF

SEQ ID NO: 11082 - protein, 20 aa, synthetic construct
  source 1..20: note = Seed: SATGFKQSSKALQRPVASDF
SATGEKQASFALARPVASDF

SEQ ID NO: 11083 - protein, 20 aa, synthetic construct
  source 1..20: note = Seed: SATGFKQSSKALQRPVASDF
SATGEKQFSIALARPVASDF

SEQ ID NO: 11084 - protein, 20 aa, synthetic construct
  source 1..20: note = Seed: SATGFKQSSKALQRPVASDF
SATGEKQFSLALARPVASDF

SEQ ID NO: 11085 - protein, 20 aa, synthetic construct
  source 1..20: note = Seed: SATGFKQSSKALQRPVASDF
SATGEKQFSVALARPVASDF

SEQ ID NO: 11086 - protein, 20 aa, synthetic construct
  source 1..20: note = Seed: SATGFKQSSKALQRPVASDF
SATGEKQLSAALIRPVASDF

SEQ ID NO: 11087 - protein, 20 aa, synthetic construct
  source 1..20: note = Seed: SATGFKQSSKALQRPVASDF
SATGEKQLSAALVRPVASDF

SEQ ID NO: 11088 - protein, 20 aa, synthetic construct
  source 1..20: note = Seed: SATGFKQSSKALQRPVASDF
SATGEKQLSSALIRPVASDF

SEQ ID NO: 11089 - protein, 20 aa, synthetic construct
  source 1..20: note = Seed: SATGFKQSSKALQRPVASDF
SATGEKQMSAALIRPVASDF

SEQ ID NO: 11090 - protein, 20 aa, synthetic construct
  source 1..20: note = Seed: SATGFKQSSKALQRPVASDF
SATGEKQMSAALVRPVASDF

SEQ ID NO: 11091 - protein, 20 aa, synthetic construct
  source 1..20: note = Seed: SATGFKQSSKALQRPVASDF
SATGEKQYSIALARPVASDF

SEQ ID NO: 11092 - protein, 20 aa, synthetic construct
  source 1..20: note = Seed: SATGFKQSSKALQRPVASDF
SATGEKQYSLALARPVASDF

SEQ ID NO: 11093 - protein, 20 aa, synthetic construct
  source 1..20: note = Seed: SATGFKQSSKALQRPVASDF
SATGFKQASAALARPVASDF

SEQ ID NO: 11094 - protein, 20 aa, synthetic construct
  source 1..20: note = Seed: SATGFKQSSKALQRPVASDF
SATGFKQASAALCRPVASDF

SEQ ID NO: 11095 - protein, 20 aa, synthetic construct
  source 1..20: note = Seed: SATGFKQSSKALQRPVASDF
SATGFKQASAALDRPVASDF

SEQ ID NO: 11096 - protein, 20 aa, synthetic construct
  source 1..20: note = Seed: SATGFKQSSKALQRPVASDF
SATGFKQASAALERPVASDF

SEQ ID NO: 11097 - protein, 20 aa, synthetic construct
  source 1..20: note = Seed: SATGFKQSSKALQRPVASDF
SATGFKQASAALFRPVASDF

SEQ ID NO: 11098 - protein, 20 aa, synthetic construct
  source 1..20: note = Seed: SATGFKQSSKALQRPVASDF
SATGFKQASAALGRPVASDF

SEQ ID NO: 11099 - protein, 20 aa, synthetic construct
  source 1..20: note = Seed: SATGFKQSSKALQRPVASDF
SATGFKQASAALHRPVASDF

SEQ ID NO: 11100 - protein, 20 aa, synthetic construct
  source 1..20: note = Seed: SATGFKQSSKALQRPVASDF
SATGFKQASAALIRPVASDF

SEQ ID NO: 11101 - protein, 20 aa, synthetic construct
  source 1..20: note = Seed: SATGFKQSSKALQRPVASDF
SATGFKQASAALKRPVASDF

SEQ ID NO: 11102 - protein, 20 aa, synthetic construct
  source 1..20: note = Seed: SATGFKQSSKALQRPVASDF
SATGFKQASAALLRPVASDF

SEQ ID NO: 11103 - protein, 20 aa, synthetic construct
  source 1..20: note = Seed: SATGFKQSSKALQRPVASDF
SATGFKQASAALMRPVASDF

SEQ ID NO: 11104 - protein, 20 aa, synthetic construct
  source 1..20: note = Seed: SATGFKQSSKALQRPVASDF
SATGFKQASAALNRPVASDF

SEQ ID NO: 11105 - protein, 20 aa, synthetic construct
  source 1..20: note = Seed: SATGFKQSSKALQRPVASDF
SATGFKQASAALPRPVASDF

SEQ ID NO: 11106 - protein, 20 aa, synthetic construct
  source 1..20: note = Seed: SATGFKQSSKALQRPVASDF
SATGFKQASAALQRPVASDF

SEQ ID NO: 11107 - protein, 20 aa, synthetic construct
  source 1..20: note = Seed: SATGFKQSSKALQRPVASDF
SATGFKQASAALRRPVASDF

SEQ ID NO: 11108 - protein, 20 aa, synthetic construct
  source 1..20: note = Seed: SATGFKQSSKALQRPVASDF
SATGFKQASAALSRPVASDF

SEQ ID NO: 11109 - protein, 20 aa, synthetic construct
  source 1..20: note = Seed: SATGFKQSSKALQRPVASDF
SATGFKQASAALTRPVASDF

SEQ ID NO: 11110 - protein, 20 aa, synthetic construct
  source 1..20: note = Seed: SATGFKQSSKALQRPVASDF
SATGFKQASAALVRPVASDF

SEQ ID NO: 11111 - protein, 20 aa, synthetic construct
  source 1..20: note = Seed: SATGFKQSSKALQRPVASDF
SATGFKQASAALWRPVASDF

SEQ ID NO: 11112 - protein, 20 aa, synthetic construct
  source 1..20: note = Seed: SATGFKQSSKALQRPVASDF
SATGFKQASAALYRPVASDF

SEQ ID NO: 11113 - protein, 20 aa, synthetic construct
  source 1..20: note = Seed: SATGFKQSSKALQRPVASDF
SATGFKQASCALARPVASDF

SEQ ID NO: 11114 - protein, 20 aa, synthetic construct
  source 1..20: note = Seed: SATGFKQSSKALQRPVASDF
SATGFKQASCALIRPVASDF

SEQ ID NO: 11115 - protein, 20 aa, synthetic construct
  source 1..20: note = Seed: SATGFKQSSKALQRPVASDF
SATGFKQASCALLRPVASDF

SEQ ID NO: 11116 - protein, 20 aa, synthetic construct
  source 1..20: note = Seed: SATGFKQSSKALQRPVASDF
SATGFKQASCALMRPVASDF

SEQ ID NO: 11117 - protein, 20 aa, synthetic construct
  source 1..20: note = Seed: SATGFKQSSKALQRPVASDF
SATGFKQASCALNRPVASDF

SEQ ID NO: 11118 - protein, 20 aa, synthetic construct
  source 1..20: note = Seed: SATGFKQSSKALQRPVASDF
SATGFKQASCALSRPVASDF

SEQ ID NO: 11119 - protein, 20 aa, synthetic construct
  source 1..20: note = Seed: SATGFKQSSKALQRPVASDF
SATGFKQASCALVRPVASDF

SEQ ID NO: 11120 - protein, 20 aa, synthetic construct
  source 1..20: note = Seed: SATGFKQSSKALQRPVASDF
SATGFKQASDALARPVASDF

SEQ ID NO: 11121 - protein, 20 aa, synthetic construct
  source 1..20: note = Seed: SATGFKQSSKALQRPVASDF
SATGFKQASDALIRPVASDF

SEQ ID NO: 11122 - protein, 20 aa, synthetic construct
  source 1..20: note = Seed: SATGFKQSSKALQRPVASDF
SATGFKQASDALNRPVASDF

SEQ ID NO: 11123 - protein, 20 aa, synthetic construct
  source 1..20: note = Seed: SATGFKQSSKALQRPVASDF
SATGFKQASDALSRPVASDF

SEQ ID NO: 11124 - protein, 20 aa, synthetic construct
  source 1..20: note = Seed: SATGFKQSSKALQRPVASDF
SATGFKQASDALVRPVASDF

SEQ ID NO: 11125 - protein, 20 aa, synthetic construct
  source 1..20: note = Seed: SATGFKQSSKALQRPVASDF
SATGFKQASEALARPVASDF

SEQ ID NO: 11126 - protein, 20 aa, synthetic construct
  source 1..20: note = Seed: SATGFKQSSKALQRPVASDF
SATGFKQASEALIRPVASDF

SEQ ID NO: 11127 - protein, 20 aa, synthetic construct
  source 1..20: note = Seed: SATGFKQSSKALQRPVASDF
SATGFKQASEALLRPVASDF

SEQ ID NO: 11128 - protein, 20 aa, synthetic construct
  source 1..20: note = Seed: SATGFKQSSKALQRPVASDF
SATGFKQASEALNRPVASDF

SEQ ID NO: 11129 - protein, 20 aa, synthetic construct
  source 1..20: note = Seed: SATGFKQSSKALQRPVASDF
SATGFKQASEALSRPVASDF

SEQ ID NO: 11130 - protein, 20 aa, synthetic construct
  source 1..20: note = Seed: SATGFKQSSKALQRPVASDF
SATGFKQASEALTRPVASDF

SEQ ID NO: 11131 - protein, 20 aa, synthetic construct
  source 1..20: note = Seed: SATGFKQSSKALQRPVASDF
SATGFKQASEALVRPVASDF

SEQ ID NO: 11132 - protein, 20 aa, synthetic construct
  source 1..20: note = Seed: SATGFKQSSKALQRPVASDF
SATGFKQASFALARPVASDF

SEQ ID NO: 11133 - protein, 20 aa, synthetic construct
  source 1..20: note = Seed: SATGFKQSSKALQRPVASDF
SATGFKQASFALDRPVASDF

SEQ ID NO: 11134 - protein, 20 aa, synthetic construct
  source 1..20: note = Seed: SATGFKQSSKALQRPVASDF
SATGFKQASFALERPVASDF

SEQ ID NO: 11135 - protein, 20 aa, synthetic construct
  source 1..20: note = Seed: SATGFKQSSKALQRPVASDF
SATGFKQASFALFRPVASDF

SEQ ID NO: 11136 - protein, 20 aa, synthetic construct
  source 1..20: note = Seed: SATGFKQSSKALQRPVASDF
SATGFKQASFALIRPVASDF

SEQ ID NO: 11137 - protein, 20 aa, synthetic construct
  source 1..20: note = Seed: SATGFKQSSKALQRPVASDF
SATGFKQASFALLRPVASDF

SEQ ID NO: 11138 - protein, 20 aa, synthetic construct
  source 1..20: note = Seed: SATGFKQSSKALQRPVASDF
SATGFKQASFALMRPVASDF

SEQ ID NO: 11139 - protein, 20 aa, synthetic construct
  source 1..20: note = Seed: SATGFKQSSKALQRPVASDF
SATGFKQASFALNRPVASDF

SEQ ID NO: 11140 - protein, 20 aa, synthetic construct
  source 1..20: note = Seed: SATGFKQSSKALQRPVASDF
SATGFKQASFALQRPVASDF

SEQ ID NO: 11141 - protein, 20 aa, synthetic construct
  source 1..20: note = Seed: SATGFKQSSKALQRPVASDF
SATGFKQASFALSRPVASDF

SEQ ID NO: 11142 - protein, 20 aa, synthetic construct
  source 1..20: note = Seed: SATGFKQSSKALQRPVASDF
SATGFKQASFALTRPVASDF

SEQ ID NO: 11143 - protein, 20 aa, synthetic construct
  source 1..20: note = Seed: SATGFKQSSKALQRPVASDF
SATGFKQASFALYRPVASDF

SEQ ID NO: 11144 - protein, 20 aa, synthetic construct
  source 1..20: note = Seed: SATGFKQSSKALQRPVASDF
SATGFKQASGALARPVASDF

SEQ ID NO: 11145 - protein, 20 aa, synthetic construct
  source 1..20: note = Seed: SATGFKQSSKALQRPVASDF
SATGFKQASGALCRPVASDF

SEQ ID NO: 11146 - protein, 20 aa, synthetic construct
  source 1..20: note = Seed: SATGFKQSSKALQRPVASDF
SATGFKQASGALDRPVASDF

SEQ ID NO: 11147 - protein, 20 aa, synthetic construct
  source 1..20: note = Seed: SATGFKQSSKALQRPVASDF
SATGFKQASGALERPVASDF

SEQ ID NO: 11148 - protein, 20 aa, synthetic construct
  source 1..20: note = Seed: SATGFKQSSKALQRPVASDF
SATGFKQASGALFRPVASDF

SEQ ID NO: 11149 - protein, 20 aa, synthetic construct
  source 1..20: note = Seed: SATGFKQSSKALQRPVASDF
SATGFKQASGALGRPVASDF

SEQ ID NO: 11150 - protein, 20 aa, synthetic construct
  source 1..20: note = Seed: SATGFKQSSKALQRPVASDF
SATGFKQASGALHRPVASDF

SEQ ID NO: 11151 - protein, 20 aa, synthetic construct
  source 1..20: note = Seed: SATGFKQSSKALQRPVASDF
SATGFKQASGALIRPVASDF

SEQ ID NO: 11152 - protein, 20 aa, synthetic construct
  source 1..20: note = Seed: SATGFKQSSKALQRPVASDF
SATGFKQASGALKRPVASDF

SEQ ID NO: 11153 - protein, 20 aa, synthetic construct
  source 1..20: note = Seed: SATGFKQSSKALQRPVASDF
SATGFKQASGALLRPVASDF

SEQ ID NO: 11154 - protein, 20 aa, synthetic construct
  source 1..20: note = Seed: SATGFKQSSKALQRPVASDF
SATGFKQASGALMRPVASDF

SEQ ID NO: 11155 - protein, 20 aa, synthetic construct
  source 1..20: note = Seed: SATGFKQSSKALQRPVASDF
SATGFKQASGALNRPVASDF

SEQ ID NO: 11156 - protein, 20 aa, synthetic construct
  source 1..20: note = Seed: SATGFKQSSKALQRPVASDF
SATGFKQASGALPRPVASDF

SEQ ID NO: 11157 - protein, 20 aa, synthetic construct
  source 1..20: note = Seed: SATGFKQSSKALQRPVASDF
SATGFKQASGALQRPVASDF

SEQ ID NO: 11158 - protein, 20 aa, synthetic construct
  source 1..20: note = Seed: SATGFKQSSKALQRPVASDF
SATGFKQASGALRRPVASDF

SEQ ID NO: 11159 - protein, 20 aa, synthetic construct
  source 1..20: note = Seed: SATGFKQSSKALQRPVASDF
SATGFKQASGALSRPVASDF

SEQ ID NO: 11160 - protein, 20 aa, synthetic construct
  source 1..20: note = Seed: SATGFKQSSKALQRPVASDF
SATGFKQASGALTRPVASDF

SEQ ID NO: 11161 - protein, 20 aa, synthetic construct
  source 1..20: note = Seed: SATGFKQSSKALQRPVASDF
SATGFKQASGALVRPVASDF

SEQ ID NO: 11162 - protein, 20 aa, synthetic construct
  source 1..20: note = Seed: SATGFKQSSKALQRPVASDF
SATGFKQASGALWRPVASDF

SEQ ID NO: 11163 - protein, 20 aa, synthetic construct
  source 1..20: note = Seed: SATGFKQSSKALQRPVASDF
SATGFKQASGALYRPVASDF

SEQ ID NO: 11164 - protein, 20 aa, synthetic construct
  source 1..20: note = Seed: SATGFKQSSKALQRPVASDF
SATGFKQASHALARPVASDF

SEQ ID NO: 11165 - protein, 20 aa, synthetic construct
  source 1..20: note = Seed: SATGFKQSSKALQRPVASDF
SATGFKQASHALGRPVASDF

SEQ ID NO: 11166 - protein, 20 aa, synthetic construct
  source 1..20: note = Seed: SATGFKQSSKALQRPVASDF
SATGFKQASHALIRPVASDF

SEQ ID NO: 11167 - protein, 20 aa, synthetic construct
  source 1..20: note = Seed: SATGFKQSSKALQRPVASDF
SATGFKQASHALLRPVASDF

SEQ ID NO: 11168 - protein, 20 aa, synthetic construct
  source 1..20: note = Seed: SATGFKQSSKALQRPVASDF
SATGFKQASHALMRPVASDF

SEQ ID NO: 11169 - protein, 20 aa, synthetic construct
  source 1..20: note = Seed: SATGFKQSSKALQRPVASDF
SATGFKQASHALNRPVASDF

SEQ ID NO: 11170 - protein, 20 aa, synthetic construct
  source 1..20: note = Seed: SATGFKQSSKALQRPVASDF
SATGFKQASHALSRPVASDF

SEQ ID NO: 11171 - protein, 20 aa, synthetic construct
  source 1..20: note = Seed: SATGFKQSSKALQRPVASDF
SATGFKQASHALTRPVASDF

SEQ ID NO: 11172 - protein, 20 aa, synthetic construct
  source 1..20: note = Seed: SATGFKQSSKALQRPVASDF
SATGFKQASHALVRPVASDF

SEQ ID NO: 11173 - protein, 20 aa, synthetic construct
  source 1..20: note = Seed: SATGFKQSSKALQRPVASDF
SATGFKQASIALARPVASDF

SEQ ID NO: 11174 - protein, 20 aa, synthetic construct
  source 1..20: note = Seed: SATGFKQSSKALQRPVASDF
SATGFKQASIALCRPVASDF

SEQ ID NO: 11175 - protein, 20 aa, synthetic construct
  source 1..20: note = Seed: SATGFKQSSKALQRPVASDF
SATGFKQASIALDRPVASDF

SEQ ID NO: 11176 - protein, 20 aa, synthetic construct
  source 1..20: note = Seed: SATGFKQSSKALQRPVASDF
SATGFKQASIALERPVASDF

SEQ ID NO: 11177 - protein, 20 aa, synthetic construct
  source 1..20: note = Seed: SATGFKQSSKALQRPVASDF
SATGFKQASIALGRPVASDF

SEQ ID NO: 11178 - protein, 20 aa, synthetic construct
  source 1..20: note = Seed: SATGFKQSSKALQRPVASDF
SATGFKQASIALHRPVASDF

SEQ ID NO: 11179 - protein, 20 aa, synthetic construct
  source 1..20: note = Seed: SATGFKQSSKALQRPVASDF
SATGFKQASIALIRPVASDF

SEQ ID NO: 11180 - protein, 20 aa, synthetic construct
  source 1..20: note = Seed: SATGFKQSSKALQRPVASDF
SATGFKQASIALKRPVASDF

SEQ ID NO: 11181 - protein, 20 aa, synthetic construct
  source 1..20: note = Seed: SATGFKQSSKALQRPVASDF
SATGFKQASIALLRPVASDF

SEQ ID NO: 11182 - protein, 20 aa, synthetic construct
  source 1..20: note = Seed: SATGFKQSSKALQRPVASDF
SATGFKQASIALMRPVASDF

SEQ ID NO: 11183 - protein, 20 aa, synthetic construct
  source 1..20: note = Seed: SATGFKQSSKALQRPVASDF
SATGFKQASIALNRPVASDF

SEQ ID NO: 11184 - protein, 20 aa, synthetic construct
  source 1..20: note = Seed: SATGFKQSSKALQRPVASDF
SATGFKQASIALPRPVASDF

SEQ ID NO: 11185 - protein, 20 aa, synthetic construct
  source 1..20: note = Seed: SATGFKQSSKALQRPVASDF
SATGFKQASIALQRPVASDF

SEQ ID NO: 11186 - protein, 20 aa, synthetic construct
  source 1..20: note = Seed: SATGFKQSSKALQRPVASDF
SATGFKQASIALRRPVASDF

SEQ ID NO: 11187 - protein, 20 aa, synthetic construct
  source 1..20: note = Seed: SATGFKQSSKALQRPVASDF
SATGFKQASIALSRPVASDF

SEQ ID NO: 11188 - protein, 20 aa, synthetic construct
  source 1..20: note = Seed: SATGFKQSSKALQRPVASDF
SATGFKQASIALTRPVASDF

SEQ ID NO: 11189 - protein, 20 aa, synthetic construct
  source 1..20: note = Seed: SATGFKQSSKALQRPVASDF
SATGFKQASIALVRPVASDF

SEQ ID NO: 11190 - protein, 20 aa, synthetic construct
  source 1..20: note = Seed: SATGFKQSSKALQRPVASDF
SATGFKQASIALYRPVASDF

SEQ ID NO: 11191 - protein, 20 aa, synthetic construct
  source 1..20: note = Seed: SATGFKQSSKALQRPVASDF
SATGFKQASKALARPVASDF

SEQ ID NO: 11192 - protein, 20 aa, synthetic construct
  source 1..20: note = Seed: SATGFKQSSKALQRPVASDF
SATGFKQASKALDRPVASDF

SEQ ID NO: 11193 - protein, 20 aa, synthetic construct
  source 1..20: note = Seed: SATGFKQSSKALQRPVASDF
SATGFKQASKALERPVASDF

SEQ ID NO: 11194 - protein, 20 aa, synthetic construct
  source 1..20: note = Seed: SATGFKQSSKALQRPVASDF
SATGFKQASKALFRPVASDF

SEQ ID NO: 11195 - protein, 20 aa, synthetic construct
  source 1..20: note = Seed: SATGFKQSSKALQRPVASDF
SATGFKQASKALGRPVASDF

SEQ ID NO: 11196 - protein, 20 aa, synthetic construct
  source 1..20: note = Seed: SATGFKQSSKALQRPVASDF
SATGFKQASKALHRPVASDF

SEQ ID NO: 11197 - protein, 20 aa, synthetic construct
  source 1..20: note = Seed: SATGFKQSSKALQRPVASDF
SATGFKQASKALIRPVASDF

SEQ ID NO: 11198 - protein, 20 aa, synthetic construct
  source 1..20: note = Seed: SATGFKQSSKALQRPVASDF
SATGFKQASKALKRPVASDF

SEQ ID NO: 11199 - protein, 20 aa, synthetic construct
  source 1..20: note = Seed: SATGFKQSSKALQRPVASDF
SATGFKQASKALLRPVASDF

SEQ ID NO: 11200 - protein, 20 aa, synthetic construct
  source 1..20: note = Seed: SATGFKQSSKALQRPVASDF
SATGFKQASKALMRPVASDF

SEQ ID NO: 11201 - protein, 20 aa, synthetic construct
  source 1..20: note = Seed: SATGFKQSSKALQRPVASDF
SATGFKQASKALNRPVASDF

SEQ ID NO: 11202 - protein, 20 aa, synthetic construct
  source 1..20: note = Seed: SATGFKQSSKALQRPVASDF
SATGFKQASKALPRPVASDF

SEQ ID NO: 11203 - protein, 20 aa, synthetic construct
  source 1..20: note = Seed: SATGFKQSSKALQRPVASDF
SATGFKQASKALQRPVASDF

SEQ ID NO: 11204 - protein, 20 aa, synthetic construct
  source 1..20: note = Seed: SATGFKQSSKALQRPVASDF
SATGFKQASKALRRPVASDF

SEQ ID NO: 11205 - protein, 20 aa, synthetic construct
  source 1..20: note = Seed: SATGFKQSSKALQRPVASDF
SATGFKQASKALSRPVASDF

SEQ ID NO: 11206 - protein, 20 aa, synthetic construct
  source 1..20: note = Seed: SATGFKQSSKALQRPVASDF
SATGFKQASKALTRPVASDF

SEQ ID NO: 11207 - protein, 20 aa, synthetic construct
  source 1..20: note = Seed: SATGFKQSSKALQRPVASDF
SATGFKQASKALVRPVASDF

SEQ ID NO: 11208 - protein, 20 aa, synthetic construct
  source 1..20: note = Seed: SATGFKQSSKALQRPVASDF
SATGFKQASKALWRPVASDF

SEQ ID NO: 11209 - protein, 20 aa, synthetic construct
  source 1..20: note = Seed: SATGFKQSSKALQRPVASDF
SATGFKQASKALYRPVASDF

SEQ ID NO: 11210 - protein, 20 aa, synthetic construct
  source 1..20: note = Seed: SATGFKQSSKALQRPVASDF
SATGFKQASLALARPVASDF

SEQ ID NO: 11211 - protein, 20 aa, synthetic construct
  source 1..20: note = Seed: SATGFKQSSKALQRPVASDF
SATGFKQASLALCRPVASDF

SEQ ID NO: 11212 - protein, 20 aa, synthetic construct
  source 1..20: note = Seed: SATGFKQSSKALQRPVASDF
SATGFKQASLALDRPVASDF

SEQ ID NO: 11213 - protein, 20 aa, synthetic construct
  source 1..20: note = Seed: SATGFKQSSKALQRPVASDF
SATGFKQASLALFRPVASDF

SEQ ID NO: 11214 - protein, 20 aa, synthetic construct
  source 1..20: note = Seed: SATGFKQSSKALQRPVASDF
SATGFKQASLALGRPVASDF

SEQ ID NO: 11215 - protein, 20 aa, synthetic construct
  source 1..20: note = Seed: SATGFKQSSKALQRPVASDF
SATGFKQASLALHRPVASDF

SEQ ID NO: 11216 - protein, 20 aa, synthetic construct
  source 1..20: note = Seed: SATGFKQSSKALQRPVASDF
SATGFKQASLALIRPVASDF

SEQ ID NO: 11217 - protein, 20 aa, synthetic construct
  source 1..20: note = Seed: SATGFKQSSKALQRPVASDF
SATGFKQASLALLRPVASDF

SEQ ID NO: 11218 - protein, 20 aa, synthetic construct
  source 1..20: note = Seed: SATGFKQSSKALQRPVASDF
SATGFKQASLALNRPVASDF

SEQ ID NO: 11219 - protein, 20 aa, synthetic construct
  source 1..20: note = Seed: SATGFKQSSKALQRPVASDF
SATGFKQASLALPRPVASDF

SEQ ID NO: 11220 - protein, 20 aa, synthetic construct
  source 1..20: note = Seed: SATGFKQSSKALQRPVASDF
SATGFKQASLALSRPVASDF

SEQ ID NO: 11221 - protein, 20 aa, synthetic construct
  source 1..20: note = Seed: SATGFKQSSKALQRPVASDF
SATGFKQASLALTRPVASDF

SEQ ID NO: 11222 - protein, 20 aa, synthetic construct
  source 1..20: note = Seed: SATGFKQSSKALQRPVASDF
SATGFKQASLALVRPVASDF

SEQ ID NO: 11223 - protein, 20 aa, synthetic construct
  source 1..20: note = Seed: SATGFKQSSKALQRPVASDF
SATGFKQASLALYRPVASDF

SEQ ID NO: 11224 - protein, 20 aa, synthetic construct
  source 1..20: note = Seed: SATGFKQSSKALQRPVASDF
SATGFKQASMALARPVASDF

SEQ ID NO: 11225 - protein, 20 aa, synthetic construct
  source 1..20: note = Seed: SATGFKQSSKALQRPVASDF
SATGFKQASMALDRPVASDF

SEQ ID NO: 11226 - protein, 20 aa, synthetic construct
  source 1..20: note = Seed: SATGFKQSSKALQRPVASDF
SATGFKQASMALGRPVASDF

SEQ ID NO: 11227 - protein, 20 aa, synthetic construct
  source 1..20: note = Seed: SATGFKQSSKALQRPVASDF
SATGFKQASMALHRPVASDF

SEQ ID NO: 11228 - protein, 20 aa, synthetic construct
  source 1..20: note = Seed: SATGFKQSSKALQRPVASDF
SATGFKQASMALIRPVASDF

SEQ ID NO: 11229 - protein, 20 aa, synthetic construct
  source 1..20: note = Seed: SATGFKQSSKALQRPVASDF
SATGFKQASMALNRPVASDF

SEQ ID NO: 11230 - protein, 20 aa, synthetic construct
  source 1..20: note = Seed: SATGFKQSSKALQRPVASDF
SATGFKQASMALPRPVASDF

SEQ ID NO: 11231 - protein, 20 aa, synthetic construct
  source 1..20: note = Seed: SATGFKQSSKALQRPVASDF
SATGFKQASMALQRPVASDF

SEQ ID NO: 11232 - protein, 20 aa, synthetic construct
  source 1..20: note = Seed: SATGFKQSSKALQRPVASDF
SATGFKQASMALSRPVASDF

SEQ ID NO: 11233 - protein, 20 aa, synthetic construct
  source 1..20: note = Seed: SATGFKQSSKALQRPVASDF
SATGFKQASMALTRPVASDF

SEQ ID NO: 11234 - protein, 20 aa, synthetic construct
  source 1..20: note = Seed: SATGFKQSSKALQRPVASDF
SATGFKQASMALVRPVASDF

SEQ ID NO: 11235 - protein, 20 aa, synthetic construct
  source 1..20: note = Seed: SATGFKQSSKALQRPVASDF
SATGFKQASMALYRPVASDF

SEQ ID NO: 11236 - protein, 20 aa, synthetic construct
  source 1..20: note = Seed: SATGFKQSSKALQRPVASDF
SATGFKQASNALARPVASDF

SEQ ID NO: 11237 - protein, 20 aa, synthetic construct
  source 1..20: note = Seed: SATGFKQSSKALQRPVASDF
SATGFKQASNALCRPVASDF

SEQ ID NO: 11238 - protein, 20 aa, synthetic construct
  source 1..20: note = Seed: SATGFKQSSKALQRPVASDF
SATGFKQASNALDRPVASDF

SEQ ID NO: 11239 - protein, 20 aa, synthetic construct
  source 1..20: note = Seed: SATGFKQSSKALQRPVASDF
SATGFKQASNALERPVASDF

SEQ ID NO: 11240 - protein, 20 aa, synthetic construct
  source 1..20: note = Seed: SATGFKQSSKALQRPVASDF
SATGFKQASNALFRPVASDF

SEQ ID NO: 11241 - protein, 20 aa, synthetic construct
  source 1..20: note = Seed: SATGFKQSSKALQRPVASDF
SATGFKQASNALGRPVASDF

SEQ ID NO: 11242 - protein, 20 aa, synthetic construct
  source 1..20: note = Seed: SATGFKQSSKALQRPVASDF
SATGFKQASNALHRPVASDF

SEQ ID NO: 11243 - protein, 20 aa, synthetic construct
  source 1..20: note = Seed: SATGFKQSSKALQRPVASDF
SATGFKQASNALIRPVASDF

SEQ ID NO: 11244 - protein, 20 aa, synthetic construct
  source 1..20: note = Seed: SATGFKQSSKALQRPVASDF
SATGFKQASNALLRPVASDF

SEQ ID NO: 11245 - protein, 20 aa, synthetic construct
  source 1..20: note = Seed: SATGFKQSSKALQRPVASDF
SATGFKQASNALMRPVASDF

SEQ ID NO: 11246 - protein, 20 aa, synthetic construct
  source 1..20: note = Seed: SATGFKQSSKALQRPVASDF
SATGFKQASNALNRPVASDF

SEQ ID NO: 11247 - protein, 20 aa, synthetic construct
  source 1..20: note = Seed: SATGFKQSSKALQRPVASDF
SATGFKQASNALPRPVASDF

SEQ ID NO: 11248 - protein, 20 aa, synthetic construct
  source 1..20: note = Seed: SATGFKQSSKALQRPVASDF
SATGFKQASNALQRPVASDF

SEQ ID NO: 11249 - protein, 20 aa, synthetic construct
  source 1..20: note = Seed: SATGFKQSSKALQRPVASDF
SATGFKQASNALSRPVASDF

SEQ ID NO: 11250 - protein, 20 aa, synthetic construct
  source 1..20: note = Seed: SATGFKQSSKALQRPVASDF
SATGFKQASNALTRPVASDF

SEQ ID NO: 11251 - protein, 20 aa, synthetic construct
  source 1..20: note = Seed: SATGFKQSSKALQRPVASDF
SATGFKQASNALVRPVASDF

SEQ ID NO: 11252 - protein, 20 aa, synthetic construct
  source 1..20: note = Seed: SATGFKQSSKALQRPVASDF
SATGFKQASNALYRPVASDF

SEQ ID NO: 11253 - protein, 20 aa, synthetic construct
  source 1..20: note = Seed: SATGFKQSSKALQRPVASDF
SATGFKQASPALARPVASDF

SEQ ID NO: 11254 - protein, 20 aa, synthetic construct
  source 1..20: note = Seed: SATGFKQSSKALQRPVASDF
SATGFKQASPALCRPVASDF

SEQ ID NO: 11255 - protein, 20 aa, synthetic construct
  source 1..20: note = Seed: SATGFKQSSKALQRPVASDF
SATGFKQASPALDRPVASDF

SEQ ID NO: 11256 - protein, 20 aa, synthetic construct
  source 1..20: note = Seed: SATGFKQSSKALQRPVASDF
SATGFKQASPALERPVASDF

SEQ ID NO: 11257 - protein, 20 aa, synthetic construct
  source 1..20: note = Seed: SATGFKQSSKALQRPVASDF
SATGFKQASPALFRPVASDF

SEQ ID NO: 11258 - protein, 20 aa, synthetic construct
  source 1..20: note = Seed: SATGFKQSSKALQRPVASDF
SATGFKQASPALGRPVASDF

SEQ ID NO: 11259 - protein, 20 aa, synthetic construct
  source 1..20: note = Seed: SATGFKQSSKALQRPVASDF
SATGFKQASPALHRPVASDF

SEQ ID NO: 11260 - protein, 20 aa, synthetic construct
  source 1..20: note = Seed: SATGFKQSSKALQRPVASDF
SATGFKQASPALIRPVASDF

SEQ ID NO: 11261 - protein, 20 aa, synthetic construct
  source 1..20: note = Seed: SATGFKQSSKALQRPVASDF
SATGFKQASPALKRPVASDF

SEQ ID NO: 11262 - protein, 20 aa, synthetic construct
  source 1..20: note = Seed: SATGFKQSSKALQRPVASDF
SATGFKQASPALLRPVASDF

SEQ ID NO: 11263 - protein, 20 aa, synthetic construct
  source 1..20: note = Seed: SATGFKQSSKALQRPVASDF
SATGFKQASPALMRPVASDF

SEQ ID NO: 11264 - protein, 20 aa, synthetic construct
  source 1..20: note = Seed: SATGFKQSSKALQRPVASDF
SATGFKQASPALNRPVASDF

SEQ ID NO: 11265 - protein, 20 aa, synthetic construct
  source 1..20: note = Seed: SATGFKQSSKALQRPVASDF
SATGFKQASPALPRPVASDF

SEQ ID NO: 11266 - protein, 20 aa, synthetic construct
  source 1..20: note = Seed: SATGFKQSSKALQRPVASDF
SATGFKQASPALQRPVASDF

SEQ ID NO: 11267 - protein, 20 aa, synthetic construct
  source 1..20: note = Seed: SATGFKQSSKALQRPVASDF
SATGFKQASPALRRPVASDF

SEQ ID NO: 11268 - protein, 20 aa, synthetic construct
  source 1..20: note = Seed: SATGFKQSSKALQRPVASDF
SATGFKQASPALSRPVASDF

SEQ ID NO: 11269 - protein, 20 aa, synthetic construct
  source 1..20: note = Seed: SATGFKQSSKALQRPVASDF
SATGFKQASPALTRPVASDF

SEQ ID NO: 11270 - protein, 20 aa, synthetic construct
  source 1..20: note = Seed: SATGFKQSSKALQRPVASDF
SATGFKQASPALVRPVASDF

SEQ ID NO: 11271 - protein, 20 aa, synthetic construct
  source 1..20: note = Seed: SATGFKQSSKALQRPVASDF
SATGFKQASPALWRPVASDF

SEQ ID NO: 11272 - protein, 20 aa, synthetic construct
  source 1..20: note = Seed: SATGFKQSSKALQRPVASDF
SATGFKQASPALYRPVASDF

SEQ ID NO: 11273 - protein, 20 aa, synthetic construct
  source 1..20: note = Seed: SATGFKQSSKALQRPVASDF
SATGFKQASQALARPVASDF

SEQ ID NO: 11274 - protein, 20 aa, synthetic construct
  source 1..20: note = Seed: SATGFKQSSKALQRPVASDF
SATGFKQASQALIRPVASDF

SEQ ID NO: 11275 - protein, 20 aa, synthetic construct
  source 1..20: note = Seed: SATGFKQSSKALQRPVASDF
SATGFKQASQALLRPVASDF

SEQ ID NO: 11276 - protein, 20 aa, synthetic construct
  source 1..20: note = Seed: SATGFKQSSKALQRPVASDF
SATGFKQASQALMRPVASDF

SEQ ID NO: 11277 - protein, 20 aa, synthetic construct
  source 1..20: note = Seed: SATGFKQSSKALQRPVASDF
SATGFKQASQALNRPVASDF

SEQ ID NO: 11278 - protein, 20 aa, synthetic construct
  source 1..20: note = Seed: SATGFKQSSKALQRPVASDF
SATGFKQASQALSRPVASDF

SEQ ID NO: 11279 - protein, 20 aa, synthetic construct
  source 1..20: note = Seed: SATGFKQSSKALQRPVASDF
SATGFKQASQALTRPVASDF

SEQ ID NO: 11280 - protein, 20 aa, synthetic construct
  source 1..20: note = Seed: SATGFKQSSKALQRPVASDF
SATGFKQASQALVRPVASDF

SEQ ID NO: 11281 - protein, 20 aa, synthetic construct
  source 1..20: note = Seed: SATGFKQSSKALQRPVASDF
SATGFKQASRALARPVASDF

SEQ ID NO: 11282 - protein, 20 aa, synthetic construct
  source 1..20: note = Seed: SATGFKQSSKALQRPVASDF
SATGFKQASRALDRPVASDF

SEQ ID NO: 11283 - protein, 20 aa, synthetic construct
  source 1..20: note = Seed: SATGFKQSSKALQRPVASDF
SATGFKQASRALERPVASDF

SEQ ID NO: 11284 - protein, 20 aa, synthetic construct
  source 1..20: note = Seed: SATGFKQSSKALQRPVASDF
SATGFKQASRALFRPVASDF

SEQ ID NO: 11285 - protein, 20 aa, synthetic construct
  source 1..20: note = Seed: SATGFKQSSKALQRPVASDF
SATGFKQASRALGRPVASDF

SEQ ID NO: 11286 - protein, 20 aa, synthetic construct
  source 1..20: note = Seed: SATGFKQSSKALQRPVASDF
SATGFKQASRALHRPVASDF

SEQ ID NO: 11287 - protein, 20 aa, synthetic construct
  source 1..20: note = Seed: SATGFKQSSKALQRPVASDF
SATGFKQASRALIRPVASDF

SEQ ID NO: 11288 - protein, 20 aa, synthetic construct
  source 1..20: note = Seed: SATGFKQSSKALQRPVASDF
SATGFKQASRALKRPVASDF

SEQ ID NO: 11289 - protein, 20 aa, synthetic construct
  source 1..20: note = Seed: SATGFKQSSKALQRPVASDF
SATGFKQASRALLRPVASDF

SEQ ID NO: 11290 - protein, 20 aa, synthetic construct
  source 1..20: note = Seed: SATGFKQSSKALQRPVASDF
SATGFKQASRALMRPVASDF

SEQ ID NO: 11291 - protein, 20 aa, synthetic construct
  source 1..20: note = Seed: SATGFKQSSKALQRPVASDF
SATGFKQASRALNRPVASDF

SEQ ID NO: 11292 - protein, 20 aa, synthetic construct
  source 1..20: note = Seed: SATGFKQSSKALQRPVASDF
SATGFKQASRALPRPVASDF

SEQ ID NO: 11293 - protein, 20 aa, synthetic construct
  source 1..20: note = Seed: SATGFKQSSKALQRPVASDF
SATGFKQASRALQRPVASDF

SEQ ID NO: 11294 - protein, 20 aa, synthetic construct
  source 1..20: note = Seed: SATGFKQSSKALQRPVASDF
SATGFKQASRALRRPVASDF

SEQ ID NO: 11295 - protein, 20 aa, synthetic construct
  source 1..20: note = Seed: SATGFKQSSKALQRPVASDF
SATGFKQASRALSRPVASDF

SEQ ID NO: 11296 - protein, 20 aa, synthetic construct
  source 1..20: note = Seed: SATGFKQSSKALQRPVASDF
SATGFKQASRALTRPVASDF

SEQ ID NO: 11297 - protein, 20 aa, synthetic construct
  source 1..20: note = Seed: SATGFKQSSKALQRPVASDF
SATGFKQASRALVRPVASDF

SEQ ID NO: 11298 - protein, 20 aa, synthetic construct
  source 1..20: note = Seed: SATGFKQSSKALQRPVASDF
SATGFKQASRALWRPVASDF

SEQ ID NO: 11299 - protein, 20 aa, synthetic construct
  source 1..20: note = Seed: SATGFKQSSKALQRPVASDF
SATGFKQASRALYRPVASDF

SEQ ID NO: 11300 - protein, 20 aa, synthetic construct
  source 1..20: note = Seed: SATGFKQSSKALQRPVASDF
SATGFKQASSALARPVASDF

SEQ ID NO: 11301 - protein, 20 aa, synthetic construct
  source 1..20: note = Seed: SATGFKQSSKALQRPVASDF
SATGFKQASSALCRPVASDF

SEQ ID NO: 11302 - protein, 20 aa, synthetic construct
  source 1..20: note = Seed: SATGFKQSSKALQRPVASDF
SATGFKQASSALDRPVASDF

SEQ ID NO: 11303 - protein, 20 aa, synthetic construct
  source 1..20: note = Seed: SATGFKQSSKALQRPVASDF
SATGFKQASSALERPVASDF

SEQ ID NO: 11304 - protein, 20 aa, synthetic construct
  source 1..20: note = Seed: SATGFKQSSKALQRPVASDF
SATGFKQASSALFRPVASDF

SEQ ID NO: 11305 - protein, 20 aa, synthetic construct
  source 1..20: note = Seed: SATGFKQSSKALQRPVASDF
SATGFKQASSALGRPVASDF

SEQ ID NO: 11306 - protein, 20 aa, synthetic construct
  source 1..20: note = Seed: SATGFKQSSKALQRPVASDF
SATGFKQASSALHRPVASDF

SEQ ID NO: 11307 - protein, 20 aa, synthetic construct
  source 1..20: note = Seed: SATGFKQSSKALQRPVASDF
SATGFKQASSALIRPVASDF

SEQ ID NO: 11308 - protein, 20 aa, synthetic construct
  source 1..20: note = Seed: SATGFKQSSKALQRPVASDF
SATGFKQASSALKRPVASDF

SEQ ID NO: 11309 - protein, 20 aa, synthetic construct
  source 1..20: note = Seed: SATGFKQSSKALQRPVASDF
SATGFKQASSALLRPVASDF

SEQ ID NO: 11310 - protein, 20 aa, synthetic construct
  source 1..20: note = Seed: SATGFKQSSKALQRPVASDF
SATGFKQASSALMRPVASDF

SEQ ID NO: 11311 - protein, 20 aa, synthetic construct
  source 1..20: note = Seed: SATGFKQSSKALQRPVASDF
SATGFKQASSALNRPVASDF

SEQ ID NO: 11312 - protein, 20 aa, synthetic construct
  source 1..20: note = Seed: SATGFKQSSKALQRPVASDF
SATGFKQASSALPRPVASDF

SEQ ID NO: 11313 - protein, 20 aa, synthetic construct
  source 1..20: note = Seed: SATGFKQSSKALQRPVASDF
SATGFKQASSALQRPVASDF

SEQ ID NO: 11314 - protein, 20 aa, synthetic construct
  source 1..20: note = Seed: SATGFKQSSKALQRPVASDF
SATGFKQASSALRRPVASDF

SEQ ID NO: 11315 - protein, 20 aa, synthetic construct
  source 1..20: note = Seed: SATGFKQSSKALQRPVASDF
SATGFKQASSALSRPVASDF

SEQ ID NO: 11316 - protein, 20 aa, synthetic construct
  source 1..20: note = Seed: SATGFKQSSKALQRPVASDF
SATGFKQASSALTRPVASDF

SEQ ID NO: 11317 - protein, 20 aa, synthetic construct
  source 1..20: note = Seed: SATGFKQSSKALQRPVASDF
SATGFKQASSALVRPVASDF

SEQ ID NO: 11318 - protein, 20 aa, synthetic construct
  source 1..20: note = Seed: SATGFKQSSKALQRPVASDF
SATGFKQASSALWRPVASDF

SEQ ID NO: 11319 - protein, 20 aa, synthetic construct
  source 1..20: note = Seed: SATGFKQSSKALQRPVASDF
SATGFKQASSALYRPVASDF

SEQ ID NO: 11320 - protein, 20 aa, synthetic construct
  source 1..20: note = Seed: SATGFKQSSKALQRPVASDF
SATGFKQASTALARPVASDF

SEQ ID NO: 11321 - protein, 20 aa, synthetic construct
  source 1..20: note = Seed: SATGFKQSSKALQRPVASDF
SATGFKQASTALCRPVASDF

SEQ ID NO: 11322 - protein, 20 aa, synthetic construct
  source 1..20: note = Seed: SATGFKQSSKALQRPVASDF
SATGFKQASTALDRPVASDF

SEQ ID NO: 11323 - protein, 20 aa, synthetic construct
  source 1..20: note = Seed: SATGFKQSSKALQRPVASDF
SATGFKQASTALERPVASDF

SEQ ID NO: 11324 - protein, 20 aa, synthetic construct
  source 1..20: note = Seed: SATGFKQSSKALQRPVASDF
SATGFKQASTALFRPVASDF

SEQ ID NO: 11325 - protein, 20 aa, synthetic construct
  source 1..20: note = Seed: SATGFKQSSKALQRPVASDF
SATGFKQASTALGRPVASDF

SEQ ID NO: 11326 - protein, 20 aa, synthetic construct
  source 1..20: note = Seed: SATGFKQSSKALQRPVASDF
SATGFKQASTALHRPVASDF

SEQ ID NO: 11327 - protein, 20 aa, synthetic construct
  source 1..20: note = Seed: SATGFKQSSKALQRPVASDF
SATGFKQASTALIRPVASDF

SEQ ID NO: 11328 - protein, 20 aa, synthetic construct
  source 1..20: note = Seed: SATGFKQSSKALQRPVASDF
SATGFKQASTALKRPVASDF

SEQ ID NO: 11329 - protein, 20 aa, synthetic construct
  source 1..20: note = Seed: SATGFKQSSKALQRPVASDF
SATGFKQASTALLRPVASDF

SEQ ID NO: 11330 - protein, 20 aa, synthetic construct
  source 1..20: note = Seed: SATGFKQSSKALQRPVASDF
SATGFKQASTALMRPVASDF

SEQ ID NO: 11331 - protein, 20 aa, synthetic construct
  source 1..20: note = Seed: SATGFKQSSKALQRPVASDF
SATGFKQASTALNRPVASDF

SEQ ID NO: 11332 - protein, 20 aa, synthetic construct
  source 1..20: note = Seed: SATGFKQSSKALQRPVASDF
SATGFKQASTALPRPVASDF

SEQ ID NO: 11333 - protein, 20 aa, synthetic construct
  source 1..20: note = Seed: SATGFKQSSKALQRPVASDF
SATGFKQASTALQRPVASDF

SEQ ID NO: 11334 - protein, 20 aa, synthetic construct
  source 1..20: note = Seed: SATGFKQSSKALQRPVASDF
SATGFKQASTALRRPVASDF

SEQ ID NO: 11335 - protein, 20 aa, synthetic construct
  source 1..20: note = Seed: SATGFKQSSKALQRPVASDF
SATGFKQASTALSRPVASDF

SEQ ID NO: 11336 - protein, 20 aa, synthetic construct
  source 1..20: note = Seed: SATGFKQSSKALQRPVASDF
SATGFKQASTALTRPVASDF

SEQ ID NO: 11337 - protein, 20 aa, synthetic construct
  source 1..20: note = Seed: SATGFKQSSKALQRPVASDF
SATGFKQASTALVRPVASDF

SEQ ID NO: 11338 - protein, 20 aa, synthetic construct
  source 1..20: note = Seed: SATGFKQSSKALQRPVASDF
SATGFKQASTALWRPVASDF

SEQ ID NO: 11339 - protein, 20 aa, synthetic construct
  source 1..20: note = Seed: SATGFKQSSKALQRPVASDF
SATGFKQASTALYRPVASDF

SEQ ID NO: 11340 - protein, 20 aa, synthetic construct
  source 1..20: note = Seed: SATGFKQSSKALQRPVASDF
SATGFKQASVALARPVASDF

SEQ ID NO: 11341 - protein, 20 aa, synthetic construct
  source 1..20: note = Seed: SATGFKQSSKALQRPVASDF
SATGFKQASVALCRPVASDF

SEQ ID NO: 11342 - protein, 20 aa, synthetic construct
  source 1..20: note = Seed: SATGFKQSSKALQRPVASDF
SATGFKQASVALDRPVASDF

SEQ ID NO: 11343 - protein, 20 aa, synthetic construct
  source 1..20: note = Seed: SATGFKQSSKALQRPVASDF
SATGFKQASVALERPVASDF

SEQ ID NO: 11344 - protein, 20 aa, synthetic construct
  source 1..20: note = Seed: SATGFKQSSKALQRPVASDF
SATGFKQASVALFRPVASDF

SEQ ID NO: 11345 - protein, 20 aa, synthetic construct
  source 1..20: note = Seed: SATGFKQSSKALQRPVASDF
SATGFKQASVALGRPVASDF

SEQ ID NO: 11346 - protein, 20 aa, synthetic construct
  source 1..20: note = Seed: SATGFKQSSKALQRPVASDF
SATGFKQASVALHRPVASDF

SEQ ID NO: 11347 - protein, 20 aa, synthetic construct
  source 1..20: note = Seed: SATGFKQSSKALQRPVASDF
SATGFKQASVALIRPVASDF

SEQ ID NO: 11348 - protein, 20 aa, synthetic construct
  source 1..20: note = Seed: SATGFKQSSKALQRPVASDF
SATGFKQASVALKRPVASDF

SEQ ID NO: 11349 - protein, 20 aa, synthetic construct
  source 1..20: note = Seed: SATGFKQSSKALQRPVASDF
SATGFKQASVALLRPVASDF

SEQ ID NO: 11350 - protein, 20 aa, synthetic construct
  source 1..20: note = Seed: SATGFKQSSKALQRPVASDF
SATGFKQASVALMRPVASDF

SEQ ID NO: 11351 - protein, 20 aa, synthetic construct
  source 1..20: note = Seed: SATGFKQSSKALQRPVASDF
SATGFKQASVALNRPVASDF

SEQ ID NO: 11352 - protein, 20 aa, synthetic construct
  source 1..20: note = Seed: SATGFKQSSKALQRPVASDF
SATGFKQASVALPRPVASDF

SEQ ID NO: 11353 - protein, 20 aa, synthetic construct
  source 1..20: note = Seed: SATGFKQSSKALQRPVASDF
SATGFKQASVALQRPVASDF

SEQ ID NO: 11354 - protein, 20 aa, synthetic construct
  source 1..20: note = Seed: SATGFKQSSKALQRPVASDF
SATGFKQASVALRRPVASDF

SEQ ID NO: 11355 - protein, 20 aa, synthetic construct
  source 1..20: note = Seed: SATGFKQSSKALQRPVASDF
SATGFKQASVALSRPVASDF

SEQ ID NO: 11356 - protein, 20 aa, synthetic construct
  source 1..20: note = Seed: SATGFKQSSKALQRPVASDF
SATGFKQASVALTRPVASDF

SEQ ID NO: 11357 - protein, 20 aa, synthetic construct
  source 1..20: note = Seed: SATGFKQSSKALQRPVASDF
SATGFKQASVALVRPVASDF

SEQ ID NO: 11358 - protein, 20 aa, synthetic construct
  source 1..20: note = Seed: SATGFKQSSKALQRPVASDF
SATGFKQASVALWRPVASDF

SEQ ID NO: 11359 - protein, 20 aa, synthetic construct
  source 1..20: note = Seed: SATGFKQSSKALQRPVASDF
SATGFKQASVALYRPVASDF

SEQ ID NO: 11360 - protein, 20 aa, synthetic construct
  source 1..20: note = Seed: SATGFKQSSKALQRPVASDF
SATGFKQASWALFRPVASDF

SEQ ID NO: 11361 - protein, 20 aa, synthetic construct
  source 1..20: note = Seed: SATGFKQSSKALQRPVASDF
SATGFKQASWALIRPVASDF

SEQ ID NO: 11362 - protein, 20 aa, synthetic construct
  source 1..20: note = Seed: SATGFKQSSKALQRPVASDF
SATGFKQASWALLRPVASDF

SEQ ID NO: 11363 - protein, 20 aa, synthetic construct
  source 1..20: note = Seed: SATGFKQSSKALQRPVASDF
SATGFKQASWALVRPVASDF

SEQ ID NO: 11364 - protein, 20 aa, synthetic construct
  source 1..20: note = Seed: SATGFKQSSKALQRPVASDF
SATGFKQASYALFRPVASDF

SEQ ID NO: 11365 - protein, 20 aa, synthetic construct
  source 1..20: note = Seed: SATGFKQSSKALQRPVASDF
SATGFKQASYALIRPVASDF

SEQ ID NO: 11366 - protein, 20 aa, synthetic construct
  source 1..20: note = Seed: SATGFKQSSKALQRPVASDF
SATGFKQASYALLRPVASDF

SEQ ID NO: 11367 - protein, 20 aa, synthetic construct
  source 1..20: note = Seed: SATGFKQSSKALQRPVASDF
SATGFKQASYALMRPVASDF

SEQ ID NO: 11368 - protein, 20 aa, synthetic construct
  source 1..20: note = Seed: SATGFKQSSKALQRPVASDF
SATGFKQASYALVRPVASDF

SEQ ID NO: 11369 - protein, 20 aa, synthetic construct
  source 1..20: note = Seed: SATGFKQSSKALQRPVASDF
SATGFKQCSAALARPVASDF

SEQ ID NO: 11370 - protein, 20 aa, synthetic construct
  source 1..20: note = Seed: SATGFKQSSKALQRPVASDF
SATGFKQCSAALFRPVASDF

SEQ ID NO: 11371 - protein, 20 aa, synthetic construct
  source 1..20: note = Seed: SATGFKQSSKALQRPVASDF
SATGFKQCSAALGRPVASDF

SEQ ID NO: 11372 - protein, 20 aa, synthetic construct
  source 1..20: note = Seed: SATGFKQSSKALQRPVASDF
SATGFKQCSAALIRPVASDF

SEQ ID NO: 11373 - protein, 20 aa, synthetic construct
  source 1..20: note = Seed: SATGFKQSSKALQRPVASDF
SATGFKQCSAALLRPVASDF

SEQ ID NO: 11374 - protein, 20 aa, synthetic construct
  source 1..20: note = Seed: SATGFKQSSKALQRPVASDF
SATGFKQCSAALMRPVASDF

SEQ ID NO: 11375 - protein, 20 aa, synthetic construct
  source 1..20: note = Seed: SATGFKQSSKALQRPVASDF
SATGFKQCSAALNRPVASDF

SEQ ID NO: 11376 - protein, 20 aa, synthetic construct
  source 1..20: note = Seed: SATGFKQSSKALQRPVASDF
SATGFKQCSAALPRPVASDF

SEQ ID NO: 11377 - protein, 20 aa, synthetic construct
  source 1..20: note = Seed: SATGFKQSSKALQRPVASDF
SATGFKQCSAALSRPVASDF

SEQ ID NO: 11378 - protein, 20 aa, synthetic construct
  source 1..20: note = Seed: SATGFKQSSKALQRPVASDF
SATGFKQCSAALTRPVASDF

SEQ ID NO: 11379 - protein, 20 aa, synthetic construct
  source 1..20: note = Seed: SATGFKQSSKALQRPVASDF
SATGFKQCSAALVRPVASDF

SEQ ID NO: 11380 - protein, 20 aa, synthetic construct
  source 1..20: note = Seed: SATGFKQSSKALQRPVASDF
SATGFKQCSFALFRPVASDF

SEQ ID NO: 11381 - protein, 20 aa, synthetic construct
  source 1..20: note = Seed: SATGFKQSSKALQRPVASDF
SATGFKQCSFALIRPVASDF

SEQ ID NO: 11382 - protein, 20 aa, synthetic construct
  source 1..20: note = Seed: SATGFKQSSKALQRPVASDF
SATGFKQCSFALLRPVASDF

SEQ ID NO: 11383 - protein, 20 aa, synthetic construct
  source 1..20: note = Seed: SATGFKQSSKALQRPVASDF
SATGFKQCSFALVRPVASDF

SEQ ID NO: 11384 - protein, 20 aa, synthetic construct
  source 1..20: note = Seed: SATGFKQSSKALQRPVASDF
SATGFKQCSGALARPVASDF

SEQ ID NO: 11385 - protein, 20 aa, synthetic construct
  source 1..20: note = Seed: SATGFKQSSKALQRPVASDF
SATGFKQCSGALIRPVASDF

SEQ ID NO: 11386 - protein, 20 aa, synthetic construct
  source 1..20: note = Seed: SATGFKQSSKALQRPVASDF
SATGFKQCSGALLRPVASDF

SEQ ID NO: 11387 - protein, 20 aa, synthetic construct
  source 1..20: note = Seed: SATGFKQSSKALQRPVASDF
SATGFKQCSGALMRPVASDF

SEQ ID NO: 11388 - protein, 20 aa, synthetic construct
  source 1..20: note = Seed: SATGFKQSSKALQRPVASDF
SATGFKQCSGALSRPVASDF

SEQ ID NO: 11389 - protein, 20 aa, synthetic construct
  source 1..20: note = Seed: SATGFKQSSKALQRPVASDF
SATGFKQCSGALTRPVASDF

SEQ ID NO: 11390 - protein, 20 aa, synthetic construct
  source 1..20: note = Seed: SATGFKQSSKALQRPVASDF
SATGFKQCSGALVRPVASDF

SEQ ID NO: 11391 - protein, 20 aa, synthetic construct
  source 1..20: note = Seed: SATGFKQSSKALQRPVASDF
SATGFKQCSIALARPVASDF

SEQ ID NO: 11392 - protein, 20 aa, synthetic construct
  source 1..20: note = Seed: SATGFKQSSKALQRPVASDF
SATGFKQCSIALGRPVASDF

SEQ ID NO: 11393 - protein, 20 aa, synthetic construct
  source 1..20: note = Seed: SATGFKQSSKALQRPVASDF
SATGFKQCSIALIRPVASDF

SEQ ID NO: 11394 - protein, 20 aa, synthetic construct
  source 1..20: note = Seed: SATGFKQSSKALQRPVASDF
SATGFKQCSIALNRPVASDF

SEQ ID NO: 11395 - protein, 20 aa, synthetic construct
  source 1..20: note = Seed: SATGFKQSSKALQRPVASDF
SATGFKQCSIALQRPVASDF

SEQ ID NO: 11396 - protein, 20 aa, synthetic construct
  source 1..20: note = Seed: SATGFKQSSKALQRPVASDF
SATGFKQCSIALSRPVASDF

SEQ ID NO: 11397 - protein, 20 aa, synthetic construct
  source 1..20: note = Seed: SATGFKQSSKALQRPVASDF
SATGFKQCSIALTRPVASDF

SEQ ID NO: 11398 - protein, 20 aa, synthetic construct
  source 1..20: note = Seed: SATGFKQSSKALQRPVASDF
SATGFKQCSIALVRPVASDF

SEQ ID NO: 11399 - protein, 20 aa, synthetic construct
  source 1..20: note = Seed: SATGFKQSSKALQRPVASDF
SATGFKQCSKALARPVASDF

SEQ ID NO: 11400 - protein, 20 aa, synthetic construct
  source 1..20: note = Seed: SATGFKQSSKALQRPVASDF
SATGFKQCSKALGRPVASDF

SEQ ID NO: 11401 - protein, 20 aa, synthetic construct
  source 1..20: note = Seed: SATGFKQSSKALQRPVASDF
SATGFKQCSKALSRPVASDF

SEQ ID NO: 11402 - protein, 20 aa, synthetic construct
  source 1..20: note = Seed: SATGFKQSSKALQRPVASDF
SATGFKQCSLALARPVASDF

SEQ ID NO: 11403 - protein, 20 aa, synthetic construct
  source 1..20: note = Seed: SATGFKQSSKALQRPVASDF
SATGFKQCSLALFRPVASDF

SEQ ID NO: 11404 - protein, 20 aa, synthetic construct
  source 1..20: note = Seed: SATGFKQSSKALQRPVASDF
SATGFKQCSLALIRPVASDF

SEQ ID NO: 11405 - protein, 20 aa, synthetic construct
  source 1..20: note = Seed: SATGFKQSSKALQRPVASDF
SATGFKQCSLALNRPVASDF

SEQ ID NO: 11406 - protein, 20 aa, synthetic construct
  source 1..20: note = Seed: SATGFKQSSKALQRPVASDF
SATGFKQCSLALSRPVASDF

SEQ ID NO: 11407 - protein, 20 aa, synthetic construct
  source 1..20: note = Seed: SATGFKQSSKALQRPVASDF
SATGFKQCSLALTRPVASDF

SEQ ID NO: 11408 - protein, 20 aa, synthetic construct
  source 1..20: note = Seed: SATGFKQSSKALQRPVASDF
SATGFKQCSLALVRPVASDF

SEQ ID NO: 11409 - protein, 20 aa, synthetic construct
  source 1..20: note = Seed: SATGFKQSSKALQRPVASDF
SATGFKQCSMALARPVASDF

SEQ ID NO: 11410 - protein, 20 aa, synthetic construct
  source 1..20: note = Seed: SATGFKQSSKALQRPVASDF
SATGFKQCSMALIRPVASDF

SEQ ID NO: 11411 - protein, 20 aa, synthetic construct
  source 1..20: note = Seed: SATGFKQSSKALQRPVASDF
SATGFKQCSMALSRPVASDF

SEQ ID NO: 11412 - protein, 20 aa, synthetic construct
  source 1..20: note = Seed: SATGFKQSSKALQRPVASDF
SATGFKQCSMALTRPVASDF

SEQ ID NO: 11413 - protein, 20 aa, synthetic construct
  source 1..20: note = Seed: SATGFKQSSKALQRPVASDF
SATGFKQCSMALVRPVASDF

SEQ ID NO: 11414 - protein, 20 aa, synthetic construct
  source 1..20: note = Seed: SATGFKQSSKALQRPVASDF
SATGFKQCSNALARPVASDF

SEQ ID NO: 11415 - protein, 20 aa, synthetic construct
  source 1..20: note = Seed: SATGFKQSSKALQRPVASDF
SATGFKQCSNALIRPVASDF

SEQ ID NO: 11416 - protein, 20 aa, synthetic construct
  source 1..20: note = Seed: SATGFKQSSKALQRPVASDF
SATGFKQCSNALLRPVASDF

SEQ ID NO: 11417 - protein, 20 aa, synthetic construct
  source 1..20: note = Seed: SATGFKQSSKALQRPVASDF
SATGFKQCSNALVRPVASDF

SEQ ID NO: 11418 - protein, 20 aa, synthetic construct
  source 1..20: note = Seed: SATGFKQSSKALQRPVASDF
SATGFKQCSPALARPVASDF

SEQ ID NO: 11419 - protein, 20 aa, synthetic construct
  source 1..20: note = Seed: SATGFKQSSKALQRPVASDF
SATGFKQCSPALIRPVASDF

SEQ ID NO: 11420 - protein, 20 aa, synthetic construct
  source 1..20: note = Seed: SATGFKQSSKALQRPVASDF
SATGFKQCSPALLRPVASDF

SEQ ID NO: 11421 - protein, 20 aa, synthetic construct
  source 1..20: note = Seed: SATGFKQSSKALQRPVASDF
SATGFKQCSPALMRPVASDF

SEQ ID NO: 11422 - protein, 20 aa, synthetic construct
  source 1..20: note = Seed: SATGFKQSSKALQRPVASDF
SATGFKQCSPALNRPVASDF

SEQ ID NO: 11423 - protein, 20 aa, synthetic construct
  source 1..20: note = Seed: SATGFKQSSKALQRPVASDF
SATGFKQCSPALSRPVASDF

SEQ ID NO: 11424 - protein, 20 aa, synthetic construct
  source 1..20: note = Seed: SATGFKQSSKALQRPVASDF
SATGFKQCSPALTRPVASDF

SEQ ID NO: 11425 - protein, 20 aa, synthetic construct
  source 1..20: note = Seed: SATGFKQSSKALQRPVASDF
SATGFKQCSPALVRPVASDF

SEQ ID NO: 11426 - protein, 20 aa, synthetic construct
  source 1..20: note = Seed: SATGFKQSSKALQRPVASDF
SATGFKQCSQALARPVASDF

SEQ ID NO: 11427 - protein, 20 aa, synthetic construct
  source 1..20: note = Seed: SATGFKQSSKALQRPVASDF
SATGFKQCSRALARPVASDF

SEQ ID NO: 11428 - protein, 20 aa, synthetic construct
  source 1..20: note = Seed: SATGFKQSSKALQRPVASDF
SATGFKQCSRALGRPVASDF

SEQ ID NO: 11429 - protein, 20 aa, synthetic construct
  source 1..20: note = Seed: SATGFKQSSKALQRPVASDF
SATGFKQCSRALQRPVASDF

SEQ ID NO: 11430 - protein, 20 aa, synthetic construct
  source 1..20: note = Seed: SATGFKQSSKALQRPVASDF
SATGFKQCSRALSRPVASDF

SEQ ID NO: 11431 - protein, 20 aa, synthetic construct
  source 1..20: note = Seed: SATGFKQSSKALQRPVASDF
SATGFKQCSRALTRPVASDF

SEQ ID NO: 11432 - protein, 20 aa, synthetic construct
  source 1..20: note = Seed: SATGFKQSSKALQRPVASDF
SATGFKQCSSALARPVASDF

SEQ ID NO: 11433 - protein, 20 aa, synthetic construct
  source 1..20: note = Seed: SATGFKQSSKALQRPVASDF
SATGFKQCSSALGRPVASDF

SEQ ID NO: 11434 - protein, 20 aa, synthetic construct
  source 1..20: note = Seed: SATGFKQSSKALQRPVASDF
SATGFKQCSSALIRPVASDF

SEQ ID NO: 11435 - protein, 20 aa, synthetic construct
  source 1..20: note = Seed: SATGFKQSSKALQRPVASDF
SATGFKQCSSALLRPVASDF

SEQ ID NO: 11436 - protein, 20 aa, synthetic construct
  source 1..20: note = Seed: SATGFKQSSKALQRPVASDF
SATGFKQCSSALMRPVASDF

SEQ ID NO: 11437 - protein, 20 aa, synthetic construct
  source 1..20: note = Seed: SATGFKQSSKALQRPVASDF
SATGFKQCSSALNRPVASDF

SEQ ID NO: 11438 - protein, 20 aa, synthetic construct
  source 1..20: note = Seed: SATGFKQSSKALQRPVASDF
SATGFKQCSSALSRPVASDF

SEQ ID NO: 11439 - protein, 20 aa, synthetic construct
  source 1..20: note = Seed: SATGFKQSSKALQRPVASDF
SATGFKQCSSALTRPVASDF

SEQ ID NO: 11440 - protein, 20 aa, synthetic construct
  source 1..20: note = Seed: SATGFKQSSKALQRPVASDF
SATGFKQCSSALVRPVASDF

SEQ ID NO: 11441 - protein, 20 aa, synthetic construct
  source 1..20: note = Seed: SATGFKQSSKALQRPVASDF
SATGFKQCSTALARPVASDF

SEQ ID NO: 11442 - protein, 20 aa, synthetic construct
  source 1..20: note = Seed: SATGFKQSSKALQRPVASDF
SATGFKQCSTALIRPVASDF

SEQ ID NO: 11443 - protein, 20 aa, synthetic construct
  source 1..20: note = Seed: SATGFKQSSKALQRPVASDF
SATGFKQCSTALLRPVASDF

SEQ ID NO: 11444 - protein, 20 aa, synthetic construct
  source 1..20: note = Seed: SATGFKQSSKALQRPVASDF
SATGFKQCSTALMRPVASDF

SEQ ID NO: 11445 - protein, 20 aa, synthetic construct
  source 1..20: note = Seed: SATGFKQSSKALQRPVASDF
SATGFKQCSTALNRPVASDF

SEQ ID NO: 11446 - protein, 20 aa, synthetic construct
  source 1..20: note = Seed: SATGFKQSSKALQRPVASDF
SATGFKQCSTALSRPVASDF

SEQ ID NO: 11447 - protein, 20 aa, synthetic construct
  source 1..20: note = Seed: SATGFKQSSKALQRPVASDF
SATGFKQCSTALVRPVASDF

SEQ ID NO: 11448 - protein, 20 aa, synthetic construct
  source 1..20: note = Seed: SATGFKQSSKALQRPVASDF
SATGFKQCSVALARPVASDF

SEQ ID NO: 11449 - protein, 20 aa, synthetic construct
  source 1..20: note = Seed: SATGFKQSSKALQRPVASDF
SATGFKQCSVALGRPVASDF

SEQ ID NO: 11450 - protein, 20 aa, synthetic construct
  source 1..20: note = Seed: SATGFKQSSKALQRPVASDF
SATGFKQCSVALIRPVASDF

SEQ ID NO: 11451 - protein, 20 aa, synthetic construct
  source 1..20: note = Seed: SATGFKQSSKALQRPVASDF
SATGFKQCSVALLRPVASDF

SEQ ID NO: 11452 - protein, 20 aa, synthetic construct
  source 1..20: note = Seed: SATGFKQSSKALQRPVASDF
SATGFKQCSVALMRPVASDF

SEQ ID NO: 11453 - protein, 20 aa, synthetic construct
  source 1..20: note = Seed: SATGFKQSSKALQRPVASDF
SATGFKQCSVALNRPVASDF

SEQ ID NO: 11454 - protein, 20 aa, synthetic construct
  source 1..20: note = Seed: SATGFKQSSKALQRPVASDF
SATGFKQCSVALQRPVASDF

SEQ ID NO: 11455 - protein, 20 aa, synthetic construct
  source 1..20: note = Seed: SATGFKQSSKALQRPVASDF
SATGFKQCSVALSRPVASDF

SEQ ID NO: 11456 - protein, 20 aa, synthetic construct
  source 1..20: note = Seed: SATGFKQSSKALQRPVASDF
SATGFKQCSVALTRPVASDF

SEQ ID NO: 11457 - protein, 20 aa, synthetic construct
  source 1..20: note = Seed: SATGFKQSSKALQRPVASDF
SATGFKQCSVALVRPVASDF

SEQ ID NO: 11458 - protein, 20 aa, synthetic construct
  source 1..20: note = Seed: SATGFKQSSKALQRPVASDF
SATGFKQDSAALARPVASDF

SEQ ID NO: 11459 - protein, 20 aa, synthetic construct
  source 1..20: note = Seed: SATGFKQSSKALQRPVASDF
SATGFKQDSAALIRPVASDF

SEQ ID NO: 11460 - protein, 20 aa, synthetic construct
  source 1..20: note = Seed: SATGFKQSSKALQRPVASDF
SATGFKQDSAALLRPVASDF

SEQ ID NO: 11461 - protein, 20 aa, synthetic construct
  source 1..20: note = Seed: SATGFKQSSKALQRPVASDF
SATGFKQDSAALMRPVASDF

SEQ ID NO: 11462 - protein, 20 aa, synthetic construct
  source 1..20: note = Seed: SATGFKQSSKALQRPVASDF
SATGFKQDSAALNRPVASDF

SEQ ID NO: 11463 - protein, 20 aa, synthetic construct
  source 1..20: note = Seed: SATGFKQSSKALQRPVASDF
SATGFKQDSAALSRPVASDF

SEQ ID NO: 11464 - protein, 20 aa, synthetic construct
  source 1..20: note = Seed: SATGFKQSSKALQRPVASDF
SATGFKQDSAALTRPVASDF

SEQ ID NO: 11465 - protein, 20 aa, synthetic construct
  source 1..20: note = Seed: SATGFKQSSKALQRPVASDF
SATGFKQDSAALVRPVASDF

SEQ ID NO: 11466 - protein, 20 aa, synthetic construct
  source 1..20: note = Seed: SATGFKQSSKALQRPVASDF
SATGFKQDSFALARPVASDF

SEQ ID NO: 11467 - protein, 20 aa, synthetic construct
  source 1..20: note = Seed: SATGFKQSSKALQRPVASDF
SATGFKQDSFALDRPVASDF

SEQ ID NO: 11468 - protein, 20 aa, synthetic construct
  source 1..20: note = Seed: SATGFKQSSKALQRPVASDF
SATGFKQDSFALERPVASDF

SEQ ID NO: 11469 - protein, 20 aa, synthetic construct
  source 1..20: note = Seed: SATGFKQSSKALQRPVASDF
SATGFKQDSFALFRPVASDF

SEQ ID NO: 11470 - protein, 20 aa, synthetic construct
  source 1..20: note = Seed: SATGFKQSSKALQRPVASDF
SATGFKQDSFALIRPVASDF

SEQ ID NO: 11471 - protein, 20 aa, synthetic construct
  source 1..20: note = Seed: SATGFKQSSKALQRPVASDF
SATGFKQDSFALLRPVASDF

SEQ ID NO: 11472 - protein, 20 aa, synthetic construct
  source 1..20: note = Seed: SATGFKQSSKALQRPVASDF
SATGFKQDSFALMRPVASDF

SEQ ID NO: 11473 - protein, 20 aa, synthetic construct
  source 1..20: note = Seed: SATGFKQSSKALQRPVASDF
SATGFKQDSFALNRPVASDF

SEQ ID NO: 11474 - protein, 20 aa, synthetic construct
  source 1..20: note = Seed: SATGFKQSSKALQRPVASDF
SATGFKQDSFALSRPVASDF

SEQ ID NO: 11475 - protein, 20 aa, synthetic construct
  source 1..20: note = Seed: SATGFKQSSKALQRPVASDF
SATGFKQDSFALTRPVASDF

SEQ ID NO: 11476 - protein, 20 aa, synthetic construct
  source 1..20: note = Seed: SATGFKQSSKALQRPVASDF
SATGFKQDSFALVRPVASDF

SEQ ID NO: 11477 - protein, 20 aa, synthetic construct
  source 1..20: note = Seed: SATGFKQSSKALQRPVASDF
SATGFKQDSGALARPVASDF

SEQ ID NO: 11478 - protein, 20 aa, synthetic construct
  source 1..20: note = Seed: SATGFKQSSKALQRPVASDF
SATGFKQDSGALIRPVASDF

SEQ ID NO: 11479 - protein, 20 aa, synthetic construct
  source 1..20: note = Seed: SATGFKQSSKALQRPVASDF
SATGFKQDSGALLRPVASDF

SEQ ID NO: 11480 - protein, 20 aa, synthetic construct
  source 1..20: note = Seed: SATGFKQSSKALQRPVASDF
SATGFKQDSGALVRPVASDF

SEQ ID NO: 11481 - protein, 20 aa, synthetic construct
  source 1..20: note = Seed: SATGFKQSSKALQRPVASDF
SATGFKQDSIALNRPVASDF

SEQ ID NO: 11482 - protein, 20 aa, synthetic construct
  source 1..20: note = Seed: SATGFKQSSKALQRPVASDF
SATGFKQDSIALSRPVASDF

SEQ ID NO: 11483 - protein, 20 aa, synthetic construct
  source 1..20: note = Seed: SATGFKQSSKALQRPVASDF
SATGFKQDSIALTRPVASDF

SEQ ID NO: 11484 - protein, 20 aa, synthetic construct
  source 1..20: note = Seed: SATGFKQSSKALQRPVASDF
SATGFKQDSIALVRPVASDF

SEQ ID NO: 11485 - protein, 20 aa, synthetic construct
  source 1..20: note = Seed: SATGFKQSSKALQRPVASDF
SATGFKQDSLALSRPVASDF

SEQ ID NO: 11486 - protein, 20 aa, synthetic construct
  source 1..20: note = Seed: SATGFKQSSKALQRPVASDF
SATGFKQDSPALARPVASDF

SEQ ID NO: 11487 - protein, 20 aa, synthetic construct
  source 1..20: note = Seed: SATGFKQSSKALQRPVASDF
SATGFKQDSPALIRPVASDF

SEQ ID NO: 11488 - protein, 20 aa, synthetic construct
  source 1..20: note = Seed: SATGFKQSSKALQRPVASDF
SATGFKQDSPALVRPVASDF

SEQ ID NO: 11489 - protein, 20 aa, synthetic construct
  source 1..20: note = Seed: SATGFKQSSKALQRPVASDF
SATGFKQDSSALARPVASDF

SEQ ID NO: 11490 - protein, 20 aa, synthetic construct
  source 1..20: note = Seed: SATGFKQSSKALQRPVASDF
SATGFKQDSSALIRPVASDF

SEQ ID NO: 11491 - protein, 20 aa, synthetic construct
  source 1..20: note = Seed: SATGFKQSSKALQRPVASDF
SATGFKQDSSALLRPVASDF

SEQ ID NO: 11492 - protein, 20 aa, synthetic construct
  source 1..20: note = Seed: SATGFKQSSKALQRPVASDF
SATGFKQDSSALVRPVASDF

SEQ ID NO: 11493 - protein, 20 aa, synthetic construct
  source 1..20: note = Seed: SATGFKQSSKALQRPVASDF
SATGFKQDSVALARPVASDF

SEQ ID NO: 11494 - protein, 20 aa, synthetic construct
  source 1..20: note = Seed: SATGFKQSSKALQRPVASDF
SATGFKQDSVALIRPVASDF

SEQ ID NO: 11495 - protein, 20 aa, synthetic construct
  source 1..20: note = Seed: SATGFKQSSKALQRPVASDF
SATGFKQDSVALLRPVASDF

SEQ ID NO: 11496 - protein, 20 aa, synthetic construct
  source 1..20: note = Seed: SATGFKQSSKALQRPVASDF
SATGFKQDSVALNRPVASDF

SEQ ID NO: 11497 - protein, 20 aa, synthetic construct
  source 1..20: note = Seed: SATGFKQSSKALQRPVASDF
SATGFKQDSVALSRPVASDF

SEQ ID NO: 11498 - protein, 20 aa, synthetic construct
  source 1..20: note = Seed: SATGFKQSSKALQRPVASDF
SATGFKQDSVALVRPVASDF

SEQ ID NO: 11499 - protein, 20 aa, synthetic construct
  source 1..20: note = Seed: SATGFKQSSKALQRPVASDF
SATGFKQESAALARPVASDF

SEQ ID NO: 11500 - protein, 20 aa, synthetic construct
  source 1..20: note = Seed: SATGFKQSSKALQRPVASDF
SATGFKQESAALCRPVASDF

SEQ ID NO: 11501 - protein, 20 aa, synthetic construct
  source 1..20: note = Seed: SATGFKQSSKALQRPVASDF
SATGFKQESAALDRPVASDF

SEQ ID NO: 11502 - protein, 20 aa, synthetic construct
  source 1..20: note = Seed: SATGFKQSSKALQRPVASDF
SATGFKQESAALERPVASDF

SEQ ID NO: 11503 - protein, 20 aa, synthetic construct
  source 1..20: note = Seed: SATGFKQSSKALQRPVASDF
SATGFKQESAALFRPVASDF

SEQ ID NO: 11504 - protein, 20 aa, synthetic construct
  source 1..20: note = Seed: SATGFKQSSKALQRPVASDF
SATGFKQESAALGRPVASDF

SEQ ID NO: 11505 - protein, 20 aa, synthetic construct
  source 1..20: note = Seed: SATGFKQSSKALQRPVASDF
SATGFKQESAALHRPVASDF

SEQ ID NO: 11506 - protein, 20 aa, synthetic construct
  source 1..20: note = Seed: SATGFKQSSKALQRPVASDF
SATGFKQESAALIRPVASDF

SEQ ID NO: 11507 - protein, 20 aa, synthetic construct
  source 1..20: note = Seed: SATGFKQSSKALQRPVASDF
SATGFKQESAALLRPVASDF

SEQ ID NO: 11508 - protein, 20 aa, synthetic construct
  source 1..20: note = Seed: SATGFKQSSKALQRPVASDF
SATGFKQESAALMRPVASDF

SEQ ID NO: 11509 - protein, 20 aa, synthetic construct
  source 1..20: note = Seed: SATGFKQSSKALQRPVASDF
SATGFKQESAALNRPVASDF

SEQ ID NO: 11510 - protein, 20 aa, synthetic construct
  source 1..20: note = Seed: SATGFKQSSKALQRPVASDF
SATGFKQESAALPRPVASDF

SEQ ID NO: 11511 - protein, 20 aa, synthetic construct
  source 1..20: note = Seed: SATGFKQSSKALQRPVASDF
SATGFKQESAALQRPVASDF

SEQ ID NO: 11512 - protein, 20 aa, synthetic construct
  source 1..20: note = Seed: SATGFKQSSKALQRPVASDF
SATGFKQESAALSRPVASDF

SEQ ID NO: 11513 - protein, 20 aa, synthetic construct
  source 1..20: note = Seed: SATGFKQSSKALQRPVASDF
SATGFKQESAALTRPVASDF

SEQ ID NO: 11514 - protein, 20 aa, synthetic construct
  source 1..20: note = Seed: SATGFKQSSKALQRPVASDF
SATGFKQESAALVRPVASDF

SEQ ID NO: 11515 - protein, 20 aa, synthetic construct
  source 1..20: note = Seed: SATGFKQSSKALQRPVASDF
SATGFKQESAALYRPVASDF

SEQ ID NO: 11516 - protein, 20 aa, synthetic construct
  source 1..20: note = Seed: SATGFKQSSKALQRPVASDF
SATGFKQESFALARPVASDF

SEQ ID NO: 11517 - protein, 20 aa, synthetic construct
  source 1..20: note = Seed: SATGFKQSSKALQRPVASDF
SATGFKQESFALDRPVASDF

SEQ ID NO: 11518 - protein, 20 aa, synthetic construct
  source 1..20: note = Seed: SATGFKQSSKALQRPVASDF
SATGFKQESFALERPVASDF

SEQ ID NO: 11519 - protein, 20 aa, synthetic construct
  source 1..20: note = Seed: SATGFKQSSKALQRPVASDF
SATGFKQESFALFRPVASDF

SEQ ID NO: 11520 - protein, 20 aa, synthetic construct
  source 1..20: note = Seed: SATGFKQSSKALQRPVASDF
SATGFKQESFALLRPVASDF

SEQ ID NO: 11521 - protein, 20 aa, synthetic construct
  source 1..20: note = Seed: SATGFKQSSKALQRPVASDF
SATGFKQESFALMRPVASDF

SEQ ID NO: 11522 - protein, 20 aa, synthetic construct
  source 1..20: note = Seed: SATGFKQSSKALQRPVASDF
SATGFKQESFALNRPVASDF

SEQ ID NO: 11523 - protein, 20 aa, synthetic construct
  source 1..20: note = Seed: SATGFKQSSKALQRPVASDF
SATGFKQESFALSRPVASDF

SEQ ID NO: 11524 - protein, 20 aa, synthetic construct
  source 1..20: note = Seed: SATGFKQSSKALQRPVASDF
SATGFKQESFALTRPVASDF

SEQ ID NO: 11525 - protein, 20 aa, synthetic construct
  source 1..20: note = Seed: SATGFKQSSKALQRPVASDF
SATGFKQESFALVRPVASDF

SEQ ID NO: 11526 - protein, 20 aa, synthetic construct
  source 1..20: note = Seed: SATGFKQSSKALQRPVASDF
SATGFKQESFALYRPVASDF

SEQ ID NO: 11527 - protein, 20 aa, synthetic construct
  source 1..20: note = Seed: SATGFKQSSKALQRPVASDF
SATGFKQESGALARPVASDF

SEQ ID NO: 11528 - protein, 20 aa, synthetic construct
  source 1..20: note = Seed: SATGFKQSSKALQRPVASDF
SATGFKQESGALCRPVASDF

SEQ ID NO: 11529 - protein, 20 aa, synthetic construct
  source 1..20: note = Seed: SATGFKQSSKALQRPVASDF
SATGFKQESGALFRPVASDF

SEQ ID NO: 11530 - protein, 20 aa, synthetic construct
  source 1..20: note = Seed: SATGFKQSSKALQRPVASDF
SATGFKQESGALGRPVASDF

SEQ ID NO: 11531 - protein, 20 aa, synthetic construct
  source 1..20: note = Seed: SATGFKQSSKALQRPVASDF
SATGFKQESGALIRPVASDF

SEQ ID NO: 11532 - protein, 20 aa, synthetic construct
  source 1..20: note = Seed: SATGFKQSSKALQRPVASDF
SATGFKQESGALLRPVASDF

SEQ ID NO: 11533 - protein, 20 aa, synthetic construct
  source 1..20: note = Seed: SATGFKQSSKALQRPVASDF
SATGFKQESGALMRPVASDF

SEQ ID NO: 11534 - protein, 20 aa, synthetic construct
  source 1..20: note = Seed: SATGFKQSSKALQRPVASDF
SATGFKQESGALNRPVASDF

SEQ ID NO: 11535 - protein, 20 aa, synthetic construct
  source 1..20: note = Seed: SATGFKQSSKALQRPVASDF
SATGFKQESGALSRPVASDF

SEQ ID NO: 11536 - protein, 20 aa, synthetic construct
  source 1..20: note = Seed: SATGFKQSSKALQRPVASDF
SATGFKQESGALTRPVASDF

SEQ ID NO: 11537 - protein, 20 aa, synthetic construct
  source 1..20: note = Seed: SATGFKQSSKALQRPVASDF
SATGFKQESGALVRPVASDF

SEQ ID NO: 11538 - protein, 20 aa, synthetic construct
  source 1..20: note = Seed: SATGFKQSSKALQRPVASDF
SATGFKQESIALARPVASDF

SEQ ID NO: 11539 - protein, 20 aa, synthetic construct
  source 1..20: note = Seed: SATGFKQSSKALQRPVASDF
SATGFKQESIALCRPVASDF

SEQ ID NO: 11540 - protein, 20 aa, synthetic construct
  source 1..20: note = Seed: SATGFKQSSKALQRPVASDF
SATGFKQESIALGRPVASDF

SEQ ID NO: 11541 - protein, 20 aa, synthetic construct
  source 1..20: note = Seed: SATGFKQSSKALQRPVASDF
SATGFKQESIALHRPVASDF

SEQ ID NO: 11542 - protein, 20 aa, synthetic construct
  source 1..20: note = Seed: SATGFKQSSKALQRPVASDF
SATGFKQESIALIRPVASDF

SEQ ID NO: 11543 - protein, 20 aa, synthetic construct
  source 1..20: note = Seed: SATGFKQSSKALQRPVASDF
SATGFKQESIALNRPVASDF

SEQ ID NO: 11544 - protein, 20 aa, synthetic construct
  source 1..20: note = Seed: SATGFKQSSKALQRPVASDF
SATGFKQESIALQRPVASDF

SEQ ID NO: 11545 - protein, 20 aa, synthetic construct
  source 1..20: note = Seed: SATGFKQSSKALQRPVASDF
SATGFKQESIALSRPVASDF

SEQ ID NO: 11546 - protein, 20 aa, synthetic construct
  source 1..20: note = Seed: SATGFKQSSKALQRPVASDF
SATGFKQESIALTRPVASDF

SEQ ID NO: 11547 - protein, 20 aa, synthetic construct
  source 1..20: note = Seed: SATGFKQSSKALQRPVASDF
SATGFKQESIALVRPVASDF

SEQ ID NO: 11548 - protein, 20 aa, synthetic construct
  source 1..20: note = Seed: SATGFKQSSKALQRPVASDF
SATGFKQESKALARPVASDF

SEQ ID NO: 11549 - protein, 20 aa, synthetic construct
  source 1..20: note = Seed: SATGFKQSSKALQRPVASDF
SATGFKQESKALSRPVASDF

SEQ ID NO: 11550 - protein, 20 aa, synthetic construct
  source 1..20: note = Seed: SATGFKQSSKALQRPVASDF
SATGFKQESLALARPVASDF

SEQ ID NO: 11551 - protein, 20 aa, synthetic construct
  source 1..20: note = Seed: SATGFKQSSKALQRPVASDF
SATGFKQESLALGRPVASDF

SEQ ID NO: 11552 - protein, 20 aa, synthetic construct
  source 1..20: note = Seed: SATGFKQSSKALQRPVASDF
SATGFKQESLALHRPVASDF

SEQ ID NO: 11553 - protein, 20 aa, synthetic construct
  source 1..20: note = Seed: SATGFKQSSKALQRPVASDF
SATGFKQESLALLRPVASDF

SEQ ID NO: 11554 - protein, 20 aa, synthetic construct
  source 1..20: note = Seed: SATGFKQSSKALQRPVASDF
SATGFKQESLALNRPVASDF

SEQ ID NO: 11555 - protein, 20 aa, synthetic construct
  source 1..20: note = Seed: SATGFKQSSKALQRPVASDF
SATGFKQESLALSRPVASDF

SEQ ID NO: 11556 - protein, 20 aa, synthetic construct
  source 1..20: note = Seed: SATGFKQSSKALQRPVASDF
SATGFKQESLALTRPVASDF

SEQ ID NO: 11557 - protein, 20 aa, synthetic construct
  source 1..20: note = Seed: SATGFKQSSKALQRPVASDF
SATGFKQESLALVRPVASDF

SEQ ID NO: 11558 - protein, 20 aa, synthetic construct
  source 1..20: note = Seed: SATGFKQSSKALQRPVASDF
SATGFKQESMALARPVASDF

SEQ ID NO: 11559 - protein, 20 aa, synthetic construct
  source 1..20: note = Seed: SATGFKQSSKALQRPVASDF
SATGFKQESMALIRPVASDF

SEQ ID NO: 11560 - protein, 20 aa, synthetic construct
  source 1..20: note = Seed: SATGFKQSSKALQRPVASDF
SATGFKQESMALNRPVASDF

SEQ ID NO: 11561 - protein, 20 aa, synthetic construct
  source 1..20: note = Seed: SATGFKQSSKALQRPVASDF
SATGFKQESMALSRPVASDF

SEQ ID NO: 11562 - protein, 20 aa, synthetic construct
  source 1..20: note = Seed: SATGFKQSSKALQRPVASDF
SATGFKQESMALTRPVASDF

SEQ ID NO: 11563 - protein, 20 aa, synthetic construct
  source 1..20: note = Seed: SATGFKQSSKALQRPVASDF
SATGFKQESMALVRPVASDF

SEQ ID NO: 11564 - protein, 20 aa, synthetic construct
  source 1..20: note = Seed: SATGFKQSSKALQRPVASDF
SATGFKQESNALARPVASDF

SEQ ID NO: 11565 - protein, 20 aa, synthetic construct
  source 1..20: note = Seed: SATGFKQSSKALQRPVASDF
SATGFKQESNALIRPVASDF

SEQ ID NO: 11566 - protein, 20 aa, synthetic construct
  source 1..20: note = Seed: SATGFKQSSKALQRPVASDF
SATGFKQESNALLRPVASDF

SEQ ID NO: 11567 - protein, 20 aa, synthetic construct
  source 1..20: note = Seed: SATGFKQSSKALQRPVASDF
SATGFKQESNALMRPVASDF

SEQ ID NO: 11568 - protein, 20 aa, synthetic construct
  source 1..20: note = Seed: SATGFKQSSKALQRPVASDF
SATGFKQESNALNRPVASDF

SEQ ID NO: 11569 - protein, 20 aa, synthetic construct
  source 1..20: note = Seed: SATGFKQSSKALQRPVASDF
SATGFKQESNALSRPVASDF

SEQ ID NO: 11570 - protein, 20 aa, synthetic construct
  source 1..20: note = Seed: SATGFKQSSKALQRPVASDF
SATGFKQESNALTRPVASDF

SEQ ID NO: 11571 - protein, 20 aa, synthetic construct
  source 1..20: note = Seed: SATGFKQSSKALQRPVASDF
SATGFKQESNALVRPVASDF

SEQ ID NO: 11572 - protein, 20 aa, synthetic construct
  source 1..20: note = Seed: SATGFKQSSKALQRPVASDF
SATGFKQESPALARPVASDF

SEQ ID NO: 11573 - protein, 20 aa, synthetic construct
  source 1..20: note = Seed: SATGFKQSSKALQRPVASDF
SATGFKQESPALGRPVASDF

SEQ ID NO: 11574 - protein, 20 aa, synthetic construct
  source 1..20: note = Seed: SATGFKQSSKALQRPVASDF
SATGFKQESPALHRPVASDF

SEQ ID NO: 11575 - protein, 20 aa, synthetic construct
  source 1..20: note = Seed: SATGFKQSSKALQRPVASDF
SATGFKQESPALIRPVASDF

SEQ ID NO: 11576 - protein, 20 aa, synthetic construct
  source 1..20: note = Seed: SATGFKQSSKALQRPVASDF
SATGFKQESPALLRPVASDF

SEQ ID NO: 11577 - protein, 20 aa, synthetic construct
  source 1..20: note = Seed: SATGFKQSSKALQRPVASDF
SATGFKQESPALMRPVASDF

SEQ ID NO: 11578 - protein, 20 aa, synthetic construct
  source 1..20: note = Seed: SATGFKQSSKALQRPVASDF
SATGFKQESPALNRPVASDF

SEQ ID NO: 11579 - protein, 20 aa, synthetic construct
  source 1..20: note = Seed: SATGFKQSSKALQRPVASDF
SATGFKQESPALQRPVASDF

SEQ ID NO: 11580 - protein, 20 aa, synthetic construct
  source 1..20: note = Seed: SATGFKQSSKALQRPVASDF
SATGFKQESPALSRPVASDF

SEQ ID NO: 11581 - protein, 20 aa, synthetic construct
  source 1..20: note = Seed: SATGFKQSSKALQRPVASDF
SATGFKQESPALTRPVASDF

SEQ ID NO: 11582 - protein, 20 aa, synthetic construct
  source 1..20: note = Seed: SATGFKQSSKALQRPVASDF
SATGFKQESPALVRPVASDF

SEQ ID NO: 11583 - protein, 20 aa, synthetic construct
  source 1..20: note = Seed: SATGFKQSSKALQRPVASDF
SATGFKQESRALARPVASDF

SEQ ID NO: 11584 - protein, 20 aa, synthetic construct
  source 1..20: note = Seed: SATGFKQSSKALQRPVASDF
SATGFKQESRALSRPVASDF

SEQ ID NO: 11585 - protein, 20 aa, synthetic construct
  source 1..20: note = Seed: SATGFKQSSKALQRPVASDF
SATGFKQESSALARPVASDF

SEQ ID NO: 11586 - protein, 20 aa, synthetic construct
  source 1..20: note = Seed: SATGFKQSSKALQRPVASDF
SATGFKQESSALCRPVASDF

SEQ ID NO: 11587 - protein, 20 aa, synthetic construct
  source 1..20: note = Seed: SATGFKQSSKALQRPVASDF
SATGFKQESSALGRPVASDF

SEQ ID NO: 11588 - protein, 20 aa, synthetic construct
  source 1..20: note = Seed: SATGFKQSSKALQRPVASDF
SATGFKQESSALHRPVASDF

SEQ ID NO: 11589 - protein, 20 aa, synthetic construct
  source 1..20: note = Seed: SATGFKQSSKALQRPVASDF
SATGFKQESSALIRPVASDF

SEQ ID NO: 11590 - protein, 20 aa, synthetic construct
  source 1..20: note = Seed: SATGFKQSSKALQRPVASDF
SATGFKQESSALLRPVASDF

SEQ ID NO: 11591 - protein, 20 aa, synthetic construct
  source 1..20: note = Seed: SATGFKQSSKALQRPVASDF
SATGFKQESSALMRPVASDF

SEQ ID NO: 11592 - protein, 20 aa, synthetic construct
  source 1..20: note = Seed: SATGFKQSSKALQRPVASDF
SATGFKQESSALNRPVASDF

SEQ ID NO: 11593 - protein, 20 aa, synthetic construct
  source 1..20: note = Seed: SATGFKQSSKALQRPVASDF
SATGFKQESSALQRPVASDF

SEQ ID NO: 11594 - protein, 20 aa, synthetic construct
  source 1..20: note = Seed: SATGFKQSSKALQRPVASDF
SATGFKQESSALSRPVASDF

SEQ ID NO: 11595 - protein, 20 aa, synthetic construct
  source 1..20: note = Seed: SATGFKQSSKALQRPVASDF
SATGFKQESSALTRPVASDF

SEQ ID NO: 11596 - protein, 20 aa, synthetic construct
  source 1..20: note = Seed: SATGFKQSSKALQRPVASDF
SATGFKQESSALVRPVASDF

SEQ ID NO: 11597 - protein, 20 aa, synthetic construct
  source 1..20: note = Seed: SATGFKQSSKALQRPVASDF
SATGFKQESTALARPVASDF

SEQ ID NO: 11598 - protein, 20 aa, synthetic construct
  source 1..20: note = Seed: SATGFKQSSKALQRPVASDF
SATGFKQESTALGRPVASDF

SEQ ID NO: 11599 - protein, 20 aa, synthetic construct
  source 1..20: note = Seed: SATGFKQSSKALQRPVASDF
SATGFKQESTALHRPVASDF

SEQ ID NO: 11600 - protein, 20 aa, synthetic construct
  source 1..20: note = Seed: SATGFKQSSKALQRPVASDF
SATGFKQESTALIRPVASDF

SEQ ID NO: 11601 - protein, 20 aa, synthetic construct
  source 1..20: note = Seed: SATGFKQSSKALQRPVASDF
SATGFKQESTALLRPVASDF

SEQ ID NO: 11602 - protein, 20 aa, synthetic construct
  source 1..20: note = Seed: SATGFKQSSKALQRPVASDF
SATGFKQESTALMRPVASDF

SEQ ID NO: 11603 - protein, 20 aa, synthetic construct
  source 1..20: note = Seed: SATGFKQSSKALQRPVASDF
SATGFKQESTALNRPVASDF

SEQ ID NO: 11604 - protein, 20 aa, synthetic construct
  source 1..20: note = Seed: SATGFKQSSKALQRPVASDF
SATGFKQESTALQRPVASDF

SEQ ID NO: 11605 - protein, 20 aa, synthetic construct
  source 1..20: note = Seed: SATGFKQSSKALQRPVASDF
SATGFKQESTALSRPVASDF

SEQ ID NO: 11606 - protein, 20 aa, synthetic construct
  source 1..20: note = Seed: SATGFKQSSKALQRPVASDF
SATGFKQESTALTRPVASDF

SEQ ID NO: 11607 - protein, 20 aa, synthetic construct
  source 1..20: note = Seed: SATGFKQSSKALQRPVASDF
SATGFKQESTALVRPVASDF

SEQ ID NO: 11608 - protein, 20 aa, synthetic construct
  source 1..20: note = Seed: SATGFKQSSKALQRPVASDF
SATGFKQESVALARPVASDF

SEQ ID NO: 11609 - protein, 20 aa, synthetic construct
  source 1..20: note = Seed: SATGFKQSSKALQRPVASDF
SATGFKQESVALERPVASDF

SEQ ID NO: 11610 - protein, 20 aa, synthetic construct
  source 1..20: note = Seed: SATGFKQSSKALQRPVASDF
SATGFKQESVALFRPVASDF

SEQ ID NO: 11611 - protein, 20 aa, synthetic construct
  source 1..20: note = Seed: SATGFKQSSKALQRPVASDF
SATGFKQESVALGRPVASDF

SEQ ID NO: 11612 - protein, 20 aa, synthetic construct
  source 1..20: note = Seed: SATGFKQSSKALQRPVASDF
SATGFKQESVALHRPVASDF

SEQ ID NO: 11613 - protein, 20 aa, synthetic construct
  source 1..20: note = Seed: SATGFKQSSKALQRPVASDF
SATGFKQESVALIRPVASDF

SEQ ID NO: 11614 - protein, 20 aa, synthetic construct
  source 1..20: note = Seed: SATGFKQSSKALQRPVASDF
SATGFKQESVALLRPVASDF

SEQ ID NO: 11615 - protein, 20 aa, synthetic construct
  source 1..20: note = Seed: SATGFKQSSKALQRPVASDF
SATGFKQESVALMRPVASDF

SEQ ID NO: 11616 - protein, 20 aa, synthetic construct
  source 1..20: note = Seed: SATGFKQSSKALQRPVASDF
SATGFKQESVALNRPVASDF

SEQ ID NO: 11617 - protein, 20 aa, synthetic construct
  source 1..20: note = Seed: SATGFKQSSKALQRPVASDF
SATGFKQESVALQRPVASDF

SEQ ID NO: 11618 - protein, 20 aa, synthetic construct
  source 1..20: note = Seed: SATGFKQSSKALQRPVASDF
SATGFKQESVALSRPVASDF

SEQ ID NO: 11619 - protein, 20 aa, synthetic construct
  source 1..20: note = Seed: SATGFKQSSKALQRPVASDF
SATGFKQESVALTRPVASDF

SEQ ID NO: 11620 - protein, 20 aa, synthetic construct
  source 1..20: note = Seed: SATGFKQSSKALQRPVASDF
SATGFKQESVALVRPVASDF

SEQ ID NO: 11621 - protein, 20 aa, synthetic construct
  source 1..20: note = Seed: SATGFKQSSKALQRPVASDF
SATGFKQESYALFRPVASDF

SEQ ID NO: 11622 - protein, 20 aa, synthetic construct
  source 1..20: note = Seed: SATGFKQSSKALQRPVASDF
SATGFKQESYALIRPVASDF

SEQ ID NO: 11623 - protein, 20 aa, synthetic construct
  source 1..20: note = Seed: SATGFKQSSKALQRPVASDF
SATGFKQESYALLRPVASDF

SEQ ID NO: 11624 - protein, 20 aa, synthetic construct
  source 1..20: note = Seed: SATGFKQSSKALQRPVASDF
SATGFKQESYALVRPVASDF

SEQ ID NO: 11625 - protein, 20 aa, synthetic construct
  source 1..20: note = Seed: SATGFKQSSKALQRPVASDF
SATGFKQFSAALARPVASDF

SEQ ID NO: 11626 - protein, 20 aa, synthetic construct
  source 1..20: note = Seed: SATGFKQSSKALQRPVASDF
SATGFKQFSAALCRPVASDF

SEQ ID NO: 11627 - protein, 20 aa, synthetic construct
  source 1..20: note = Seed: SATGFKQSSKALQRPVASDF
SATGFKQFSAALDRPVASDF

SEQ ID NO: 11628 - protein, 20 aa, synthetic construct
  source 1..20: note = Seed: SATGFKQSSKALQRPVASDF
SATGFKQFSAALERPVASDF

SEQ ID NO: 11629 - protein, 20 aa, synthetic construct
  source 1..20: note = Seed: SATGFKQSSKALQRPVASDF
SATGFKQFSAALFRPVASDF

SEQ ID NO: 11630 - protein, 20 aa, synthetic construct
  source 1..20: note = Seed: SATGFKQSSKALQRPVASDF
SATGFKQFSAALGRPVASDF

SEQ ID NO: 11631 - protein, 20 aa, synthetic construct
  source 1..20: note = Seed: SATGFKQSSKALQRPVASDF
SATGFKQFSAALHRPVASDF

SEQ ID NO: 11632 - protein, 20 aa, synthetic construct
  source 1..20: note = Seed: SATGFKQSSKALQRPVASDF
SATGFKQFSAALIRPVASDF

SEQ ID NO: 11633 - protein, 20 aa, synthetic construct
  source 1..20: note = Seed: SATGFKQSSKALQRPVASDF
SATGFKQFSAALKRPVASDF

SEQ ID NO: 11634 - protein, 20 aa, synthetic construct
  source 1..20: note = Seed: SATGFKQSSKALQRPVASDF
SATGFKQFSAALLRPVASDF

SEQ ID NO: 11635 - protein, 20 aa, synthetic construct
  source 1..20: note = Seed: SATGFKQSSKALQRPVASDF
SATGFKQFSAALMRPVASDF

SEQ ID NO: 11636 - protein, 20 aa, synthetic construct
  source 1..20: note = Seed: SATGFKQSSKALQRPVASDF
SATGFKQFSAALNRPVASDF

SEQ ID NO: 11637 - protein, 20 aa, synthetic construct
  source 1..20: note = Seed: SATGFKQSSKALQRPVASDF
SATGFKQFSAALQRPVASDF

SEQ ID NO: 11638 - protein, 20 aa, synthetic construct
  source 1..20: note = Seed: SATGFKQSSKALQRPVASDF
SATGFKQFSAALRRPVASDF

SEQ ID NO: 11639 - protein, 20 aa, synthetic construct
  source 1..20: note = Seed: SATGFKQSSKALQRPVASDF
SATGFKQFSAALSRPVASDF

SEQ ID NO: 11640 - protein, 20 aa, synthetic construct
  source 1..20: note = Seed: SATGFKQSSKALQRPVASDF
SATGFKQFSAALVRPVASDF

SEQ ID NO: 11641 - protein, 20 aa, synthetic construct
  source 1..20: note = Seed: SATGFKQSSKALQRPVASDF
SATGFKQFSAALYRPVASDF

SEQ ID NO: 11642 - protein, 20 aa, synthetic construct
  source 1..20: note = Seed: SATGFKQSSKALQRPVASDF
SATGFKQFSCALLRPVASDF

SEQ ID NO: 11643 - protein, 20 aa, synthetic construct
  source 1..20: note = Seed: SATGFKQSSKALQRPVASDF
SATGFKQFSDALSRPVASDF

SEQ ID NO: 11644 - protein, 20 aa, synthetic construct
  source 1..20: note = Seed: SATGFKQSSKALQRPVASDF
SATGFKQFSDALVRPVASDF

SEQ ID NO: 11645 - protein, 20 aa, synthetic construct
  source 1..20: note = Seed: SATGFKQSSKALQRPVASDF
SATGFKQFSEALIRPVASDF

SEQ ID NO: 11646 - protein, 20 aa, synthetic construct
  source 1..20: note = Seed: SATGFKQSSKALQRPVASDF
SATGFKQFSEALMRPVASDF

SEQ ID NO: 11647 - protein, 20 aa, synthetic construct
  source 1..20: note = Seed: SATGFKQSSKALQRPVASDF
SATGFKQFSEALNRPVASDF

SEQ ID NO: 11648 - protein, 20 aa, synthetic construct
  source 1..20: note = Seed: SATGFKQSSKALQRPVASDF
SATGFKQFSFALDRPVASDF

SEQ ID NO: 11649 - protein, 20 aa, synthetic construct
  source 1..20: note = Seed: SATGFKQSSKALQRPVASDF
SATGFKQFSFALERPVASDF

SEQ ID NO: 11650 - protein, 20 aa, synthetic construct
  source 1..20: note = Seed: SATGFKQSSKALQRPVASDF
SATGFKQFSFALHRPVASDF

SEQ ID NO: 11651 - protein, 20 aa, synthetic construct
  source 1..20: note = Seed: SATGFKQSSKALQRPVASDF
SATGFKQFSFALMRPVASDF

SEQ ID NO: 11652 - protein, 20 aa, synthetic construct
  source 1..20: note = Seed: SATGFKQSSKALQRPVASDF
SATGFKQFSFALNRPVASDF

SEQ ID NO: 11653 - protein, 20 aa, synthetic construct
  source 1..20: note = Seed: SATGFKQSSKALQRPVASDF
SATGFKQFSFALSRPVASDF

SEQ ID NO: 11654 - protein, 20 aa, synthetic construct
  source 1..20: note = Seed: SATGFKQSSKALQRPVASDF
SATGFKQFSFALTRPVASDF

SEQ ID NO: 11655 - protein, 20 aa, synthetic construct
  source 1..20: note = Seed: SATGFKQSSKALQRPVASDF
SATGFKQFSFALVRPVASDF

SEQ ID NO: 11656 - protein, 20 aa, synthetic construct
  source 1..20: note = Seed: SATGFKQSSKALQRPVASDF
SATGFKQFSGALARPVASDF

SEQ ID NO: 11657 - protein, 20 aa, synthetic construct
  source 1..20: note = Seed: SATGFKQSSKALQRPVASDF
SATGFKQFSGALCRPVASDF

SEQ ID NO: 11658 - protein, 20 aa, synthetic construct
  source 1..20: note = Seed: SATGFKQSSKALQRPVASDF
SATGFKQFSGALFRPVASDF

SEQ ID NO: 11659 - protein, 20 aa, synthetic construct
  source 1..20: note = Seed: SATGFKQSSKALQRPVASDF
SATGFKQFSGALGRPVASDF

SEQ ID NO: 11660 - protein, 20 aa, synthetic construct
  source 1..20: note = Seed: SATGFKQSSKALQRPVASDF
SATGFKQFSGALHRPVASDF

SEQ ID NO: 11661 - protein, 20 aa, synthetic construct
  source 1..20: note = Seed: SATGFKQSSKALQRPVASDF
SATGFKQFSGALIRPVASDF

SEQ ID NO: 11662 - protein, 20 aa, synthetic construct
  source 1..20: note = Seed: SATGFKQSSKALQRPVASDF
SATGFKQFSGALKRPVASDF

SEQ ID NO: 11663 - protein, 20 aa, synthetic construct
  source 1..20: note = Seed: SATGFKQSSKALQRPVASDF
SATGFKQFSGALLRPVASDF

SEQ ID NO: 11664 - protein, 20 aa, synthetic construct
  source 1..20: note = Seed: SATGFKQSSKALQRPVASDF
SATGFKQFSGALMRPVASDF

SEQ ID NO: 11665 - protein, 20 aa, synthetic construct
  source 1..20: note = Seed: SATGFKQSSKALQRPVASDF
SATGFKQFSGALNRPVASDF

SEQ ID NO: 11666 - protein, 20 aa, synthetic construct
  source 1..20: note = Seed: SATGFKQSSKALQRPVASDF
SATGFKQFSGALQRPVASDF

SEQ ID NO: 11667 - protein, 20 aa, synthetic construct
  source 1..20: note = Seed: SATGFKQSSKALQRPVASDF
SATGFKQFSGALRRPVASDF

SEQ ID NO: 11668 - protein, 20 aa, synthetic construct
  source 1..20: note = Seed: SATGFKQSSKALQRPVASDF
SATGFKQFSGALSRPVASDF

SEQ ID NO: 11669 - protein, 20 aa, synthetic construct
  source 1..20: note = Seed: SATGFKQSSKALQRPVASDF
SATGFKQFSGALTRPVASDF

SEQ ID NO: 11670 - protein, 20 aa, synthetic construct
  source 1..20: note = Seed: SATGFKQSSKALQRPVASDF
SATGFKQFSGALVRPVASDF

SEQ ID NO: 11671 - protein, 20 aa, synthetic construct
  source 1..20: note = Seed: SATGFKQSSKALQRPVASDF
SATGFKQFSGALYRPVASDF

SEQ ID NO: 11672 - protein, 20 aa, synthetic construct
  source 1..20: note = Seed: SATGFKQSSKALQRPVASDF
SATGFKQFSHALARPVASDF

SEQ ID NO: 11673 - protein, 20 aa, synthetic construct
  source 1..20: note = Seed: SATGFKQSSKALQRPVASDF
SATGFKQFSHALGRPVASDF

SEQ ID NO: 11674 - protein, 20 aa, synthetic construct
  source 1..20: note = Seed: SATGFKQSSKALQRPVASDF
SATGFKQFSHALHRPVASDF

SEQ ID NO: 11675 - protein, 20 aa, synthetic construct
  source 1..20: note = Seed: SATGFKQSSKALQRPVASDF
SATGFKQFSHALIRPVASDF

SEQ ID NO: 11676 - protein, 20 aa, synthetic construct
  source 1..20: note = Seed: SATGFKQSSKALQRPVASDF
SATGFKQFSHALKRPVASDF

SEQ ID NO: 11677 - protein, 20 aa, synthetic construct
  source 1..20: note = Seed: SATGFKQSSKALQRPVASDF
SATGFKQFSHALLRPVASDF

SEQ ID NO: 11678 - protein, 20 aa, synthetic construct
  source 1..20: note = Seed: SATGFKQSSKALQRPVASDF
SATGFKQFSHALQRPVASDF

SEQ ID NO: 11679 - protein, 20 aa, synthetic construct
  source 1..20: note = Seed: SATGFKQSSKALQRPVASDF
SATGFKQFSHALRRPVASDF

SEQ ID NO: 11680 - protein, 20 aa, synthetic construct
  source 1..20: note = Seed: SATGFKQSSKALQRPVASDF
SATGFKQFSHALSRPVASDF

SEQ ID NO: 11681 - protein, 20 aa, synthetic construct
  source 1..20: note = Seed: SATGFKQSSKALQRPVASDF
SATGFKQFSHALTRPVASDF

SEQ ID NO: 11682 - protein, 20 aa, synthetic construct
  source 1..20: note = Seed: SATGFKQSSKALQRPVASDF
SATGFKQFSHALVRPVASDF

SEQ ID NO: 11683 - protein, 20 aa, synthetic construct
  source 1..20: note = Seed: SATGFKQSSKALQRPVASDF
SATGFKQFSIALARPVASDF

SEQ ID NO: 11684 - protein, 20 aa, synthetic construct
  source 1..20: note = Seed: SATGFKQSSKALQRPVASDF
SATGFKQFSIALDRPVASDF

SEQ ID NO: 11685 - protein, 20 aa, synthetic construct
  source 1..20: note = Seed: SATGFKQSSKALQRPVASDF
SATGFKQFSIALERPVASDF

SEQ ID NO: 11686 - protein, 20 aa, synthetic construct
  source 1..20: note = Seed: SATGFKQSSKALQRPVASDF
SATGFKQFSIALHRPVASDF

SEQ ID NO: 11687 - protein, 20 aa, synthetic construct
  source 1..20: note = Seed: SATGFKQSSKALQRPVASDF
SATGFKQFSIALKRPVASDF

SEQ ID NO: 11688 - protein, 20 aa, synthetic construct
  source 1..20: note = Seed: SATGFKQSSKALQRPVASDF
SATGFKQFSIALNRPVASDF

SEQ ID NO: 11689 - protein, 20 aa, synthetic construct
  source 1..20: note = Seed: SATGFKQSSKALQRPVASDF
SATGFKQFSIALSRPVASDF

SEQ ID NO: 11690 - protein, 20 aa, synthetic construct
  source 1..20: note = Seed: SATGFKQSSKALQRPVASDF
SATGFKQFSKALARPVASDF

SEQ ID NO: 11691 - protein, 20 aa, synthetic construct
  source 1..20: note = Seed: SATGFKQSSKALQRPVASDF
SATGFKQFSKALGRPVASDF

SEQ ID NO: 11692 - protein, 20 aa, synthetic construct
  source 1..20: note = Seed: SATGFKQSSKALQRPVASDF
SATGFKQFSKALHRPVASDF

SEQ ID NO: 11693 - protein, 20 aa, synthetic construct
  source 1..20: note = Seed: SATGFKQSSKALQRPVASDF
SATGFKQFSKALIRPVASDF

SEQ ID NO: 11694 - protein, 20 aa, synthetic construct
  source 1..20: note = Seed: SATGFKQSSKALQRPVASDF
SATGFKQFSKALKRPVASDF

SEQ ID NO: 11695 - protein, 20 aa, synthetic construct
  source 1..20: note = Seed: SATGFKQSSKALQRPVASDF
SATGFKQFSKALLRPVASDF

SEQ ID NO: 11696 - protein, 20 aa, synthetic construct
  source 1..20: note = Seed: SATGFKQSSKALQRPVASDF
SATGFKQFSKALMRPVASDF

SEQ ID NO: 11697 - protein, 20 aa, synthetic construct
  source 1..20: note = Seed: SATGFKQSSKALQRPVASDF
SATGFKQFSKALNRPVASDF

SEQ ID NO: 11698 - protein, 20 aa, synthetic construct
  source 1..20: note = Seed: SATGFKQSSKALQRPVASDF
SATGFKQFSKALPRPVASDF

SEQ ID NO: 11699 - protein, 20 aa, synthetic construct
  source 1..20: note = Seed: SATGFKQSSKALQRPVASDF
SATGFKQFSKALQRPVASDF

SEQ ID NO: 11700 - protein, 20 aa, synthetic construct
  source 1..20: note = Seed: SATGFKQSSKALQRPVASDF
SATGFKQFSKALRRPVASDF

SEQ ID NO: 11701 - protein, 20 aa, synthetic construct
  source 1..20: note = Seed: SATGFKQSSKALQRPVASDF
SATGFKQFSKALSRPVASDF

SEQ ID NO: 11702 - protein, 20 aa, synthetic construct
  source 1..20: note = Seed: SATGFKQSSKALQRPVASDF
SATGFKQFSKALTRPVASDF

SEQ ID NO: 11703 - protein, 20 aa, synthetic construct
  source 1..20: note = Seed: SATGFKQSSKALQRPVASDF
SATGFKQFSKALVRPVASDF

SEQ ID NO: 11704 - protein, 20 aa, synthetic construct
  source 1..20: note = Seed: SATGFKQSSKALQRPVASDF
SATGFKQFSKALYRPVASDF

SEQ ID NO: 11705 - protein, 20 aa, synthetic construct
  source 1..20: note = Seed: SATGFKQSSKALQRPVASDF
SATGFKQFSLALARPVASDF

SEQ ID NO: 11706 - protein, 20 aa, synthetic construct
  source 1..20: note = Seed: SATGFKQSSKALQRPVASDF
SATGFKQFSLALERPVASDF

SEQ ID NO: 11707 - protein, 20 aa, synthetic construct
  source 1..20: note = Seed: SATGFKQSSKALQRPVASDF
SATGFKQFSLALMRPVASDF

SEQ ID NO: 11708 - protein, 20 aa, synthetic construct
  source 1..20: note = Seed: SATGFKQSSKALQRPVASDF
SATGFKQFSLALNRPVASDF

SEQ ID NO: 11709 - protein, 20 aa, synthetic construct
  source 1..20: note = Seed: SATGFKQSSKALQRPVASDF
SATGFKQFSLALQRPVASDF

SEQ ID NO: 11710 - protein, 20 aa, synthetic construct
  source 1..20: note = Seed: SATGFKQSSKALQRPVASDF
SATGFKQFSLALSRPVASDF

SEQ ID NO: 11711 - protein, 20 aa, synthetic construct
  source 1..20: note = Seed: SATGFKQSSKALQRPVASDF
SATGFKQFSLALTRPVASDF

SEQ ID NO: 11712 - protein, 20 aa, synthetic construct
  source 1..20: note = Seed: SATGFKQSSKALQRPVASDF
SATGFKQFSLALVRPVASDF

SEQ ID NO: 11713 - protein, 20 aa, synthetic construct
  source 1..20: note = Seed: SATGFKQSSKALQRPVASDF
SATGFKQFSMALRRPVASDF

SEQ ID NO: 11714 - protein, 20 aa, synthetic construct
  source 1..20: note = Seed: SATGFKQSSKALQRPVASDF
SATGFKQFSMALSRPVASDF

SEQ ID NO: 11715 - protein, 20 aa, synthetic construct
  source 1..20: note = Seed: SATGFKQSSKALQRPVASDF
SATGFKQFSNALARPVASDF

SEQ ID NO: 11716 - protein, 20 aa, synthetic construct
  source 1..20: note = Seed: SATGFKQSSKALQRPVASDF
SATGFKQFSNALCRPVASDF

SEQ ID NO: 11717 - protein, 20 aa, synthetic construct
  source 1..20: note = Seed: SATGFKQSSKALQRPVASDF
SATGFKQFSNALGRPVASDF

SEQ ID NO: 11718 - protein, 20 aa, synthetic construct
  source 1..20: note = Seed: SATGFKQSSKALQRPVASDF
SATGFKQFSNALHRPVASDF

SEQ ID NO: 11719 - protein, 20 aa, synthetic construct
  source 1..20: note = Seed: SATGFKQSSKALQRPVASDF
SATGFKQFSNALIRPVASDF

SEQ ID NO: 11720 - protein, 20 aa, synthetic construct
  source 1..20: note = Seed: SATGFKQSSKALQRPVASDF
SATGFKQFSNALLRPVASDF

SEQ ID NO: 11721 - protein, 20 aa, synthetic construct
  source 1..20: note = Seed: SATGFKQSSKALQRPVASDF
SATGFKQFSNALMRPVASDF

SEQ ID NO: 11722 - protein, 20 aa, synthetic construct
  source 1..20: note = Seed: SATGFKQSSKALQRPVASDF
SATGFKQFSNALNRPVASDF

SEQ ID NO: 11723 - protein, 20 aa, synthetic construct
  source 1..20: note = Seed: SATGFKQSSKALQRPVASDF
SATGFKQFSNALQRPVASDF

SEQ ID NO: 11724 - protein, 20 aa, synthetic construct
  source 1..20: note = Seed: SATGFKQSSKALQRPVASDF
SATGFKQFSNALRRPVASDF

SEQ ID NO: 11725 - protein, 20 aa, synthetic construct
  source 1..20: note = Seed: SATGFKQSSKALQRPVASDF
SATGFKQFSNALSRPVASDF

SEQ ID NO: 11726 - protein, 20 aa, synthetic construct
  source 1..20: note = Seed: SATGFKQSSKALQRPVASDF
SATGFKQFSNALTRPVASDF

SEQ ID NO: 11727 - protein, 20 aa, synthetic construct
  source 1..20: note = Seed: SATGFKQSSKALQRPVASDF
SATGFKQFSNALVRPVASDF

SEQ ID NO: 11728 - protein, 20 aa, synthetic construct
  source 1..20: note = Seed: SATGFKQSSKALQRPVASDF
SATGFKQFSPALARPVASDF

SEQ ID NO: 11729 - protein, 20 aa, synthetic construct
  source 1..20: note = Seed: SATGFKQSSKALQRPVASDF
SATGFKQFSPALCRPVASDF

SEQ ID NO: 11730 - protein, 20 aa, synthetic construct
  source 1..20: note = Seed: SATGFKQSSKALQRPVASDF
SATGFKQFSPALDRPVASDF

SEQ ID NO: 11731 - protein, 20 aa, synthetic construct
  source 1..20: note = Seed: SATGFKQSSKALQRPVASDF
SATGFKQFSPALERPVASDF

SEQ ID NO: 11732 - protein, 20 aa, synthetic construct
  source 1..20: note = Seed: SATGFKQSSKALQRPVASDF
SATGFKQFSPALFRPVASDF

SEQ ID NO: 11733 - protein, 20 aa, synthetic construct
  source 1..20: note = Seed: SATGFKQSSKALQRPVASDF
SATGFKQFSPALGRPVASDF

SEQ ID NO: 11734 - protein, 20 aa, synthetic construct
  source 1..20: note = Seed: SATGFKQSSKALQRPVASDF
SATGFKQFSPALHRPVASDF

SEQ ID NO: 11735 - protein, 20 aa, synthetic construct
  source 1..20: note = Seed: SATGFKQSSKALQRPVASDF
SATGFKQFSPALIRPVASDF

SEQ ID NO: 11736 - protein, 20 aa, synthetic construct
  source 1..20: note = Seed: SATGFKQSSKALQRPVASDF
SATGFKQFSPALLRPVASDF

SEQ ID NO: 11737 - protein, 20 aa, synthetic construct
  source 1..20: note = Seed: SATGFKQSSKALQRPVASDF
SATGFKQFSPALMRPVASDF

SEQ ID NO: 11738 - protein, 20 aa, synthetic construct
  source 1..20: note = Seed: SATGFKQSSKALQRPVASDF
SATGFKQFSPALNRPVASDF

SEQ ID NO: 11739 - protein, 20 aa, synthetic construct
  source 1..20: note = Seed: SATGFKQSSKALQRPVASDF
SATGFKQFSPALQRPVASDF

SEQ ID NO: 11740 - protein, 20 aa, synthetic construct
  source 1..20: note = Seed: SATGFKQSSKALQRPVASDF
SATGFKQFSPALRRPVASDF

SEQ ID NO: 11741 - protein, 20 aa, synthetic construct
  source 1..20: note = Seed: SATGFKQSSKALQRPVASDF
SATGFKQFSPALSRPVASDF

SEQ ID NO: 11742 - protein, 20 aa, synthetic construct
  source 1..20: note = Seed: SATGFKQSSKALQRPVASDF
SATGFKQFSPALVRPVASDF

SEQ ID NO: 11743 - protein, 20 aa, synthetic construct
  source 1..20: note = Seed: SATGFKQSSKALQRPVASDF
SATGFKQFSPALWRPVASDF

SEQ ID NO: 11744 - protein, 20 aa, synthetic construct
  source 1..20: note = Seed: SATGFKQSSKALQRPVASDF
SATGFKQFSPALYRPVASDF

SEQ ID NO: 11745 - protein, 20 aa, synthetic construct
  source 1..20: note = Seed: SATGFKQSSKALQRPVASDF
SATGFKQFSQALLRPVASDF

SEQ ID NO: 11746 - protein, 20 aa, synthetic construct
  source 1..20: note = Seed: SATGFKQSSKALQRPVASDF
SATGFKQFSRALARPVASDF

SEQ ID NO: 11747 - protein, 20 aa, synthetic construct
  source 1..20: note = Seed: SATGFKQSSKALQRPVASDF
SATGFKQFSRALGRPVASDF

SEQ ID NO: 11748 - protein, 20 aa, synthetic construct
  source 1..20: note = Seed: SATGFKQSSKALQRPVASDF
SATGFKQFSRALHRPVASDF

SEQ ID NO: 11749 - protein, 20 aa, synthetic construct
  source 1..20: note = Seed: SATGFKQSSKALQRPVASDF
SATGFKQFSRALIRPVASDF

SEQ ID NO: 11750 - protein, 20 aa, synthetic construct
  source 1..20: note = Seed: SATGFKQSSKALQRPVASDF
SATGFKQFSRALKRPVASDF

SEQ ID NO: 11751 - protein, 20 aa, synthetic construct
  source 1..20: note = Seed: SATGFKQSSKALQRPVASDF
SATGFKQFSRALLRPVASDF

SEQ ID NO: 11752 - protein, 20 aa, synthetic construct
  source 1..20: note = Seed: SATGFKQSSKALQRPVASDF
SATGFKQFSRALMRPVASDF

SEQ ID NO: 11753 - protein, 20 aa, synthetic construct
  source 1..20: note = Seed: SATGFKQSSKALQRPVASDF
SATGFKQFSRALNRPVASDF

SEQ ID NO: 11754 - protein, 20 aa, synthetic construct
  source 1..20: note = Seed: SATGFKQSSKALQRPVASDF
SATGFKQFSRALPRPVASDF

SEQ ID NO: 11755 - protein, 20 aa, synthetic construct
  source 1..20: note = Seed: SATGFKQSSKALQRPVASDF
SATGFKQFSRALQRPVASDF

SEQ ID NO: 11756 - protein, 20 aa, synthetic construct
  source 1..20: note = Seed: SATGFKQSSKALQRPVASDF
SATGFKQFSRALRRPVASDF

SEQ ID NO: 11757 - protein, 20 aa, synthetic construct
  source 1..20: note = Seed: SATGFKQSSKALQRPVASDF
SATGFKQFSRALSRPVASDF

SEQ ID NO: 11758 - protein, 20 aa, synthetic construct
  source 1..20: note = Seed: SATGFKQSSKALQRPVASDF
SATGFKQFSRALTRPVASDF

SEQ ID NO: 11759 - protein, 20 aa, synthetic construct
  source 1..20: note = Seed: SATGFKQSSKALQRPVASDF
SATGFKQFSRALVRPVASDF

SEQ ID NO: 11760 - protein, 20 aa, synthetic construct
  source 1..20: note = Seed: SATGFKQSSKALQRPVASDF
SATGFKQFSRALYRPVASDF

SEQ ID NO: 11761 - protein, 20 aa, synthetic construct
  source 1..20: note = Seed: SATGFKQSSKALQRPVASDF
SATGFKQFSSALARPVASDF

SEQ ID NO: 11762 - protein, 20 aa, synthetic construct
  source 1..20: note = Seed: SATGFKQSSKALQRPVASDF
SATGFKQFSSALCRPVASDF

SEQ ID NO: 11763 - protein, 20 aa, synthetic construct
  source 1..20: note = Seed: SATGFKQSSKALQRPVASDF
SATGFKQFSSALDRPVASDF

SEQ ID NO: 11764 - protein, 20 aa, synthetic construct
  source 1..20: note = Seed: SATGFKQSSKALQRPVASDF
SATGFKQFSSALERPVASDF

SEQ ID NO: 11765 - protein, 20 aa, synthetic construct
  source 1..20: note = Seed: SATGFKQSSKALQRPVASDF
SATGFKQFSSALFRPVASDF

SEQ ID NO: 11766 - protein, 20 aa, synthetic construct
  source 1..20: note = Seed: SATGFKQSSKALQRPVASDF
SATGFKQFSSALGRPVASDF

SEQ ID NO: 11767 - protein, 20 aa, synthetic construct
  source 1..20: note = Seed: SATGFKQSSKALQRPVASDF
SATGFKQFSSALHRPVASDF

SEQ ID NO: 11768 - protein, 20 aa, synthetic construct
  source 1..20: note = Seed: SATGFKQSSKALQRPVASDF
SATGFKQFSSALIRPVASDF

SEQ ID NO: 11769 - protein, 20 aa, synthetic construct
  source 1..20: note = Seed: SATGFKQSSKALQRPVASDF
SATGFKQFSSALKRPVASDF

SEQ ID NO: 11770 - protein, 20 aa, synthetic construct
  source 1..20: note = Seed: SATGFKQSSKALQRPVASDF
SATGFKQFSSALLRPVASDF

SEQ ID NO: 11771 - protein, 20 aa, synthetic construct
  source 1..20: note = Seed: SATGFKQSSKALQRPVASDF
SATGFKQFSSALMRPVASDF

SEQ ID NO: 11772 - protein, 20 aa, synthetic construct
  source 1..20: note = Seed: SATGFKQSSKALQRPVASDF
SATGFKQFSSALNRPVASDF

SEQ ID NO: 11773 - protein, 20 aa, synthetic construct
  source 1..20: note = Seed: SATGFKQSSKALQRPVASDF
SATGFKQFSSALPRPVASDF

SEQ ID NO: 11774 - protein, 20 aa, synthetic construct
  source 1..20: note = Seed: SATGFKQSSKALQRPVASDF
SATGFKQFSSALQRPVASDF

SEQ ID NO: 11775 - protein, 20 aa, synthetic construct
  source 1..20: note = Seed: SATGFKQSSKALQRPVASDF
SATGFKQFSSALRRPVASDF

SEQ ID NO: 11776 - protein, 20 aa, synthetic construct
  source 1..20: note = Seed: SATGFKQSSKALQRPVASDF
SATGFKQFSSALSRPVASDF

SEQ ID NO: 11777 - protein, 20 aa, synthetic construct
  source 1..20: note = Seed: SATGFKQSSKALQRPVASDF
SATGFKQFSSALTRPVASDF

SEQ ID NO: 11778 - protein, 20 aa, synthetic construct
  source 1..20: note = Seed: SATGFKQSSKALQRPVASDF
SATGFKQFSSALVRPVASDF

SEQ ID NO: 11779 - protein, 20 aa, synthetic construct
  source 1..20: note = Seed: SATGFKQSSKALQRPVASDF
SATGFKQFSSALYRPVASDF

SEQ ID NO: 11780 - protein, 20 aa, synthetic construct
  source 1..20: note = Seed: SATGFKQSSKALQRPVASDF
SATGFKQFSTALARPVASDF

SEQ ID NO: 11781 - protein, 20 aa, synthetic construct
  source 1..20: note = Seed: SATGFKQSSKALQRPVASDF
SATGFKQFSTALCRPVASDF

SEQ ID NO: 11782 - protein, 20 aa, synthetic construct
  source 1..20: note = Seed: SATGFKQSSKALQRPVASDF
SATGFKQFSTALDRPVASDF

SEQ ID NO: 11783 - protein, 20 aa, synthetic construct
  source 1..20: note = Seed: SATGFKQSSKALQRPVASDF
SATGFKQFSTALERPVASDF

SEQ ID NO: 11784 - protein, 20 aa, synthetic construct
  source 1..20: note = Seed: SATGFKQSSKALQRPVASDF
SATGFKQFSTALFRPVASDF

SEQ ID NO: 11785 - protein, 20 aa, synthetic construct
  source 1..20: note = Seed: SATGFKQSSKALQRPVASDF
SATGFKQFSTALGRPVASDF

SEQ ID NO: 11786 - protein, 20 aa, synthetic construct
  source 1..20: note = Seed: SATGFKQSSKALQRPVASDF
SATGFKQFSTALHRPVASDF

SEQ ID NO: 11787 - protein, 20 aa, synthetic construct
  source 1..20: note = Seed: SATGFKQSSKALQRPVASDF
SATGFKQFSTALIRPVASDF

SEQ ID NO: 11788 - protein, 20 aa, synthetic construct
  source 1..20: note = Seed: SATGFKQSSKALQRPVASDF
SATGFKQFSTALKRPVASDF

SEQ ID NO: 11789 - protein, 20 aa, synthetic construct
  source 1..20: note = Seed: SATGFKQSSKALQRPVASDF
SATGFKQFSTALLRPVASDF

SEQ ID NO: 11790 - protein, 20 aa, synthetic construct
  source 1..20: note = Seed: SATGFKQSSKALQRPVASDF
SATGFKQFSTALMRPVASDF

SEQ ID NO: 11791 - protein, 20 aa, synthetic construct
  source 1..20: note = Seed: SATGFKQSSKALQRPVASDF
SATGFKQFSTALNRPVASDF

SEQ ID NO: 11792 - protein, 20 aa, synthetic construct
  source 1..20: note = Seed: SATGFKQSSKALQRPVASDF
SATGFKQFSTALQRPVASDF

SEQ ID NO: 11793 - protein, 20 aa, synthetic construct
  source 1..20: note = Seed: SATGFKQSSKALQRPVASDF
SATGFKQFSTALRRPVASDF

SEQ ID NO: 11794 - protein, 20 aa, synthetic construct
  source 1..20: note = Seed: SATGFKQSSKALQRPVASDF
SATGFKQFSTALSRPVASDF

SEQ ID NO: 11795 - protein, 20 aa, synthetic construct
  source 1..20: note = Seed: SATGFKQSSKALQRPVASDF
SATGFKQFSTALTRPVASDF

SEQ ID NO: 11796 - protein, 20 aa, synthetic construct
  source 1..20: note = Seed: SATGFKQSSKALQRPVASDF
SATGFKQFSTALVRPVASDF

SEQ ID NO: 11797 - protein, 20 aa, synthetic construct
  source 1..20: note = Seed: SATGFKQSSKALQRPVASDF
SATGFKQFSTALWRPVASDF

SEQ ID NO: 11798 - protein, 20 aa, synthetic construct
  source 1..20: note = Seed: SATGFKQSSKALQRPVASDF
SATGFKQFSTALYRPVASDF

SEQ ID NO: 11799 - protein, 20 aa, synthetic construct
  source 1..20: note = Seed: SATGFKQSSKALQRPVASDF
SATGFKQFSVALARPVASDF

SEQ ID NO: 11800 - protein, 20 aa, synthetic construct
  source 1..20: note = Seed: SATGFKQSSKALQRPVASDF
SATGFKQFSVALCRPVASDF

SEQ ID NO: 11801 - protein, 20 aa, synthetic construct
  source 1..20: note = Seed: SATGFKQSSKALQRPVASDF
SATGFKQFSVALDRPVASDF

SEQ ID NO: 11802 - protein, 20 aa, synthetic construct
  source 1..20: note = Seed: SATGFKQSSKALQRPVASDF
SATGFKQFSVALERPVASDF

SEQ ID NO: 11803 - protein, 20 aa, synthetic construct
  source 1..20: note = Seed: SATGFKQSSKALQRPVASDF
SATGFKQFSVALGRPVASDF

SEQ ID NO: 11804 - protein, 20 aa, synthetic construct
  source 1..20: note = Seed: SATGFKQSSKALQRPVASDF
SATGFKQFSVALHRPVASDF

SEQ ID NO: 11805 - protein, 20 aa, synthetic construct
  source 1..20: note = Seed: SATGFKQSSKALQRPVASDF
SATGFKQFSVALIRPVASDF

SEQ ID NO: 11806 - protein, 20 aa, synthetic construct
  source 1..20: note = Seed: SATGFKQSSKALQRPVASDF
SATGFKQFSVALKRPVASDF

SEQ ID NO: 11807 - protein, 20 aa, synthetic construct
  source 1..20: note = Seed: SATGFKQSSKALQRPVASDF
SATGFKQFSVALLRPVASDF

SEQ ID NO: 11808 - protein, 20 aa, synthetic construct
  source 1..20: note = Seed: SATGFKQSSKALQRPVASDF
SATGFKQFSVALNRPVASDF

SEQ ID NO: 11809 - protein, 20 aa, synthetic construct
  source 1..20: note = Seed: SATGFKQSSKALQRPVASDF
SATGFKQFSVALQRPVASDF

SEQ ID NO: 11810 - protein, 20 aa, synthetic construct
  source 1..20: note = Seed: SATGFKQSSKALQRPVASDF
SATGFKQFSVALSRPVASDF

SEQ ID NO: 11811 - protein, 20 aa, synthetic construct
  source 1..20: note = Seed: SATGFKQSSKALQRPVASDF
SATGFKQFSVALVRPVASDF

SEQ ID NO: 11812 - protein, 20 aa, synthetic construct
  source 1..20: note = Seed: SATGFKQSSKALQRPVASDF
SATGFKQFSVALYRPVASDF

SEQ ID NO: 11813 - protein, 20 aa, synthetic construct
  source 1..20: note = Seed: SATGFKQSSKALQRPVASDF
SATGFKQGSAALARPVASDF

SEQ ID NO: 11814 - protein, 20 aa, synthetic construct
  source 1..20: note = Seed: SATGFKQSSKALQRPVASDF
SATGFKQGSAALCRPVASDF

SEQ ID NO: 11815 - protein, 20 aa, synthetic construct
  source 1..20: note = Seed: SATGFKQSSKALQRPVASDF
SATGFKQGSAALFRPVASDF

SEQ ID NO: 11816 - protein, 20 aa, synthetic construct
  source 1..20: note = Seed: SATGFKQSSKALQRPVASDF
SATGFKQGSAALGRPVASDF

SEQ ID NO: 11817 - protein, 20 aa, synthetic construct
  source 1..20: note = Seed: SATGFKQSSKALQRPVASDF
SATGFKQGSAALHRPVASDF

SEQ ID NO: 11818 - protein, 20 aa, synthetic construct
  source 1..20: note = Seed: SATGFKQSSKALQRPVASDF
SATGFKQGSAALIRPVASDF

SEQ ID NO: 11819 - protein, 20 aa, synthetic construct
  source 1..20: note = Seed: SATGFKQSSKALQRPVASDF
SATGFKQGSAALLRPVASDF

SEQ ID NO: 11820 - protein, 20 aa, synthetic construct
  source 1..20: note = Seed: SATGFKQSSKALQRPVASDF
SATGFKQGSAALMRPVASDF

SEQ ID NO: 11821 - protein, 20 aa, synthetic construct
  source 1..20: note = Seed: SATGFKQSSKALQRPVASDF
SATGFKQGSAALNRPVASDF

SEQ ID NO: 11822 - protein, 20 aa, synthetic construct
  source 1..20: note = Seed: SATGFKQSSKALQRPVASDF
SATGFKQGSAALPRPVASDF

SEQ ID NO: 11823 - protein, 20 aa, synthetic construct
  source 1..20: note = Seed: SATGFKQSSKALQRPVASDF
SATGFKQGSAALQRPVASDF

SEQ ID NO: 11824 - protein, 20 aa, synthetic construct
  source 1..20: note = Seed: SATGFKQSSKALQRPVASDF
SATGFKQGSAALSRPVASDF

SEQ ID NO: 11825 - protein, 20 aa, synthetic construct
  source 1..20: note = Seed: SATGFKQSSKALQRPVASDF
SATGFKQGSAALTRPVASDF

SEQ ID NO: 11826 - protein, 20 aa, synthetic construct
  source 1..20: note = Seed: SATGFKQSSKALQRPVASDF
SATGFKQGSAALVRPVASDF

SEQ ID NO: 11827 - protein, 20 aa, synthetic construct
  source 1..20: note = Seed: SATGFKQSSKALQRPVASDF
SATGFKQGSAALYRPVASDF

SEQ ID NO: 11828 - protein, 20 aa, synthetic construct
  source 1..20: note = Seed: SATGFKQSSKALQRPVASDF
SATGFKQGSFALERPVASDF

SEQ ID NO: 11829 - protein, 20 aa, synthetic construct
  source 1..20: note = Seed: SATGFKQSSKALQRPVASDF
SATGFKQGSFALIRPVASDF

SEQ ID NO: 11830 - protein, 20 aa, synthetic construct
  source 1..20: note = Seed: SATGFKQSSKALQRPVASDF
SATGFKQGSFALLRPVASDF

SEQ ID NO: 11831 - protein, 20 aa, synthetic construct
  source 1..20: note = Seed: SATGFKQSSKALQRPVASDF
SATGFKQGSFALVRPVASDF

SEQ ID NO: 11832 - protein, 20 aa, synthetic construct
  source 1..20: note = Seed: SATGFKQSSKALQRPVASDF
SATGFKQGSGALARPVASDF

SEQ ID NO: 11833 - protein, 20 aa, synthetic construct
  source 1..20: note = Seed: SATGFKQSSKALQRPVASDF
SATGFKQGSGALFRPVASDF

SEQ ID NO: 11834 - protein, 20 aa, synthetic construct
  source 1..20: note = Seed: SATGFKQSSKALQRPVASDF
SATGFKQGSGALIRPVASDF

SEQ ID NO: 11835 - protein, 20 aa, synthetic construct
  source 1..20: note = Seed: SATGFKQSSKALQRPVASDF
SATGFKQGSGALLRPVASDF

SEQ ID NO: 11836 - protein, 20 aa, synthetic construct
  source 1..20: note = Seed: SATGFKQSSKALQRPVASDF
SATGFKQGSGALMRPVASDF

SEQ ID NO: 11837 - protein, 20 aa, synthetic construct
  source 1..20: note = Seed: SATGFKQSSKALQRPVASDF
SATGFKQGSGALSRPVASDF

SEQ ID NO: 11838 - protein, 20 aa, synthetic construct
  source 1..20: note = Seed: SATGFKQSSKALQRPVASDF
SATGFKQGSGALTRPVASDF

SEQ ID NO: 11839 - protein, 20 aa, synthetic construct
  source 1..20: note = Seed: SATGFKQSSKALQRPVASDF
SATGFKQGSGALVRPVASDF

SEQ ID NO: 11840 - protein, 20 aa, synthetic construct
  source 1..20: note = Seed: SATGFKQSSKALQRPVASDF
SATGFKQGSIALGRPVASDF

SEQ ID NO: 11841 - protein, 20 aa, synthetic construct
  source 1..20: note = Seed: SATGFKQSSKALQRPVASDF
SATGFKQGSIALHRPVASDF

SEQ ID NO: 11842 - protein, 20 aa, synthetic construct
  source 1..20: note = Seed: SATGFKQSSKALQRPVASDF
SATGFKQGSIALNRPVASDF

SEQ ID NO: 11843 - protein, 20 aa, synthetic construct
  source 1..20: note = Seed: SATGFKQSSKALQRPVASDF
SATGFKQGSIALSRPVASDF

SEQ ID NO: 11844 - protein, 20 aa, synthetic construct
  source 1..20: note = Seed: SATGFKQSSKALQRPVASDF
SATGFKQGSIALTRPVASDF

SEQ ID NO: 11845 - protein, 20 aa, synthetic construct
  source 1..20: note = Seed: SATGFKQSSKALQRPVASDF
SATGFKQGSIALVRPVASDF

SEQ ID NO: 11846 - protein, 20 aa, synthetic construct
  source 1..20: note = Seed: SATGFKQSSKALQRPVASDF
SATGFKQGSKALARPVASDF

SEQ ID NO: 11847 - protein, 20 aa, synthetic construct
  source 1..20: note = Seed: SATGFKQSSKALQRPVASDF
SATGFKQGSKALSRPVASDF

SEQ ID NO: 11848 - protein, 20 aa, synthetic construct
  source 1..20: note = Seed: SATGFKQSSKALQRPVASDF
SATGFKQGSLALHRPVASDF

SEQ ID NO: 11849 - protein, 20 aa, synthetic construct
  source 1..20: note = Seed: SATGFKQSSKALQRPVASDF
SATGFKQGSLALNRPVASDF

SEQ ID NO: 11850 - protein, 20 aa, synthetic construct
  source 1..20: note = Seed: SATGFKQSSKALQRPVASDF
SATGFKQGSLALSRPVASDF

SEQ ID NO: 11851 - protein, 20 aa, synthetic construct
  source 1..20: note = Seed: SATGFKQSSKALQRPVASDF
SATGFKQGSLALVRPVASDF

SEQ ID NO: 11852 - protein, 20 aa, synthetic construct
  source 1..20: note = Seed: SATGFKQSSKALQRPVASDF
SATGFKQGSMALIRPVASDF

SEQ ID NO: 11853 - protein, 20 aa, synthetic construct
  source 1..20: note = Seed: SATGFKQSSKALQRPVASDF
SATGFKQGSMALNRPVASDF

SEQ ID NO: 11854 - protein, 20 aa, synthetic construct
  source 1..20: note = Seed: SATGFKQSSKALQRPVASDF
SATGFKQGSMALSRPVASDF

SEQ ID NO: 11855 - protein, 20 aa, synthetic construct
  source 1..20: note = Seed: SATGFKQSSKALQRPVASDF
SATGFKQGSMALVRPVASDF

SEQ ID NO: 11856 - protein, 20 aa, synthetic construct
  source 1..20: note = Seed: SATGFKQSSKALQRPVASDF
SATGFKQGSNALARPVASDF

SEQ ID NO: 11857 - protein, 20 aa, synthetic construct
  source 1..20: note = Seed: SATGFKQSSKALQRPVASDF
SATGFKQGSNALIRPVASDF

SEQ ID NO: 11858 - protein, 20 aa, synthetic construct
  source 1..20: note = Seed: SATGFKQSSKALQRPVASDF
SATGFKQGSNALLRPVASDF

SEQ ID NO: 11859 - protein, 20 aa, synthetic construct
  source 1..20: note = Seed: SATGFKQSSKALQRPVASDF
SATGFKQGSNALMRPVASDF

SEQ ID NO: 11860 - protein, 20 aa, synthetic construct
  source 1..20: note = Seed: SATGFKQSSKALQRPVASDF
SATGFKQGSNALNRPVASDF

SEQ ID NO: 11861 - protein, 20 aa, synthetic construct
  source 1..20: note = Seed: SATGFKQSSKALQRPVASDF
SATGFKQGSNALSRPVASDF

SEQ ID NO: 11862 - protein, 20 aa, synthetic construct
  source 1..20: note = Seed: SATGFKQSSKALQRPVASDF
SATGFKQGSNALTRPVASDF

SEQ ID NO: 11863 - protein, 20 aa, synthetic construct
  source 1..20: note = Seed: SATGFKQSSKALQRPVASDF
SATGFKQGSNALVRPVASDF

SEQ ID NO: 11864 - protein, 20 aa, synthetic construct
  source 1..20: note = Seed: SATGFKQSSKALQRPVASDF
SATGFKQGSPALARPVASDF

SEQ ID NO: 11865 - protein, 20 aa, synthetic construct
  source 1..20: note = Seed: SATGFKQSSKALQRPVASDF
SATGFKQGSPALFRPVASDF

SEQ ID NO: 11866 - protein, 20 aa, synthetic construct
  source 1..20: note = Seed: SATGFKQSSKALQRPVASDF
SATGFKQGSPALIRPVASDF

SEQ ID NO: 11867 - protein, 20 aa, synthetic construct
  source 1..20: note = Seed: SATGFKQSSKALQRPVASDF
SATGFKQGSPALLRPVASDF

SEQ ID NO: 11868 - protein, 20 aa, synthetic construct
  source 1..20: note = Seed: SATGFKQSSKALQRPVASDF
SATGFKQGSPALMRPVASDF

SEQ ID NO: 11869 - protein, 20 aa, synthetic construct
  source 1..20: note = Seed: SATGFKQSSKALQRPVASDF
SATGFKQGSPALNRPVASDF

SEQ ID NO: 11870 - protein, 20 aa, synthetic construct
  source 1..20: note = Seed: SATGFKQSSKALQRPVASDF
SATGFKQGSPALSRPVASDF

SEQ ID NO: 11871 - protein, 20 aa, synthetic construct
  source 1..20: note = Seed: SATGFKQSSKALQRPVASDF
SATGFKQGSPALTRPVASDF

SEQ ID NO: 11872 - protein, 20 aa, synthetic construct
  source 1..20: note = Seed: SATGFKQSSKALQRPVASDF
SATGFKQGSPALVRPVASDF

SEQ ID NO: 11873 - protein, 20 aa, synthetic construct
  source 1..20: note = Seed: SATGFKQSSKALQRPVASDF
SATGFKQGSRALARPVASDF

SEQ ID NO: 11874 - protein, 20 aa, synthetic construct
  source 1..20: note = Seed: SATGFKQSSKALQRPVASDF
SATGFKQGSRALSRPVASDF

SEQ ID NO: 11875 - protein, 20 aa, synthetic construct
  source 1..20: note = Seed: SATGFKQSSKALQRPVASDF
SATGFKQGSSALARPVASDF

SEQ ID NO: 11876 - protein, 20 aa, synthetic construct
  source 1..20: note = Seed: SATGFKQSSKALQRPVASDF
SATGFKQGSSALFRPVASDF

SEQ ID NO: 11877 - protein, 20 aa, synthetic construct
  source 1..20: note = Seed: SATGFKQSSKALQRPVASDF
SATGFKQGSSALGRPVASDF

SEQ ID NO: 11878 - protein, 20 aa, synthetic construct
  source 1..20: note = Seed: SATGFKQSSKALQRPVASDF
SATGFKQGSSALIRPVASDF

SEQ ID NO: 11879 - protein, 20 aa, synthetic construct
  source 1..20: note = Seed: SATGFKQSSKALQRPVASDF
SATGFKQGSSALLRPVASDF

SEQ ID NO: 11880 - protein, 20 aa, synthetic construct
  source 1..20: note = Seed: SATGFKQSSKALQRPVASDF
SATGFKQGSSALMRPVASDF

SEQ ID NO: 11881 - protein, 20 aa, synthetic construct
  source 1..20: note = Seed: SATGFKQSSKALQRPVASDF
SATGFKQGSSALNRPVASDF

SEQ ID NO: 11882 - protein, 20 aa, synthetic construct
  source 1..20: note = Seed: SATGFKQSSKALQRPVASDF
SATGFKQGSSALSRPVASDF

SEQ ID NO: 11883 - protein, 20 aa, synthetic construct
  source 1..20: note = Seed: SATGFKQSSKALQRPVASDF
SATGFKQGSSALTRPVASDF

SEQ ID NO: 11884 - protein, 20 aa, synthetic construct
  source 1..20: note = Seed: SATGFKQSSKALQRPVASDF
SATGFKQGSSALVRPVASDF

SEQ ID NO: 11885 - protein, 20 aa, synthetic construct
  source 1..20: note = Seed: SATGFKQSSKALQRPVASDF
SATGFKQGSTALARPVASDF

SEQ ID NO: 11886 - protein, 20 aa, synthetic construct
  source 1..20: note = Seed: SATGFKQSSKALQRPVASDF
SATGFKQGSTALIRPVASDF

SEQ ID NO: 11887 - protein, 20 aa, synthetic construct
  source 1..20: note = Seed: SATGFKQSSKALQRPVASDF
SATGFKQGSTALLRPVASDF

SEQ ID NO: 11888 - protein, 20 aa, synthetic construct
  source 1..20: note = Seed: SATGFKQSSKALQRPVASDF
SATGFKQGSTALMRPVASDF

SEQ ID NO: 11889 - protein, 20 aa, synthetic construct
  source 1..20: note = Seed: SATGFKQSSKALQRPVASDF
SATGFKQGSTALNRPVASDF

SEQ ID NO: 11890 - protein, 20 aa, synthetic construct
  source 1..20: note = Seed: SATGFKQSSKALQRPVASDF
SATGFKQGSTALSRPVASDF

SEQ ID NO: 11891 - protein, 20 aa, synthetic construct
  source 1..20: note = Seed: SATGFKQSSKALQRPVASDF
SATGFKQGSTALTRPVASDF

SEQ ID NO: 11892 - protein, 20 aa, synthetic construct
  source 1..20: note = Seed: SATGFKQSSKALQRPVASDF
SATGFKQGSTALVRPVASDF

SEQ ID NO: 11893 - protein, 20 aa, synthetic construct
  source 1..20: note = Seed: SATGFKQSSKALQRPVASDF
SATGFKQGSVALARPVASDF

SEQ ID NO: 11894 - protein, 20 aa, synthetic construct
  source 1..20: note = Seed: SATGFKQSSKALQRPVASDF
SATGFKQGSVALGRPVASDF

SEQ ID NO: 11895 - protein, 20 aa, synthetic construct
  source 1..20: note = Seed: SATGFKQSSKALQRPVASDF
SATGFKQGSVALHRPVASDF

SEQ ID NO: 11896 - protein, 20 aa, synthetic construct
  source 1..20: note = Seed: SATGFKQSSKALQRPVASDF
SATGFKQGSVALIRPVASDF

SEQ ID NO: 11897 - protein, 20 aa, synthetic construct
  source 1..20: note = Seed: SATGFKQSSKALQRPVASDF
SATGFKQGSVALLRPVASDF

SEQ ID NO: 11898 - protein, 20 aa, synthetic construct
  source 1..20: note = Seed: SATGFKQSSKALQRPVASDF
SATGFKQGSVALMRPVASDF

SEQ ID NO: 11899 - protein, 20 aa, synthetic construct
  source 1..20: note = Seed: SATGFKQSSKALQRPVASDF
SATGFKQGSVALNRPVASDF

SEQ ID NO: 11900 - protein, 20 aa, synthetic construct
  source 1..20: note = Seed: SATGFKQSSKALQRPVASDF
SATGFKQGSVALQRPVASDF

SEQ ID NO: 11901 - protein, 20 aa, synthetic construct
  source 1..20: note = Seed: SATGFKQSSKALQRPVASDF
SATGFKQGSVALSRPVASDF

SEQ ID NO: 11902 - protein, 20 aa, synthetic construct
  source 1..20: note = Seed: SATGFKQSSKALQRPVASDF
SATGFKQGSVALTRPVASDF

SEQ ID NO: 11903 - protein, 20 aa, synthetic construct
  source 1..20: note = Seed: SATGFKQSSKALQRPVASDF
SATGFKQGSVALVRPVASDF

SEQ ID NO: 11904 - protein, 20 aa, synthetic construct
  source 1..20: note = Seed: SATGFKQSSKALQRPVASDF
SATGFKQHSAALARPVASDF

SEQ ID NO: 11905 - protein, 20 aa, synthetic construct
  source 1..20: note = Seed: SATGFKQSSKALQRPVASDF
SATGFKQHSAALFRPVASDF

SEQ ID NO: 11906 - protein, 20 aa, synthetic construct
  source 1..20: note = Seed: SATGFKQSSKALQRPVASDF
SATGFKQHSAALGRPVASDF

SEQ ID NO: 11907 - protein, 20 aa, synthetic construct
  source 1..20: note = Seed: SATGFKQSSKALQRPVASDF
SATGFKQHSAALIRPVASDF

SEQ ID NO: 11908 - protein, 20 aa, synthetic construct
  source 1..20: note = Seed: SATGFKQSSKALQRPVASDF
SATGFKQHSAALLRPVASDF

SEQ ID NO: 11909 - protein, 20 aa, synthetic construct
  source 1..20: note = Seed: SATGFKQSSKALQRPVASDF
SATGFKQHSAALMRPVASDF

SEQ ID NO: 11910 - protein, 20 aa, synthetic construct
  source 1..20: note = Seed: SATGFKQSSKALQRPVASDF
SATGFKQHSAALNRPVASDF

SEQ ID NO: 11911 - protein, 20 aa, synthetic construct
  source 1..20: note = Seed: SATGFKQSSKALQRPVASDF
SATGFKQHSAALSRPVASDF

SEQ ID NO: 11912 - protein, 20 aa, synthetic construct
  source 1..20: note = Seed: SATGFKQSSKALQRPVASDF
SATGFKQHSAALTRPVASDF

SEQ ID NO: 11913 - protein, 20 aa, synthetic construct
  source 1..20: note = Seed: SATGFKQSSKALQRPVASDF
SATGFKQHSAALVRPVASDF

SEQ ID NO: 11914 - protein, 20 aa, synthetic construct
  source 1..20: note = Seed: SATGFKQSSKALQRPVASDF
SATGFKQHSFALARPVASDF

SEQ ID NO: 11915 - protein, 20 aa, synthetic construct
  source 1..20: note = Seed: SATGFKQSSKALQRPVASDF
SATGFKQHSFALDRPVASDF

SEQ ID NO: 11916 - protein, 20 aa, synthetic construct
  source 1..20: note = Seed: SATGFKQSSKALQRPVASDF
SATGFKQHSFALERPVASDF

SEQ ID NO: 11917 - protein, 20 aa, synthetic construct
  source 1..20: note = Seed: SATGFKQSSKALQRPVASDF
SATGFKQHSFALFRPVASDF

SEQ ID NO: 11918 - protein, 20 aa, synthetic construct
  source 1..20: note = Seed: SATGFKQSSKALQRPVASDF
SATGFKQHSFALIRPVASDF

SEQ ID NO: 11919 - protein, 20 aa, synthetic construct
  source 1..20: note = Seed: SATGFKQSSKALQRPVASDF
SATGFKQHSFALLRPVASDF

SEQ ID NO: 11920 - protein, 20 aa, synthetic construct
  source 1..20: note = Seed: SATGFKQSSKALQRPVASDF
SATGFKQHSFALMRPVASDF

SEQ ID NO: 11921 - protein, 20 aa, synthetic construct
  source 1..20: note = Seed: SATGFKQSSKALQRPVASDF
SATGFKQHSFALSRPVASDF

SEQ ID NO: 11922 - protein, 20 aa, synthetic construct
  source 1..20: note = Seed: SATGFKQSSKALQRPVASDF
SATGFKQHSFALTRPVASDF

SEQ ID NO: 11923 - protein, 20 aa, synthetic construct
  source 1..20: note = Seed: SATGFKQSSKALQRPVASDF
SATGFKQHSFALVRPVASDF

SEQ ID NO: 11924 - protein, 20 aa, synthetic construct
  source 1..20: note = Seed: SATGFKQSSKALQRPVASDF
SATGFKQHSGALARPVASDF

SEQ ID NO: 11925 - protein, 20 aa, synthetic construct
  source 1..20: note = Seed: SATGFKQSSKALQRPVASDF
SATGFKQHSGALIRPVASDF

SEQ ID NO: 11926 - protein, 20 aa, synthetic construct
  source 1..20: note = Seed: SATGFKQSSKALQRPVASDF
SATGFKQHSGALLRPVASDF

SEQ ID NO: 11927 - protein, 20 aa, synthetic construct
  source 1..20: note = Seed: SATGFKQSSKALQRPVASDF
SATGFKQHSGALMRPVASDF

SEQ ID NO: 11928 - protein, 20 aa, synthetic construct
  source 1..20: note = Seed: SATGFKQSSKALQRPVASDF
SATGFKQHSGALSRPVASDF

SEQ ID NO: 11929 - protein, 20 aa, synthetic construct
  source 1..20: note = Seed: SATGFKQSSKALQRPVASDF
SATGFKQHSGALTRPVASDF

SEQ ID NO: 11930 - protein, 20 aa, synthetic construct
  source 1..20: note = Seed: SATGFKQSSKALQRPVASDF
SATGFKQHSGALVRPVASDF

SEQ ID NO: 11931 - protein, 20 aa, synthetic construct
  source 1..20: note = Seed: SATGFKQSSKALQRPVASDF
SATGFKQHSIALGRPVASDF

SEQ ID NO: 11932 - protein, 20 aa, synthetic construct
  source 1..20: note = Seed: SATGFKQSSKALQRPVASDF
SATGFKQHSIALHRPVASDF

SEQ ID NO: 11933 - protein, 20 aa, synthetic construct
  source 1..20: note = Seed: SATGFKQSSKALQRPVASDF
SATGFKQHSIALNRPVASDF

SEQ ID NO: 11934 - protein, 20 aa, synthetic construct
  source 1..20: note = Seed: SATGFKQSSKALQRPVASDF
SATGFKQHSIALRRPVASDF

SEQ ID NO: 11935 - protein, 20 aa, synthetic construct
  source 1..20: note = Seed: SATGFKQSSKALQRPVASDF
SATGFKQHSIALSRPVASDF

SEQ ID NO: 11936 - protein, 20 aa, synthetic construct
  source 1..20: note = Seed: SATGFKQSSKALQRPVASDF
SATGFKQHSKALARPVASDF

SEQ ID NO: 11937 - protein, 20 aa, synthetic construct
  source 1..20: note = Seed: SATGFKQSSKALQRPVASDF
SATGFKQHSKALRRPVASDF

SEQ ID NO: 11938 - protein, 20 aa, synthetic construct
  source 1..20: note = Seed: SATGFKQSSKALQRPVASDF
SATGFKQHSLALNRPVASDF

SEQ ID NO: 11939 - protein, 20 aa, synthetic construct
  source 1..20: note = Seed: SATGFKQSSKALQRPVASDF
SATGFKQHSMALNRPVASDF

SEQ ID NO: 11940 - protein, 20 aa, synthetic construct
  source 1..20: note = Seed: SATGFKQSSKALQRPVASDF
SATGFKQHSMALSRPVASDF

SEQ ID NO: 11941 - protein, 20 aa, synthetic construct
  source 1..20: note = Seed: SATGFKQSSKALQRPVASDF
SATGFKQHSMALVRPVASDF

SEQ ID NO: 11942 - protein, 20 aa, synthetic construct
  source 1..20: note = Seed: SATGFKQSSKALQRPVASDF
SATGFKQHSNALARPVASDF

SEQ ID NO: 11943 - protein, 20 aa, synthetic construct
  source 1..20: note = Seed: SATGFKQSSKALQRPVASDF
SATGFKQHSNALIRPVASDF

SEQ ID NO: 11944 - protein, 20 aa, synthetic construct
  source 1..20: note = Seed: SATGFKQSSKALQRPVASDF
SATGFKQHSNALLRPVASDF

SEQ ID NO: 11945 - protein, 20 aa, synthetic construct
  source 1..20: note = Seed: SATGFKQSSKALQRPVASDF
SATGFKQHSNALVRPVASDF

SEQ ID NO: 11946 - protein, 20 aa, synthetic construct
  source 1..20: note = Seed: SATGFKQSSKALQRPVASDF
SATGFKQHSPALARPVASDF

SEQ ID NO: 11947 - protein, 20 aa, synthetic construct
  source 1..20: note = Seed: SATGFKQSSKALQRPVASDF
SATGFKQHSPALIRPVASDF

SEQ ID NO: 11948 - protein, 20 aa, synthetic construct
  source 1..20: note = Seed: SATGFKQSSKALQRPVASDF
SATGFKQHSPALLRPVASDF

SEQ ID NO: 11949 - protein, 20 aa, synthetic construct
  source 1..20: note = Seed: SATGFKQSSKALQRPVASDF
SATGFKQHSPALMRPVASDF

SEQ ID NO: 11950 - protein, 20 aa, synthetic construct
  source 1..20: note = Seed: SATGFKQSSKALQRPVASDF
SATGFKQHSPALNRPVASDF

SEQ ID NO: 11951 - protein, 20 aa, synthetic construct
  source 1..20: note = Seed: SATGFKQSSKALQRPVASDF
SATGFKQHSPALSRPVASDF

SEQ ID NO: 11952 - protein, 20 aa, synthetic construct
  source 1..20: note = Seed: SATGFKQSSKALQRPVASDF
SATGFKQHSPALVRPVASDF

SEQ ID NO: 11953 - protein, 20 aa, synthetic construct
  source 1..20: note = Seed: SATGFKQSSKALQRPVASDF
SATGFKQHSRALARPVASDF

SEQ ID NO: 11954 - protein, 20 aa, synthetic construct
  source 1..20: note = Seed: SATGFKQSSKALQRPVASDF
SATGFKQHSRALRRPVASDF

SEQ ID NO: 11955 - protein, 20 aa, synthetic construct
  source 1..20: note = Seed: SATGFKQSSKALQRPVASDF
SATGFKQHSRALSRPVASDF

SEQ ID NO: 11956 - protein, 20 aa, synthetic construct
  source 1..20: note = Seed: SATGFKQSSKALQRPVASDF
SATGFKQHSSALARPVASDF

SEQ ID NO: 11957 - protein, 20 aa, synthetic construct
  source 1..20: note = Seed: SATGFKQSSKALQRPVASDF
SATGFKQHSSALGRPVASDF

SEQ ID NO: 11958 - protein, 20 aa, synthetic construct
  source 1..20: note = Seed: SATGFKQSSKALQRPVASDF
SATGFKQHSSALIRPVASDF

SEQ ID NO: 11959 - protein, 20 aa, synthetic construct
  source 1..20: note = Seed: SATGFKQSSKALQRPVASDF
SATGFKQHSSALLRPVASDF

SEQ ID NO: 11960 - protein, 20 aa, synthetic construct
  source 1..20: note = Seed: SATGFKQSSKALQRPVASDF
SATGFKQHSSALMRPVASDF

SEQ ID NO: 11961 - protein, 20 aa, synthetic construct
  source 1..20: note = Seed: SATGFKQSSKALQRPVASDF
SATGFKQHSSALNRPVASDF

SEQ ID NO: 11962 - protein, 20 aa, synthetic construct
  source 1..20: note = Seed: SATGFKQSSKALQRPVASDF
SATGFKQHSSALSRPVASDF

SEQ ID NO: 11963 - protein, 20 aa, synthetic construct
  source 1..20: note = Seed: SATGFKQSSKALQRPVASDF
SATGFKQHSSALTRPVASDF

SEQ ID NO: 11964 - protein, 20 aa, synthetic construct
  source 1..20: note = Seed: SATGFKQSSKALQRPVASDF
SATGFKQHSSALVRPVASDF

SEQ ID NO: 11965 - protein, 20 aa, synthetic construct
  source 1..20: note = Seed: SATGFKQSSKALQRPVASDF
SATGFKQHSTALARPVASDF

SEQ ID NO: 11966 - protein, 20 aa, synthetic construct
  source 1..20: note = Seed: SATGFKQSSKALQRPVASDF
SATGFKQHSTALIRPVASDF

SEQ ID NO: 11967 - protein, 20 aa, synthetic construct
  source 1..20: note = Seed: SATGFKQSSKALQRPVASDF
SATGFKQHSTALLRPVASDF

SEQ ID NO: 11968 - protein, 20 aa, synthetic construct
  source 1..20: note = Seed: SATGFKQSSKALQRPVASDF
SATGFKQHSTALMRPVASDF

SEQ ID NO: 11969 - protein, 20 aa, synthetic construct
  source 1..20: note = Seed: SATGFKQSSKALQRPVASDF
SATGFKQHSTALNRPVASDF

SEQ ID NO: 11970 - protein, 20 aa, synthetic construct
  source 1..20: note = Seed: SATGFKQSSKALQRPVASDF
SATGFKQHSTALSRPVASDF

SEQ ID NO: 11971 - protein, 20 aa, synthetic construct
  source 1..20: note = Seed: SATGFKQSSKALQRPVASDF
SATGFKQHSTALVRPVASDF

SEQ ID NO: 11972 - protein, 20 aa, synthetic construct
  source 1..20: note = Seed: SATGFKQSSKALQRPVASDF
SATGFKQHSVALARPVASDF

SEQ ID NO: 11973 - protein, 20 aa, synthetic construct
  source 1..20: note = Seed: SATGFKQSSKALQRPVASDF
SATGFKQHSVALHRPVASDF

SEQ ID NO: 11974 - protein, 20 aa, synthetic construct
  source 1..20: note = Seed: SATGFKQSSKALQRPVASDF
SATGFKQHSVALIRPVASDF

SEQ ID NO: 11975 - protein, 20 aa, synthetic construct
  source 1..20: note = Seed: SATGFKQSSKALQRPVASDF
SATGFKQHSVALNRPVASDF

SEQ ID NO: 11976 - protein, 20 aa, synthetic construct
  source 1..20: note = Seed: SATGFKQSSKALQRPVASDF
SATGFKQHSVALSRPVASDF

SEQ ID NO: 11977 - protein, 20 aa, synthetic construct
  source 1..20: note = Seed: SATGFKQSSKALQRPVASDF
SATGFKQHSVALTRPVASDF

SEQ ID NO: 11978 - protein, 20 aa, synthetic construct
  source 1..20: note = Seed: SATGFKQSSKALQRPVASDF
SATGFKQHSVALVRPVASDF

SEQ ID NO: 11979 - protein, 20 aa, synthetic construct
  source 1..20: note = Seed: SATGFKQSSKALQRPVASDF
SATGFKQISAALARPVASDF

SEQ ID NO: 11980 - protein, 20 aa, synthetic construct
  source 1..20: note = Seed: SATGFKQSSKALQRPVASDF
SATGFKQISAALCRPVASDF

SEQ ID NO: 11981 - protein, 20 aa, synthetic construct
  source 1..20: note = Seed: SATGFKQSSKALQRPVASDF
SATGFKQISAALDRPVASDF

SEQ ID NO: 11982 - protein, 20 aa, synthetic construct
  source 1..20: note = Seed: SATGFKQSSKALQRPVASDF
SATGFKQISAALERPVASDF

SEQ ID NO: 11983 - protein, 20 aa, synthetic construct
  source 1..20: note = Seed: SATGFKQSSKALQRPVASDF
SATGFKQISAALFRPVASDF

SEQ ID NO: 11984 - protein, 20 aa, synthetic construct
  source 1..20: note = Seed: SATGFKQSSKALQRPVASDF
SATGFKQISAALGRPVASDF

SEQ ID NO: 11985 - protein, 20 aa, synthetic construct
  source 1..20: note = Seed: SATGFKQSSKALQRPVASDF
SATGFKQISAALHRPVASDF

SEQ ID NO: 11986 - protein, 20 aa, synthetic construct
  source 1..20: note = Seed: SATGFKQSSKALQRPVASDF
SATGFKQISAALIRPVASDF

SEQ ID NO: 11987 - protein, 20 aa, synthetic construct
  source 1..20: note = Seed: SATGFKQSSKALQRPVASDF
SATGFKQISAALKRPVASDF

SEQ ID NO: 11988 - protein, 20 aa, synthetic construct
  source 1..20: note = Seed: SATGFKQSSKALQRPVASDF
SATGFKQISAALLRPVASDF

SEQ ID NO: 11989 - protein, 20 aa, synthetic construct
  source 1..20: note = Seed: SATGFKQSSKALQRPVASDF
SATGFKQISAALMRPVASDF

SEQ ID NO: 11990 - protein, 20 aa, synthetic construct
  source 1..20: note = Seed: SATGFKQSSKALQRPVASDF
SATGFKQISAALNRPVASDF

SEQ ID NO: 11991 - protein, 20 aa, synthetic construct
  source 1..20: note = Seed: SATGFKQSSKALQRPVASDF
SATGFKQISAALPRPVASDF

SEQ ID NO: 11992 - protein, 20 aa, synthetic construct
  source 1..20: note = Seed: SATGFKQSSKALQRPVASDF
SATGFKQISAALQRPVASDF

SEQ ID NO: 11993 - protein, 20 aa, synthetic construct
  source 1..20: note = Seed: SATGFKQSSKALQRPVASDF
SATGFKQISAALRRPVASDF

SEQ ID NO: 11994 - protein, 20 aa, synthetic construct
  source 1..20: note = Seed: SATGFKQSSKALQRPVASDF
SATGFKQISAALSRPVASDF

SEQ ID NO: 11995 - protein, 20 aa, synthetic construct
  source 1..20: note = Seed: SATGFKQSSKALQRPVASDF
SATGFKQISAALTRPVASDF

SEQ ID NO: 11996 - protein, 20 aa, synthetic construct
  source 1..20: note = Seed: SATGFKQSSKALQRPVASDF
SATGFKQISAALVRPVASDF

SEQ ID NO: 11997 - protein, 20 aa, synthetic construct
  source 1..20: note = Seed: SATGFKQSSKALQRPVASDF
SATGFKQISAALWRPVASDF

SEQ ID NO: 11998 - protein, 20 aa, synthetic construct
  source 1..20: note = Seed: SATGFKQSSKALQRPVASDF
SATGFKQISAALYRPVASDF

SEQ ID NO: 11999 - protein, 20 aa, synthetic construct
  source 1..20: note = Seed: SATGFKQSSKALQRPVASDF
SATGFKQISCALARPVASDF

SEQ ID NO: 12000 - protein, 20 aa, synthetic construct
  source 1..20: note = Seed: SATGFKQSSKALQRPVASDF
SATGFKQISCALGRPVASDF

SEQ ID NO: 12001 - protein, 20 aa, synthetic construct
  source 1..20: note = Seed: SATGFKQSSKALQRPVASDF
SATGFKQISCALIRPVASDF

SEQ ID NO: 12002 - protein, 20 aa, synthetic construct
  source 1..20: note = Seed: SATGFKQSSKALQRPVASDF
SATGFKQISCALLRPVASDF

SEQ ID NO: 12003 - protein, 20 aa, synthetic construct
  source 1..20: note = Seed: SATGFKQSSKALQRPVASDF
SATGFKQISCALMRPVASDF

SEQ ID NO: 12004 - protein, 20 aa, synthetic construct
  source 1..20: note = Seed: SATGFKQSSKALQRPVASDF
SATGFKQISCALNRPVASDF

SEQ ID NO: 12005 - protein, 20 aa, synthetic construct
  source 1..20: note = Seed: SATGFKQSSKALQRPVASDF
SATGFKQISCALSRPVASDF

SEQ ID NO: 12006 - protein, 20 aa, synthetic construct
  source 1..20: note = Seed: SATGFKQSSKALQRPVASDF
SATGFKQISCALTRPVASDF

SEQ ID NO: 12007 - protein, 20 aa, synthetic construct
  source 1..20: note = Seed: SATGFKQSSKALQRPVASDF
SATGFKQISCALVRPVASDF

SEQ ID NO: 12008 - protein, 20 aa, synthetic construct
  source 1..20: note = Seed: SATGFKQSSKALQRPVASDF
SATGFKQISDALARPVASDF

SEQ ID NO: 12009 - protein, 20 aa, synthetic construct
  source 1..20: note = Seed: SATGFKQSSKALQRPVASDF
SATGFKQISDALIRPVASDF

SEQ ID NO: 12010 - protein, 20 aa, synthetic construct
  source 1..20: note = Seed: SATGFKQSSKALQRPVASDF
SATGFKQISDALLRPVASDF

SEQ ID NO: 12011 - protein, 20 aa, synthetic construct
  source 1..20: note = Seed: SATGFKQSSKALQRPVASDF
SATGFKQISDALNRPVASDF

SEQ ID NO: 12012 - protein, 20 aa, synthetic construct
  source 1..20: note = Seed: SATGFKQSSKALQRPVASDF
SATGFKQISDALSRPVASDF

SEQ ID NO: 12013 - protein, 20 aa, synthetic construct
  source 1..20: note = Seed: SATGFKQSSKALQRPVASDF
SATGFKQISDALTRPVASDF

SEQ ID NO: 12014 - protein, 20 aa, synthetic construct
  source 1..20: note = Seed: SATGFKQSSKALQRPVASDF
SATGFKQISDALVRPVASDF

SEQ ID NO: 12015 - protein, 20 aa, synthetic construct
  source 1..20: note = Seed: SATGFKQSSKALQRPVASDF
SATGFKQISEALARPVASDF

SEQ ID NO: 12016 - protein, 20 aa, synthetic construct
  source 1..20: note = Seed: SATGFKQSSKALQRPVASDF
SATGFKQISEALGRPVASDF

SEQ ID NO: 12017 - protein, 20 aa, synthetic construct
  source 1..20: note = Seed: SATGFKQSSKALQRPVASDF
SATGFKQISEALIRPVASDF

SEQ ID NO: 12018 - protein, 20 aa, synthetic construct
  source 1..20: note = Seed: SATGFKQSSKALQRPVASDF
SATGFKQISEALLRPVASDF

SEQ ID NO: 12019 - protein, 20 aa, synthetic construct
  source 1..20: note = Seed: SATGFKQSSKALQRPVASDF
SATGFKQISEALMRPVASDF

SEQ ID NO: 12020 - protein, 20 aa, synthetic construct
  source 1..20: note = Seed: SATGFKQSSKALQRPVASDF
SATGFKQISEALNRPVASDF

SEQ ID NO: 12021 - protein, 20 aa, synthetic construct
  source 1..20: note = Seed: SATGFKQSSKALQRPVASDF
SATGFKQISEALSRPVASDF

SEQ ID NO: 12022 - protein, 20 aa, synthetic construct
  source 1..20: note = Seed: SATGFKQSSKALQRPVASDF
SATGFKQISEALTRPVASDF

SEQ ID NO: 12023 - protein, 20 aa, synthetic construct
  source 1..20: note = Seed: SATGFKQSSKALQRPVASDF
SATGFKQISEALVRPVASDF

SEQ ID NO: 12024 - protein, 20 aa, synthetic construct
  source 1..20: note = Seed: SATGFKQSSKALQRPVASDF
SATGFKQISFALARPVASDF

SEQ ID NO: 12025 - protein, 20 aa, synthetic construct
  source 1..20: note = Seed: SATGFKQSSKALQRPVASDF
SATGFKQISFALDRPVASDF

SEQ ID NO: 12026 - protein, 20 aa, synthetic construct
  source 1..20: note = Seed: SATGFKQSSKALQRPVASDF
SATGFKQISFALERPVASDF

SEQ ID NO: 12027 - protein, 20 aa, synthetic construct
  source 1..20: note = Seed: SATGFKQSSKALQRPVASDF
SATGFKQISFALHRPVASDF

SEQ ID NO: 12028 - protein, 20 aa, synthetic construct
  source 1..20: note = Seed: SATGFKQSSKALQRPVASDF
SATGFKQISFALIRPVASDF

SEQ ID NO: 12029 - protein, 20 aa, synthetic construct
  source 1..20: note = Seed: SATGFKQSSKALQRPVASDF
SATGFKQISFALLRPVASDF

SEQ ID NO: 12030 - protein, 20 aa, synthetic construct
  source 1..20: note = Seed: SATGFKQSSKALQRPVASDF
SATGFKQISFALMRPVASDF

SEQ ID NO: 12031 - protein, 20 aa, synthetic construct
  source 1..20: note = Seed: SATGFKQSSKALQRPVASDF
SATGFKQISFALNRPVASDF

SEQ ID NO: 12032 - protein, 20 aa, synthetic construct
  source 1..20: note = Seed: SATGFKQSSKALQRPVASDF
SATGFKQISFALPRPVASDF

SEQ ID NO: 12033 - protein, 20 aa, synthetic construct
  source 1..20: note = Seed: SATGFKQSSKALQRPVASDF
SATGFKQISFALQRPVASDF

SEQ ID NO: 12034 - protein, 20 aa, synthetic construct
  source 1..20: note = Seed: SATGFKQSSKALQRPVASDF
SATGFKQISFALRRPVASDF

SEQ ID NO: 12035 - protein, 20 aa, synthetic construct
  source 1..20: note = Seed: SATGFKQSSKALQRPVASDF
SATGFKQISFALSRPVASDF

SEQ ID NO: 12036 - protein, 20 aa, synthetic construct
  source 1..20: note = Seed: SATGFKQSSKALQRPVASDF
SATGFKQISFALTRPVASDF

SEQ ID NO: 12037 - protein, 20 aa, synthetic construct
  source 1..20: note = Seed: SATGFKQSSKALQRPVASDF
SATGFKQISFALVRPVASDF

SEQ ID NO: 12038 - protein, 20 aa, synthetic construct
  source 1..20: note = Seed: SATGFKQSSKALQRPVASDF
SATGFKQISGALARPVASDF

SEQ ID NO: 12039 - protein, 20 aa, synthetic construct
  source 1..20: note = Seed: SATGFKQSSKALQRPVASDF
SATGFKQISGALCRPVASDF

SEQ ID NO: 12040 - protein, 20 aa, synthetic construct
  source 1..20: note = Seed: SATGFKQSSKALQRPVASDF
SATGFKQISGALDRPVASDF

SEQ ID NO: 12041 - protein, 20 aa, synthetic construct
  source 1..20: note = Seed: SATGFKQSSKALQRPVASDF
SATGFKQISGALERPVASDF

SEQ ID NO: 12042 - protein, 20 aa, synthetic construct
  source 1..20: note = Seed: SATGFKQSSKALQRPVASDF
SATGFKQISGALFRPVASDF

SEQ ID NO: 12043 - protein, 20 aa, synthetic construct
  source 1..20: note = Seed: SATGFKQSSKALQRPVASDF
SATGFKQISGALGRPVASDF

SEQ ID NO: 12044 - protein, 20 aa, synthetic construct
  source 1..20: note = Seed: SATGFKQSSKALQRPVASDF
SATGFKQISGALHRPVASDF

SEQ ID NO: 12045 - protein, 20 aa, synthetic construct
  source 1..20: note = Seed: SATGFKQSSKALQRPVASDF
SATGFKQISGALIRPVASDF

SEQ ID NO: 12046 - protein, 20 aa, synthetic construct
  source 1..20: note = Seed: SATGFKQSSKALQRPVASDF
SATGFKQISGALKRPVASDF

SEQ ID NO: 12047 - protein, 20 aa, synthetic construct
  source 1..20: note = Seed: SATGFKQSSKALQRPVASDF
SATGFKQISGALLRPVASDF

SEQ ID NO: 12048 - protein, 20 aa, synthetic construct
  source 1..20: note = Seed: SATGFKQSSKALQRPVASDF
SATGFKQISGALMRPVASDF

SEQ ID NO: 12049 - protein, 20 aa, synthetic construct
  source 1..20: note = Seed: SATGFKQSSKALQRPVASDF
SATGFKQISGALNRPVASDF

SEQ ID NO: 12050 - protein, 20 aa, synthetic construct
  source 1..20: note = Seed: SATGFKQSSKALQRPVASDF
SATGFKQISGALPRPVASDF

SEQ ID NO: 12051 - protein, 20 aa, synthetic construct
  source 1..20: note = Seed: SATGFKQSSKALQRPVASDF
SATGFKQISGALQRPVASDF

SEQ ID NO: 12052 - protein, 20 aa, synthetic construct
  source 1..20: note = Seed: SATGFKQSSKALQRPVASDF
SATGFKQISGALRRPVASDF

SEQ ID NO: 12053 - protein, 20 aa, synthetic construct
  source 1..20: note = Seed: SATGFKQSSKALQRPVASDF
SATGFKQISGALSRPVASDF

SEQ ID NO: 12054 - protein, 20 aa, synthetic construct
  source 1..20: note = Seed: SATGFKQSSKALQRPVASDF
SATGFKQISGALTRPVASDF

SEQ ID NO: 12055 - protein, 20 aa, synthetic construct
  source 1..20: note = Seed: SATGFKQSSKALQRPVASDF
SATGFKQISGALVRPVASDF

SEQ ID NO: 12056 - protein, 20 aa, synthetic construct
  source 1..20: note = Seed: SATGFKQSSKALQRPVASDF
SATGFKQISGALWRPVASDF

SEQ ID NO: 12057 - protein, 20 aa, synthetic construct
  source 1..20: note = Seed: SATGFKQSSKALQRPVASDF
SATGFKQISGALYRPVASDF

SEQ ID NO: 12058 - protein, 20 aa, synthetic construct
  source 1..20: note = Seed: SATGFKQSSKALQRPVASDF
SATGFKQISHALARPVASDF

SEQ ID NO: 12059 - protein, 20 aa, synthetic construct
  source 1..20: note = Seed: SATGFKQSSKALQRPVASDF
SATGFKQISHALCRPVASDF

SEQ ID NO: 12060 - protein, 20 aa, synthetic construct
  source 1..20: note = Seed: SATGFKQSSKALQRPVASDF
SATGFKQISHALGRPVASDF

SEQ ID NO: 12061 - protein, 20 aa, synthetic construct
  source 1..20: note = Seed: SATGFKQSSKALQRPVASDF
SATGFKQISHALHRPVASDF

SEQ ID NO: 12062 - protein, 20 aa, synthetic construct
  source 1..20: note = Seed: SATGFKQSSKALQRPVASDF
SATGFKQISHALIRPVASDF

SEQ ID NO: 12063 - protein, 20 aa, synthetic construct
  source 1..20: note = Seed: SATGFKQSSKALQRPVASDF
SATGFKQISHALKRPVASDF

SEQ ID NO: 12064 - protein, 20 aa, synthetic construct
  source 1..20: note = Seed: SATGFKQSSKALQRPVASDF
SATGFKQISHALLRPVASDF

SEQ ID NO: 12065 - protein, 20 aa, synthetic construct
  source 1..20: note = Seed: SATGFKQSSKALQRPVASDF
SATGFKQISHALMRPVASDF

SEQ ID NO: 12066 - protein, 20 aa, synthetic construct
  source 1..20: note = Seed: SATGFKQSSKALQRPVASDF
SATGFKQISHALNRPVASDF

SEQ ID NO: 12067 - protein, 20 aa, synthetic construct
  source 1..20: note = Seed: SATGFKQSSKALQRPVASDF
SATGFKQISHALQRPVASDF

SEQ ID NO: 12068 - protein, 20 aa, synthetic construct
  source 1..20: note = Seed: SATGFKQSSKALQRPVASDF
SATGFKQISHALRRPVASDF

SEQ ID NO: 12069 - protein, 20 aa, synthetic construct
  source 1..20: note = Seed: SATGFKQSSKALQRPVASDF
SATGFKQISHALSRPVASDF

SEQ ID NO: 12070 - protein, 20 aa, synthetic construct
  source 1..20: note = Seed: SATGFKQSSKALQRPVASDF
SATGFKQISHALTRPVASDF

SEQ ID NO: 12071 - protein, 20 aa, synthetic construct
  source 1..20: note = Seed: SATGFKQSSKALQRPVASDF
SATGFKQISHALVRPVASDF

SEQ ID NO: 12072 - protein, 20 aa, synthetic construct
  source 1..20: note = Seed: SATGFKQSSKALQRPVASDF
SATGFKQISIALARPVASDF

SEQ ID NO: 12073 - protein, 20 aa, synthetic construct
  source 1..20: note = Seed: SATGFKQSSKALQRPVASDF
SATGFKQISIALCRPVASDF

SEQ ID NO: 12074 - protein, 20 aa, synthetic construct
  source 1..20: note = Seed: SATGFKQSSKALQRPVASDF
SATGFKQISIALDRPVASDF

SEQ ID NO: 12075 - protein, 20 aa, synthetic construct
  source 1..20: note = Seed: SATGFKQSSKALQRPVASDF
SATGFKQISIALERPVASDF

SEQ ID NO: 12076 - protein, 20 aa, synthetic construct
  source 1..20: note = Seed: SATGFKQSSKALQRPVASDF
SATGFKQISIALFRPVASDF

SEQ ID NO: 12077 - protein, 20 aa, synthetic construct
  source 1..20: note = Seed: SATGFKQSSKALQRPVASDF
SATGFKQISIALGRPVASDF

SEQ ID NO: 12078 - protein, 20 aa, synthetic construct
  source 1..20: note = Seed: SATGFKQSSKALQRPVASDF
SATGFKQISIALHRPVASDF

SEQ ID NO: 12079 - protein, 20 aa, synthetic construct
  source 1..20: note = Seed: SATGFKQSSKALQRPVASDF
SATGFKQISIALIRPVASDF

SEQ ID NO: 12080 - protein, 20 aa, synthetic construct
  source 1..20: note = Seed: SATGFKQSSKALQRPVASDF
SATGFKQISIALKRPVASDF

SEQ ID NO: 12081 - protein, 20 aa, synthetic construct
  source 1..20: note = Seed: SATGFKQSSKALQRPVASDF
SATGFKQISIALLRPVASDF

SEQ ID NO: 12082 - protein, 20 aa, synthetic construct
  source 1..20: note = Seed: SATGFKQSSKALQRPVASDF
SATGFKQISIALNRPVASDF

SEQ ID NO: 12083 - protein, 20 aa, synthetic construct
  source 1..20: note = Seed: SATGFKQSSKALQRPVASDF
SATGFKQISIALPRPVASDF

SEQ ID NO: 12084 - protein, 20 aa, synthetic construct
  source 1..20: note = Seed: SATGFKQSSKALQRPVASDF
SATGFKQISIALQRPVASDF

SEQ ID NO: 12085 - protein, 20 aa, synthetic construct
  source 1..20: note = Seed: SATGFKQSSKALQRPVASDF
SATGFKQISIALRRPVASDF

SEQ ID NO: 12086 - protein, 20 aa, synthetic construct
  source 1..20: note = Seed: SATGFKQSSKALQRPVASDF
SATGFKQISIALSRPVASDF

SEQ ID NO: 12087 - protein, 20 aa, synthetic construct
  source 1..20: note = Seed: SATGFKQSSKALQRPVASDF
SATGFKQISIALTRPVASDF

SEQ ID NO: 12088 - protein, 20 aa, synthetic construct
  source 1..20: note = Seed: SATGFKQSSKALQRPVASDF
SATGFKQISIALVRPVASDF

SEQ ID NO: 12089 - protein, 20 aa, synthetic construct
  source 1..20: note = Seed: SATGFKQSSKALQRPVASDF
SATGFKQISIALYRPVASDF

SEQ ID NO: 12090 - protein, 20 aa, synthetic construct
  source 1..20: note = Seed: SATGFKQSSKALQRPVASDF
SATGFKQISKALARPVASDF

SEQ ID NO: 12091 - protein, 20 aa, synthetic construct
  source 1..20: note = Seed: SATGFKQSSKALQRPVASDF
SATGFKQISKALCRPVASDF

SEQ ID NO: 12092 - protein, 20 aa, synthetic construct
  source 1..20: note = Seed: SATGFKQSSKALQRPVASDF
SATGFKQISKALDRPVASDF

SEQ ID NO: 12093 - protein, 20 aa, synthetic construct
  source 1..20: note = Seed: SATGFKQSSKALQRPVASDF
SATGFKQISKALERPVASDF

SEQ ID NO: 12094 - protein, 20 aa, synthetic construct
  source 1..20: note = Seed: SATGFKQSSKALQRPVASDF
SATGFKQISKALFRPVASDF

SEQ ID NO: 12095 - protein, 20 aa, synthetic construct
  source 1..20: note = Seed: SATGFKQSSKALQRPVASDF
SATGFKQISKALGRPVASDF

SEQ ID NO: 12096 - protein, 20 aa, synthetic construct
  source 1..20: note = Seed: SATGFKQSSKALQRPVASDF
SATGFKQISKALHRPVASDF

SEQ ID NO: 12097 - protein, 20 aa, synthetic construct
  source 1..20: note = Seed: SATGFKQSSKALQRPVASDF
SATGFKQISKALIRPVASDF

SEQ ID NO: 12098 - protein, 20 aa, synthetic construct
  source 1..20: note = Seed: SATGFKQSSKALQRPVASDF
SATGFKQISKALKRPVASDF

SEQ ID NO: 12099 - protein, 20 aa, synthetic construct
  source 1..20: note = Seed: SATGFKQSSKALQRPVASDF
SATGFKQISKALLRPVASDF

SEQ ID NO: 12100 - protein, 20 aa, synthetic construct
  source 1..20: note = Seed: SATGFKQSSKALQRPVASDF
SATGFKQISKALMRPVASDF

SEQ ID NO: 12101 - protein, 20 aa, synthetic construct
  source 1..20: note = Seed: SATGFKQSSKALQRPVASDF
SATGFKQISKALNRPVASDF

SEQ ID NO: 12102 - protein, 20 aa, synthetic construct
  source 1..20: note = Seed: SATGFKQSSKALQRPVASDF
SATGFKQISKALPRPVASDF

SEQ ID NO: 12103 - protein, 20 aa, synthetic construct
  source 1..20: note = Seed: SATGFKQSSKALQRPVASDF
SATGFKQISKALQRPVASDF

SEQ ID NO: 12104 - protein, 20 aa, synthetic construct
  source 1..20: note = Seed: SATGFKQSSKALQRPVASDF
SATGFKQISKALRRPVASDF

SEQ ID NO: 12105 - protein, 20 aa, synthetic construct
  source 1..20: note = Seed: SATGFKQSSKALQRPVASDF
SATGFKQISKALSRPVASDF

SEQ ID NO: 12106 - protein, 20 aa, synthetic construct
  source 1..20: note = Seed: SATGFKQSSKALQRPVASDF
SATGFKQISKALTRPVASDF

SEQ ID NO: 12107 - protein, 20 aa, synthetic construct
  source 1..20: note = Seed: SATGFKQSSKALQRPVASDF
SATGFKQISKALVRPVASDF

SEQ ID NO: 12108 - protein, 20 aa, synthetic construct
  source 1..20: note = Seed: SATGFKQSSKALQRPVASDF
SATGFKQISKALWRPVASDF

SEQ ID NO: 12109 - protein, 20 aa, synthetic construct
  source 1..20: note = Seed: SATGFKQSSKALQRPVASDF
SATGFKQISKALYRPVASDF

SEQ ID NO: 12110 - protein, 20 aa, synthetic construct
  source 1..20: note = Seed: SATGFKQSSKALQRPVASDF
SATGFKQISLALARPVASDF

SEQ ID NO: 12111 - protein, 20 aa, synthetic construct
  source 1..20: note = Seed: SATGFKQSSKALQRPVASDF
SATGFKQISLALCRPVASDF

SEQ ID NO: 12112 - protein, 20 aa, synthetic construct
  source 1..20: note = Seed: SATGFKQSSKALQRPVASDF
SATGFKQISLALDRPVASDF

SEQ ID NO: 12113 - protein, 20 aa, synthetic construct
  source 1..20: note = Seed: SATGFKQSSKALQRPVASDF
SATGFKQISLALERPVASDF

SEQ ID NO: 12114 - protein, 20 aa, synthetic construct
  source 1..20: note = Seed: SATGFKQSSKALQRPVASDF
SATGFKQISLALFRPVASDF

SEQ ID NO: 12115 - protein, 20 aa, synthetic construct
  source 1..20: note = Seed: SATGFKQSSKALQRPVASDF
SATGFKQISLALGRPVASDF

SEQ ID NO: 12116 - protein, 20 aa, synthetic construct
  source 1..20: note = Seed: SATGFKQSSKALQRPVASDF
SATGFKQISLALHRPVASDF

SEQ ID NO: 12117 - protein, 20 aa, synthetic construct
  source 1..20: note = Seed: SATGFKQSSKALQRPVASDF
SATGFKQISLALIRPVASDF

SEQ ID NO: 12118 - protein, 20 aa, synthetic construct
  source 1..20: note = Seed: SATGFKQSSKALQRPVASDF
SATGFKQISLALKRPVASDF

SEQ ID NO: 12119 - protein, 20 aa, synthetic construct
  source 1..20: note = Seed: SATGFKQSSKALQRPVASDF
SATGFKQISLALLRPVASDF

SEQ ID NO: 12120 - protein, 20 aa, synthetic construct
  source 1..20: note = Seed: SATGFKQSSKALQRPVASDF
SATGFKQISLALMRPVASDF

SEQ ID NO: 12121 - protein, 20 aa, synthetic construct
  source 1..20: note = Seed: SATGFKQSSKALQRPVASDF
SATGFKQISLALNRPVASDF

SEQ ID NO: 12122 - protein, 20 aa, synthetic construct
  source 1..20: note = Seed: SATGFKQSSKALQRPVASDF
SATGFKQISLALSRPVASDF

SEQ ID NO: 12123 - protein, 20 aa, synthetic construct
  source 1..20: note = Seed: SATGFKQSSKALQRPVASDF
SATGFKQISLALTRPVASDF

SEQ ID NO: 12124 - protein, 20 aa, synthetic construct
  source 1..20: note = Seed: SATGFKQSSKALQRPVASDF
SATGFKQISLALVRPVASDF

SEQ ID NO: 12125 - protein, 20 aa, synthetic construct
  source 1..20: note = Seed: SATGFKQSSKALQRPVASDF
SATGFKQISLALYRPVASDF

SEQ ID NO: 12126 - protein, 20 aa, synthetic construct
  source 1..20: note = Seed: SATGFKQSSKALQRPVASDF
SATGFKQISMALARPVASDF

SEQ ID NO: 12127 - protein, 20 aa, synthetic construct
  source 1..20: note = Seed: SATGFKQSSKALQRPVASDF
SATGFKQISMALCRPVASDF

SEQ ID NO: 12128 - protein, 20 aa, synthetic construct
  source 1..20: note = Seed: SATGFKQSSKALQRPVASDF
SATGFKQISMALDRPVASDF

SEQ ID NO: 12129 - protein, 20 aa, synthetic construct
  source 1..20: note = Seed: SATGFKQSSKALQRPVASDF
SATGFKQISMALGRPVASDF

SEQ ID NO: 12130 - protein, 20 aa, synthetic construct
  source 1..20: note = Seed: SATGFKQSSKALQRPVASDF
SATGFKQISMALHRPVASDF

SEQ ID NO: 12131 - protein, 20 aa, synthetic construct
  source 1..20: note = Seed: SATGFKQSSKALQRPVASDF
SATGFKQISMALIRPVASDF

SEQ ID NO: 12132 - protein, 20 aa, synthetic construct
  source 1..20: note = Seed: SATGFKQSSKALQRPVASDF
SATGFKQISMALKRPVASDF

SEQ ID NO: 12133 - protein, 20 aa, synthetic construct
  source 1..20: note = Seed: SATGFKQSSKALQRPVASDF
SATGFKQISMALLRPVASDF

SEQ ID NO: 12134 - protein, 20 aa, synthetic construct
  source 1..20: note = Seed: SATGFKQSSKALQRPVASDF
SATGFKQISMALMRPVASDF

SEQ ID NO: 12135 - protein, 20 aa, synthetic construct
  source 1..20: note = Seed: SATGFKQSSKALQRPVASDF
SATGFKQISMALNRPVASDF

SEQ ID NO: 12136 - protein, 20 aa, synthetic construct
  source 1..20: note = Seed: SATGFKQSSKALQRPVASDF
SATGFKQISMALQRPVASDF

SEQ ID NO: 12137 - protein, 20 aa, synthetic construct
  source 1..20: note = Seed: SATGFKQSSKALQRPVASDF
SATGFKQISMALRRPVASDF

SEQ ID NO: 12138 - protein, 20 aa, synthetic construct
  source 1..20: note = Seed: SATGFKQSSKALQRPVASDF
SATGFKQISMALSRPVASDF

SEQ ID NO: 12139 - protein, 20 aa, synthetic construct
  source 1..20: note = Seed: SATGFKQSSKALQRPVASDF
SATGFKQISMALVRPVASDF

SEQ ID NO: 12140 - protein, 20 aa, synthetic construct
  source 1..20: note = Seed: SATGFKQSSKALQRPVASDF
SATGFKQISMALYRPVASDF

SEQ ID NO: 12141 - protein, 20 aa, synthetic construct
  source 1..20: note = Seed: SATGFKQSSKALQRPVASDF
SATGFKQISNALARPVASDF

SEQ ID NO: 12142 - protein, 20 aa, synthetic construct
  source 1..20: note = Seed: SATGFKQSSKALQRPVASDF
SATGFKQISNALCRPVASDF

SEQ ID NO: 12143 - protein, 20 aa, synthetic construct
  source 1..20: note = Seed: SATGFKQSSKALQRPVASDF
SATGFKQISNALDRPVASDF

SEQ ID NO: 12144 - protein, 20 aa, synthetic construct
  source 1..20: note = Seed: SATGFKQSSKALQRPVASDF
SATGFKQISNALERPVASDF

SEQ ID NO: 12145 - protein, 20 aa, synthetic construct
  source 1..20: note = Seed: SATGFKQSSKALQRPVASDF
SATGFKQISNALFRPVASDF

SEQ ID NO: 12146 - protein, 20 aa, synthetic construct
  source 1..20: note = Seed: SATGFKQSSKALQRPVASDF
SATGFKQISNALGRPVASDF

SEQ ID NO: 12147 - protein, 20 aa, synthetic construct
  source 1..20: note = Seed: SATGFKQSSKALQRPVASDF
SATGFKQISNALHRPVASDF

SEQ ID NO: 12148 - protein, 20 aa, synthetic construct
  source 1..20: note = Seed: SATGFKQSSKALQRPVASDF
SATGFKQISNALIRPVASDF

SEQ ID NO: 12149 - protein, 20 aa, synthetic construct
  source 1..20: note = Seed: SATGFKQSSKALQRPVASDF
SATGFKQISNALLRPVASDF

SEQ ID NO: 12150 - protein, 20 aa, synthetic construct
  source 1..20: note = Seed: SATGFKQSSKALQRPVASDF
SATGFKQISNALMRPVASDF

SEQ ID NO: 12151 - protein, 20 aa, synthetic construct
  source 1..20: note = Seed: SATGFKQSSKALQRPVASDF
SATGFKQISNALNRPVASDF

SEQ ID NO: 12152 - protein, 20 aa, synthetic construct
  source 1..20: note = Seed: SATGFKQSSKALQRPVASDF
SATGFKQISNALPRPVASDF

SEQ ID NO: 12153 - protein, 20 aa, synthetic construct
  source 1..20: note = Seed: SATGFKQSSKALQRPVASDF
SATGFKQISNALQRPVASDF

SEQ ID NO: 12154 - protein, 20 aa, synthetic construct
  source 1..20: note = Seed: SATGFKQSSKALQRPVASDF
SATGFKQISNALRRPVASDF

SEQ ID NO: 12155 - protein, 20 aa, synthetic construct
  source 1..20: note = Seed: SATGFKQSSKALQRPVASDF
SATGFKQISNALSRPVASDF

SEQ ID NO: 12156 - protein, 20 aa, synthetic construct
  source 1..20: note = Seed: SATGFKQSSKALQRPVASDF
SATGFKQISNALTRPVASDF

SEQ ID NO: 12157 - protein, 20 aa, synthetic construct
  source 1..20: note = Seed: SATGFKQSSKALQRPVASDF
SATGFKQISNALVRPVASDF

SEQ ID NO: 12158 - protein, 20 aa, synthetic construct
  source 1..20: note = Seed: SATGFKQSSKALQRPVASDF
SATGFKQISNALYRPVASDF

SEQ ID NO: 12159 - protein, 20 aa, synthetic construct
  source 1..20: note = Seed: SATGFKQSSKALQRPVASDF
SATGFKQISPALARPVASDF

SEQ ID NO: 12160 - protein, 20 aa, synthetic construct
  source 1..20: note = Seed: SATGFKQSSKALQRPVASDF
SATGFKQISPALCRPVASDF

SEQ ID NO: 12161 - protein, 20 aa, synthetic construct
  source 1..20: note = Seed: SATGFKQSSKALQRPVASDF
SATGFKQISPALDRPVASDF

SEQ ID NO: 12162 - protein, 20 aa, synthetic construct
  source 1..20: note = Seed: SATGFKQSSKALQRPVASDF
SATGFKQISPALERPVASDF

SEQ ID NO: 12163 - protein, 20 aa, synthetic construct
  source 1..20: note = Seed: SATGFKQSSKALQRPVASDF
SATGFKQISPALFRPVASDF

SEQ ID NO: 12164 - protein, 20 aa, synthetic construct
  source 1..20: note = Seed: SATGFKQSSKALQRPVASDF
SATGFKQISPALGRPVASDF

SEQ ID NO: 12165 - protein, 20 aa, synthetic construct
  source 1..20: note = Seed: SATGFKQSSKALQRPVASDF
SATGFKQISPALHRPVASDF

SEQ ID NO: 12166 - protein, 20 aa, synthetic construct
  source 1..20: note = Seed: SATGFKQSSKALQRPVASDF
SATGFKQISPALIRPVASDF

SEQ ID NO: 12167 - protein, 20 aa, synthetic construct
  source 1..20: note = Seed: SATGFKQSSKALQRPVASDF
SATGFKQISPALKRPVASDF

SEQ ID NO: 12168 - protein, 20 aa, synthetic construct
  source 1..20: note = Seed: SATGFKQSSKALQRPVASDF
SATGFKQISPALLRPVASDF

SEQ ID NO: 12169 - protein, 20 aa, synthetic construct
  source 1..20: note = Seed: SATGFKQSSKALQRPVASDF
SATGFKQISPALMRPVASDF

SEQ ID NO: 12170 - protein, 20 aa, synthetic construct
  source 1..20: note = Seed: SATGFKQSSKALQRPVASDF
SATGFKQISPALNRPVASDF

SEQ ID NO: 12171 - protein, 20 aa, synthetic construct
  source 1..20: note = Seed: SATGFKQSSKALQRPVASDF
SATGFKQISPALPRPVASDF

SEQ ID NO: 12172 - protein, 20 aa, synthetic construct
  source 1..20: note = Seed: SATGFKQSSKALQRPVASDF
SATGFKQISPALQRPVASDF

SEQ ID NO: 12173 - protein, 20 aa, synthetic construct
  source 1..20: note = Seed: SATGFKQSSKALQRPVASDF
SATGFKQISPALRRPVASDF

SEQ ID NO: 12174 - protein, 20 aa, synthetic construct
  source 1..20: note = Seed: SATGFKQSSKALQRPVASDF
SATGFKQISPALSRPVASDF

SEQ ID NO: 12175 - protein, 20 aa, synthetic construct
  source 1..20: note = Seed: SATGFKQSSKALQRPVASDF
SATGFKQISPALTRPVASDF

SEQ ID NO: 12176 - protein, 20 aa, synthetic construct
  source 1..20: note = Seed: SATGFKQSSKALQRPVASDF
SATGFKQISPALVRPVASDF

SEQ ID NO: 12177 - protein, 20 aa, synthetic construct
  source 1..20: note = Seed: SATGFKQSSKALQRPVASDF
SATGFKQISPALWRPVASDF

SEQ ID NO: 12178 - protein, 20 aa, synthetic construct
  source 1..20: note = Seed: SATGFKQSSKALQRPVASDF
SATGFKQISPALYRPVASDF

SEQ ID NO: 12179 - protein, 20 aa, synthetic construct
  source 1..20: note = Seed: SATGFKQSSKALQRPVASDF
SATGFKQISQALARPVASDF

SEQ ID NO: 12180 - protein, 20 aa, synthetic construct
  source 1..20: note = Seed: SATGFKQSSKALQRPVASDF
SATGFKQISQALGRPVASDF

SEQ ID NO: 12181 - protein, 20 aa, synthetic construct
  source 1..20: note = Seed: SATGFKQSSKALQRPVASDF
SATGFKQISQALIRPVASDF

SEQ ID NO: 12182 - protein, 20 aa, synthetic construct
  source 1..20: note = Seed: SATGFKQSSKALQRPVASDF
SATGFKQISQALLRPVASDF

SEQ ID NO: 12183 - protein, 20 aa, synthetic construct
  source 1..20: note = Seed: SATGFKQSSKALQRPVASDF
SATGFKQISQALMRPVASDF

SEQ ID NO: 12184 - protein, 20 aa, synthetic construct
  source 1..20: note = Seed: SATGFKQSSKALQRPVASDF
SATGFKQISQALNRPVASDF

SEQ ID NO: 12185 - protein, 20 aa, synthetic construct
  source 1..20: note = Seed: SATGFKQSSKALQRPVASDF
SATGFKQISQALSRPVASDF

SEQ ID NO: 12186 - protein, 20 aa, synthetic construct
  source 1..20: note = Seed: SATGFKQSSKALQRPVASDF
SATGFKQISQALTRPVASDF

SEQ ID NO: 12187 - protein, 20 aa, synthetic construct
  source 1..20: note = Seed: SATGFKQSSKALQRPVASDF
SATGFKQISQALVRPVASDF

SEQ ID NO: 12188 - protein, 20 aa, synthetic construct
  source 1..20: note = Seed: SATGFKQSSKALQRPVASDF
SATGFKQISRALCRPVASDF

SEQ ID NO: 12189 - protein, 20 aa, synthetic construct
  source 1..20: note = Seed: SATGFKQSSKALQRPVASDF
SATGFKQISRALDRPVASDF

SEQ ID NO: 12190 - protein, 20 aa, synthetic construct
  source 1..20: note = Seed: SATGFKQSSKALQRPVASDF
SATGFKQISRALERPVASDF

SEQ ID NO: 12191 - protein, 20 aa, synthetic construct
  source 1..20: note = Seed: SATGFKQSSKALQRPVASDF
SATGFKQISRALFRPVASDF

SEQ ID NO: 12192 - protein, 20 aa, synthetic construct
  source 1..20: note = Seed: SATGFKQSSKALQRPVASDF
SATGFKQISRALGRPVASDF

SEQ ID NO: 12193 - protein, 20 aa, synthetic construct
  source 1..20: note = Seed: SATGFKQSSKALQRPVASDF
SATGFKQISRALHRPVASDF

SEQ ID NO: 12194 - protein, 20 aa, synthetic construct
  source 1..20: note = Seed: SATGFKQSSKALQRPVASDF
SATGFKQISRALIRPVASDF

SEQ ID NO: 12195 - protein, 20 aa, synthetic construct
  source 1..20: note = Seed: SATGFKQSSKALQRPVASDF
SATGFKQISRALKRPVASDF

SEQ ID NO: 12196 - protein, 20 aa, synthetic construct
  source 1..20: note = Seed: SATGFKQSSKALQRPVASDF
SATGFKQISRALLRPVASDF

SEQ ID NO: 12197 - protein, 20 aa, synthetic construct
  source 1..20: note = Seed: SATGFKQSSKALQRPVASDF
SATGFKQISRALMRPVASDF

SEQ ID NO: 12198 - protein, 20 aa, synthetic construct
  source 1..20: note = Seed: SATGFKQSSKALQRPVASDF
SATGFKQISRALNRPVASDF

SEQ ID NO: 12199 - protein, 20 aa, synthetic construct
  source 1..20: note = Seed: SATGFKQSSKALQRPVASDF
SATGFKQISRALPRPVASDF

SEQ ID NO: 12200 - protein, 20 aa, synthetic construct
  source 1..20: note = Seed: SATGFKQSSKALQRPVASDF
SATGFKQISRALQRPVASDF

SEQ ID NO: 12201 - protein, 20 aa, synthetic construct
  source 1..20: note = Seed: SATGFKQSSKALQRPVASDF
SATGFKQISRALRRPVASDF

SEQ ID NO: 12202 - protein, 20 aa, synthetic construct
  source 1..20: note = Seed: SATGFKQSSKALQRPVASDF
SATGFKQISRALVRPVASDF

SEQ ID NO: 12203 - protein, 20 aa, synthetic construct
  source 1..20: note = Seed: SATGFKQSSKALQRPVASDF
SATGFKQISRALWRPVASDF

SEQ ID NO: 12204 - protein, 20 aa, synthetic construct
  source 1..20: note = Seed: SATGFKQSSKALQRPVASDF
SATGFKQISRALYRPVASDF

SEQ ID NO: 12205 - protein, 20 aa, synthetic construct
  source 1..20: note = Seed: SATGFKQSSKALQRPVASDF
SATGFKQISSALARPVASDF

SEQ ID NO: 12206 - protein, 20 aa, synthetic construct
  source 1..20: note = Seed: SATGFKQSSKALQRPVASDF
SATGFKQISSALCRPVASDF

SEQ ID NO: 12207 - protein, 20 aa, synthetic construct
  source 1..20: note = Seed: SATGFKQSSKALQRPVASDF
SATGFKQISSALDRPVASDF

SEQ ID NO: 12208 - protein, 20 aa, synthetic construct
  source 1..20: note = Seed: SATGFKQSSKALQRPVASDF
SATGFKQISSALERPVASDF

SEQ ID NO: 12209 - protein, 20 aa, synthetic construct
  source 1..20: note = Seed: SATGFKQSSKALQRPVASDF
SATGFKQISSALFRPVASDF

SEQ ID NO: 12210 - protein, 20 aa, synthetic construct
  source 1..20: note = Seed: SATGFKQSSKALQRPVASDF
SATGFKQISSALGRPVASDF

SEQ ID NO: 12211 - protein, 20 aa, synthetic construct
  source 1..20: note = Seed: SATGFKQSSKALQRPVASDF
SATGFKQISSALHRPVASDF

SEQ ID NO: 12212 - protein, 20 aa, synthetic construct
  source 1..20: note = Seed: SATGFKQSSKALQRPVASDF
SATGFKQISSALIRPVASDF

SEQ ID NO: 12213 - protein, 20 aa, synthetic construct
  source 1..20: note = Seed: SATGFKQSSKALQRPVASDF
SATGFKQISSALKRPVASDF

SEQ ID NO: 12214 - protein, 20 aa, synthetic construct
  source 1..20: note = Seed: SATGFKQSSKALQRPVASDF
SATGFKQISSALLRPVASDF

SEQ ID NO: 12215 - protein, 20 aa, synthetic construct
  source 1..20: note = Seed: SATGFKQSSKALQRPVASDF
SATGFKQISSALMRPVASDF

SEQ ID NO: 12216 - protein, 20 aa, synthetic construct
  source 1..20: note = Seed: SATGFKQSSKALQRPVASDF
SATGFKQISSALNRPVASDF

SEQ ID NO: 12217 - protein, 20 aa, synthetic construct
  source 1..20: note = Seed: SATGFKQSSKALQRPVASDF
SATGFKQISSALPRPVASDF

SEQ ID NO: 12218 - protein, 20 aa, synthetic construct
  source 1..20: note = Seed: SATGFKQSSKALQRPVASDF
SATGFKQISSALQRPVASDF

SEQ ID NO: 12219 - protein, 20 aa, synthetic construct
  source 1..20: note = Seed: SATGFKQSSKALQRPVASDF
SATGFKQISSALRRPVASDF

SEQ ID NO: 12220 - protein, 20 aa, synthetic construct
  source 1..20: note = Seed: SATGFKQSSKALQRPVASDF
SATGFKQISSALSRPVASDF

SEQ ID NO: 12221 - protein, 20 aa, synthetic construct
  source 1..20: note = Seed: SATGFKQSSKALQRPVASDF
SATGFKQISSALTRPVASDF

SEQ ID NO: 12222 - protein, 20 aa, synthetic construct
  source 1..20: note = Seed: SATGFKQSSKALQRPVASDF
SATGFKQISSALVRPVASDF

SEQ ID NO: 12223 - protein, 20 aa, synthetic construct
  source 1..20: note = Seed: SATGFKQSSKALQRPVASDF
SATGFKQISSALWRPVASDF

SEQ ID NO: 12224 - protein, 20 aa, synthetic construct
  source 1..20: note = Seed: SATGFKQSSKALQRPVASDF
SATGFKQISSALYRPVASDF

SEQ ID NO: 12225 - protein, 20 aa, synthetic construct
  source 1..20: note = Seed: SATGFKQSSKALQRPVASDF
SATGFKQISTALARPVASDF

SEQ ID NO: 12226 - protein, 20 aa, synthetic construct
  source 1..20: note = Seed: SATGFKQSSKALQRPVASDF
SATGFKQISTALCRPVASDF

SEQ ID NO: 12227 - protein, 20 aa, synthetic construct
  source 1..20: note = Seed: SATGFKQSSKALQRPVASDF
SATGFKQISTALDRPVASDF

SEQ ID NO: 12228 - protein, 20 aa, synthetic construct
  source 1..20: note = Seed: SATGFKQSSKALQRPVASDF
SATGFKQISTALERPVASDF

SEQ ID NO: 12229 - protein, 20 aa, synthetic construct
  source 1..20: note = Seed: SATGFKQSSKALQRPVASDF
SATGFKQISTALFRPVASDF

SEQ ID NO: 12230 - protein, 20 aa, synthetic construct
  source 1..20: note = Seed: SATGFKQSSKALQRPVASDF
SATGFKQISTALGRPVASDF

SEQ ID NO: 12231 - protein, 20 aa, synthetic construct
  source 1..20: note = Seed: SATGFKQSSKALQRPVASDF
SATGFKQISTALHRPVASDF

SEQ ID NO: 12232 - protein, 20 aa, synthetic construct
  source 1..20: note = Seed: SATGFKQSSKALQRPVASDF
SATGFKQISTALIRPVASDF

SEQ ID NO: 12233 - protein, 20 aa, synthetic construct
  source 1..20: note = Seed: SATGFKQSSKALQRPVASDF
SATGFKQISTALKRPVASDF

SEQ ID NO: 12234 - protein, 20 aa, synthetic construct
  source 1..20: note = Seed: SATGFKQSSKALQRPVASDF
SATGFKQISTALLRPVASDF

SEQ ID NO: 12235 - protein, 20 aa, synthetic construct
  source 1..20: note = Seed: SATGFKQSSKALQRPVASDF
SATGFKQISTALMRPVASDF

SEQ ID NO: 12236 - protein, 20 aa, synthetic construct
  source 1..20: note = Seed: SATGFKQSSKALQRPVASDF
SATGFKQISTALNRPVASDF

SEQ ID NO: 12237 - protein, 20 aa, synthetic construct
  source 1..20: note = Seed: SATGFKQSSKALQRPVASDF
SATGFKQISTALPRPVASDF

SEQ ID NO: 12238 - protein, 20 aa, synthetic construct
  source 1..20: note = Seed: SATGFKQSSKALQRPVASDF
SATGFKQISTALQRPVASDF

SEQ ID NO: 12239 - protein, 20 aa, synthetic construct
  source 1..20: note = Seed: SATGFKQSSKALQRPVASDF
SATGFKQISTALRRPVASDF

SEQ ID NO: 12240 - protein, 20 aa, synthetic construct
  source 1..20: note = Seed: SATGFKQSSKALQRPVASDF
SATGFKQISTALSRPVASDF

SEQ ID NO: 12241 - protein, 20 aa, synthetic construct
  source 1..20: note = Seed: SATGFKQSSKALQRPVASDF
SATGFKQISTALTRPVASDF

SEQ ID NO: 12242 - protein, 20 aa, synthetic construct
  source 1..20: note = Seed: SATGFKQSSKALQRPVASDF
SATGFKQISTALVRPVASDF

SEQ ID NO: 12243 - protein, 20 aa, synthetic construct
  source 1..20: note = Seed: SATGFKQSSKALQRPVASDF
SATGFKQISTALWRPVASDF

SEQ ID NO: 12244 - protein, 20 aa, synthetic construct
  source 1..20: note = Seed: SATGFKQSSKALQRPVASDF
SATGFKQISTALYRPVASDF

SEQ ID NO: 12245 - protein, 20 aa, synthetic construct
  source 1..20: note = Seed: SATGFKQSSKALQRPVASDF
SATGFKQISVALARPVASDF

SEQ ID NO: 12246 - protein, 20 aa, synthetic construct
  source 1..20: note = Seed: SATGFKQSSKALQRPVASDF
SATGFKQISVALCRPVASDF

SEQ ID NO: 12247 - protein, 20 aa, synthetic construct
  source 1..20: note = Seed: SATGFKQSSKALQRPVASDF
SATGFKQISVALDRPVASDF

SEQ ID NO: 12248 - protein, 20 aa, synthetic construct
  source 1..20: note = Seed: SATGFKQSSKALQRPVASDF
SATGFKQISVALERPVASDF

SEQ ID NO: 12249 - protein, 20 aa, synthetic construct
  source 1..20: note = Seed: SATGFKQSSKALQRPVASDF
SATGFKQISVALFRPVASDF

SEQ ID NO: 12250 - protein, 20 aa, synthetic construct
  source 1..20: note = Seed: SATGFKQSSKALQRPVASDF
SATGFKQISVALGRPVASDF

SEQ ID NO: 12251 - protein, 20 aa, synthetic construct
  source 1..20: note = Seed: SATGFKQSSKALQRPVASDF
SATGFKQISVALHRPVASDF

SEQ ID NO: 12252 - protein, 20 aa, synthetic construct
  source 1..20: note = Seed: SATGFKQSSKALQRPVASDF
SATGFKQISVALIRPVASDF

SEQ ID NO: 12253 - protein, 20 aa, synthetic construct
  source 1..20: note = Seed: SATGFKQSSKALQRPVASDF
SATGFKQISVALKRPVASDF

SEQ ID NO: 12254 - protein, 20 aa, synthetic construct
  source 1..20: note = Seed: SATGFKQSSKALQRPVASDF
SATGFKQISVALLRPVASDF

SEQ ID NO: 12255 - protein, 20 aa, synthetic construct
  source 1..20: note = Seed: SATGFKQSSKALQRPVASDF
SATGFKQISVALMRPVASDF

SEQ ID NO: 12256 - protein, 20 aa, synthetic construct
  source 1..20: note = Seed: SATGFKQSSKALQRPVASDF
SATGFKQISVALNRPVASDF

SEQ ID NO: 12257 - protein, 20 aa, synthetic construct
  source 1..20: note = Seed: SATGFKQSSKALQRPVASDF
SATGFKQISVALPRPVASDF

SEQ ID NO: 12258 - protein, 20 aa, synthetic construct
  source 1..20: note = Seed: SATGFKQSSKALQRPVASDF
SATGFKQISVALQRPVASDF

SEQ ID NO: 12259 - protein, 20 aa, synthetic construct
  source 1..20: note = Seed: SATGFKQSSKALQRPVASDF
SATGFKQISVALRRPVASDF

SEQ ID NO: 12260 - protein, 20 aa, synthetic construct
  source 1..20: note = Seed: SATGFKQSSKALQRPVASDF
SATGFKQISVALSRPVASDF

SEQ ID NO: 12261 - protein, 20 aa, synthetic construct
  source 1..20: note = Seed: SATGFKQSSKALQRPVASDF
SATGFKQISVALTRPVASDF

SEQ ID NO: 12262 - protein, 20 aa, synthetic construct
  source 1..20: note = Seed: SATGFKQSSKALQRPVASDF
SATGFKQISVALVRPVASDF

SEQ ID NO: 12263 - protein, 20 aa, synthetic construct
  source 1..20: note = Seed: SATGFKQSSKALQRPVASDF
SATGFKQISVALWRPVASDF

SEQ ID NO: 12264 - protein, 20 aa, synthetic construct
  source 1..20: note = Seed: SATGFKQSSKALQRPVASDF
SATGFKQISVALYRPVASDF

SEQ ID NO: 12265 - protein, 20 aa, synthetic construct
  source 1..20: note = Seed: SATGFKQSSKALQRPVASDF
SATGFKQISWALMRPVASDF

SEQ ID NO: 12266 - protein, 20 aa, synthetic construct
  source 1..20: note = Seed: SATGFKQSSKALQRPVASDF
SATGFKQISWALVRPVASDF

SEQ ID NO: 12267 - protein, 20 aa, synthetic construct
  source 1..20: note = Seed: SATGFKQSSKALQRPVASDF
SATGFKQISYALERPVASDF

SEQ ID NO: 12268 - protein, 20 aa, synthetic construct
  source 1..20: note = Seed: SATGFKQSSKALQRPVASDF
SATGFKQISYALMRPVASDF

SEQ ID NO: 12269 - protein, 20 aa, synthetic construct
  source 1..20: note = Seed: SATGFKQSSKALQRPVASDF
SATGFKQISYALVRPVASDF

SEQ ID NO: 12270 - protein, 20 aa, synthetic construct
  source 1..20: note = Seed: SATGFKQSSKALQRPVASDF
SATGFKQKSAALARPVASDF

SEQ ID NO: 12271 - protein, 20 aa, synthetic construct
  source 1..20: note = Seed: SATGFKQSSKALQRPVASDF
SATGFKQKSAALIRPVASDF

SEQ ID NO: 12272 - protein, 20 aa, synthetic construct
  source 1..20: note = Seed: SATGFKQSSKALQRPVASDF
SATGFKQKSAALLRPVASDF

SEQ ID NO: 12273 - protein, 20 aa, synthetic construct
  source 1..20: note = Seed: SATGFKQSSKALQRPVASDF
SATGFKQKSAALMRPVASDF

SEQ ID NO: 12274 - protein, 20 aa, synthetic construct
  source 1..20: note = Seed: SATGFKQSSKALQRPVASDF
SATGFKQKSAALSRPVASDF

SEQ ID NO: 12275 - protein, 20 aa, synthetic construct
  source 1..20: note = Seed: SATGFKQSSKALQRPVASDF
SATGFKQKSAALTRPVASDF

SEQ ID NO: 12276 - protein, 20 aa, synthetic construct
  source 1..20: note = Seed: SATGFKQSSKALQRPVASDF
SATGFKQKSAALVRPVASDF

SEQ ID NO: 12277 - protein, 20 aa, synthetic construct
  source 1..20: note = Seed: SATGFKQSSKALQRPVASDF
SATGFKQKSFALFRPVASDF

SEQ ID NO: 12278 - protein, 20 aa, synthetic construct
  source 1..20: note = Seed: SATGFKQSSKALQRPVASDF
SATGFKQKSFALIRPVASDF

SEQ ID NO: 12279 - protein, 20 aa, synthetic construct
  source 1..20: note = Seed: SATGFKQSSKALQRPVASDF
SATGFKQKSFALLRPVASDF

SEQ ID NO: 12280 - protein, 20 aa, synthetic construct
  source 1..20: note = Seed: SATGFKQSSKALQRPVASDF
SATGFKQKSFALVRPVASDF

SEQ ID NO: 12281 - protein, 20 aa, synthetic construct
  source 1..20: note = Seed: SATGFKQSSKALQRPVASDF
SATGFKQKSGALARPVASDF

SEQ ID NO: 12282 - protein, 20 aa, synthetic construct
  source 1..20: note = Seed: SATGFKQSSKALQRPVASDF
SATGFKQKSGALIRPVASDF

SEQ ID NO: 12283 - protein, 20 aa, synthetic construct
  source 1..20: note = Seed: SATGFKQSSKALQRPVASDF
SATGFKQKSGALLRPVASDF

SEQ ID NO: 12284 - protein, 20 aa, synthetic construct
  source 1..20: note = Seed: SATGFKQSSKALQRPVASDF
SATGFKQKSGALMRPVASDF

SEQ ID NO: 12285 - protein, 20 aa, synthetic construct
  source 1..20: note = Seed: SATGFKQSSKALQRPVASDF
SATGFKQKSGALVRPVASDF

SEQ ID NO: 12286 - protein, 20 aa, synthetic construct
  source 1..20: note = Seed: SATGFKQSSKALQRPVASDF
SATGFKQKSIALARPVASDF

SEQ ID NO: 12287 - protein, 20 aa, synthetic construct
  source 1..20: note = Seed: SATGFKQSSKALQRPVASDF
SATGFKQKSIALGRPVASDF

SEQ ID NO: 12288 - protein, 20 aa, synthetic construct
  source 1..20: note = Seed: SATGFKQSSKALQRPVASDF
SATGFKQKSIALHRPVASDF

SEQ ID NO: 12289 - protein, 20 aa, synthetic construct
  source 1..20: note = Seed: SATGFKQSSKALQRPVASDF
SATGFKQKSIALNRPVASDF

SEQ ID NO: 12290 - protein, 20 aa, synthetic construct
  source 1..20: note = Seed: SATGFKQSSKALQRPVASDF
SATGFKQKSKALARPVASDF

SEQ ID NO: 12291 - protein, 20 aa, synthetic construct
  source 1..20: note = Seed: SATGFKQSSKALQRPVASDF
SATGFKQKSKALRRPVASDF

SEQ ID NO: 12292 - protein, 20 aa, synthetic construct
  source 1..20: note = Seed: SATGFKQSSKALQRPVASDF
SATGFKQKSKALSRPVASDF

SEQ ID NO: 12293 - protein, 20 aa, synthetic construct
  source 1..20: note = Seed: SATGFKQSSKALQRPVASDF
SATGFKQKSNALARPVASDF

SEQ ID NO: 12294 - protein, 20 aa, synthetic construct
  source 1..20: note = Seed: SATGFKQSSKALQRPVASDF
SATGFKQKSNALIRPVASDF

SEQ ID NO: 12295 - protein, 20 aa, synthetic construct
  source 1..20: note = Seed: SATGFKQSSKALQRPVASDF
SATGFKQKSNALLRPVASDF

SEQ ID NO: 12296 - protein, 20 aa, synthetic construct
  source 1..20: note = Seed: SATGFKQSSKALQRPVASDF
SATGFKQKSNALVRPVASDF

SEQ ID NO: 12297 - protein, 20 aa, synthetic construct
  source 1..20: note = Seed: SATGFKQSSKALQRPVASDF
SATGFKQKSPALARPVASDF

SEQ ID NO: 12298 - protein, 20 aa, synthetic construct
  source 1..20: note = Seed: SATGFKQSSKALQRPVASDF
SATGFKQKSPALIRPVASDF

SEQ ID NO: 12299 - protein, 20 aa, synthetic construct
  source 1..20: note = Seed: SATGFKQSSKALQRPVASDF
SATGFKQKSPALLRPVASDF

SEQ ID NO: 12300 - protein, 20 aa, synthetic construct
  source 1..20: note = Seed: SATGFKQSSKALQRPVASDF
SATGFKQKSPALVRPVASDF

SEQ ID NO: 12301 - protein, 20 aa, synthetic construct
  source 1..20: note = Seed: SATGFKQSSKALQRPVASDF
SATGFKQKSRALARPVASDF

SEQ ID NO: 12302 - protein, 20 aa, synthetic construct
  source 1..20: note = Seed: SATGFKQSSKALQRPVASDF
SATGFKQKSRALMRPVASDF

SEQ ID NO: 12303 - protein, 20 aa, synthetic construct
  source 1..20: note = Seed: SATGFKQSSKALQRPVASDF
SATGFKQKSRALRRPVASDF

SEQ ID NO: 12304 - protein, 20 aa, synthetic construct
  source 1..20: note = Seed: SATGFKQSSKALQRPVASDF
SATGFKQKSRALSRPVASDF

SEQ ID NO: 12305 - protein, 20 aa, synthetic construct
  source 1..20: note = Seed: SATGFKQSSKALQRPVASDF
SATGFKQKSSALARPVASDF

SEQ ID NO: 12306 - protein, 20 aa, synthetic construct
  source 1..20: note = Seed: SATGFKQSSKALQRPVASDF
SATGFKQKSSALIRPVASDF

SEQ ID NO: 12307 - protein, 20 aa, synthetic construct
  source 1..20: note = Seed: SATGFKQSSKALQRPVASDF
SATGFKQKSSALLRPVASDF

SEQ ID NO: 12308 - protein, 20 aa, synthetic construct
  source 1..20: note = Seed: SATGFKQSSKALQRPVASDF
SATGFKQKSSALMRPVASDF

SEQ ID NO: 12309 - protein, 20 aa, synthetic construct
  source 1..20: note = Seed: SATGFKQSSKALQRPVASDF
SATGFKQKSSALSRPVASDF

SEQ ID NO: 12310 - protein, 20 aa, synthetic construct
  source 1..20: note = Seed: SATGFKQSSKALQRPVASDF
SATGFKQKSSALVRPVASDF

SEQ ID NO: 12311 - protein, 20 aa, synthetic construct
  source 1..20: note = Seed: SATGFKQSSKALQRPVASDF
SATGFKQKSTALARPVASDF

SEQ ID NO: 12312 - protein, 20 aa, synthetic construct
  source 1..20: note = Seed: SATGFKQSSKALQRPVASDF
SATGFKQKSTALIRPVASDF

SEQ ID NO: 12313 - protein, 20 aa, synthetic construct
  source 1..20: note = Seed: SATGFKQSSKALQRPVASDF
SATGFKQKSTALLRPVASDF

SEQ ID NO: 12314 - protein, 20 aa, synthetic construct
  source 1..20: note = Seed: SATGFKQSSKALQRPVASDF
SATGFKQKSTALVRPVASDF

SEQ ID NO: 12315 - protein, 20 aa, synthetic construct
  source 1..20: note = Seed: SATGFKQSSKALQRPVASDF
SATGFKQKSVALARPVASDF

SEQ ID NO: 12316 - protein, 20 aa, synthetic construct
  source 1..20: note = Seed: SATGFKQSSKALQRPVASDF
SATGFKQKSVALIRPVASDF

SEQ ID NO: 12317 - protein, 20 aa, synthetic construct
  source 1..20: note = Seed: SATGFKQSSKALQRPVASDF
SATGFKQKSVALNRPVASDF

SEQ ID NO: 12318 - protein, 20 aa, synthetic construct
  source 1..20: note = Seed: SATGFKQSSKALQRPVASDF
SATGFKQKSVALSRPVASDF

SEQ ID NO: 12319 - protein, 20 aa, synthetic construct
  source 1..20: note = Seed: SATGFKQSSKALQRPVASDF
SATGFKQKSVALTRPVASDF

SEQ ID NO: 12320 - protein, 20 aa, synthetic construct
  source 1..20: note = Seed: SATGFKQSSKALQRPVASDF
SATGFKQKSVALVRPVASDF

SEQ ID NO: 12321 - protein, 20 aa, synthetic construct
  source 1..20: note = Seed: SATGFKQSSKALQRPVASDF
SATGFKQLSAALARPVASDF

SEQ ID NO: 12322 - protein, 20 aa, synthetic construct
  source 1..20: note = Seed: SATGFKQSSKALQRPVASDF
SATGFKQLSAALCRPVASDF

SEQ ID NO: 12323 - protein, 20 aa, synthetic construct
  source 1..20: note = Seed: SATGFKQSSKALQRPVASDF
SATGFKQLSAALDRPVASDF

SEQ ID NO: 12324 - protein, 20 aa, synthetic construct
  source 1..20: note = Seed: SATGFKQSSKALQRPVASDF
SATGFKQLSAALERPVASDF

SEQ ID NO: 12325 - protein, 20 aa, synthetic construct
  source 1..20: note = Seed: SATGFKQSSKALQRPVASDF
SATGFKQLSAALFRPVASDF

SEQ ID NO: 12326 - protein, 20 aa, synthetic construct
  source 1..20: note = Seed: SATGFKQSSKALQRPVASDF
SATGFKQLSAALGRPVASDF

SEQ ID NO: 12327 - protein, 20 aa, synthetic construct
  source 1..20: note = Seed: SATGFKQSSKALQRPVASDF
SATGFKQLSAALHRPVASDF

SEQ ID NO: 12328 - protein, 20 aa, synthetic construct
  source 1..20: note = Seed: SATGFKQSSKALQRPVASDF
SATGFKQLSAALIRPVASDF

SEQ ID NO: 12329 - protein, 20 aa, synthetic construct
  source 1..20: note = Seed: SATGFKQSSKALQRPVASDF
SATGFKQLSAALKRPVASDF

SEQ ID NO: 12330 - protein, 20 aa, synthetic construct
  source 1..20: note = Seed: SATGFKQSSKALQRPVASDF
SATGFKQLSAALLRPVASDF

SEQ ID NO: 12331 - protein, 20 aa, synthetic construct
  source 1..20: note = Seed: SATGFKQSSKALQRPVASDF
SATGFKQLSAALMRPVASDF

SEQ ID NO: 12332 - protein, 20 aa, synthetic construct
  source 1..20: note = Seed: SATGFKQSSKALQRPVASDF
SATGFKQLSAALNRPVASDF

SEQ ID NO: 12333 - protein, 20 aa, synthetic construct
  source 1..20: note = Seed: SATGFKQSSKALQRPVASDF
SATGFKQLSAALPRPVASDF

SEQ ID NO: 12334 - protein, 20 aa, synthetic construct
  source 1..20: note = Seed: SATGFKQSSKALQRPVASDF
SATGFKQLSAALQRPVASDF

SEQ ID NO: 12335 - protein, 20 aa, synthetic construct
  source 1..20: note = Seed: SATGFKQSSKALQRPVASDF
SATGFKQLSAALRRPVASDF

SEQ ID NO: 12336 - protein, 20 aa, synthetic construct
  source 1..20: note = Seed: SATGFKQSSKALQRPVASDF
SATGFKQLSAALSRPVASDF

SEQ ID NO: 12337 - protein, 20 aa, synthetic construct
  source 1..20: note = Seed: SATGFKQSSKALQRPVASDF
SATGFKQLSAALTRPVASDF

SEQ ID NO: 12338 - protein, 20 aa, synthetic construct
  source 1..20: note = Seed: SATGFKQSSKALQRPVASDF
SATGFKQLSAALVRPVASDF

SEQ ID NO: 12339 - protein, 20 aa, synthetic construct
  source 1..20: note = Seed: SATGFKQSSKALQRPVASDF
SATGFKQLSAALWRPVASDF

SEQ ID NO: 12340 - protein, 20 aa, synthetic construct
  source 1..20: note = Seed: SATGFKQSSKALQRPVASDF
SATGFKQLSAALYRPVASDF

SEQ ID NO: 12341 - protein, 20 aa, synthetic construct
  source 1..20: note = Seed: SATGFKQSSKALQRPVASDF
SATGFKQLSCALARPVASDF

SEQ ID NO: 12342 - protein, 20 aa, synthetic construct
  source 1..20: note = Seed: SATGFKQSSKALQRPVASDF
SATGFKQLSCALGRPVASDF

SEQ ID NO: 12343 - protein, 20 aa, synthetic construct
  source 1..20: note = Seed: SATGFKQSSKALQRPVASDF
SATGFKQLSCALHRPVASDF

SEQ ID NO: 12344 - protein, 20 aa, synthetic construct
  source 1..20: note = Seed: SATGFKQSSKALQRPVASDF
SATGFKQLSCALIRPVASDF

SEQ ID NO: 12345 - protein, 20 aa, synthetic construct
  source 1..20: note = Seed: SATGFKQSSKALQRPVASDF
SATGFKQLSCALLRPVASDF

SEQ ID NO: 12346 - protein, 20 aa, synthetic construct
  source 1..20: note = Seed: SATGFKQSSKALQRPVASDF
SATGFKQLSCALMRPVASDF

SEQ ID NO: 12347 - protein, 20 aa, synthetic construct
  source 1..20: note = Seed: SATGFKQSSKALQRPVASDF
SATGFKQLSCALNRPVASDF

SEQ ID NO: 12348 - protein, 20 aa, synthetic construct
  source 1..20: note = Seed: SATGFKQSSKALQRPVASDF
SATGFKQLSCALPRPVASDF

SEQ ID NO: 12349 - protein, 20 aa, synthetic construct
  source 1..20: note = Seed: SATGFKQSSKALQRPVASDF
SATGFKQLSCALSRPVASDF

SEQ ID NO: 12350 - protein, 20 aa, synthetic construct
  source 1..20: note = Seed: SATGFKQSSKALQRPVASDF
SATGFKQLSCALTRPVASDF

SEQ ID NO: 12351 - protein, 20 aa, synthetic construct
  source 1..20: note = Seed: SATGFKQSSKALQRPVASDF
SATGFKQLSCALVRPVASDF

SEQ ID NO: 12352 - protein, 20 aa, synthetic construct
  source 1..20: note = Seed: SATGFKQSSKALQRPVASDF
SATGFKQLSDALARPVASDF

SEQ ID NO: 12353 - protein, 20 aa, synthetic construct
  source 1..20: note = Seed: SATGFKQSSKALQRPVASDF
SATGFKQLSDALIRPVASDF

SEQ ID NO: 12354 - protein, 20 aa, synthetic construct
  source 1..20: note = Seed: SATGFKQSSKALQRPVASDF
SATGFKQLSDALLRPVASDF

SEQ ID NO: 12355 - protein, 20 aa, synthetic construct
  source 1..20: note = Seed: SATGFKQSSKALQRPVASDF
SATGFKQLSDALMRPVASDF

SEQ ID NO: 12356 - protein, 20 aa, synthetic construct
  source 1..20: note = Seed: SATGFKQSSKALQRPVASDF
SATGFKQLSDALNRPVASDF

SEQ ID NO: 12357 - protein, 20 aa, synthetic construct
  source 1..20: note = Seed: SATGFKQSSKALQRPVASDF
SATGFKQLSDALSRPVASDF

SEQ ID NO: 12358 - protein, 20 aa, synthetic construct
  source 1..20: note = Seed: SATGFKQSSKALQRPVASDF
SATGFKQLSDALTRPVASDF

SEQ ID NO: 12359 - protein, 20 aa, synthetic construct
  source 1..20: note = Seed: SATGFKQSSKALQRPVASDF
SATGFKQLSDALVRPVASDF

SEQ ID NO: 12360 - protein, 20 aa, synthetic construct
  source 1..20: note = Seed: SATGFKQSSKALQRPVASDF
SATGFKQLSEALARPVASDF

SEQ ID NO: 12361 - protein, 20 aa, synthetic construct
  source 1..20: note = Seed: SATGFKQSSKALQRPVASDF
SATGFKQLSEALGRPVASDF

SEQ ID NO: 12362 - protein, 20 aa, synthetic construct
  source 1..20: note = Seed: SATGFKQSSKALQRPVASDF
SATGFKQLSEALIRPVASDF

SEQ ID NO: 12363 - protein, 20 aa, synthetic construct
  source 1..20: note = Seed: SATGFKQSSKALQRPVASDF
SATGFKQLSEALLRPVASDF

SEQ ID NO: 12364 - protein, 20 aa, synthetic construct
  source 1..20: note = Seed: SATGFKQSSKALQRPVASDF
SATGFKQLSEALMRPVASDF

SEQ ID NO: 12365 - protein, 20 aa, synthetic construct
  source 1..20: note = Seed: SATGFKQSSKALQRPVASDF
SATGFKQLSEALNRPVASDF

SEQ ID NO: 12366 - protein, 20 aa, synthetic construct
  source 1..20: note = Seed: SATGFKQSSKALQRPVASDF
SATGFKQLSEALSRPVASDF

SEQ ID NO: 12367 - protein, 20 aa, synthetic construct
  source 1..20: note = Seed: SATGFKQSSKALQRPVASDF
SATGFKQLSEALTRPVASDF

SEQ ID NO: 12368 - protein, 20 aa, synthetic construct
  source 1..20: note = Seed: SATGFKQSSKALQRPVASDF
SATGFKQLSEALVRPVASDF

SEQ ID NO: 12369 - protein, 20 aa, synthetic construct
  source 1..20: note = Seed: SATGFKQSSKALQRPVASDF
SATGFKQLSFALARPVASDF

SEQ ID NO: 12370 - protein, 20 aa, synthetic construct
  source 1..20: note = Seed: SATGFKQSSKALQRPVASDF
SATGFKQLSFALDRPVASDF

SEQ ID NO: 12371 - protein, 20 aa, synthetic construct
  source 1..20: note = Seed: SATGFKQSSKALQRPVASDF
SATGFKQLSFALERPVASDF

SEQ ID NO: 12372 - protein, 20 aa, synthetic construct
  source 1..20: note = Seed: SATGFKQSSKALQRPVASDF
SATGFKQLSFALIRPVASDF

SEQ ID NO: 12373 - protein, 20 aa, synthetic construct
  source 1..20: note = Seed: SATGFKQSSKALQRPVASDF
SATGFKQLSFALLRPVASDF

SEQ ID NO: 12374 - protein, 20 aa, synthetic construct
  source 1..20: note = Seed: SATGFKQSSKALQRPVASDF
SATGFKQLSFALMRPVASDF

SEQ ID NO: 12375 - protein, 20 aa, synthetic construct
  source 1..20: note = Seed: SATGFKQSSKALQRPVASDF
SATGFKQLSFALNRPVASDF

SEQ ID NO: 12376 - protein, 20 aa, synthetic construct
  source 1..20: note = Seed: SATGFKQSSKALQRPVASDF
SATGFKQLSFALQRPVASDF

SEQ ID NO: 12377 - protein, 20 aa, synthetic construct
  source 1..20: note = Seed: SATGFKQSSKALQRPVASDF
SATGFKQLSFALRRPVASDF

SEQ ID NO: 12378 - protein, 20 aa, synthetic construct
  source 1..20: note = Seed: SATGFKQSSKALQRPVASDF
SATGFKQLSFALSRPVASDF

SEQ ID NO: 12379 - protein, 20 aa, synthetic construct
  source 1..20: note = Seed: SATGFKQSSKALQRPVASDF
SATGFKQLSFALTRPVASDF

SEQ ID NO: 12380 - protein, 20 aa, synthetic construct
  source 1..20: note = Seed: SATGFKQSSKALQRPVASDF
SATGFKQLSFALVRPVASDF

SEQ ID NO: 12381 - protein, 20 aa, synthetic construct
  source 1..20: note = Seed: SATGFKQSSKALQRPVASDF
SATGFKQLSGALARPVASDF

SEQ ID NO: 12382 - protein, 20 aa, synthetic construct
  source 1..20: note = Seed: SATGFKQSSKALQRPVASDF
SATGFKQLSGALCRPVASDF

SEQ ID NO: 12383 - protein, 20 aa, synthetic construct
  source 1..20: note = Seed: SATGFKQSSKALQRPVASDF
SATGFKQLSGALDRPVASDF

SEQ ID NO: 12384 - protein, 20 aa, synthetic construct
  source 1..20: note = Seed: SATGFKQSSKALQRPVASDF
SATGFKQLSGALERPVASDF

SEQ ID NO: 12385 - protein, 20 aa, synthetic construct
  source 1..20: note = Seed: SATGFKQSSKALQRPVASDF
SATGFKQLSGALFRPVASDF

SEQ ID NO: 12386 - protein, 20 aa, synthetic construct
  source 1..20: note = Seed: SATGFKQSSKALQRPVASDF
SATGFKQLSGALGRPVASDF

SEQ ID NO: 12387 - protein, 20 aa, synthetic construct
  source 1..20: note = Seed: SATGFKQSSKALQRPVASDF
SATGFKQLSGALHRPVASDF

SEQ ID NO: 12388 - protein, 20 aa, synthetic construct
  source 1..20: note = Seed: SATGFKQSSKALQRPVASDF
SATGFKQLSGALIRPVASDF

SEQ ID NO: 12389 - protein, 20 aa, synthetic construct
  source 1..20: note = Seed: SATGFKQSSKALQRPVASDF
SATGFKQLSGALKRPVASDF

SEQ ID NO: 12390 - protein, 20 aa, synthetic construct
  source 1..20: note = Seed: SATGFKQSSKALQRPVASDF
SATGFKQLSGALLRPVASDF

SEQ ID NO: 12391 - protein, 20 aa, synthetic construct
  source 1..20: note = Seed: SATGFKQSSKALQRPVASDF
SATGFKQLSGALMRPVASDF

SEQ ID NO: 12392 - protein, 20 aa, synthetic construct
  source 1..20: note = Seed: SATGFKQSSKALQRPVASDF
SATGFKQLSGALNRPVASDF

SEQ ID NO: 12393 - protein, 20 aa, synthetic construct
  source 1..20: note = Seed: SATGFKQSSKALQRPVASDF
SATGFKQLSGALPRPVASDF

SEQ ID NO: 12394 - protein, 20 aa, synthetic construct
  source 1..20: note = Seed: SATGFKQSSKALQRPVASDF
SATGFKQLSGALQRPVASDF

SEQ ID NO: 12395 - protein, 20 aa, synthetic construct
  source 1..20: note = Seed: SATGFKQSSKALQRPVASDF
SATGFKQLSGALRRPVASDF

SEQ ID NO: 12396 - protein, 20 aa, synthetic construct
  source 1..20: note = Seed: SATGFKQSSKALQRPVASDF
SATGFKQLSGALSRPVASDF

SEQ ID NO: 12397 - protein, 20 aa, synthetic construct
  source 1..20: note = Seed: SATGFKQSSKALQRPVASDF
SATGFKQLSGALTRPVASDF

SEQ ID NO: 12398 - protein, 20 aa, synthetic construct
  source 1..20: note = Seed: SATGFKQSSKALQRPVASDF
SATGFKQLSGALVRPVASDF

SEQ ID NO: 12399 - protein, 20 aa, synthetic construct
  source 1..20: note = Seed: SATGFKQSSKALQRPVASDF
SATGFKQLSGALWRPVASDF

SEQ ID NO: 12400 - protein, 20 aa, synthetic construct
  source 1..20: note = Seed: SATGFKQSSKALQRPVASDF
SATGFKQLSGALYRPVASDF

SEQ ID NO: 12401 - protein, 20 aa, synthetic construct
  source 1..20: note = Seed: SATGFKQSSKALQRPVASDF
SATGFKQLSHALARPVASDF

SEQ ID NO: 12402 - protein, 20 aa, synthetic construct
  source 1..20: note = Seed: SATGFKQSSKALQRPVASDF
SATGFKQLSHALCRPVASDF

SEQ ID NO: 12403 - protein, 20 aa, synthetic construct
  source 1..20: note = Seed: SATGFKQSSKALQRPVASDF
SATGFKQLSHALFRPVASDF

SEQ ID NO: 12404 - protein, 20 aa, synthetic construct
  source 1..20: note = Seed: SATGFKQSSKALQRPVASDF
SATGFKQLSHALGRPVASDF

SEQ ID NO: 12405 - protein, 20 aa, synthetic construct
  source 1..20: note = Seed: SATGFKQSSKALQRPVASDF
SATGFKQLSHALHRPVASDF

SEQ ID NO: 12406 - protein, 20 aa, synthetic construct
  source 1..20: note = Seed: SATGFKQSSKALQRPVASDF
SATGFKQLSHALIRPVASDF

SEQ ID NO: 12407 - protein, 20 aa, synthetic construct
  source 1..20: note = Seed: SATGFKQSSKALQRPVASDF
SATGFKQLSHALKRPVASDF

SEQ ID NO: 12408 - protein, 20 aa, synthetic construct
  source 1..20: note = Seed: SATGFKQSSKALQRPVASDF
SATGFKQLSHALLRPVASDF

SEQ ID NO: 12409 - protein, 20 aa, synthetic construct
  source 1..20: note = Seed: SATGFKQSSKALQRPVASDF
SATGFKQLSHALMRPVASDF

SEQ ID NO: 12410 - protein, 20 aa, synthetic construct
  source 1..20: note = Seed: SATGFKQSSKALQRPVASDF
SATGFKQLSHALNRPVASDF

SEQ ID NO: 12411 - protein, 20 aa, synthetic construct
  source 1..20: note = Seed: SATGFKQSSKALQRPVASDF
SATGFKQLSHALQRPVASDF

SEQ ID NO: 12412 - protein, 20 aa, synthetic construct
  source 1..20: note = Seed: SATGFKQSSKALQRPVASDF
SATGFKQLSHALRRPVASDF

SEQ ID NO: 12413 - protein, 20 aa, synthetic construct
  source 1..20: note = Seed: SATGFKQSSKALQRPVASDF
SATGFKQLSHALSRPVASDF

SEQ ID NO: 12414 - protein, 20 aa, synthetic construct
  source 1..20: note = Seed: SATGFKQSSKALQRPVASDF
SATGFKQLSHALTRPVASDF

SEQ ID NO: 12415 - protein, 20 aa, synthetic construct
  source 1..20: note = Seed: SATGFKQSSKALQRPVASDF
SATGFKQLSHALVRPVASDF

SEQ ID NO: 12416 - protein, 20 aa, synthetic construct
  source 1..20: note = Seed: SATGFKQSSKALQRPVASDF
SATGFKQLSIALARPVASDF

SEQ ID NO: 12417 - protein, 20 aa, synthetic construct
  source 1..20: note = Seed: SATGFKQSSKALQRPVASDF
SATGFKQLSIALCRPVASDF

SEQ ID NO: 12418 - protein, 20 aa, synthetic construct
  source 1..20: note = Seed: SATGFKQSSKALQRPVASDF
SATGFKQLSIALDRPVASDF

SEQ ID NO: 12419 - protein, 20 aa, synthetic construct
  source 1..20: note = Seed: SATGFKQSSKALQRPVASDF
SATGFKQLSIALERPVASDF

SEQ ID NO: 12420 - protein, 20 aa, synthetic construct
  source 1..20: note = Seed: SATGFKQSSKALQRPVASDF
SATGFKQLSIALFRPVASDF

SEQ ID NO: 12421 - protein, 20 aa, synthetic construct
  source 1..20: note = Seed: SATGFKQSSKALQRPVASDF
SATGFKQLSIALGRPVASDF

SEQ ID NO: 12422 - protein, 20 aa, synthetic construct
  source 1..20: note = Seed: SATGFKQSSKALQRPVASDF
SATGFKQLSIALHRPVASDF

SEQ ID NO: 12423 - protein, 20 aa, synthetic construct
  source 1..20: note = Seed: SATGFKQSSKALQRPVASDF
SATGFKQLSIALIRPVASDF

SEQ ID NO: 12424 - protein, 20 aa, synthetic construct
  source 1..20: note = Seed: SATGFKQSSKALQRPVASDF
SATGFKQLSIALKRPVASDF

SEQ ID NO: 12425 - protein, 20 aa, synthetic construct
  source 1..20: note = Seed: SATGFKQSSKALQRPVASDF
SATGFKQLSIALLRPVASDF

SEQ ID NO: 12426 - protein, 20 aa, synthetic construct
  source 1..20: note = Seed: SATGFKQSSKALQRPVASDF
SATGFKQLSIALMRPVASDF

SEQ ID NO: 12427 - protein, 20 aa, synthetic construct
  source 1..20: note = Seed: SATGFKQSSKALQRPVASDF
SATGFKQLSIALNRPVASDF

SEQ ID NO: 12428 - protein, 20 aa, synthetic construct
  source 1..20: note = Seed: SATGFKQSSKALQRPVASDF
SATGFKQLSIALPRPVASDF

SEQ ID NO: 12429 - protein, 20 aa, synthetic construct
  source 1..20: note = Seed: SATGFKQSSKALQRPVASDF
SATGFKQLSIALQRPVASDF

SEQ ID NO: 12430 - protein, 20 aa, synthetic construct
  source 1..20: note = Seed: SATGFKQSSKALQRPVASDF
SATGFKQLSIALRRPVASDF

SEQ ID NO: 12431 - protein, 20 aa, synthetic construct
  source 1..20: note = Seed: SATGFKQSSKALQRPVASDF
SATGFKQLSIALSRPVASDF

SEQ ID NO: 12432 - protein, 20 aa, synthetic construct
  source 1..20: note = Seed: SATGFKQSSKALQRPVASDF
SATGFKQLSIALTRPVASDF

SEQ ID NO: 12433 - protein, 20 aa, synthetic construct
  source 1..20: note = Seed: SATGFKQSSKALQRPVASDF
SATGFKQLSIALVRPVASDF

SEQ ID NO: 12434 - protein, 20 aa, synthetic construct
  source 1..20: note = Seed: SATGFKQSSKALQRPVASDF
SATGFKQLSIALYRPVASDF

SEQ ID NO: 12435 - protein, 20 aa, synthetic construct
  source 1..20: note = Seed: SATGFKQSSKALQRPVASDF
SATGFKQLSKALARPVASDF

SEQ ID NO: 12436 - protein, 20 aa, synthetic construct
  source 1..20: note = Seed: SATGFKQSSKALQRPVASDF
SATGFKQLSKALCRPVASDF

SEQ ID NO: 12437 - protein, 20 aa, synthetic construct
  source 1..20: note = Seed: SATGFKQSSKALQRPVASDF
SATGFKQLSKALDRPVASDF

SEQ ID NO: 12438 - protein, 20 aa, synthetic construct
  source 1..20: note = Seed: SATGFKQSSKALQRPVASDF
SATGFKQLSKALERPVASDF

SEQ ID NO: 12439 - protein, 20 aa, synthetic construct
  source 1..20: note = Seed: SATGFKQSSKALQRPVASDF
SATGFKQLSKALFRPVASDF

SEQ ID NO: 12440 - protein, 20 aa, synthetic construct
  source 1..20: note = Seed: SATGFKQSSKALQRPVASDF
SATGFKQLSKALGRPVASDF

SEQ ID NO: 12441 - protein, 20 aa, synthetic construct
  source 1..20: note = Seed: SATGFKQSSKALQRPVASDF
SATGFKQLSKALHRPVASDF

SEQ ID NO: 12442 - protein, 20 aa, synthetic construct
  source 1..20: note = Seed: SATGFKQSSKALQRPVASDF
SATGFKQLSKALIRPVASDF

SEQ ID NO: 12443 - protein, 20 aa, synthetic construct
  source 1..20: note = Seed: SATGFKQSSKALQRPVASDF
SATGFKQLSKALKRPVASDF

SEQ ID NO: 12444 - protein, 20 aa, synthetic construct
  source 1..20: note = Seed: SATGFKQSSKALQRPVASDF
SATGFKQLSKALLRPVASDF

SEQ ID NO: 12445 - protein, 20 aa, synthetic construct
  source 1..20: note = Seed: SATGFKQSSKALQRPVASDF
SATGFKQLSKALMRPVASDF

SEQ ID NO: 12446 - protein, 20 aa, synthetic construct
  source 1..20: note = Seed: SATGFKQSSKALQRPVASDF
SATGFKQLSKALNRPVASDF

SEQ ID NO: 12447 - protein, 20 aa, synthetic construct
  source 1..20: note = Seed: SATGFKQSSKALQRPVASDF
SATGFKQLSKALPRPVASDF

SEQ ID NO: 12448 - protein, 20 aa, synthetic construct
  source 1..20: note = Seed: SATGFKQSSKALQRPVASDF
SATGFKQLSKALQRPVASDF

SEQ ID NO: 12449 - protein, 20 aa, synthetic construct
  source 1..20: note = Seed: SATGFKQSSKALQRPVASDF
SATGFKQLSKALRRPVASDF

SEQ ID NO: 12450 - protein, 20 aa, synthetic construct
  source 1..20: note = Seed: SATGFKQSSKALQRPVASDF
SATGFKQLSKALSRPVASDF

SEQ ID NO: 12451 - protein, 20 aa, synthetic construct
  source 1..20: note = Seed: SATGFKQSSKALQRPVASDF
SATGFKQLSKALTRPVASDF

SEQ ID NO: 12452 - protein, 20 aa, synthetic construct
  source 1..20: note = Seed: SATGFKQSSKALQRPVASDF
SATGFKQLSKALVRPVASDF

SEQ ID NO: 12453 - protein, 20 aa, synthetic construct
  source 1..20: note = Seed: SATGFKQSSKALQRPVASDF
SATGFKQLSKALWRPVASDF

SEQ ID NO: 12454 - protein, 20 aa, synthetic construct
  source 1..20: note = Seed: SATGFKQSSKALQRPVASDF
SATGFKQLSKALYRPVASDF

SEQ ID NO: 12455 - protein, 20 aa, synthetic construct
  source 1..20: note = Seed: SATGFKQSSKALQRPVASDF
SATGFKQLSLALARPVASDF

SEQ ID NO: 12456 - protein, 20 aa, synthetic construct
  source 1..20: note = Seed: SATGFKQSSKALQRPVASDF
SATGFKQLSLALCRPVASDF

SEQ ID NO: 12457 - protein, 20 aa, synthetic construct
  source 1..20: note = Seed: SATGFKQSSKALQRPVASDF
SATGFKQLSLALDRPVASDF

SEQ ID NO: 12458 - protein, 20 aa, synthetic construct
  source 1..20: note = Seed: SATGFKQSSKALQRPVASDF
SATGFKQLSLALERPVASDF

SEQ ID NO: 12459 - protein, 20 aa, synthetic construct
  source 1..20: note = Seed: SATGFKQSSKALQRPVASDF
SATGFKQLSLALFRPVASDF

SEQ ID NO: 12460 - protein, 20 aa, synthetic construct
  source 1..20: note = Seed: SATGFKQSSKALQRPVASDF
SATGFKQLSLALGRPVASDF

SEQ ID NO: 12461 - protein, 20 aa, synthetic construct
  source 1..20: note = Seed: SATGFKQSSKALQRPVASDF
SATGFKQLSLALHRPVASDF

SEQ ID NO: 12462 - protein, 20 aa, synthetic construct
  source 1..20: note = Seed: SATGFKQSSKALQRPVASDF
SATGFKQLSLALIRPVASDF

SEQ ID NO: 12463 - protein, 20 aa, synthetic construct
  source 1..20: note = Seed: SATGFKQSSKALQRPVASDF
SATGFKQLSLALKRPVASDF

SEQ ID NO: 12464 - protein, 20 aa, synthetic construct
  source 1..20: note = Seed: SATGFKQSSKALQRPVASDF
SATGFKQLSLALLRPVASDF

SEQ ID NO: 12465 - protein, 20 aa, synthetic construct
  source 1..20: note = Seed: SATGFKQSSKALQRPVASDF
SATGFKQLSLALMRPVASDF

SEQ ID NO: 12466 - protein, 20 aa, synthetic construct
  source 1..20: note = Seed: SATGFKQSSKALQRPVASDF
SATGFKQLSLALNRPVASDF

SEQ ID NO: 12467 - protein, 20 aa, synthetic construct
  source 1..20: note = Seed: SATGFKQSSKALQRPVASDF
SATGFKQLSLALQRPVASDF

SEQ ID NO: 12468 - protein, 20 aa, synthetic construct
  source 1..20: note = Seed: SATGFKQSSKALQRPVASDF
SATGFKQLSLALRRPVASDF

SEQ ID NO: 12469 - protein, 20 aa, synthetic construct
  source 1..20: note = Seed: SATGFKQSSKALQRPVASDF
SATGFKQLSLALSRPVASDF

SEQ ID NO: 12470 - protein, 20 aa, synthetic construct
  source 1..20: note = Seed: SATGFKQSSKALQRPVASDF
SATGFKQLSLALTRPVASDF

SEQ ID NO: 12471 - protein, 20 aa, synthetic construct
  source 1..20: note = Seed: SATGFKQSSKALQRPVASDF
SATGFKQLSLALVRPVASDF

SEQ ID NO: 12472 - protein, 20 aa, synthetic construct
  source 1..20: note = Seed: SATGFKQSSKALQRPVASDF
SATGFKQLSLALYRPVASDF

SEQ ID NO: 12473 - protein, 20 aa, synthetic construct
  source 1..20: note = Seed: SATGFKQSSKALQRPVASDF
SATGFKQLSMALARPVASDF

SEQ ID NO: 12474 - protein, 20 aa, synthetic construct
  source 1..20: note = Seed: SATGFKQSSKALQRPVASDF
SATGFKQLSMALCRPVASDF

SEQ ID NO: 12475 - protein, 20 aa, synthetic construct
  source 1..20: note = Seed: SATGFKQSSKALQRPVASDF
SATGFKQLSMALDRPVASDF

SEQ ID NO: 12476 - protein, 20 aa, synthetic construct
  source 1..20: note = Seed: SATGFKQSSKALQRPVASDF
SATGFKQLSMALERPVASDF

SEQ ID NO: 12477 - protein, 20 aa, synthetic construct
  source 1..20: note = Seed: SATGFKQSSKALQRPVASDF
SATGFKQLSMALFRPVASDF

SEQ ID NO: 12478 - protein, 20 aa, synthetic construct
  source 1..20: note = Seed: SATGFKQSSKALQRPVASDF
SATGFKQLSMALGRPVASDF

SEQ ID NO: 12479 - protein, 20 aa, synthetic construct
  source 1..20: note = Seed: SATGFKQSSKALQRPVASDF
SATGFKQLSMALHRPVASDF

SEQ ID NO: 12480 - protein, 20 aa, synthetic construct
  source 1..20: note = Seed: SATGFKQSSKALQRPVASDF
SATGFKQLSMALIRPVASDF

SEQ ID NO: 12481 - protein, 20 aa, synthetic construct
  source 1..20: note = Seed: SATGFKQSSKALQRPVASDF
SATGFKQLSMALKRPVASDF

SEQ ID NO: 12482 - protein, 20 aa, synthetic construct
  source 1..20: note = Seed: SATGFKQSSKALQRPVASDF
SATGFKQLSMALLRPVASDF

SEQ ID NO: 12483 - protein, 20 aa, synthetic construct
  source 1..20: note = Seed: SATGFKQSSKALQRPVASDF
SATGFKQLSMALMRPVASDF

SEQ ID NO: 12484 - protein, 20 aa, synthetic construct
  source 1..20: note = Seed: SATGFKQSSKALQRPVASDF
SATGFKQLSMALNRPVASDF

SEQ ID NO: 12485 - protein, 20 aa, synthetic construct
  source 1..20: note = Seed: SATGFKQSSKALQRPVASDF
SATGFKQLSMALQRPVASDF

SEQ ID NO: 12486 - protein, 20 aa, synthetic construct
  source 1..20: note = Seed: SATGFKQSSKALQRPVASDF
SATGFKQLSMALRRPVASDF

SEQ ID NO: 12487 - protein, 20 aa, synthetic construct
  source 1..20: note = Seed: SATGFKQSSKALQRPVASDF
SATGFKQLSMALSRPVASDF

SEQ ID NO: 12488 - protein, 20 aa, synthetic construct
  source 1..20: note = Seed: SATGFKQSSKALQRPVASDF
SATGFKQLSMALTRPVASDF

SEQ ID NO: 12489 - protein, 20 aa, synthetic construct
  source 1..20: note = Seed: SATGFKQSSKALQRPVASDF
SATGFKQLSMALVRPVASDF

SEQ ID NO: 12490 - protein, 20 aa, synthetic construct
  source 1..20: note = Seed: SATGFKQSSKALQRPVASDF
SATGFKQLSMALYRPVASDF

SEQ ID NO: 12491 - protein, 20 aa, synthetic construct
  source 1..20: note = Seed: SATGFKQSSKALQRPVASDF
SATGFKQLSNALARPVASDF

SEQ ID NO: 12492 - protein, 20 aa, synthetic construct
  source 1..20: note = Seed: SATGFKQSSKALQRPVASDF
SATGFKQLSNALCRPVASDF

SEQ ID NO: 12493 - protein, 20 aa, synthetic construct
  source 1..20: note = Seed: SATGFKQSSKALQRPVASDF
SATGFKQLSNALDRPVASDF

SEQ ID NO: 12494 - protein, 20 aa, synthetic construct
  source 1..20: note = Seed: SATGFKQSSKALQRPVASDF
SATGFKQLSNALERPVASDF

SEQ ID NO: 12495 - protein, 20 aa, synthetic construct
  source 1..20: note = Seed: SATGFKQSSKALQRPVASDF
SATGFKQLSNALFRPVASDF

SEQ ID NO: 12496 - protein, 20 aa, synthetic construct
  source 1..20: note = Seed: SATGFKQSSKALQRPVASDF
SATGFKQLSNALGRPVASDF

SEQ ID NO: 12497 - protein, 20 aa, synthetic construct
  source 1..20: note = Seed: SATGFKQSSKALQRPVASDF
SATGFKQLSNALHRPVASDF

SEQ ID NO: 12498 - protein, 20 aa, synthetic construct
  source 1..20: note = Seed: SATGFKQSSKALQRPVASDF
SATGFKQLSNALIRPVASDF

SEQ ID NO: 12499 - protein, 20 aa, synthetic construct
  source 1..20: note = Seed: SATGFKQSSKALQRPVASDF
SATGFKQLSNALKRPVASDF

SEQ ID NO: 12500 - protein, 20 aa, synthetic construct
  source 1..20: note = Seed: SATGFKQSSKALQRPVASDF
SATGFKQLSNALLRPVASDF

SEQ ID NO: 12501 - protein, 20 aa, synthetic construct
  source 1..20: note = Seed: SATGFKQSSKALQRPVASDF
SATGFKQLSNALMRPVASDF

SEQ ID NO: 12502 - protein, 20 aa, synthetic construct
  source 1..20: note = Seed: SATGFKQSSKALQRPVASDF
SATGFKQLSNALNRPVASDF

SEQ ID NO: 12503 - protein, 20 aa, synthetic construct
  source 1..20: note = Seed: SATGFKQSSKALQRPVASDF
SATGFKQLSNALPRPVASDF

SEQ ID NO: 12504 - protein, 20 aa, synthetic construct
  source 1..20: note = Seed: SATGFKQSSKALQRPVASDF
SATGFKQLSNALQRPVASDF

SEQ ID NO: 12505 - protein, 20 aa, synthetic construct
  source 1..20: note = Seed: SATGFKQSSKALQRPVASDF
SATGFKQLSNALRRPVASDF

SEQ ID NO: 12506 - protein, 20 aa, synthetic construct
  source 1..20: note = Seed: SATGFKQSSKALQRPVASDF
SATGFKQLSNALSRPVASDF

SEQ ID NO: 12507 - protein, 20 aa, synthetic construct
  source 1..20: note = Seed: SATGFKQSSKALQRPVASDF
SATGFKQLSNALTRPVASDF

SEQ ID NO: 12508 - protein, 20 aa, synthetic construct
  source 1..20: note = Seed: SATGFKQSSKALQRPVASDF
SATGFKQLSNALVRPVASDF

SEQ ID NO: 12509 - protein, 20 aa, synthetic construct
  source 1..20: note = Seed: SATGFKQSSKALQRPVASDF
SATGFKQLSNALWRPVASDF

SEQ ID NO: 12510 - protein, 20 aa, synthetic construct
  source 1..20: note = Seed: SATGFKQSSKALQRPVASDF
SATGFKQLSNALYRPVASDF

SEQ ID NO: 12511 - protein, 20 aa, synthetic construct
  source 1..20: note = Seed: SATGFKQSSKALQRPVASDF
SATGFKQLSPALARPVASDF

SEQ ID NO: 12512 - protein, 20 aa, synthetic construct
  source 1..20: note = Seed: SATGFKQSSKALQRPVASDF
SATGFKQLSPALCRPVASDF

SEQ ID NO: 12513 - protein, 20 aa, synthetic construct
  source 1..20: note = Seed: SATGFKQSSKALQRPVASDF
SATGFKQLSPALDRPVASDF

SEQ ID NO: 12514 - protein, 20 aa, synthetic construct
  source 1..20: note = Seed: SATGFKQSSKALQRPVASDF
SATGFKQLSPALERPVASDF

SEQ ID NO: 12515 - protein, 20 aa, synthetic construct
  source 1..20: note = Seed: SATGFKQSSKALQRPVASDF
SATGFKQLSPALFRPVASDF

SEQ ID NO: 12516 - protein, 20 aa, synthetic construct
  source 1..20: note = Seed: SATGFKQSSKALQRPVASDF
SATGFKQLSPALGRPVASDF

SEQ ID NO: 12517 - protein, 20 aa, synthetic construct
  source 1..20: note = Seed: SATGFKQSSKALQRPVASDF
SATGFKQLSPALHRPVASDF

SEQ ID NO: 12518 - protein, 20 aa, synthetic construct
  source 1..20: note = Seed: SATGFKQSSKALQRPVASDF
SATGFKQLSPALIRPVASDF

SEQ ID NO: 12519 - protein, 20 aa, synthetic construct
  source 1..20: note = Seed: SATGFKQSSKALQRPVASDF
SATGFKQLSPALKRPVASDF

SEQ ID NO: 12520 - protein, 20 aa, synthetic construct
  source 1..20: note = Seed: SATGFKQSSKALQRPVASDF
SATGFKQLSPALLRPVASDF

SEQ ID NO: 12521 - protein, 20 aa, synthetic construct
  source 1..20: note = Seed: SATGFKQSSKALQRPVASDF
SATGFKQLSPALMRPVASDF

SEQ ID NO: 12522 - protein, 20 aa, synthetic construct
  source 1..20: note = Seed: SATGFKQSSKALQRPVASDF
SATGFKQLSPALNRPVASDF

SEQ ID NO: 12523 - protein, 20 aa, synthetic construct
  source 1..20: note = Seed: SATGFKQSSKALQRPVASDF
SATGFKQLSPALPRPVASDF

SEQ ID NO: 12524 - protein, 20 aa, synthetic construct
  source 1..20: note = Seed: SATGFKQSSKALQRPVASDF
SATGFKQLSPALQRPVASDF

SEQ ID NO: 12525 - protein, 20 aa, synthetic construct
  source 1..20: note = Seed: SATGFKQSSKALQRPVASDF
SATGFKQLSPALRRPVASDF

SEQ ID NO: 12526 - protein, 20 aa, synthetic construct
  source 1..20: note = Seed: SATGFKQSSKALQRPVASDF
SATGFKQLSPALSRPVASDF

SEQ ID NO: 12527 - protein, 20 aa, synthetic construct
  source 1..20: note = Seed: SATGFKQSSKALQRPVASDF
SATGFKQLSPALTRPVASDF

SEQ ID NO: 12528 - protein, 20 aa, synthetic construct
  source 1..20: note = Seed: SATGFKQSSKALQRPVASDF
SATGFKQLSPALVRPVASDF

SEQ ID NO: 12529 - protein, 20 aa, synthetic construct
  source 1..20: note = Seed: SATGFKQSSKALQRPVASDF
SATGFKQLSPALWRPVASDF

SEQ ID NO: 12530 - protein, 20 aa, synthetic construct
  source 1..20: note = Seed: SATGFKQSSKALQRPVASDF
SATGFKQLSPALYRPVASDF

SEQ ID NO: 12531 - protein, 20 aa, synthetic construct
  source 1..20: note = Seed: SATGFKQSSKALQRPVASDF
SATGFKQLSQALARPVASDF

SEQ ID NO: 12532 - protein, 20 aa, synthetic construct
  source 1..20: note = Seed: SATGFKQSSKALQRPVASDF
SATGFKQLSQALGRPVASDF

SEQ ID NO: 12533 - protein, 20 aa, synthetic construct
  source 1..20: note = Seed: SATGFKQSSKALQRPVASDF
SATGFKQLSQALIRPVASDF

SEQ ID NO: 12534 - protein, 20 aa, synthetic construct
  source 1..20: note = Seed: SATGFKQSSKALQRPVASDF
SATGFKQLSQALLRPVASDF

SEQ ID NO: 12535 - protein, 20 aa, synthetic construct
  source 1..20: note = Seed: SATGFKQSSKALQRPVASDF
SATGFKQLSQALMRPVASDF

SEQ ID NO: 12536 - protein, 20 aa, synthetic construct
  source 1..20: note = Seed: SATGFKQSSKALQRPVASDF
SATGFKQLSQALNRPVASDF

SEQ ID NO: 12537 - protein, 20 aa, synthetic construct
  source 1..20: note = Seed: SATGFKQSSKALQRPVASDF
SATGFKQLSQALPRPVASDF

SEQ ID NO: 12538 - protein, 20 aa, synthetic construct
  source 1..20: note = Seed: SATGFKQSSKALQRPVASDF
SATGFKQLSQALSRPVASDF

SEQ ID NO: 12539 - protein, 20 aa, synthetic construct
  source 1..20: note = Seed: SATGFKQSSKALQRPVASDF
SATGFKQLSQALTRPVASDF

SEQ ID NO: 12540 - protein, 20 aa, synthetic construct
  source 1..20: note = Seed: SATGFKQSSKALQRPVASDF
SATGFKQLSQALVRPVASDF

SEQ ID NO: 12541 - protein, 20 aa, synthetic construct
  source 1..20: note = Seed: SATGFKQSSKALQRPVASDF
SATGFKQLSRALARPVASDF

SEQ ID NO: 12542 - protein, 20 aa, synthetic construct
  source 1..20: note = Seed: SATGFKQSSKALQRPVASDF
SATGFKQLSRALCRPVASDF

SEQ ID NO: 12543 - protein, 20 aa, synthetic construct
  source 1..20: note = Seed: SATGFKQSSKALQRPVASDF
SATGFKQLSRALDRPVASDF

SEQ ID NO: 12544 - protein, 20 aa, synthetic construct
  source 1..20: note = Seed: SATGFKQSSKALQRPVASDF
SATGFKQLSRALERPVASDF

SEQ ID NO: 12545 - protein, 20 aa, synthetic construct
  source 1..20: note = Seed: SATGFKQSSKALQRPVASDF
SATGFKQLSRALFRPVASDF

SEQ ID NO: 12546 - protein, 20 aa, synthetic construct
  source 1..20: note = Seed: SATGFKQSSKALQRPVASDF
SATGFKQLSRALGRPVASDF

SEQ ID NO: 12547 - protein, 20 aa, synthetic construct
  source 1..20: note = Seed: SATGFKQSSKALQRPVASDF
SATGFKQLSRALHRPVASDF

SEQ ID NO: 12548 - protein, 20 aa, synthetic construct
  source 1..20: note = Seed: SATGFKQSSKALQRPVASDF
SATGFKQLSRALIRPVASDF

SEQ ID NO: 12549 - protein, 20 aa, synthetic construct
  source 1..20: note = Seed: SATGFKQSSKALQRPVASDF
SATGFKQLSRALKRPVASDF

SEQ ID NO: 12550 - protein, 20 aa, synthetic construct
  source 1..20: note = Seed: SATGFKQSSKALQRPVASDF
SATGFKQLSRALLRPVASDF

SEQ ID NO: 12551 - protein, 20 aa, synthetic construct
  source 1..20: note = Seed: SATGFKQSSKALQRPVASDF
SATGFKQLSRALMRPVASDF

SEQ ID NO: 12552 - protein, 20 aa, synthetic construct
  source 1..20: note = Seed: SATGFKQSSKALQRPVASDF
SATGFKQLSRALNRPVASDF

SEQ ID NO: 12553 - protein, 20 aa, synthetic construct
  source 1..20: note = Seed: SATGFKQSSKALQRPVASDF
SATGFKQLSRALPRPVASDF

SEQ ID NO: 12554 - protein, 20 aa, synthetic construct
  source 1..20: note = Seed: SATGFKQSSKALQRPVASDF
SATGFKQLSRALQRPVASDF

SEQ ID NO: 12555 - protein, 20 aa, synthetic construct
  source 1..20: note = Seed: SATGFKQSSKALQRPVASDF
SATGFKQLSRALRRPVASDF

SEQ ID NO: 12556 - protein, 20 aa, synthetic construct
  source 1..20: note = Seed: SATGFKQSSKALQRPVASDF
SATGFKQLSRALSRPVASDF

SEQ ID NO: 12557 - protein, 20 aa, synthetic construct
  source 1..20: note = Seed: SATGFKQSSKALQRPVASDF
SATGFKQLSRALTRPVASDF

SEQ ID NO: 12558 - protein, 20 aa, synthetic construct
  source 1..20: note = Seed: SATGFKQSSKALQRPVASDF
SATGFKQLSRALVRPVASDF

SEQ ID NO: 12559 - protein, 20 aa, synthetic construct
  source 1..20: note = Seed: SATGFKQSSKALQRPVASDF
SATGFKQLSRALWRPVASDF

SEQ ID NO: 12560 - protein, 20 aa, synthetic construct
  source 1..20: note = Seed: SATGFKQSSKALQRPVASDF
SATGFKQLSRALYRPVASDF

SEQ ID NO: 12561 - protein, 20 aa, synthetic construct
  source 1..20: note = Seed: SATGFKQSSKALQRPVASDF
SATGFKQLSSALARPVASDF

SEQ ID NO: 12562 - protein, 20 aa, synthetic construct
  source 1..20: note = Seed: SATGFKQSSKALQRPVASDF
SATGFKQLSSALCRPVASDF

SEQ ID NO: 12563 - protein, 20 aa, synthetic construct
  source 1..20: note = Seed: SATGFKQSSKALQRPVASDF
SATGFKQLSSALDRPVASDF

SEQ ID NO: 12564 - protein, 20 aa, synthetic construct
  source 1..20: note = Seed: SATGFKQSSKALQRPVASDF
SATGFKQLSSALERPVASDF

SEQ ID NO: 12565 - protein, 20 aa, synthetic construct
  source 1..20: note = Seed: SATGFKQSSKALQRPVASDF
SATGFKQLSSALFRPVASDF

SEQ ID NO: 12566 - protein, 20 aa, synthetic construct
  source 1..20: note = Seed: SATGFKQSSKALQRPVASDF
SATGFKQLSSALGRPVASDF

SEQ ID NO: 12567 - protein, 20 aa, synthetic construct
  source 1..20: note = Seed: SATGFKQSSKALQRPVASDF
SATGFKQLSSALHRPVASDF

SEQ ID NO: 12568 - protein, 20 aa, synthetic construct
  source 1..20: note = Seed: SATGFKQSSKALQRPVASDF
SATGFKQLSSALIRPVASDF

SEQ ID NO: 12569 - protein, 20 aa, synthetic construct
  source 1..20: note = Seed: SATGFKQSSKALQRPVASDF
SATGFKQLSSALKRPVASDF

SEQ ID NO: 12570 - protein, 20 aa, synthetic construct
  source 1..20: note = Seed: SATGFKQSSKALQRPVASDF
SATGFKQLSSALLRPVASDF

SEQ ID NO: 12571 - protein, 20 aa, synthetic construct
  source 1..20: note = Seed: SATGFKQSSKALQRPVASDF
SATGFKQLSSALMRPVASDF

SEQ ID NO: 12572 - protein, 20 aa, synthetic construct
  source 1..20: note = Seed: SATGFKQSSKALQRPVASDF
SATGFKQLSSALNRPVASDF

SEQ ID NO: 12573 - protein, 20 aa, synthetic construct
  source 1..20: note = Seed: SATGFKQSSKALQRPVASDF
SATGFKQLSSALPRPVASDF

SEQ ID NO: 12574 - protein, 20 aa, synthetic construct
  source 1..20: note = Seed: SATGFKQSSKALQRPVASDF
SATGFKQLSSALQRPVASDF

SEQ ID NO: 12575 - protein, 20 aa, synthetic construct
  source 1..20: note = Seed: SATGFKQSSKALQRPVASDF
SATGFKQLSSALRRPVASDF

SEQ ID NO: 12576 - protein, 20 aa, synthetic construct
  source 1..20: note = Seed: SATGFKQSSKALQRPVASDF
SATGFKQLSSALSRPVASDF

SEQ ID NO: 12577 - protein, 20 aa, synthetic construct
  source 1..20: note = Seed: SATGFKQSSKALQRPVASDF
SATGFKQLSSALTRPVASDF

SEQ ID NO: 12578 - protein, 20 aa, synthetic construct
  source 1..20: note = Seed: SATGFKQSSKALQRPVASDF
SATGFKQLSSALVRPVASDF

SEQ ID NO: 12579 - protein, 20 aa, synthetic construct
  source 1..20: note = Seed: SATGFKQSSKALQRPVASDF
SATGFKQLSSALWRPVASDF

SEQ ID NO: 12580 - protein, 20 aa, synthetic construct
  source 1..20: note = Seed: SATGFKQSSKALQRPVASDF
SATGFKQLSSALYRPVASDF

SEQ ID NO: 12581 - protein, 20 aa, synthetic construct
  source 1..20: note = Seed: SATGFKQSSKALQRPVASDF
SATGFKQLSTALARPVASDF

SEQ ID NO: 12582 - protein, 20 aa, synthetic construct
  source 1..20: note = Seed: SATGFKQSSKALQRPVASDF
SATGFKQLSTALCRPVASDF

SEQ ID NO: 12583 - protein, 20 aa, synthetic construct
  source 1..20: note = Seed: SATGFKQSSKALQRPVASDF
SATGFKQLSTALDRPVASDF

SEQ ID NO: 12584 - protein, 20 aa, synthetic construct
  source 1..20: note = Seed: SATGFKQSSKALQRPVASDF
SATGFKQLSTALERPVASDF

SEQ ID NO: 12585 - protein, 20 aa, synthetic construct
  source 1..20: note = Seed: SATGFKQSSKALQRPVASDF
SATGFKQLSTALFRPVASDF

SEQ ID NO: 12586 - protein, 20 aa, synthetic construct
  source 1..20: note = Seed: SATGFKQSSKALQRPVASDF
SATGFKQLSTALGRPVASDF

SEQ ID NO: 12587 - protein, 20 aa, synthetic construct
  source 1..20: note = Seed: SATGFKQSSKALQRPVASDF
SATGFKQLSTALHRPVASDF

SEQ ID NO: 12588 - protein, 20 aa, synthetic construct
  source 1..20: note = Seed: SATGFKQSSKALQRPVASDF
SATGFKQLSTALIRPVASDF

SEQ ID NO: 12589 - protein, 20 aa, synthetic construct
  source 1..20: note = Seed: SATGFKQSSKALQRPVASDF
SATGFKQLSTALKRPVASDF

SEQ ID NO: 12590 - protein, 20 aa, synthetic construct
  source 1..20: note = Seed: SATGFKQSSKALQRPVASDF
SATGFKQLSTALLRPVASDF

SEQ ID NO: 12591 - protein, 20 aa, synthetic construct
  source 1..20: note = Seed: SATGFKQSSKALQRPVASDF
SATGFKQLSTALMRPVASDF

SEQ ID NO: 12592 - protein, 20 aa, synthetic construct
  source 1..20: note = Seed: SATGFKQSSKALQRPVASDF
SATGFKQLSTALNRPVASDF

SEQ ID NO: 12593 - protein, 20 aa, synthetic construct
  source 1..20: note = Seed: SATGFKQSSKALQRPVASDF
SATGFKQLSTALPRPVASDF

SEQ ID NO: 12594 - protein, 20 aa, synthetic construct
  source 1..20: note = Seed: SATGFKQSSKALQRPVASDF
SATGFKQLSTALQRPVASDF

SEQ ID NO: 12595 - protein, 20 aa, synthetic construct
  source 1..20: note = Seed: SATGFKQSSKALQRPVASDF
SATGFKQLSTALRRPVASDF

SEQ ID NO: 12596 - protein, 20 aa, synthetic construct
  source 1..20: note = Seed: SATGFKQSSKALQRPVASDF
SATGFKQLSTALSRPVASDF

SEQ ID NO: 12597 - protein, 20 aa, synthetic construct
  source 1..20: note = Seed: SATGFKQSSKALQRPVASDF
SATGFKQLSTALTRPVASDF

SEQ ID NO: 12598 - protein, 20 aa, synthetic construct
  source 1..20: note = Seed: SATGFKQSSKALQRPVASDF
SATGFKQLSTALVRPVASDF

SEQ ID NO: 12599 - protein, 20 aa, synthetic construct
  source 1..20: note = Seed: SATGFKQSSKALQRPVASDF
SATGFKQLSTALWRPVASDF

SEQ ID NO: 12600 - protein, 20 aa, synthetic construct
  source 1..20: note = Seed: SATGFKQSSKALQRPVASDF
SATGFKQLSTALYRPVASDF

SEQ ID NO: 12601 - protein, 20 aa, synthetic construct
  source 1..20: note = Seed: SATGFKQSSKALQRPVASDF
SATGFKQLSVALARPVASDF

SEQ ID NO: 12602 - protein, 20 aa, synthetic construct
  source 1..20: note = Seed: SATGFKQSSKALQRPVASDF
SATGFKQLSVALCRPVASDF

SEQ ID NO: 12603 - protein, 20 aa, synthetic construct
  source 1..20: note = Seed: SATGFKQSSKALQRPVASDF
SATGFKQLSVALDRPVASDF

SEQ ID NO: 12604 - protein, 20 aa, synthetic construct
  source 1..20: note = Seed: SATGFKQSSKALQRPVASDF
SATGFKQLSVALERPVASDF

SEQ ID NO: 12605 - protein, 20 aa, synthetic construct
  source 1..20: note = Seed: SATGFKQSSKALQRPVASDF
SATGFKQLSVALFRPVASDF

SEQ ID NO: 12606 - protein, 20 aa, synthetic construct
  source 1..20: note = Seed: SATGFKQSSKALQRPVASDF
SATGFKQLSVALGRPVASDF

SEQ ID NO: 12607 - protein, 20 aa, synthetic construct
  source 1..20: note = Seed: SATGFKQSSKALQRPVASDF
SATGFKQLSVALHRPVASDF

SEQ ID NO: 12608 - protein, 20 aa, synthetic construct
  source 1..20: note = Seed: SATGFKQSSKALQRPVASDF
SATGFKQLSVALIRPVASDF

SEQ ID NO: 12609 - protein, 20 aa, synthetic construct
  source 1..20: note = Seed: SATGFKQSSKALQRPVASDF
SATGFKQLSVALKRPVASDF

SEQ ID NO: 12610 - protein, 20 aa, synthetic construct
  source 1..20: note = Seed: SATGFKQSSKALQRPVASDF
SATGFKQLSVALLRPVASDF

SEQ ID NO: 12611 - protein, 20 aa, synthetic construct
  source 1..20: note = Seed: SATGFKQSSKALQRPVASDF
SATGFKQLSVALMRPVASDF

SEQ ID NO: 12612 - protein, 20 aa, synthetic construct
  source 1..20: note = Seed: SATGFKQSSKALQRPVASDF
SATGFKQLSVALNRPVASDF

SEQ ID NO: 12613 - protein, 20 aa, synthetic construct
  source 1..20: note = Seed: SATGFKQSSKALQRPVASDF
SATGFKQLSVALPRPVASDF

SEQ ID NO: 12614 - protein, 20 aa, synthetic construct
  source 1..20: note = Seed: SATGFKQSSKALQRPVASDF
SATGFKQLSVALQRPVASDF

SEQ ID NO: 12615 - protein, 20 aa, synthetic construct
  source 1..20: note = Seed: SATGFKQSSKALQRPVASDF
SATGFKQLSVALRRPVASDF

SEQ ID NO: 12616 - protein, 20 aa, synthetic construct
  source 1..20: note = Seed: SATGFKQSSKALQRPVASDF
SATGFKQLSVALSRPVASDF

SEQ ID NO: 12617 - protein, 20 aa, synthetic construct
  source 1..20: note = Seed: SATGFKQSSKALQRPVASDF
SATGFKQLSVALTRPVASDF

SEQ ID NO: 12618 - protein, 20 aa, synthetic construct
  source 1..20: note = Seed: SATGFKQSSKALQRPVASDF
SATGFKQLSVALVRPVASDF

SEQ ID NO: 12619 - protein, 20 aa, synthetic construct
  source 1..20: note = Seed: SATGFKQSSKALQRPVASDF
SATGFKQLSVALWRPVASDF

SEQ ID NO: 12620 - protein, 20 aa, synthetic construct
  source 1..20: note = Seed: SATGFKQSSKALQRPVASDF
SATGFKQLSVALYRPVASDF

SEQ ID NO: 12621 - protein, 20 aa, synthetic construct
  source 1..20: note = Seed: SATGFKQSSKALQRPVASDF
SATGFKQLSWALCRPVASDF

SEQ ID NO: 12622 - protein, 20 aa, synthetic construct
  source 1..20: note = Seed: SATGFKQSSKALQRPVASDF
SATGFKQLSWALVRPVASDF

SEQ ID NO: 12623 - protein, 20 aa, synthetic construct
  source 1..20: note = Seed: SATGFKQSSKALQRPVASDF
SATGFKQLSYALVRPVASDF

SEQ ID NO: 12624 - protein, 20 aa, synthetic construct
  source 1..20: note = Seed: SATGFKQSSKALQRPVASDF
SATGFKQMSAALARPVASDF

SEQ ID NO: 12625 - protein, 20 aa, synthetic construct
  source 1..20: note = Seed: SATGFKQSSKALQRPVASDF
SATGFKQMSAALCRPVASDF

SEQ ID NO: 12626 - protein, 20 aa, synthetic construct
  source 1..20: note = Seed: SATGFKQSSKALQRPVASDF
SATGFKQMSAALDRPVASDF

SEQ ID NO: 12627 - protein, 20 aa, synthetic construct
  source 1..20: note = Seed: SATGFKQSSKALQRPVASDF
SATGFKQMSAALERPVASDF

SEQ ID NO: 12628 - protein, 20 aa, synthetic construct
  source 1..20: note = Seed: SATGFKQSSKALQRPVASDF
SATGFKQMSAALFRPVASDF

SEQ ID NO: 12629 - protein, 20 aa, synthetic construct
  source 1..20: note = Seed: SATGFKQSSKALQRPVASDF
SATGFKQMSAALGRPVASDF

SEQ ID NO: 12630 - protein, 20 aa, synthetic construct
  source 1..20: note = Seed: SATGFKQSSKALQRPVASDF
SATGFKQMSAALHRPVASDF

SEQ ID NO: 12631 - protein, 20 aa, synthetic construct
  source 1..20: note = Seed: SATGFKQSSKALQRPVASDF
SATGFKQMSAALIRPVASDF

SEQ ID NO: 12632 - protein, 20 aa, synthetic construct
  source 1..20: note = Seed: SATGFKQSSKALQRPVASDF
SATGFKQMSAALKRPVASDF

SEQ ID NO: 12633 - protein, 20 aa, synthetic construct
  source 1..20: note = Seed: SATGFKQSSKALQRPVASDF
SATGFKQMSAALLRPVASDF

SEQ ID NO: 12634 - protein, 20 aa, synthetic construct
  source 1..20: note = Seed: SATGFKQSSKALQRPVASDF
SATGFKQMSAALMRPVASDF

SEQ ID NO: 12635 - protein, 20 aa, synthetic construct
  source 1..20: note = Seed: SATGFKQSSKALQRPVASDF
SATGFKQMSAALNRPVASDF

SEQ ID NO: 12636 - protein, 20 aa, synthetic construct
  source 1..20: note = Seed: SATGFKQSSKALQRPVASDF
SATGFKQMSAALPRPVASDF

SEQ ID NO: 12637 - protein, 20 aa, synthetic construct
  source 1..20: note = Seed: SATGFKQSSKALQRPVASDF
SATGFKQMSAALQRPVASDF

SEQ ID NO: 12638 - protein, 20 aa, synthetic construct
  source 1..20: note = Seed: SATGFKQSSKALQRPVASDF
SATGFKQMSAALRRPVASDF

SEQ ID NO: 12639 - protein, 20 aa, synthetic construct
  source 1..20: note = Seed: SATGFKQSSKALQRPVASDF
SATGFKQMSAALSRPVASDF

SEQ ID NO: 12640 - protein, 20 aa, synthetic construct
  source 1..20: note = Seed: SATGFKQSSKALQRPVASDF
SATGFKQMSAALTRPVASDF

SEQ ID NO: 12641 - protein, 20 aa, synthetic construct
  source 1..20: note = Seed: SATGFKQSSKALQRPVASDF
SATGFKQMSAALVRPVASDF

SEQ ID NO: 12642 - protein, 20 aa, synthetic construct
  source 1..20: note = Seed: SATGFKQSSKALQRPVASDF
SATGFKQMSAALWRPVASDF

SEQ ID NO: 12643 - protein, 20 aa, synthetic construct
  source 1..20: note = Seed: SATGFKQSSKALQRPVASDF
SATGFKQMSAALYRPVASDF

SEQ ID NO: 12644 - protein, 20 aa, synthetic construct
  source 1..20: note = Seed: SATGFKQSSKALQRPVASDF
SATGFKQMSCALARPVASDF

SEQ ID NO: 12645 - protein, 20 aa, synthetic construct
  source 1..20: note = Seed: SATGFKQSSKALQRPVASDF
SATGFKQMSCALDRPVASDF

SEQ ID NO: 12646 - protein, 20 aa, synthetic construct
  source 1..20: note = Seed: SATGFKQSSKALQRPVASDF
SATGFKQMSCALGRPVASDF

SEQ ID NO: 12647 - protein, 20 aa, synthetic construct
  source 1..20: note = Seed: SATGFKQSSKALQRPVASDF
SATGFKQMSCALHRPVASDF

SEQ ID NO: 12648 - protein, 20 aa, synthetic construct
  source 1..20: note = Seed: SATGFKQSSKALQRPVASDF
SATGFKQMSCALIRPVASDF

SEQ ID NO: 12649 - protein, 20 aa, synthetic construct
  source 1..20: note = Seed: SATGFKQSSKALQRPVASDF
SATGFKQMSCALLRPVASDF

SEQ ID NO: 12650 - protein, 20 aa, synthetic construct
  source 1..20: note = Seed: SATGFKQSSKALQRPVASDF
SATGFKQMSCALMRPVASDF

SEQ ID NO: 12651 - protein, 20 aa, synthetic construct
  source 1..20: note = Seed: SATGFKQSSKALQRPVASDF
SATGFKQMSCALNRPVASDF

SEQ ID NO: 12652 - protein, 20 aa, synthetic construct
  source 1..20: note = Seed: SATGFKQSSKALQRPVASDF
SATGFKQMSCALPRPVASDF

SEQ ID NO: 12653 - protein, 20 aa, synthetic construct
  source 1..20: note = Seed: SATGFKQSSKALQRPVASDF
SATGFKQMSCALSRPVASDF

SEQ ID NO: 12654 - protein, 20 aa, synthetic construct
  source 1..20: note = Seed: SATGFKQSSKALQRPVASDF
SATGFKQMSCALTRPVASDF

SEQ ID NO: 12655 - protein, 20 aa, synthetic construct
  source 1..20: note = Seed: SATGFKQSSKALQRPVASDF
SATGFKQMSCALVRPVASDF

SEQ ID NO: 12656 - protein, 20 aa, synthetic construct
  source 1..20: note = Seed: SATGFKQSSKALQRPVASDF
SATGFKQMSDALARPVASDF

SEQ ID NO: 12657 - protein, 20 aa, synthetic construct
  source 1..20: note = Seed: SATGFKQSSKALQRPVASDF
SATGFKQMSDALGRPVASDF

SEQ ID NO: 12658 - protein, 20 aa, synthetic construct
  source 1..20: note = Seed: SATGFKQSSKALQRPVASDF
SATGFKQMSDALIRPVASDF

SEQ ID NO: 12659 - protein, 20 aa, synthetic construct
  source 1..20: note = Seed: SATGFKQSSKALQRPVASDF
SATGFKQMSDALLRPVASDF

SEQ ID NO: 12660 - protein, 20 aa, synthetic construct
  source 1..20: note = Seed: SATGFKQSSKALQRPVASDF
SATGFKQMSDALMRPVASDF

SEQ ID NO: 12661 - protein, 20 aa, synthetic construct
  source 1..20: note = Seed: SATGFKQSSKALQRPVASDF
SATGFKQMSDALNRPVASDF

SEQ ID NO: 12662 - protein, 20 aa, synthetic construct
  source 1..20: note = Seed: SATGFKQSSKALQRPVASDF
SATGFKQMSDALSRPVASDF

SEQ ID NO: 12663 - protein, 20 aa, synthetic construct
  source 1..20: note = Seed: SATGFKQSSKALQRPVASDF
SATGFKQMSDALTRPVASDF

SEQ ID NO: 12664 - protein, 20 aa, synthetic construct
  source 1..20: note = Seed: SATGFKQSSKALQRPVASDF
SATGFKQMSDALVRPVASDF

SEQ ID NO: 12665 - protein, 20 aa, synthetic construct
  source 1..20: note = Seed: SATGFKQSSKALQRPVASDF
SATGFKQMSEALARPVASDF

SEQ ID NO: 12666 - protein, 20 aa, synthetic construct
  source 1..20: note = Seed: SATGFKQSSKALQRPVASDF
SATGFKQMSEALGRPVASDF

SEQ ID NO: 12667 - protein, 20 aa, synthetic construct
  source 1..20: note = Seed: SATGFKQSSKALQRPVASDF
SATGFKQMSEALHRPVASDF

SEQ ID NO: 12668 - protein, 20 aa, synthetic construct
  source 1..20: note = Seed: SATGFKQSSKALQRPVASDF
SATGFKQMSEALIRPVASDF

SEQ ID NO: 12669 - protein, 20 aa, synthetic construct
  source 1..20: note = Seed: SATGFKQSSKALQRPVASDF
SATGFKQMSEALLRPVASDF

SEQ ID NO: 12670 - protein, 20 aa, synthetic construct
  source 1..20: note = Seed: SATGFKQSSKALQRPVASDF
SATGFKQMSEALMRPVASDF

SEQ ID NO: 12671 - protein, 20 aa, synthetic construct
  source 1..20: note = Seed: SATGFKQSSKALQRPVASDF
SATGFKQMSEALNRPVASDF

SEQ ID NO: 12672 - protein, 20 aa, synthetic construct
  source 1..20: note = Seed: SATGFKQSSKALQRPVASDF
SATGFKQMSEALSRPVASDF

SEQ ID NO: 12673 - protein, 20 aa, synthetic construct
  source 1..20: note = Seed: SATGFKQSSKALQRPVASDF
SATGFKQMSEALTRPVASDF

SEQ ID NO: 12674 - protein, 20 aa, synthetic construct
  source 1..20: note = Seed: SATGFKQSSKALQRPVASDF
SATGFKQMSEALVRPVASDF

SEQ ID NO: 12675 - protein, 20 aa, synthetic construct
  source 1..20: note = Seed: SATGFKQSSKALQRPVASDF
SATGFKQMSFALARPVASDF

SEQ ID NO: 12676 - protein, 20 aa, synthetic construct
  source 1..20: note = Seed: SATGFKQSSKALQRPVASDF
SATGFKQMSFALDRPVASDF

SEQ ID NO: 12677 - protein, 20 aa, synthetic construct
  source 1..20: note = Seed: SATGFKQSSKALQRPVASDF
SATGFKQMSFALERPVASDF

SEQ ID NO: 12678 - protein, 20 aa, synthetic construct
  source 1..20: note = Seed: SATGFKQSSKALQRPVASDF
SATGFKQMSFALIRPVASDF

SEQ ID NO: 12679 - protein, 20 aa, synthetic construct
  source 1..20: note = Seed: SATGFKQSSKALQRPVASDF
SATGFKQMSFALLRPVASDF

SEQ ID NO: 12680 - protein, 20 aa, synthetic construct
  source 1..20: note = Seed: SATGFKQSSKALQRPVASDF
SATGFKQMSFALMRPVASDF

SEQ ID NO: 12681 - protein, 20 aa, synthetic construct
  source 1..20: note = Seed: SATGFKQSSKALQRPVASDF
SATGFKQMSFALNRPVASDF

SEQ ID NO: 12682 - protein, 20 aa, synthetic construct
  source 1..20: note = Seed: SATGFKQSSKALQRPVASDF
SATGFKQMSFALRRPVASDF

SEQ ID NO: 12683 - protein, 20 aa, synthetic construct
  source 1..20: note = Seed: SATGFKQSSKALQRPVASDF
SATGFKQMSFALSRPVASDF

SEQ ID NO: 12684 - protein, 20 aa, synthetic construct
  source 1..20: note = Seed: SATGFKQSSKALQRPVASDF
SATGFKQMSFALTRPVASDF

SEQ ID NO: 12685 - protein, 20 aa, synthetic construct
  source 1..20: note = Seed: SATGFKQSSKALQRPVASDF
SATGFKQMSFALVRPVASDF

SEQ ID NO: 12686 - protein, 20 aa, synthetic construct
  source 1..20: note = Seed: SATGFKQSSKALQRPVASDF
SATGFKQMSGALARPVASDF

SEQ ID NO: 12687 - protein, 20 aa, synthetic construct
  source 1..20: note = Seed: SATGFKQSSKALQRPVASDF
SATGFKQMSGALCRPVASDF

SEQ ID NO: 12688 - protein, 20 aa, synthetic construct
  source 1..20: note = Seed: SATGFKQSSKALQRPVASDF
SATGFKQMSGALDRPVASDF

SEQ ID NO: 12689 - protein, 20 aa, synthetic construct
  source 1..20: note = Seed: SATGFKQSSKALQRPVASDF
SATGFKQMSGALERPVASDF

SEQ ID NO: 12690 - protein, 20 aa, synthetic construct
  source 1..20: note = Seed: SATGFKQSSKALQRPVASDF
SATGFKQMSGALFRPVASDF

SEQ ID NO: 12691 - protein, 20 aa, synthetic construct
  source 1..20: note = Seed: SATGFKQSSKALQRPVASDF
SATGFKQMSGALGRPVASDF

SEQ ID NO: 12692 - protein, 20 aa, synthetic construct
  source 1..20: note = Seed: SATGFKQSSKALQRPVASDF
SATGFKQMSGALHRPVASDF

SEQ ID NO: 12693 - protein, 20 aa, synthetic construct
  source 1..20: note = Seed: SATGFKQSSKALQRPVASDF
SATGFKQMSGALIRPVASDF

SEQ ID NO: 12694 - protein, 20 aa, synthetic construct
  source 1..20: note = Seed: SATGFKQSSKALQRPVASDF
SATGFKQMSGALKRPVASDF

SEQ ID NO: 12695 - protein, 20 aa, synthetic construct
  source 1..20: note = Seed: SATGFKQSSKALQRPVASDF
SATGFKQMSGALLRPVASDF

SEQ ID NO: 12696 - protein, 20 aa, synthetic construct
  source 1..20: note = Seed: SATGFKQSSKALQRPVASDF
SATGFKQMSGALMRPVASDF

SEQ ID NO: 12697 - protein, 20 aa, synthetic construct
  source 1..20: note = Seed: SATGFKQSSKALQRPVASDF
SATGFKQMSGALNRPVASDF

SEQ ID NO: 12698 - protein, 20 aa, synthetic construct
  source 1..20: note = Seed: SATGFKQSSKALQRPVASDF
SATGFKQMSGALPRPVASDF

SEQ ID NO: 12699 - protein, 20 aa, synthetic construct
  source 1..20: note = Seed: SATGFKQSSKALQRPVASDF
SATGFKQMSGALQRPVASDF

SEQ ID NO: 12700 - protein, 20 aa, synthetic construct
  source 1..20: note = Seed: SATGFKQSSKALQRPVASDF
SATGFKQMSGALRRPVASDF

SEQ ID NO: 12701 - protein, 20 aa, synthetic construct
  source 1..20: note = Seed: SATGFKQSSKALQRPVASDF
SATGFKQMSGALSRPVASDF

SEQ ID NO: 12702 - protein, 20 aa, synthetic construct
  source 1..20: note = Seed: SATGFKQSSKALQRPVASDF
SATGFKQMSGALTRPVASDF

SEQ ID NO: 12703 - protein, 20 aa, synthetic construct
  source 1..20: note = Seed: SATGFKQSSKALQRPVASDF
SATGFKQMSGALVRPVASDF

SEQ ID NO: 12704 - protein, 20 aa, synthetic construct
  source 1..20: note = Seed: SATGFKQSSKALQRPVASDF
SATGFKQMSGALWRPVASDF

SEQ ID NO: 12705 - protein, 20 aa, synthetic construct
  source 1..20: note = Seed: SATGFKQSSKALQRPVASDF
SATGFKQMSGALYRPVASDF

SEQ ID NO: 12706 - protein, 20 aa, synthetic construct
  source 1..20: note = Seed: SATGFKQSSKALQRPVASDF
SATGFKQMSHALARPVASDF

SEQ ID NO: 12707 - protein, 20 aa, synthetic construct
  source 1..20: note = Seed: SATGFKQSSKALQRPVASDF
SATGFKQMSHALCRPVASDF

SEQ ID NO: 12708 - protein, 20 aa, synthetic construct
  source 1..20: note = Seed: SATGFKQSSKALQRPVASDF
SATGFKQMSHALDRPVASDF

SEQ ID NO: 12709 - protein, 20 aa, synthetic construct
  source 1..20: note = Seed: SATGFKQSSKALQRPVASDF
SATGFKQMSHALFRPVASDF

SEQ ID NO: 12710 - protein, 20 aa, synthetic construct
  source 1..20: note = Seed: SATGFKQSSKALQRPVASDF
SATGFKQMSHALGRPVASDF

SEQ ID NO: 12711 - protein, 20 aa, synthetic construct
  source 1..20: note = Seed: SATGFKQSSKALQRPVASDF
SATGFKQMSHALHRPVASDF

SEQ ID NO: 12712 - protein, 20 aa, synthetic construct
  source 1..20: note = Seed: SATGFKQSSKALQRPVASDF
SATGFKQMSHALIRPVASDF

SEQ ID NO: 12713 - protein, 20 aa, synthetic construct
  source 1..20: note = Seed: SATGFKQSSKALQRPVASDF
SATGFKQMSHALKRPVASDF

SEQ ID NO: 12714 - protein, 20 aa, synthetic construct
  source 1..20: note = Seed: SATGFKQSSKALQRPVASDF
SATGFKQMSHALLRPVASDF

SEQ ID NO: 12715 - protein, 20 aa, synthetic construct
  source 1..20: note = Seed: SATGFKQSSKALQRPVASDF
SATGFKQMSHALMRPVASDF

SEQ ID NO: 12716 - protein, 20 aa, synthetic construct
  source 1..20: note = Seed: SATGFKQSSKALQRPVASDF
SATGFKQMSHALNRPVASDF

SEQ ID NO: 12717 - protein, 20 aa, synthetic construct
  source 1..20: note = Seed: SATGFKQSSKALQRPVASDF
SATGFKQMSHALPRPVASDF

SEQ ID NO: 12718 - protein, 20 aa, synthetic construct
  source 1..20: note = Seed: SATGFKQSSKALQRPVASDF
SATGFKQMSHALQRPVASDF

SEQ ID NO: 12719 - protein, 20 aa, synthetic construct
  source 1..20: note = Seed: SATGFKQSSKALQRPVASDF
SATGFKQMSHALRRPVASDF

SEQ ID NO: 12720 - protein, 20 aa, synthetic construct
  source 1..20: note = Seed: SATGFKQSSKALQRPVASDF
SATGFKQMSHALSRPVASDF

SEQ ID NO: 12721 - protein, 20 aa, synthetic construct
  source 1..20: note = Seed: SATGFKQSSKALQRPVASDF
SATGFKQMSHALTRPVASDF

SEQ ID NO: 12722 - protein, 20 aa, synthetic construct
  source 1..20: note = Seed: SATGFKQSSKALQRPVASDF
SATGFKQMSHALVRPVASDF

SEQ ID NO: 12723 - protein, 20 aa, synthetic construct
  source 1..20: note = Seed: SATGFKQSSKALQRPVASDF
SATGFKQMSHALYRPVASDF

SEQ ID NO: 12724 - protein, 20 aa, synthetic construct
  source 1..20: note = Seed: SATGFKQSSKALQRPVASDF
SATGFKQMSIALARPVASDF

SEQ ID NO: 12725 - protein, 20 aa, synthetic construct
  source 1..20: note = Seed: SATGFKQSSKALQRPVASDF
SATGFKQMSIALCRPVASDF

SEQ ID NO: 12726 - protein, 20 aa, synthetic construct
  source 1..20: note = Seed: SATGFKQSSKALQRPVASDF
SATGFKQMSIALDRPVASDF

SEQ ID NO: 12727 - protein, 20 aa, synthetic construct
  source 1..20: note = Seed: SATGFKQSSKALQRPVASDF
SATGFKQMSIALERPVASDF

SEQ ID NO: 12728 - protein, 20 aa, synthetic construct
  source 1..20: note = Seed: SATGFKQSSKALQRPVASDF
SATGFKQMSIALFRPVASDF

SEQ ID NO: 12729 - protein, 20 aa, synthetic construct
  source 1..20: note = Seed: SATGFKQSSKALQRPVASDF
SATGFKQMSIALGRPVASDF

SEQ ID NO: 12730 - protein, 20 aa, synthetic construct
  source 1..20: note = Seed: SATGFKQSSKALQRPVASDF
SATGFKQMSIALHRPVASDF

SEQ ID NO: 12731 - protein, 20 aa, synthetic construct
  source 1..20: note = Seed: SATGFKQSSKALQRPVASDF
SATGFKQMSIALIRPVASDF

SEQ ID NO: 12732 - protein, 20 aa, synthetic construct
  source 1..20: note = Seed: SATGFKQSSKALQRPVASDF
SATGFKQMSIALKRPVASDF

SEQ ID NO: 12733 - protein, 20 aa, synthetic construct
  source 1..20: note = Seed: SATGFKQSSKALQRPVASDF
SATGFKQMSIALLRPVASDF

SEQ ID NO: 12734 - protein, 20 aa, synthetic construct
  source 1..20: note = Seed: SATGFKQSSKALQRPVASDF
SATGFKQMSIALMRPVASDF

SEQ ID NO: 12735 - protein, 20 aa, synthetic construct
  source 1..20: note = Seed: SATGFKQSSKALQRPVASDF
SATGFKQMSIALNRPVASDF

SEQ ID NO: 12736 - protein, 20 aa, synthetic construct
  source 1..20: note = Seed: SATGFKQSSKALQRPVASDF
SATGFKQMSIALPRPVASDF

SEQ ID NO: 12737 - protein, 20 aa, synthetic construct
  source 1..20: note = Seed: SATGFKQSSKALQRPVASDF
SATGFKQMSIALQRPVASDF

SEQ ID NO: 12738 - protein, 20 aa, synthetic construct
  source 1..20: note = Seed: SATGFKQSSKALQRPVASDF
SATGFKQMSIALRRPVASDF

SEQ ID NO: 12739 - protein, 20 aa, synthetic construct
  source 1..20: note = Seed: SATGFKQSSKALQRPVASDF
SATGFKQMSIALSRPVASDF

SEQ ID NO: 12740 - protein, 20 aa, synthetic construct
  source 1..20: note = Seed: SATGFKQSSKALQRPVASDF
SATGFKQMSIALTRPVASDF

SEQ ID NO: 12741 - protein, 20 aa, synthetic construct
  source 1..20: note = Seed: SATGFKQSSKALQRPVASDF
SATGFKQMSIALVRPVASDF

SEQ ID NO: 12742 - protein, 20 aa, synthetic construct
  source 1..20: note = Seed: SATGFKQSSKALQRPVASDF
SATGFKQMSIALYRPVASDF

SEQ ID NO: 12743 - protein, 20 aa, synthetic construct
  source 1..20: note = Seed: SATGFKQSSKALQRPVASDF
SATGFKQMSKALARPVASDF

SEQ ID NO: 12744 - protein, 20 aa, synthetic construct
  source 1..20: note = Seed: SATGFKQSSKALQRPVASDF
SATGFKQMSKALCRPVASDF

SEQ ID NO: 12745 - protein, 20 aa, synthetic construct
  source 1..20: note = Seed: SATGFKQSSKALQRPVASDF
SATGFKQMSKALDRPVASDF

SEQ ID NO: 12746 - protein, 20 aa, synthetic construct
  source 1..20: note = Seed: SATGFKQSSKALQRPVASDF
SATGFKQMSKALERPVASDF

SEQ ID NO: 12747 - protein, 20 aa, synthetic construct
  source 1..20: note = Seed: SATGFKQSSKALQRPVASDF
SATGFKQMSKALFRPVASDF

SEQ ID NO: 12748 - protein, 20 aa, synthetic construct
  source 1..20: note = Seed: SATGFKQSSKALQRPVASDF
SATGFKQMSKALGRPVASDF

SEQ ID NO: 12749 - protein, 20 aa, synthetic construct
  source 1..20: note = Seed: SATGFKQSSKALQRPVASDF
SATGFKQMSKALHRPVASDF

SEQ ID NO: 12750 - protein, 20 aa, synthetic construct
  source 1..20: note = Seed: SATGFKQSSKALQRPVASDF
SATGFKQMSKALIRPVASDF

SEQ ID NO: 12751 - protein, 20 aa, synthetic construct
  source 1..20: note = Seed: SATGFKQSSKALQRPVASDF
SATGFKQMSKALKRPVASDF

SEQ ID NO: 12752 - protein, 20 aa, synthetic construct
  source 1..20: note = Seed: SATGFKQSSKALQRPVASDF
SATGFKQMSKALLRPVASDF

SEQ ID NO: 12753 - protein, 20 aa, synthetic construct
  source 1..20: note = Seed: SATGFKQSSKALQRPVASDF
SATGFKQMSKALMRPVASDF

SEQ ID NO: 12754 - protein, 20 aa, synthetic construct
  source 1..20: note = Seed: SATGFKQSSKALQRPVASDF
SATGFKQMSKALNRPVASDF

SEQ ID NO: 12755 - protein, 20 aa, synthetic construct
  source 1..20: note = Seed: SATGFKQSSKALQRPVASDF
SATGFKQMSKALPRPVASDF

SEQ ID NO: 12756 - protein, 20 aa, synthetic construct
  source 1..20: note = Seed: SATGFKQSSKALQRPVASDF
SATGFKQMSKALQRPVASDF

SEQ ID NO: 12757 - protein, 20 aa, synthetic construct
  source 1..20: note = Seed: SATGFKQSSKALQRPVASDF
SATGFKQMSKALRRPVASDF

SEQ ID NO: 12758 - protein, 20 aa, synthetic construct
  source 1..20: note = Seed: SATGFKQSSKALQRPVASDF
SATGFKQMSKALSRPVASDF

SEQ ID NO: 12759 - protein, 20 aa, synthetic construct
  source 1..20: note = Seed: SATGFKQSSKALQRPVASDF
SATGFKQMSKALTRPVASDF

SEQ ID NO: 12760 - protein, 20 aa, synthetic construct
  source 1..20: note = Seed: SATGFKQSSKALQRPVASDF
SATGFKQMSKALVRPVASDF

SEQ ID NO: 12761 - protein, 20 aa, synthetic construct
  source 1..20: note = Seed: SATGFKQSSKALQRPVASDF
SATGFKQMSKALWRPVASDF

SEQ ID NO: 12762 - protein, 20 aa, synthetic construct
  source 1..20: note = Seed: SATGFKQSSKALQRPVASDF
SATGFKQMSKALYRPVASDF

SEQ ID NO: 12763 - protein, 20 aa, synthetic construct
  source 1..20: note = Seed: SATGFKQSSKALQRPVASDF
SATGFKQMSLALARPVASDF

SEQ ID NO: 12764 - protein, 20 aa, synthetic construct
  source 1..20: note = Seed: SATGFKQSSKALQRPVASDF
SATGFKQMSLALCRPVASDF

SEQ ID NO: 12765 - protein, 20 aa, synthetic construct
  source 1..20: note = Seed: SATGFKQSSKALQRPVASDF
SATGFKQMSLALDRPVASDF

SEQ ID NO: 12766 - protein, 20 aa, synthetic construct
  source 1..20: note = Seed: SATGFKQSSKALQRPVASDF
SATGFKQMSLALERPVASDF

SEQ ID NO: 12767 - protein, 20 aa, synthetic construct
  source 1..20: note = Seed: SATGFKQSSKALQRPVASDF
SATGFKQMSLALFRPVASDF

SEQ ID NO: 12768 - protein, 20 aa, synthetic construct
  source 1..20: note = Seed: SATGFKQSSKALQRPVASDF
SATGFKQMSLALGRPVASDF

SEQ ID NO: 12769 - protein, 20 aa, synthetic construct
  source 1..20: note = Seed: SATGFKQSSKALQRPVASDF
SATGFKQMSLALHRPVASDF

SEQ ID NO: 12770 - protein, 20 aa, synthetic construct
  source 1..20: note = Seed: SATGFKQSSKALQRPVASDF
SATGFKQMSLALIRPVASDF

SEQ ID NO: 12771 - protein, 20 aa, synthetic construct
  source 1..20: note = Seed: SATGFKQSSKALQRPVASDF
SATGFKQMSLALKRPVASDF

SEQ ID NO: 12772 - protein, 20 aa, synthetic construct
  source 1..20: note = Seed: SATGFKQSSKALQRPVASDF
SATGFKQMSLALLRPVASDF

SEQ ID NO: 12773 - protein, 20 aa, synthetic construct
  source 1..20: note = Seed: SATGFKQSSKALQRPVASDF
SATGFKQMSLALMRPVASDF

SEQ ID NO: 12774 - protein, 20 aa, synthetic construct
  source 1..20: note = Seed: SATGFKQSSKALQRPVASDF
SATGFKQMSLALNRPVASDF

SEQ ID NO: 12775 - protein, 20 aa, synthetic construct
  source 1..20: note = Seed: SATGFKQSSKALQRPVASDF
SATGFKQMSLALPRPVASDF

SEQ ID NO: 12776 - protein, 20 aa, synthetic construct
  source 1..20: note = Seed: SATGFKQSSKALQRPVASDF
SATGFKQMSLALQRPVASDF

SEQ ID NO: 12777 - protein, 20 aa, synthetic construct
  source 1..20: note = Seed: SATGFKQSSKALQRPVASDF
SATGFKQMSLALRRPVASDF

SEQ ID NO: 12778 - protein, 20 aa, synthetic construct
  source 1..20: note = Seed: SATGFKQSSKALQRPVASDF
SATGFKQMSLALSRPVASDF

SEQ ID NO: 12779 - protein, 20 aa, synthetic construct
  source 1..20: note = Seed: SATGFKQSSKALQRPVASDF
SATGFKQMSLALTRPVASDF

SEQ ID NO: 12780 - protein, 20 aa, synthetic construct
  source 1..20: note = Seed: SATGFKQSSKALQRPVASDF
SATGFKQMSLALVRPVASDF

SEQ ID NO: 12781 - protein, 20 aa, synthetic construct
  source 1..20: note = Seed: SATGFKQSSKALQRPVASDF
SATGFKQMSLALYRPVASDF

SEQ ID NO: 12782 - protein, 20 aa, synthetic construct
  source 1..20: note = Seed: SATGFKQSSKALQRPVASDF
SATGFKQMSMALARPVASDF

SEQ ID NO: 12783 - protein, 20 aa, synthetic construct
  source 1..20: note = Seed: SATGFKQSSKALQRPVASDF
SATGFKQMSMALCRPVASDF

SEQ ID NO: 12784 - protein, 20 aa, synthetic construct
  source 1..20: note = Seed: SATGFKQSSKALQRPVASDF
SATGFKQMSMALDRPVASDF

SEQ ID NO: 12785 - protein, 20 aa, synthetic construct
  source 1..20: note = Seed: SATGFKQSSKALQRPVASDF
SATGFKQMSMALERPVASDF

SEQ ID NO: 12786 - protein, 20 aa, synthetic construct
  source 1..20: note = Seed: SATGFKQSSKALQRPVASDF
SATGFKQMSMALFRPVASDF

SEQ ID NO: 12787 - protein, 20 aa, synthetic construct
  source 1..20: note = Seed: SATGFKQSSKALQRPVASDF
SATGFKQMSMALGRPVASDF

SEQ ID NO: 12788 - protein, 20 aa, synthetic construct
  source 1..20: note = Seed: SATGFKQSSKALQRPVASDF
SATGFKQMSMALHRPVASDF

SEQ ID NO: 12789 - protein, 20 aa, synthetic construct
  source 1..20: note = Seed: SATGFKQSSKALQRPVASDF
SATGFKQMSMALIRPVASDF

SEQ ID NO: 12790 - protein, 20 aa, synthetic construct
  source 1..20: note = Seed: SATGFKQSSKALQRPVASDF
SATGFKQMSMALKRPVASDF

SEQ ID NO: 12791 - protein, 20 aa, synthetic construct
  source 1..20: note = Seed: SATGFKQSSKALQRPVASDF
SATGFKQMSMALLRPVASDF

SEQ ID NO: 12792 - protein, 20 aa, synthetic construct
  source 1..20: note = Seed: SATGFKQSSKALQRPVASDF
SATGFKQMSMALMRPVASDF

SEQ ID NO: 12793 - protein, 20 aa, synthetic construct
  source 1..20: note = Seed: SATGFKQSSKALQRPVASDF
SATGFKQMSMALNRPVASDF

SEQ ID NO: 12794 - protein, 20 aa, synthetic construct
  source 1..20: note = Seed: SATGFKQSSKALQRPVASDF
SATGFKQMSMALQRPVASDF

SEQ ID NO: 12795 - protein, 20 aa, synthetic construct
  source 1..20: note = Seed: SATGFKQSSKALQRPVASDF
SATGFKQMSMALRRPVASDF

SEQ ID NO: 12796 - protein, 20 aa, synthetic construct
  source 1..20: note = Seed: SATGFKQSSKALQRPVASDF
SATGFKQMSMALSRPVASDF

SEQ ID NO: 12797 - protein, 20 aa, synthetic construct
  source 1..20: note = Seed: SATGFKQSSKALQRPVASDF
SATGFKQMSMALTRPVASDF

SEQ ID NO: 12798 - protein, 20 aa, synthetic construct
  source 1..20: note = Seed: SATGFKQSSKALQRPVASDF
SATGFKQMSMALVRPVASDF

SEQ ID NO: 12799 - protein, 20 aa, synthetic construct
  source 1..20: note = Seed: SATGFKQSSKALQRPVASDF
SATGFKQMSMALYRPVASDF

SEQ ID NO: 12800 - protein, 20 aa, synthetic construct
  source 1..20: note = Seed: SATGFKQSSKALQRPVASDF
SATGFKQMSNALARPVASDF

SEQ ID NO: 12801 - protein, 20 aa, synthetic construct
  source 1..20: note = Seed: SATGFKQSSKALQRPVASDF
SATGFKQMSNALCRPVASDF

SEQ ID NO: 12802 - protein, 20 aa, synthetic construct
  source 1..20: note = Seed: SATGFKQSSKALQRPVASDF
SATGFKQMSNALDRPVASDF

SEQ ID NO: 12803 - protein, 20 aa, synthetic construct
  source 1..20: note = Seed: SATGFKQSSKALQRPVASDF
SATGFKQMSNALERPVASDF

SEQ ID NO: 12804 - protein, 20 aa, synthetic construct
  source 1..20: note = Seed: SATGFKQSSKALQRPVASDF
SATGFKQMSNALFRPVASDF

SEQ ID NO: 12805 - protein, 20 aa, synthetic construct
  source 1..20: note = Seed: SATGFKQSSKALQRPVASDF
SATGFKQMSNALGRPVASDF

SEQ ID NO: 12806 - protein, 20 aa, synthetic construct
  source 1..20: note = Seed: SATGFKQSSKALQRPVASDF
SATGFKQMSNALHRPVASDF

SEQ ID NO: 12807 - protein, 20 aa, synthetic construct
  source 1..20: note = Seed: SATGFKQSSKALQRPVASDF
SATGFKQMSNALIRPVASDF

SEQ ID NO: 12808 - protein, 20 aa, synthetic construct
  source 1..20: note = Seed: SATGFKQSSKALQRPVASDF
SATGFKQMSNALKRPVASDF

SEQ ID NO: 12809 - protein, 20 aa, synthetic construct
  source 1..20: note = Seed: SATGFKQSSKALQRPVASDF
SATGFKQMSNALLRPVASDF

SEQ ID NO: 12810 - protein, 20 aa, synthetic construct
  source 1..20: note = Seed: SATGFKQSSKALQRPVASDF
SATGFKQMSNALMRPVASDF

SEQ ID NO: 12811 - protein, 20 aa, synthetic construct
  source 1..20: note = Seed: SATGFKQSSKALQRPVASDF
SATGFKQMSNALNRPVASDF

SEQ ID NO: 12812 - protein, 20 aa, synthetic construct
  source 1..20: note = Seed: SATGFKQSSKALQRPVASDF
SATGFKQMSNALPRPVASDF

SEQ ID NO: 12813 - protein, 20 aa, synthetic construct
  source 1..20: note = Seed: SATGFKQSSKALQRPVASDF
SATGFKQMSNALQRPVASDF

SEQ ID NO: 12814 - protein, 20 aa, synthetic construct
  source 1..20: note = Seed: SATGFKQSSKALQRPVASDF
SATGFKQMSNALRRPVASDF

SEQ ID NO: 12815 - protein, 20 aa, synthetic construct
  source 1..20: note = Seed: SATGFKQSSKALQRPVASDF
SATGFKQMSNALSRPVASDF

SEQ ID NO: 12816 - protein, 20 aa, synthetic construct
  source 1..20: note = Seed: SATGFKQSSKALQRPVASDF
SATGFKQMSNALTRPVASDF

SEQ ID NO: 12817 - protein, 20 aa, synthetic construct
  source 1..20: note = Seed: SATGFKQSSKALQRPVASDF
SATGFKQMSNALVRPVASDF

SEQ ID NO: 12818 - protein, 20 aa, synthetic construct
  source 1..20: note = Seed: SATGFKQSSKALQRPVASDF
SATGFKQMSNALWRPVASDF

SEQ ID NO: 12819 - protein, 20 aa, synthetic construct
  source 1..20: note = Seed: SATGFKQSSKALQRPVASDF
SATGFKQMSNALYRPVASDF

SEQ ID NO: 12820 - protein, 20 aa, synthetic construct
  source 1..20: note = Seed: SATGFKQSSKALQRPVASDF
SATGFKQMSPALARPVASDF

SEQ ID NO: 12821 - protein, 20 aa, synthetic construct
  source 1..20: note = Seed: SATGFKQSSKALQRPVASDF
SATGFKQMSPALCRPVASDF

SEQ ID NO: 12822 - protein, 20 aa, synthetic construct
  source 1..20: note = Seed: SATGFKQSSKALQRPVASDF
SATGFKQMSPALDRPVASDF

SEQ ID NO: 12823 - protein, 20 aa, synthetic construct
  source 1..20: note = Seed: SATGFKQSSKALQRPVASDF
SATGFKQMSPALERPVASDF

SEQ ID NO: 12824 - protein, 20 aa, synthetic construct
  source 1..20: note = Seed: SATGFKQSSKALQRPVASDF
SATGFKQMSPALFRPVASDF

SEQ ID NO: 12825 - protein, 20 aa, synthetic construct
  source 1..20: note = Seed: SATGFKQSSKALQRPVASDF
SATGFKQMSPALGRPVASDF

SEQ ID NO: 12826 - protein, 20 aa, synthetic construct
  source 1..20: note = Seed: SATGFKQSSKALQRPVASDF
SATGFKQMSPALHRPVASDF

SEQ ID NO: 12827 - protein, 20 aa, synthetic construct
  source 1..20: note = Seed: SATGFKQSSKALQRPVASDF
SATGFKQMSPALIRPVASDF

SEQ ID NO: 12828 - protein, 20 aa, synthetic construct
  source 1..20: note = Seed: SATGFKQSSKALQRPVASDF
SATGFKQMSPALKRPVASDF

SEQ ID NO: 12829 - protein, 20 aa, synthetic construct
  source 1..20: note = Seed: SATGFKQSSKALQRPVASDF
SATGFKQMSPALLRPVASDF

SEQ ID NO: 12830 - protein, 20 aa, synthetic construct
  source 1..20: note = Seed: SATGFKQSSKALQRPVASDF
SATGFKQMSPALMRPVASDF

SEQ ID NO: 12831 - protein, 20 aa, synthetic construct
  source 1..20: note = Seed: SATGFKQSSKALQRPVASDF
SATGFKQMSPALNRPVASDF

SEQ ID NO: 12832 - protein, 20 aa, synthetic construct
  source 1..20: note = Seed: SATGFKQSSKALQRPVASDF
SATGFKQMSPALPRPVASDF

SEQ ID NO: 12833 - protein, 20 aa, synthetic construct
  source 1..20: note = Seed: SATGFKQSSKALQRPVASDF
SATGFKQMSPALQRPVASDF

SEQ ID NO: 12834 - protein, 20 aa, synthetic construct
  source 1..20: note = Seed: SATGFKQSSKALQRPVASDF
SATGFKQMSPALRRPVASDF

SEQ ID NO: 12835 - protein, 20 aa, synthetic construct
  source 1..20: note = Seed: SATGFKQSSKALQRPVASDF
SATGFKQMSPALSRPVASDF

SEQ ID NO: 12836 - protein, 20 aa, synthetic construct
  source 1..20: note = Seed: SATGFKQSSKALQRPVASDF
SATGFKQMSPALTRPVASDF

SEQ ID NO: 12837 - protein, 20 aa, synthetic construct
  source 1..20: note = Seed: SATGFKQSSKALQRPVASDF
SATGFKQMSPALVRPVASDF

SEQ ID NO: 12838 - protein, 20 aa, synthetic construct
  source 1..20: note = Seed: SATGFKQSSKALQRPVASDF
SATGFKQMSPALWRPVASDF

SEQ ID NO: 12839 - protein, 20 aa, synthetic construct
  source 1..20: note = Seed: SATGFKQSSKALQRPVASDF
SATGFKQMSPALYRPVASDF

SEQ ID NO: 12840 - protein, 20 aa, synthetic construct
  source 1..20: note = Seed: SATGFKQSSKALQRPVASDF
SATGFKQMSQALARPVASDF

SEQ ID NO: 12841 - protein, 20 aa, synthetic construct
  source 1..20: note = Seed: SATGFKQSSKALQRPVASDF
SATGFKQMSQALGRPVASDF

SEQ ID NO: 12842 - protein, 20 aa, synthetic construct
  source 1..20: note = Seed: SATGFKQSSKALQRPVASDF
SATGFKQMSQALHRPVASDF

SEQ ID NO: 12843 - protein, 20 aa, synthetic construct
  source 1..20: note = Seed: SATGFKQSSKALQRPVASDF
SATGFKQMSQALIRPVASDF

SEQ ID NO: 12844 - protein, 20 aa, synthetic construct
  source 1..20: note = Seed: SATGFKQSSKALQRPVASDF
SATGFKQMSQALLRPVASDF

SEQ ID NO: 12845 - protein, 20 aa, synthetic construct
  source 1..20: note = Seed: SATGFKQSSKALQRPVASDF
SATGFKQMSQALMRPVASDF

SEQ ID NO: 12846 - protein, 20 aa, synthetic construct
  source 1..20: note = Seed: SATGFKQSSKALQRPVASDF
SATGFKQMSQALNRPVASDF

SEQ ID NO: 12847 - protein, 20 aa, synthetic construct
  source 1..20: note = Seed: SATGFKQSSKALQRPVASDF
SATGFKQMSQALPRPVASDF

SEQ ID NO: 12848 - protein, 20 aa, synthetic construct
  source 1..20: note = Seed: SATGFKQSSKALQRPVASDF
SATGFKQMSQALQRPVASDF

SEQ ID NO: 12849 - protein, 20 aa, synthetic construct
  source 1..20: note = Seed: SATGFKQSSKALQRPVASDF
SATGFKQMSQALRRPVASDF

SEQ ID NO: 12850 - protein, 20 aa, synthetic construct
  source 1..20: note = Seed: SATGFKQSSKALQRPVASDF
SATGFKQMSQALSRPVASDF

SEQ ID NO: 12851 - protein, 20 aa, synthetic construct
  source 1..20: note = Seed: SATGFKQSSKALQRPVASDF
SATGFKQMSQALTRPVASDF

SEQ ID NO: 12852 - protein, 20 aa, synthetic construct
  source 1..20: note = Seed: SATGFKQSSKALQRPVASDF
SATGFKQMSQALVRPVASDF

SEQ ID NO: 12853 - protein, 20 aa, synthetic construct
  source 1..20: note = Seed: SATGFKQSSKALQRPVASDF
SATGFKQMSRALARPVASDF

SEQ ID NO: 12854 - protein, 20 aa, synthetic construct
  source 1..20: note = Seed: SATGFKQSSKALQRPVASDF
SATGFKQMSRALCRPVASDF

SEQ ID NO: 12855 - protein, 20 aa, synthetic construct
  source 1..20: note = Seed: SATGFKQSSKALQRPVASDF
SATGFKQMSRALDRPVASDF

SEQ ID NO: 12856 - protein, 20 aa, synthetic construct
  source 1..20: note = Seed: SATGFKQSSKALQRPVASDF
SATGFKQMSRALERPVASDF

SEQ ID NO: 12857 - protein, 20 aa, synthetic construct
  source 1..20: note = Seed: SATGFKQSSKALQRPVASDF
SATGFKQMSRALFRPVASDF

SEQ ID NO: 12858 - protein, 20 aa, synthetic construct
  source 1..20: note = Seed: SATGFKQSSKALQRPVASDF
SATGFKQMSRALGRPVASDF

SEQ ID NO: 12859 - protein, 20 aa, synthetic construct
  source 1..20: note = Seed: SATGFKQSSKALQRPVASDF
SATGFKQMSRALHRPVASDF

SEQ ID NO: 12860 - protein, 20 aa, synthetic construct
  source 1..20: note = Seed: SATGFKQSSKALQRPVASDF
SATGFKQMSRALIRPVASDF

SEQ ID NO: 12861 - protein, 20 aa, synthetic construct
  source 1..20: note = Seed: SATGFKQSSKALQRPVASDF
SATGFKQMSRALKRPVASDF

SEQ ID NO: 12862 - protein, 20 aa, synthetic construct
  source 1..20: note = Seed: SATGFKQSSKALQRPVASDF
SATGFKQMSRALLRPVASDF

SEQ ID NO: 12863 - protein, 20 aa, synthetic construct
  source 1..20: note = Seed: SATGFKQSSKALQRPVASDF
SATGFKQMSRALMRPVASDF

SEQ ID NO: 12864 - protein, 20 aa, synthetic construct
  source 1..20: note = Seed: SATGFKQSSKALQRPVASDF
SATGFKQMSRALNRPVASDF

SEQ ID NO: 12865 - protein, 20 aa, synthetic construct
  source 1..20: note = Seed: SATGFKQSSKALQRPVASDF
SATGFKQMSRALPRPVASDF

SEQ ID NO: 12866 - protein, 20 aa, synthetic construct
  source 1..20: note = Seed: SATGFKQSSKALQRPVASDF
SATGFKQMSRALQRPVASDF

SEQ ID NO: 12867 - protein, 20 aa, synthetic construct
  source 1..20: note = Seed: SATGFKQSSKALQRPVASDF
SATGFKQMSRALRRPVASDF

SEQ ID NO: 12868 - protein, 20 aa, synthetic construct
  source 1..20: note = Seed: SATGFKQSSKALQRPVASDF
SATGFKQMSRALSRPVASDF

SEQ ID NO: 12869 - protein, 20 aa, synthetic construct
  source 1..20: note = Seed: SATGFKQSSKALQRPVASDF
SATGFKQMSRALTRPVASDF

SEQ ID NO: 12870 - protein, 20 aa, synthetic construct
  source 1..20: note = Seed: SATGFKQSSKALQRPVASDF
SATGFKQMSRALVRPVASDF

SEQ ID NO: 12871 - protein, 20 aa, synthetic construct
  source 1..20: note = Seed: SATGFKQSSKALQRPVASDF
SATGFKQMSRALWRPVASDF

SEQ ID NO: 12872 - protein, 20 aa, synthetic construct
  source 1..20: note = Seed: SATGFKQSSKALQRPVASDF
SATGFKQMSRALYRPVASDF

SEQ ID NO: 12873 - protein, 20 aa, synthetic construct
  source 1..20: note = Seed: SATGFKQSSKALQRPVASDF
SATGFKQMSSALARPVASDF

SEQ ID NO: 12874 - protein, 20 aa, synthetic construct
  source 1..20: note = Seed: SATGFKQSSKALQRPVASDF
SATGFKQMSSALCRPVASDF

SEQ ID NO: 12875 - protein, 20 aa, synthetic construct
  source 1..20: note = Seed: SATGFKQSSKALQRPVASDF
SATGFKQMSSALDRPVASDF

SEQ ID NO: 12876 - protein, 20 aa, synthetic construct
  source 1..20: note = Seed: SATGFKQSSKALQRPVASDF
SATGFKQMSSALERPVASDF

SEQ ID NO: 12877 - protein, 20 aa, synthetic construct
  source 1..20: note = Seed: SATGFKQSSKALQRPVASDF
SATGFKQMSSALFRPVASDF

SEQ ID NO: 12878 - protein, 20 aa, synthetic construct
  source 1..20: note = Seed: SATGFKQSSKALQRPVASDF
SATGFKQMSSALGRPVASDF

SEQ ID NO: 12879 - protein, 20 aa, synthetic construct
  source 1..20: note = Seed: SATGFKQSSKALQRPVASDF
SATGFKQMSSALHRPVASDF

SEQ ID NO: 12880 - protein, 20 aa, synthetic construct
  source 1..20: note = Seed: SATGFKQSSKALQRPVASDF
SATGFKQMSSALIRPVASDF

SEQ ID NO: 12881 - protein, 20 aa, synthetic construct
  source 1..20: note = Seed: SATGFKQSSKALQRPVASDF
SATGFKQMSSALKRPVASDF

SEQ ID NO: 12882 - protein, 20 aa, synthetic construct
  source 1..20: note = Seed: SATGFKQSSKALQRPVASDF
SATGFKQMSSALLRPVASDF

SEQ ID NO: 12883 - protein, 20 aa, synthetic construct
  source 1..20: note = Seed: SATGFKQSSKALQRPVASDF
SATGFKQMSSALMRPVASDF

SEQ ID NO: 12884 - protein, 20 aa, synthetic construct
  source 1..20: note = Seed: SATGFKQSSKALQRPVASDF
SATGFKQMSSALNRPVASDF

SEQ ID NO: 12885 - protein, 20 aa, synthetic construct
  source 1..20: note = Seed: SATGFKQSSKALQRPVASDF
SATGFKQMSSALPRPVASDF

SEQ ID NO: 12886 - protein, 20 aa, synthetic construct
  source 1..20: note = Seed: SATGFKQSSKALQRPVASDF
SATGFKQMSSALQRPVASDF

SEQ ID NO: 12887 - protein, 20 aa, synthetic construct
  source 1..20: note = Seed: SATGFKQSSKALQRPVASDF
SATGFKQMSSALRRPVASDF

SEQ ID NO: 12888 - protein, 20 aa, synthetic construct
  source 1..20: note = Seed: SATGFKQSSKALQRPVASDF
SATGFKQMSSALSRPVASDF

SEQ ID NO: 12889 - protein, 20 aa, synthetic construct
  source 1..20: note = Seed: SATGFKQSSKALQRPVASDF
SATGFKQMSSALTRPVASDF

SEQ ID NO: 12890 - protein, 20 aa, synthetic construct
  source 1..20: note = Seed: SATGFKQSSKALQRPVASDF
SATGFKQMSSALVRPVASDF

SEQ ID NO: 12891 - protein, 20 aa, synthetic construct
  source 1..20: note = Seed: SATGFKQSSKALQRPVASDF
SATGFKQMSSALWRPVASDF

SEQ ID NO: 12892 - protein, 20 aa, synthetic construct
  source 1..20: note = Seed: SATGFKQSSKALQRPVASDF
SATGFKQMSSALYRPVASDF

SEQ ID NO: 12893 - protein, 20 aa, synthetic construct
  source 1..20: note = Seed: SATGFKQSSKALQRPVASDF
SATGFKQMSTALARPVASDF

SEQ ID NO: 12894 - protein, 20 aa, synthetic construct
  source 1..20: note = Seed: SATGFKQSSKALQRPVASDF
SATGFKQMSTALCRPVASDF

SEQ ID NO: 12895 - protein, 20 aa, synthetic construct
  source 1..20: note = Seed: SATGFKQSSKALQRPVASDF
SATGFKQMSTALDRPVASDF

SEQ ID NO: 12896 - protein, 20 aa, synthetic construct
  source 1..20: note = Seed: SATGFKQSSKALQRPVASDF
SATGFKQMSTALERPVASDF

SEQ ID NO: 12897 - protein, 20 aa, synthetic construct
  source 1..20: note = Seed: SATGFKQSSKALQRPVASDF
SATGFKQMSTALFRPVASDF

SEQ ID NO: 12898 - protein, 20 aa, synthetic construct
  source 1..20: note = Seed: SATGFKQSSKALQRPVASDF
SATGFKQMSTALGRPVASDF

SEQ ID NO: 12899 - protein, 20 aa, synthetic construct
  source 1..20: note = Seed: SATGFKQSSKALQRPVASDF
SATGFKQMSTALHRPVASDF

SEQ ID NO: 12900 - protein, 20 aa, synthetic construct
  source 1..20: note = Seed: SATGFKQSSKALQRPVASDF
SATGFKQMSTALIRPVASDF

SEQ ID NO: 12901 - protein, 20 aa, synthetic construct
  source 1..20: note = Seed: SATGFKQSSKALQRPVASDF
SATGFKQMSTALKRPVASDF

SEQ ID NO: 12902 - protein, 20 aa, synthetic construct
  source 1..20: note = Seed: SATGFKQSSKALQRPVASDF
SATGFKQMSTALLRPVASDF

SEQ ID NO: 12903 - protein, 20 aa, synthetic construct
  source 1..20: note = Seed: SATGFKQSSKALQRPVASDF
SATGFKQMSTALMRPVASDF

SEQ ID NO: 12904 - protein, 20 aa, synthetic construct
  source 1..20: note = Seed: SATGFKQSSKALQRPVASDF
SATGFKQMSTALNRPVASDF

SEQ ID NO: 12905 - protein, 20 aa, synthetic construct
  source 1..20: note = Seed: SATGFKQSSKALQRPVASDF
SATGFKQMSTALPRPVASDF

SEQ ID NO: 12906 - protein, 20 aa, synthetic construct
  source 1..20: note = Seed: SATGFKQSSKALQRPVASDF
SATGFKQMSTALQRPVASDF

SEQ ID NO: 12907 - protein, 20 aa, synthetic construct
  source 1..20: note = Seed: SATGFKQSSKALQRPVASDF
SATGFKQMSTALRRPVASDF

SEQ ID NO: 12908 - protein, 20 aa, synthetic construct
  source 1..20: note = Seed: SATGFKQSSKALQRPVASDF
SATGFKQMSTALSRPVASDF

SEQ ID NO: 12909 - protein, 20 aa, synthetic construct
  source 1..20: note = Seed: SATGFKQSSKALQRPVASDF
SATGFKQMSTALTRPVASDF

SEQ ID NO: 12910 - protein, 20 aa, synthetic construct
  source 1..20: note = Seed: SATGFKQSSKALQRPVASDF
SATGFKQMSTALVRPVASDF

SEQ ID NO: 12911 - protein, 20 aa, synthetic construct
  source 1..20: note = Seed: SATGFKQSSKALQRPVASDF
SATGFKQMSTALWRPVASDF

SEQ ID NO: 12912 - protein, 20 aa, synthetic construct
  source 1..20: note = Seed: SATGFKQSSKALQRPVASDF
SATGFKQMSTALYRPVASDF

SEQ ID NO: 12913 - protein, 20 aa, synthetic construct
  source 1..20: note = Seed: SATGFKQSSKALQRPVASDF
SATGFKQMSVALARPVASDF

SEQ ID NO: 12914 - protein, 20 aa, synthetic construct
  source 1..20: note = Seed: SATGFKQSSKALQRPVASDF
SATGFKQMSVALCRPVASDF

SEQ ID NO: 12915 - protein, 20 aa, synthetic construct
  source 1..20: note = Seed: SATGFKQSSKALQRPVASDF
SATGFKQMSVALDRPVASDF

SEQ ID NO: 12916 - protein, 20 aa, synthetic construct
  source 1..20: note = Seed: SATGFKQSSKALQRPVASDF
SATGFKQMSVALERPVASDF

SEQ ID NO: 12917 - protein, 20 aa, synthetic construct
  source 1..20: note = Seed: SATGFKQSSKALQRPVASDF
SATGFKQMSVALFRPVASDF

SEQ ID NO: 12918 - protein, 20 aa, synthetic construct
  source 1..20: note = Seed: SATGFKQSSKALQRPVASDF
SATGFKQMSVALGRPVASDF

SEQ ID NO: 12919 - protein, 20 aa, synthetic construct
  source 1..20: note = Seed: SATGFKQSSKALQRPVASDF
SATGFKQMSVALHRPVASDF

SEQ ID NO: 12920 - protein, 20 aa, synthetic construct
  source 1..20: note = Seed: SATGFKQSSKALQRPVASDF
SATGFKQMSVALIRPVASDF

SEQ ID NO: 12921 - protein, 20 aa, synthetic construct
  source 1..20: note = Seed: SATGFKQSSKALQRPVASDF
SATGFKQMSVALKRPVASDF

SEQ ID NO: 12922 - protein, 20 aa, synthetic construct
  source 1..20: note = Seed: SATGFKQSSKALQRPVASDF
SATGFKQMSVALLRPVASDF

SEQ ID NO: 12923 - protein, 20 aa, synthetic construct
  source 1..20: note = Seed: SATGFKQSSKALQRPVASDF
SATGFKQMSVALMRPVASDF

SEQ ID NO: 12924 - protein, 20 aa, synthetic construct
  source 1..20: note = Seed: SATGFKQSSKALQRPVASDF
SATGFKQMSVALNRPVASDF

SEQ ID NO: 12925 - protein, 20 aa, synthetic construct
  source 1..20: note = Seed: SATGFKQSSKALQRPVASDF
SATGFKQMSVALPRPVASDF

SEQ ID NO: 12926 - protein, 20 aa, synthetic construct
  source 1..20: note = Seed: SATGFKQSSKALQRPVASDF
SATGFKQMSVALQRPVASDF

SEQ ID NO: 12927 - protein, 20 aa, synthetic construct
  source 1..20: note = Seed: SATGFKQSSKALQRPVASDF
SATGFKQMSVALRRPVASDF

SEQ ID NO: 12928 - protein, 20 aa, synthetic construct
  source 1..20: note = Seed: SATGFKQSSKALQRPVASDF
SATGFKQMSVALSRPVASDF

SEQ ID NO: 12929 - protein, 20 aa, synthetic construct
  source 1..20: note = Seed: SATGFKQSSKALQRPVASDF
SATGFKQMSVALTRPVASDF

SEQ ID NO: 12930 - protein, 20 aa, synthetic construct
  source 1..20: note = Seed: SATGFKQSSKALQRPVASDF
SATGFKQMSVALVRPVASDF

SEQ ID NO: 12931 - protein, 20 aa, synthetic construct
  source 1..20: note = Seed: SATGFKQSSKALQRPVASDF
SATGFKQMSVALWRPVASDF

SEQ ID NO: 12932 - protein, 20 aa, synthetic construct
  source 1..20: note = Seed: SATGFKQSSKALQRPVASDF
SATGFKQMSVALYRPVASDF

SEQ ID NO: 12933 - protein, 20 aa, synthetic construct
  source 1..20: note = Seed: SATGFKQSSKALQRPVASDF
SATGFKQMSWALCRPVASDF

SEQ ID NO: 12934 - protein, 20 aa, synthetic construct
  source 1..20: note = Seed: SATGFKQSSKALQRPVASDF
SATGFKQMSWALVRPVASDF

SEQ ID NO: 12935 - protein, 20 aa, synthetic construct
  source 1..20: note = Seed: SATGFKQSSKALQRPVASDF
SATGFKQMSYALARPVASDF

SEQ ID NO: 12936 - protein, 20 aa, synthetic construct
  source 1..20: note = Seed: SATGFKQSSKALQRPVASDF
SATGFKQMSYALVRPVASDF

SEQ ID NO: 12937 - protein, 20 aa, synthetic construct
  source 1..20: note = Seed: SATGFKQSSKALQRPVASDF
SATGFKQNSAALARPVASDF

SEQ ID NO: 12938 - protein, 20 aa, synthetic construct
  source 1..20: note = Seed: SATGFKQSSKALQRPVASDF
SATGFKQNSAALCRPVASDF

SEQ ID NO: 12939 - protein, 20 aa, synthetic construct
  source 1..20: note = Seed: SATGFKQSSKALQRPVASDF
SATGFKQNSAALFRPVASDF

SEQ ID NO: 12940 - protein, 20 aa, synthetic construct
  source 1..20: note = Seed: SATGFKQSSKALQRPVASDF
SATGFKQNSAALGRPVASDF

SEQ ID NO: 12941 - protein, 20 aa, synthetic construct
  source 1..20: note = Seed: SATGFKQSSKALQRPVASDF
SATGFKQNSAALHRPVASDF

SEQ ID NO: 12942 - protein, 20 aa, synthetic construct
  source 1..20: note = Seed: SATGFKQSSKALQRPVASDF
SATGFKQNSAALIRPVASDF

SEQ ID NO: 12943 - protein, 20 aa, synthetic construct
  source 1..20: note = Seed: SATGFKQSSKALQRPVASDF
SATGFKQNSAALLRPVASDF

SEQ ID NO: 12944 - protein, 20 aa, synthetic construct
  source 1..20: note = Seed: SATGFKQSSKALQRPVASDF
SATGFKQNSAALMRPVASDF

SEQ ID NO: 12945 - protein, 20 aa, synthetic construct
  source 1..20: note = Seed: SATGFKQSSKALQRPVASDF
SATGFKQNSAALNRPVASDF

SEQ ID NO: 12946 - protein, 20 aa, synthetic construct
  source 1..20: note = Seed: SATGFKQSSKALQRPVASDF
SATGFKQNSAALSRPVASDF

SEQ ID NO: 12947 - protein, 20 aa, synthetic construct
  source 1..20: note = Seed: SATGFKQSSKALQRPVASDF
SATGFKQNSAALTRPVASDF

SEQ ID NO: 12948 - protein, 20 aa, synthetic construct
  source 1..20: note = Seed: SATGFKQSSKALQRPVASDF
SATGFKQNSAALVRPVASDF

SEQ ID NO: 12949 - protein, 20 aa, synthetic construct
  source 1..20: note = Seed: SATGFKQSSKALQRPVASDF
SATGFKQNSAALWRPVASDF

SEQ ID NO: 12950 - protein, 20 aa, synthetic construct
  source 1..20: note = Seed: SATGFKQSSKALQRPVASDF
SATGFKQNSAALYRPVASDF

SEQ ID NO: 12951 - protein, 20 aa, synthetic construct
  source 1..20: note = Seed: SATGFKQSSKALQRPVASDF
SATGFKQNSFALARPVASDF

SEQ ID NO: 12952 - protein, 20 aa, synthetic construct
  source 1..20: note = Seed: SATGFKQSSKALQRPVASDF
SATGFKQNSFALDRPVASDF

SEQ ID NO: 12953 - protein, 20 aa, synthetic construct
  source 1..20: note = Seed: SATGFKQSSKALQRPVASDF
SATGFKQNSFALERPVASDF

SEQ ID NO: 12954 - protein, 20 aa, synthetic construct
  source 1..20: note = Seed: SATGFKQSSKALQRPVASDF
SATGFKQNSFALFRPVASDF

SEQ ID NO: 12955 - protein, 20 aa, synthetic construct
  source 1..20: note = Seed: SATGFKQSSKALQRPVASDF
SATGFKQNSFALIRPVASDF

SEQ ID NO: 12956 - protein, 20 aa, synthetic construct
  source 1..20: note = Seed: SATGFKQSSKALQRPVASDF
SATGFKQNSFALLRPVASDF

SEQ ID NO: 12957 - protein, 20 aa, synthetic construct
  source 1..20: note = Seed: SATGFKQSSKALQRPVASDF
SATGFKQNSFALMRPVASDF

SEQ ID NO: 12958 - protein, 20 aa, synthetic construct
  source 1..20: note = Seed: SATGFKQSSKALQRPVASDF
SATGFKQNSFALSRPVASDF

SEQ ID NO: 12959 - protein, 20 aa, synthetic construct
  source 1..20: note = Seed: SATGFKQSSKALQRPVASDF
SATGFKQNSFALTRPVASDF

SEQ ID NO: 12960 - protein, 20 aa, synthetic construct
  source 1..20: note = Seed: SATGFKQSSKALQRPVASDF
SATGFKQNSFALVRPVASDF

SEQ ID NO: 12961 - protein, 20 aa, synthetic construct
  source 1..20: note = Seed: SATGFKQSSKALQRPVASDF
SATGFKQNSGALARPVASDF

SEQ ID NO: 12962 - protein, 20 aa, synthetic construct
  source 1..20: note = Seed: SATGFKQSSKALQRPVASDF
SATGFKQNSGALIRPVASDF

SEQ ID NO: 12963 - protein, 20 aa, synthetic construct
  source 1..20: note = Seed: SATGFKQSSKALQRPVASDF
SATGFKQNSGALLRPVASDF

SEQ ID NO: 12964 - protein, 20 aa, synthetic construct
  source 1..20: note = Seed: SATGFKQSSKALQRPVASDF
SATGFKQNSGALMRPVASDF

SEQ ID NO: 12965 - protein, 20 aa, synthetic construct
  source 1..20: note = Seed: SATGFKQSSKALQRPVASDF
SATGFKQNSGALSRPVASDF

SEQ ID NO: 12966 - protein, 20 aa, synthetic construct
  source 1..20: note = Seed: SATGFKQSSKALQRPVASDF
SATGFKQNSGALTRPVASDF

SEQ ID NO: 12967 - protein, 20 aa, synthetic construct
  source 1..20: note = Seed: SATGFKQSSKALQRPVASDF
SATGFKQNSGALVRPVASDF

SEQ ID NO: 12968 - protein, 20 aa, synthetic construct
  source 1..20: note = Seed: SATGFKQSSKALQRPVASDF
SATGFKQNSIALARPVASDF

SEQ ID NO: 12969 - protein, 20 aa, synthetic construct
  source 1..20: note = Seed: SATGFKQSSKALQRPVASDF
SATGFKQNSIALGRPVASDF

SEQ ID NO: 12970 - protein, 20 aa, synthetic construct
  source 1..20: note = Seed: SATGFKQSSKALQRPVASDF
SATGFKQNSIALHRPVASDF

SEQ ID NO: 12971 - protein, 20 aa, synthetic construct
  source 1..20: note = Seed: SATGFKQSSKALQRPVASDF
SATGFKQNSIALIRPVASDF

SEQ ID NO: 12972 - protein, 20 aa, synthetic construct
  source 1..20: note = Seed: SATGFKQSSKALQRPVASDF
SATGFKQNSIALNRPVASDF

SEQ ID NO: 12973 - protein, 20 aa, synthetic construct
  source 1..20: note = Seed: SATGFKQSSKALQRPVASDF
SATGFKQNSIALSRPVASDF

SEQ ID NO: 12974 - protein, 20 aa, synthetic construct
  source 1..20: note = Seed: SATGFKQSSKALQRPVASDF
SATGFKQNSIALTRPVASDF

SEQ ID NO: 12975 - protein, 20 aa, synthetic construct
  source 1..20: note = Seed: SATGFKQSSKALQRPVASDF
SATGFKQNSIALVRPVASDF

SEQ ID NO: 12976 - protein, 20 aa, synthetic construct
  source 1..20: note = Seed: SATGFKQSSKALQRPVASDF
SATGFKQNSKALARPVASDF

SEQ ID NO: 12977 - protein, 20 aa, synthetic construct
  source 1..20: note = Seed: SATGFKQSSKALQRPVASDF
SATGFKQNSKALGRPVASDF

SEQ ID NO: 12978 - protein, 20 aa, synthetic construct
  source 1..20: note = Seed: SATGFKQSSKALQRPVASDF
SATGFKQNSKALSRPVASDF

SEQ ID NO: 12979 - protein, 20 aa, synthetic construct
  source 1..20: note = Seed: SATGFKQSSKALQRPVASDF
SATGFKQNSLALGRPVASDF

SEQ ID NO: 12980 - protein, 20 aa, synthetic construct
  source 1..20: note = Seed: SATGFKQSSKALQRPVASDF
SATGFKQNSLALNRPVASDF

SEQ ID NO: 12981 - protein, 20 aa, synthetic construct
  source 1..20: note = Seed: SATGFKQSSKALQRPVASDF
SATGFKQNSLALSRPVASDF

SEQ ID NO: 12982 - protein, 20 aa, synthetic construct
  source 1..20: note = Seed: SATGFKQSSKALQRPVASDF
SATGFKQNSLALVRPVASDF

SEQ ID NO: 12983 - protein, 20 aa, synthetic construct
  source 1..20: note = Seed: SATGFKQSSKALQRPVASDF
SATGFKQNSMALIRPVASDF

SEQ ID NO: 12984 - protein, 20 aa, synthetic construct
  source 1..20: note = Seed: SATGFKQSSKALQRPVASDF
SATGFKQNSMALNRPVASDF

SEQ ID NO: 12985 - protein, 20 aa, synthetic construct
  source 1..20: note = Seed: SATGFKQSSKALQRPVASDF
SATGFKQNSMALSRPVASDF

SEQ ID NO: 12986 - protein, 20 aa, synthetic construct
  source 1..20: note = Seed: SATGFKQSSKALQRPVASDF
SATGFKQNSMALVRPVASDF

SEQ ID NO: 12987 - protein, 20 aa, synthetic construct
  source 1..20: note = Seed: SATGFKQSSKALQRPVASDF
SATGFKQNSNALARPVASDF

SEQ ID NO: 12988 - protein, 20 aa, synthetic construct
  source 1..20: note = Seed: SATGFKQSSKALQRPVASDF
SATGFKQNSNALIRPVASDF

SEQ ID NO: 12989 - protein, 20 aa, synthetic construct
  source 1..20: note = Seed: SATGFKQSSKALQRPVASDF
SATGFKQNSNALLRPVASDF

SEQ ID NO: 12990 - protein, 20 aa, synthetic construct
  source 1..20: note = Seed: SATGFKQSSKALQRPVASDF
SATGFKQNSNALMRPVASDF

SEQ ID NO: 12991 - protein, 20 aa, synthetic construct
  source 1..20: note = Seed: SATGFKQSSKALQRPVASDF
SATGFKQNSNALSRPVASDF

SEQ ID NO: 12992 - protein, 20 aa, synthetic construct
  source 1..20: note = Seed: SATGFKQSSKALQRPVASDF
SATGFKQNSNALVRPVASDF

SEQ ID NO: 12993 - protein, 20 aa, synthetic construct
  source 1..20: note = Seed: SATGFKQSSKALQRPVASDF
SATGFKQNSPALARPVASDF

SEQ ID NO: 12994 - protein, 20 aa, synthetic construct
  source 1..20: note = Seed: SATGFKQSSKALQRPVASDF
SATGFKQNSPALFRPVASDF

SEQ ID NO: 12995 - protein, 20 aa, synthetic construct
  source 1..20: note = Seed: SATGFKQSSKALQRPVASDF
SATGFKQNSPALIRPVASDF

SEQ ID NO: 12996 - protein, 20 aa, synthetic construct
  source 1..20: note = Seed: SATGFKQSSKALQRPVASDF
SATGFKQNSPALLRPVASDF

SEQ ID NO: 12997 - protein, 20 aa, synthetic construct
  source 1..20: note = Seed: SATGFKQSSKALQRPVASDF
SATGFKQNSPALMRPVASDF

SEQ ID NO: 12998 - protein, 20 aa, synthetic construct
  source 1..20: note = Seed: SATGFKQSSKALQRPVASDF
SATGFKQNSPALNRPVASDF

SEQ ID NO: 12999 - protein, 20 aa, synthetic construct
  source 1..20: note = Seed: SATGFKQSSKALQRPVASDF
SATGFKQNSPALSRPVASDF

SEQ ID NO: 13000 - protein, 20 aa, synthetic construct
  source 1..20: note = Seed: SATGFKQSSKALQRPVASDF
SATGFKQNSPALTRPVASDF

SEQ ID NO: 13001 - protein, 20 aa, synthetic construct
  source 1..20: note = Seed: SATGFKQSSKALQRPVASDF
SATGFKQNSPALVRPVASDF

SEQ ID NO: 13002 - protein, 20 aa, synthetic construct
  source 1..20: note = Seed: SATGFKQSSKALQRPVASDF
SATGFKQNSRALARPVASDF

SEQ ID NO: 13003 - protein, 20 aa, synthetic construct
  source 1..20: note = Seed: SATGFKQSSKALQRPVASDF
SATGFKQNSRALGRPVASDF

SEQ ID NO: 13004 - protein, 20 aa, synthetic construct
  source 1..20: note = Seed: SATGFKQSSKALQRPVASDF
SATGFKQNSRALSRPVASDF

SEQ ID NO: 13005 - protein, 20 aa, synthetic construct
  source 1..20: note = Seed: SATGFKQSSKALQRPVASDF
SATGFKQNSSALARPVASDF

SEQ ID NO: 13006 - protein, 20 aa, synthetic construct
  source 1..20: note = Seed: SATGFKQSSKALQRPVASDF
SATGFKQNSSALFRPVASDF

SEQ ID NO: 13007 - protein, 20 aa, synthetic construct
  source 1..20: note = Seed: SATGFKQSSKALQRPVASDF
SATGFKQNSSALIRPVASDF

SEQ ID NO: 13008 - protein, 20 aa, synthetic construct
  source 1..20: note = Seed: SATGFKQSSKALQRPVASDF
SATGFKQNSSALLRPVASDF

SEQ ID NO: 13009 - protein, 20 aa, synthetic construct
  source 1..20: note = Seed: SATGFKQSSKALQRPVASDF
SATGFKQNSSALMRPVASDF

SEQ ID NO: 13010 - protein, 20 aa, synthetic construct
  source 1..20: note = Seed: SATGFKQSSKALQRPVASDF
SATGFKQNSSALNRPVASDF

SEQ ID NO: 13011 - protein, 20 aa, synthetic construct
  source 1..20: note = Seed: SATGFKQSSKALQRPVASDF
SATGFKQNSSALSRPVASDF

SEQ ID NO: 13012 - protein, 20 aa, synthetic construct
  source 1..20: note = Seed: SATGFKQSSKALQRPVASDF
SATGFKQNSSALTRPVASDF

SEQ ID NO: 13013 - protein, 20 aa, synthetic construct
  source 1..20: note = Seed: SATGFKQSSKALQRPVASDF
SATGFKQNSSALVRPVASDF

SEQ ID NO: 13014 - protein, 20 aa, synthetic construct
  source 1..20: note = Seed: SATGFKQSSKALQRPVASDF
SATGFKQNSTALARPVASDF

SEQ ID NO: 13015 - protein, 20 aa, synthetic construct
  source 1..20: note = Seed: SATGFKQSSKALQRPVASDF
SATGFKQNSTALIRPVASDF

SEQ ID NO: 13016 - protein, 20 aa, synthetic construct
  source 1..20: note = Seed: SATGFKQSSKALQRPVASDF
SATGFKQNSTALLRPVASDF

SEQ ID NO: 13017 - protein, 20 aa, synthetic construct
  source 1..20: note = Seed: SATGFKQSSKALQRPVASDF
SATGFKQNSTALMRPVASDF

SEQ ID NO: 13018 - protein, 20 aa, synthetic construct
  source 1..20: note = Seed: SATGFKQSSKALQRPVASDF
SATGFKQNSTALNRPVASDF

SEQ ID NO: 13019 - protein, 20 aa, synthetic construct
  source 1..20: note = Seed: SATGFKQSSKALQRPVASDF
SATGFKQNSTALSRPVASDF

SEQ ID NO: 13020 - protein, 20 aa, synthetic construct
  source 1..20: note = Seed: SATGFKQSSKALQRPVASDF
SATGFKQNSTALTRPVASDF

SEQ ID NO: 13021 - protein, 20 aa, synthetic construct
  source 1..20: note = Seed: SATGFKQSSKALQRPVASDF
SATGFKQNSTALVRPVASDF

SEQ ID NO: 13022 - protein, 20 aa, synthetic construct
  source 1..20: note = Seed: SATGFKQSSKALQRPVASDF
SATGFKQNSVALARPVASDF

SEQ ID NO: 13023 - protein, 20 aa, synthetic construct
  source 1..20: note = Seed: SATGFKQSSKALQRPVASDF
SATGFKQNSVALGRPVASDF

SEQ ID NO: 13024 - protein, 20 aa, synthetic construct
  source 1..20: note = Seed: SATGFKQSSKALQRPVASDF
SATGFKQNSVALHRPVASDF

SEQ ID NO: 13025 - protein, 20 aa, synthetic construct
  source 1..20: note = Seed: SATGFKQSSKALQRPVASDF
SATGFKQNSVALIRPVASDF

SEQ ID NO: 13026 - protein, 20 aa, synthetic construct
  source 1..20: note = Seed: SATGFKQSSKALQRPVASDF
SATGFKQNSVALLRPVASDF

SEQ ID NO: 13027 - protein, 20 aa, synthetic construct
  source 1..20: note = Seed: SATGFKQSSKALQRPVASDF
SATGFKQNSVALNRPVASDF

SEQ ID NO: 13028 - protein, 20 aa, synthetic construct
  source 1..20: note = Seed: SATGFKQSSKALQRPVASDF
SATGFKQNSVALQRPVASDF

SEQ ID NO: 13029 - protein, 20 aa, synthetic construct
  source 1..20: note = Seed: SATGFKQSSKALQRPVASDF
SATGFKQNSVALSRPVASDF

SEQ ID NO: 13030 - protein, 20 aa, synthetic construct
  source 1..20: note = Seed: SATGFKQSSKALQRPVASDF
SATGFKQNSVALTRPVASDF

SEQ ID NO: 13031 - protein, 20 aa, synthetic construct
  source 1..20: note = Seed: SATGFKQSSKALQRPVASDF
SATGFKQNSVALVRPVASDF

SEQ ID NO: 13032 - protein, 20 aa, synthetic construct
  source 1..20: note = Seed: SATGFKQSSKALQRPVASDF
SATGFKQPSAALIRPVASDF

SEQ ID NO: 13033 - protein, 20 aa, synthetic construct
  source 1..20: note = Seed: SATGFKQSSKALQRPVASDF
SATGFKQPSAALLRPVASDF

SEQ ID NO: 13034 - protein, 20 aa, synthetic construct
  source 1..20: note = Seed: SATGFKQSSKALQRPVASDF
SATGFKQPSAALVRPVASDF

SEQ ID NO: 13035 - protein, 20 aa, synthetic construct
  source 1..20: note = Seed: SATGFKQSSKALQRPVASDF
SATGFKQPSFALIRPVASDF

SEQ ID NO: 13036 - protein, 20 aa, synthetic construct
  source 1..20: note = Seed: SATGFKQSSKALQRPVASDF
SATGFKQPSFALVRPVASDF

SEQ ID NO: 13037 - protein, 20 aa, synthetic construct
  source 1..20: note = Seed: SATGFKQSSKALQRPVASDF
SATGFKQPSSALIRPVASDF

SEQ ID NO: 13038 - protein, 20 aa, synthetic construct
  source 1..20: note = Seed: SATGFKQSSKALQRPVASDF
SATGFKQPSSALLRPVASDF

SEQ ID NO: 13039 - protein, 20 aa, synthetic construct
  source 1..20: note = Seed: SATGFKQSSKALQRPVASDF
SATGFKQPSSALVRPVASDF

SEQ ID NO: 13040 - protein, 20 aa, synthetic construct
  source 1..20: note = Seed: SATGFKQSSKALQRPVASDF
SATGFKQPSVALIRPVASDF

SEQ ID NO: 13041 - protein, 20 aa, synthetic construct
  source 1..20: note = Seed: SATGFKQSSKALQRPVASDF
SATGFKQQSAALARPVASDF

SEQ ID NO: 13042 - protein, 20 aa, synthetic construct
  source 1..20: note = Seed: SATGFKQSSKALQRPVASDF
SATGFKQQSAALCRPVASDF

SEQ ID NO: 13043 - protein, 20 aa, synthetic construct
  source 1..20: note = Seed: SATGFKQSSKALQRPVASDF
SATGFKQQSAALDRPVASDF

SEQ ID NO: 13044 - protein, 20 aa, synthetic construct
  source 1..20: note = Seed: SATGFKQSSKALQRPVASDF
SATGFKQQSAALERPVASDF

SEQ ID NO: 13045 - protein, 20 aa, synthetic construct
  source 1..20: note = Seed: SATGFKQSSKALQRPVASDF
SATGFKQQSAALFRPVASDF

SEQ ID NO: 13046 - protein, 20 aa, synthetic construct
  source 1..20: note = Seed: SATGFKQSSKALQRPVASDF
SATGFKQQSAALGRPVASDF

SEQ ID NO: 13047 - protein, 20 aa, synthetic construct
  source 1..20: note = Seed: SATGFKQSSKALQRPVASDF
SATGFKQQSAALHRPVASDF

SEQ ID NO: 13048 - protein, 20 aa, synthetic construct
  source 1..20: note = Seed: SATGFKQSSKALQRPVASDF
SATGFKQQSAALIRPVASDF

SEQ ID NO: 13049 - protein, 20 aa, synthetic construct
  source 1..20: note = Seed: SATGFKQSSKALQRPVASDF
SATGFKQQSAALKRPVASDF

SEQ ID NO: 13050 - protein, 20 aa, synthetic construct
  source 1..20: note = Seed: SATGFKQSSKALQRPVASDF
SATGFKQQSAALLRPVASDF

SEQ ID NO: 13051 - protein, 20 aa, synthetic construct
  source 1..20: note = Seed: SATGFKQSSKALQRPVASDF
SATGFKQQSAALMRPVASDF

SEQ ID NO: 13052 - protein, 20 aa, synthetic construct
  source 1..20: note = Seed: SATGFKQSSKALQRPVASDF
SATGFKQQSAALNRPVASDF

SEQ ID NO: 13053 - protein, 20 aa, synthetic construct
  source 1..20: note = Seed: SATGFKQSSKALQRPVASDF
SATGFKQQSAALPRPVASDF

SEQ ID NO: 13054 - protein, 20 aa, synthetic construct
  source 1..20: note = Seed: SATGFKQSSKALQRPVASDF
SATGFKQQSAALQRPVASDF

SEQ ID NO: 13055 - protein, 20 aa, synthetic construct
  source 1..20: note = Seed: SATGFKQSSKALQRPVASDF
SATGFKQQSAALRRPVASDF

SEQ ID NO: 13056 - protein, 20 aa, synthetic construct
  source 1..20: note = Seed: SATGFKQSSKALQRPVASDF
SATGFKQQSAALSRPVASDF

SEQ ID NO: 13057 - protein, 20 aa, synthetic construct
  source 1..20: note = Seed: SATGFKQSSKALQRPVASDF
SATGFKQQSAALTRPVASDF

SEQ ID NO: 13058 - protein, 20 aa, synthetic construct
  source 1..20: note = Seed: SATGFKQSSKALQRPVASDF
SATGFKQQSAALVRPVASDF

SEQ ID NO: 13059 - protein, 20 aa, synthetic construct
  source 1..20: note = Seed: SATGFKQSSKALQRPVASDF
SATGFKQQSAALWRPVASDF

SEQ ID NO: 13060 - protein, 20 aa, synthetic construct
  source 1..20: note = Seed: SATGFKQSSKALQRPVASDF
SATGFKQQSAALYRPVASDF

SEQ ID NO: 13061 - protein, 20 aa, synthetic construct
  source 1..20: note = Seed: SATGFKQSSKALQRPVASDF
SATGFKQQSCALARPVASDF

SEQ ID NO: 13062 - protein, 20 aa, synthetic construct
  source 1..20: note = Seed: SATGFKQSSKALQRPVASDF
SATGFKQQSCALIRPVASDF

SEQ ID NO: 13063 - protein, 20 aa, synthetic construct
  source 1..20: note = Seed: SATGFKQSSKALQRPVASDF
SATGFKQQSCALLRPVASDF

SEQ ID NO: 13064 - protein, 20 aa, synthetic construct
  source 1..20: note = Seed: SATGFKQSSKALQRPVASDF
SATGFKQQSCALSRPVASDF

SEQ ID NO: 13065 - protein, 20 aa, synthetic construct
  source 1..20: note = Seed: SATGFKQSSKALQRPVASDF
SATGFKQQSCALVRPVASDF

SEQ ID NO: 13066 - protein, 20 aa, synthetic construct
  source 1..20: note = Seed: SATGFKQSSKALQRPVASDF
SATGFKQQSFALARPVASDF

SEQ ID NO: 13067 - protein, 20 aa, synthetic construct
  source 1..20: note = Seed: SATGFKQSSKALQRPVASDF
SATGFKQQSFALERPVASDF

SEQ ID NO: 13068 - protein, 20 aa, synthetic construct
  source 1..20: note = Seed: SATGFKQSSKALQRPVASDF
SATGFKQQSFALFRPVASDF

SEQ ID NO: 13069 - protein, 20 aa, synthetic construct
  source 1..20: note = Seed: SATGFKQSSKALQRPVASDF
SATGFKQQSFALIRPVASDF

SEQ ID NO: 13070 - protein, 20 aa, synthetic construct
  source 1..20: note = Seed: SATGFKQSSKALQRPVASDF
SATGFKQQSFALLRPVASDF

SEQ ID NO: 13071 - protein, 20 aa, synthetic construct
  source 1..20: note = Seed: SATGFKQSSKALQRPVASDF
SATGFKQQSFALMRPVASDF

SEQ ID NO: 13072 - protein, 20 aa, synthetic construct
  source 1..20: note = Seed: SATGFKQSSKALQRPVASDF
SATGFKQQSFALSRPVASDF

SEQ ID NO: 13073 - protein, 20 aa, synthetic construct
  source 1..20: note = Seed: SATGFKQSSKALQRPVASDF
SATGFKQQSFALTRPVASDF

SEQ ID NO: 13074 - protein, 20 aa, synthetic construct
  source 1..20: note = Seed: SATGFKQSSKALQRPVASDF
SATGFKQQSFALVRPVASDF

SEQ ID NO: 13075 - protein, 20 aa, synthetic construct
  source 1..20: note = Seed: SATGFKQSSKALQRPVASDF
SATGFKQQSGALARPVASDF

SEQ ID NO: 13076 - protein, 20 aa, synthetic construct
  source 1..20: note = Seed: SATGFKQSSKALQRPVASDF
SATGFKQQSGALCRPVASDF

SEQ ID NO: 13077 - protein, 20 aa, synthetic construct
  source 1..20: note = Seed: SATGFKQSSKALQRPVASDF
SATGFKQQSGALFRPVASDF

SEQ ID NO: 13078 - protein, 20 aa, synthetic construct
  source 1..20: note = Seed: SATGFKQSSKALQRPVASDF
SATGFKQQSGALGRPVASDF

SEQ ID NO: 13079 - protein, 20 aa, synthetic construct
  source 1..20: note = Seed: SATGFKQSSKALQRPVASDF
SATGFKQQSGALHRPVASDF

SEQ ID NO: 13080 - protein, 20 aa, synthetic construct
  source 1..20: note = Seed: SATGFKQSSKALQRPVASDF
SATGFKQQSGALIRPVASDF

SEQ ID NO: 13081 - protein, 20 aa, synthetic construct
  source 1..20: note = Seed: SATGFKQSSKALQRPVASDF
SATGFKQQSGALLRPVASDF

SEQ ID NO: 13082 - protein, 20 aa, synthetic construct
  source 1..20: note = Seed: SATGFKQSSKALQRPVASDF
SATGFKQQSGALMRPVASDF

SEQ ID NO: 13083 - protein, 20 aa, synthetic construct
  source 1..20: note = Seed: SATGFKQSSKALQRPVASDF
SATGFKQQSGALNRPVASDF

SEQ ID NO: 13084 - protein, 20 aa, synthetic construct
  source 1..20: note = Seed: SATGFKQSSKALQRPVASDF
SATGFKQQSGALPRPVASDF

SEQ ID NO: 13085 - protein, 20 aa, synthetic construct
  source 1..20: note = Seed: SATGFKQSSKALQRPVASDF
SATGFKQQSGALQRPVASDF

SEQ ID NO: 13086 - protein, 20 aa, synthetic construct
  source 1..20: note = Seed: SATGFKQSSKALQRPVASDF
SATGFKQQSGALSRPVASDF

SEQ ID NO: 13087 - protein, 20 aa, synthetic construct
  source 1..20: note = Seed: SATGFKQSSKALQRPVASDF
SATGFKQQSGALTRPVASDF

SEQ ID NO: 13088 - protein, 20 aa, synthetic construct
  source 1..20: note = Seed: SATGFKQSSKALQRPVASDF
SATGFKQQSGALVRPVASDF

SEQ ID NO: 13089 - protein, 20 aa, synthetic construct
  source 1..20: note = Seed: SATGFKQSSKALQRPVASDF
SATGFKQQSGALYRPVASDF

SEQ ID NO: 13090 - protein, 20 aa, synthetic construct
  source 1..20: note = Seed: SATGFKQSSKALQRPVASDF
SATGFKQQSHALARPVASDF

SEQ ID NO: 13091 - protein, 20 aa, synthetic construct
  source 1..20: note = Seed: SATGFKQSSKALQRPVASDF
SATGFKQQSHALIRPVASDF

SEQ ID NO: 13092 - protein, 20 aa, synthetic construct
  source 1..20: note = Seed: SATGFKQSSKALQRPVASDF
SATGFKQQSHALLRPVASDF

SEQ ID NO: 13093 - protein, 20 aa, synthetic construct
  source 1..20: note = Seed: SATGFKQSSKALQRPVASDF
SATGFKQQSHALVRPVASDF

SEQ ID NO: 13094 - protein, 20 aa, synthetic construct
  source 1..20: note = Seed: SATGFKQSSKALQRPVASDF
SATGFKQQSIALARPVASDF

SEQ ID NO: 13095 - protein, 20 aa, synthetic construct
  source 1..20: note = Seed: SATGFKQSSKALQRPVASDF
SATGFKQQSIALCRPVASDF

SEQ ID NO: 13096 - protein, 20 aa, synthetic construct
  source 1..20: note = Seed: SATGFKQSSKALQRPVASDF
SATGFKQQSIALDRPVASDF

SEQ ID NO: 13097 - protein, 20 aa, synthetic construct
  source 1..20: note = Seed: SATGFKQSSKALQRPVASDF
SATGFKQQSIALERPVASDF

SEQ ID NO: 13098 - protein, 20 aa, synthetic construct
  source 1..20: note = Seed: SATGFKQSSKALQRPVASDF
SATGFKQQSIALGRPVASDF

SEQ ID NO: 13099 - protein, 20 aa, synthetic construct
  source 1..20: note = Seed: SATGFKQSSKALQRPVASDF
SATGFKQQSIALHRPVASDF

SEQ ID NO: 13100 - protein, 20 aa, synthetic construct
  source 1..20: note = Seed: SATGFKQSSKALQRPVASDF
SATGFKQQSIALIRPVASDF

SEQ ID NO: 13101 - protein, 20 aa, synthetic construct
  source 1..20: note = Seed: SATGFKQSSKALQRPVASDF
SATGFKQQSIALNRPVASDF

SEQ ID NO: 13102 - protein, 20 aa, synthetic construct
  source 1..20: note = Seed: SATGFKQSSKALQRPVASDF
SATGFKQQSIALPRPVASDF

SEQ ID NO: 13103 - protein, 20 aa, synthetic construct
  source 1..20: note = Seed: SATGFKQSSKALQRPVASDF
SATGFKQQSIALQRPVASDF

SEQ ID NO: 13104 - protein, 20 aa, synthetic construct
  source 1..20: note = Seed: SATGFKQSSKALQRPVASDF
SATGFKQQSIALSRPVASDF

SEQ ID NO: 13105 - protein, 20 aa, synthetic construct
  source 1..20: note = Seed: SATGFKQSSKALQRPVASDF
SATGFKQQSIALTRPVASDF

SEQ ID NO: 13106 - protein, 20 aa, synthetic construct
  source 1..20: note = Seed: SATGFKQSSKALQRPVASDF
SATGFKQQSIALVRPVASDF

SEQ ID NO: 13107 - protein, 20 aa, synthetic construct
  source 1..20: note = Seed: SATGFKQSSKALQRPVASDF
SATGFKQQSIALYRPVASDF

SEQ ID NO: 13108 - protein, 20 aa, synthetic construct
  source 1..20: note = Seed: SATGFKQSSKALQRPVASDF
SATGFKQQSKALARPVASDF

SEQ ID NO: 13109 - protein, 20 aa, synthetic construct
  source 1..20: note = Seed: SATGFKQSSKALQRPVASDF
SATGFKQQSKALGRPVASDF

SEQ ID NO: 13110 - protein, 20 aa, synthetic construct
  source 1..20: note = Seed: SATGFKQSSKALQRPVASDF
SATGFKQQSKALHRPVASDF

SEQ ID NO: 13111 - protein, 20 aa, synthetic construct
  source 1..20: note = Seed: SATGFKQSSKALQRPVASDF
SATGFKQQSKALMRPVASDF

SEQ ID NO: 13112 - protein, 20 aa, synthetic construct
  source 1..20: note = Seed: SATGFKQSSKALQRPVASDF
SATGFKQQSKALNRPVASDF

SEQ ID NO: 13113 - protein, 20 aa, synthetic construct
  source 1..20: note = Seed: SATGFKQSSKALQRPVASDF
SATGFKQQSKALQRPVASDF

SEQ ID NO: 13114 - protein, 20 aa, synthetic construct
  source 1..20: note = Seed: SATGFKQSSKALQRPVASDF
SATGFKQQSKALRRPVASDF

SEQ ID NO: 13115 - protein, 20 aa, synthetic construct
  source 1..20: note = Seed: SATGFKQSSKALQRPVASDF
SATGFKQQSKALSRPVASDF

SEQ ID NO: 13116 - protein, 20 aa, synthetic construct
  source 1..20: note = Seed: SATGFKQSSKALQRPVASDF
SATGFKQQSKALTRPVASDF

SEQ ID NO: 13117 - protein, 20 aa, synthetic construct
  source 1..20: note = Seed: SATGFKQSSKALQRPVASDF
SATGFKQQSKALVRPVASDF

SEQ ID NO: 13118 - protein, 20 aa, synthetic construct
  source 1..20: note = Seed: SATGFKQSSKALQRPVASDF
SATGFKQQSLALARPVASDF

SEQ ID NO: 13119 - protein, 20 aa, synthetic construct
  source 1..20: note = Seed: SATGFKQSSKALQRPVASDF
SATGFKQQSLALCRPVASDF

SEQ ID NO: 13120 - protein, 20 aa, synthetic construct
  source 1..20: note = Seed: SATGFKQSSKALQRPVASDF
SATGFKQQSLALGRPVASDF

SEQ ID NO: 13121 - protein, 20 aa, synthetic construct
  source 1..20: note = Seed: SATGFKQSSKALQRPVASDF
SATGFKQQSLALHRPVASDF

SEQ ID NO: 13122 - protein, 20 aa, synthetic construct
  source 1..20: note = Seed: SATGFKQSSKALQRPVASDF
SATGFKQQSLALIRPVASDF

SEQ ID NO: 13123 - protein, 20 aa, synthetic construct
  source 1..20: note = Seed: SATGFKQSSKALQRPVASDF
SATGFKQQSLALLRPVASDF

SEQ ID NO: 13124 - protein, 20 aa, synthetic construct
  source 1..20: note = Seed: SATGFKQSSKALQRPVASDF
SATGFKQQSLALNRPVASDF

SEQ ID NO: 13125 - protein, 20 aa, synthetic construct
  source 1..20: note = Seed: SATGFKQSSKALQRPVASDF
SATGFKQQSLALSRPVASDF

SEQ ID NO: 13126 - protein, 20 aa, synthetic construct
  source 1..20: note = Seed: SATGFKQSSKALQRPVASDF
SATGFKQQSLALTRPVASDF

SEQ ID NO: 13127 - protein, 20 aa, synthetic construct
  source 1..20: note = Seed: SATGFKQSSKALQRPVASDF
SATGFKQQSLALVRPVASDF

SEQ ID NO: 13128 - protein, 20 aa, synthetic construct
  source 1..20: note = Seed: SATGFKQSSKALQRPVASDF
SATGFKQQSMALARPVASDF

SEQ ID NO: 13129 - protein, 20 aa, synthetic construct
  source 1..20: note = Seed: SATGFKQSSKALQRPVASDF
SATGFKQQSMALGRPVASDF

SEQ ID NO: 13130 - protein, 20 aa, synthetic construct
  source 1..20: note = Seed: SATGFKQSSKALQRPVASDF
SATGFKQQSMALHRPVASDF

SEQ ID NO: 13131 - protein, 20 aa, synthetic construct
  source 1..20: note = Seed: SATGFKQSSKALQRPVASDF
SATGFKQQSMALIRPVASDF

SEQ ID NO: 13132 - protein, 20 aa, synthetic construct
  source 1..20: note = Seed: SATGFKQSSKALQRPVASDF
SATGFKQQSMALNRPVASDF

SEQ ID NO: 13133 - protein, 20 aa, synthetic construct
  source 1..20: note = Seed: SATGFKQSSKALQRPVASDF
SATGFKQQSMALSRPVASDF

SEQ ID NO: 13134 - protein, 20 aa, synthetic construct
  source 1..20: note = Seed: SATGFKQSSKALQRPVASDF
SATGFKQQSMALTRPVASDF

SEQ ID NO: 13135 - protein, 20 aa, synthetic construct
  source 1..20: note = Seed: SATGFKQSSKALQRPVASDF
SATGFKQQSMALVRPVASDF

SEQ ID NO: 13136 - protein, 20 aa, synthetic construct
  source 1..20: note = Seed: SATGFKQSSKALQRPVASDF
SATGFKQQSNALARPVASDF

SEQ ID NO: 13137 - protein, 20 aa, synthetic construct
  source 1..20: note = Seed: SATGFKQSSKALQRPVASDF
SATGFKQQSNALCRPVASDF

SEQ ID NO: 13138 - protein, 20 aa, synthetic construct
  source 1..20: note = Seed: SATGFKQSSKALQRPVASDF
SATGFKQQSNALFRPVASDF

SEQ ID NO: 13139 - protein, 20 aa, synthetic construct
  source 1..20: note = Seed: SATGFKQSSKALQRPVASDF
SATGFKQQSNALGRPVASDF

SEQ ID NO: 13140 - protein, 20 aa, synthetic construct
  source 1..20: note = Seed: SATGFKQSSKALQRPVASDF
SATGFKQQSNALIRPVASDF

SEQ ID NO: 13141 - protein, 20 aa, synthetic construct
  source 1..20: note = Seed: SATGFKQSSKALQRPVASDF
SATGFKQQSNALLRPVASDF

SEQ ID NO: 13142 - protein, 20 aa, synthetic construct
  source 1..20: note = Seed: SATGFKQSSKALQRPVASDF
SATGFKQQSNALMRPVASDF

SEQ ID NO: 13143 - protein, 20 aa, synthetic construct
  source 1..20: note = Seed: SATGFKQSSKALQRPVASDF
SATGFKQQSNALNRPVASDF

SEQ ID NO: 13144 - protein, 20 aa, synthetic construct
  source 1..20: note = Seed: SATGFKQSSKALQRPVASDF
SATGFKQQSNALQRPVASDF

SEQ ID NO: 13145 - protein, 20 aa, synthetic construct
  source 1..20: note = Seed: SATGFKQSSKALQRPVASDF
SATGFKQQSNALSRPVASDF

SEQ ID NO: 13146 - protein, 20 aa, synthetic construct
  source 1..20: note = Seed: SATGFKQSSKALQRPVASDF
SATGFKQQSNALTRPVASDF

SEQ ID NO: 13147 - protein, 20 aa, synthetic construct
  source 1..20: note = Seed: SATGFKQSSKALQRPVASDF
SATGFKQQSNALVRPVASDF

SEQ ID NO: 13148 - protein, 20 aa, synthetic construct
  source 1..20: note = Seed: SATGFKQSSKALQRPVASDF
SATGFKQQSPALARPVASDF

SEQ ID NO: 13149 - protein, 20 aa, synthetic construct
  source 1..20: note = Seed: SATGFKQSSKALQRPVASDF
SATGFKQQSPALCRPVASDF

SEQ ID NO: 13150 - protein, 20 aa, synthetic construct
  source 1..20: note = Seed: SATGFKQSSKALQRPVASDF
SATGFKQQSPALDRPVASDF

SEQ ID NO: 13151 - protein, 20 aa, synthetic construct
  source 1..20: note = Seed: SATGFKQSSKALQRPVASDF
SATGFKQQSPALERPVASDF

SEQ ID NO: 13152 - protein, 20 aa, synthetic construct
  source 1..20: note = Seed: SATGFKQSSKALQRPVASDF
SATGFKQQSPALFRPVASDF

SEQ ID NO: 13153 - protein, 20 aa, synthetic construct
  source 1..20: note = Seed: SATGFKQSSKALQRPVASDF
SATGFKQQSPALGRPVASDF

SEQ ID NO: 13154 - protein, 20 aa, synthetic construct
  source 1..20: note = Seed: SATGFKQSSKALQRPVASDF
SATGFKQQSPALHRPVASDF

SEQ ID NO: 13155 - protein, 20 aa, synthetic construct
  source 1..20: note = Seed: SATGFKQSSKALQRPVASDF
SATGFKQQSPALIRPVASDF

SEQ ID NO: 13156 - protein, 20 aa, synthetic construct
  source 1..20: note = Seed: SATGFKQSSKALQRPVASDF
SATGFKQQSPALLRPVASDF

SEQ ID NO: 13157 - protein, 20 aa, synthetic construct
  source 1..20: note = Seed: SATGFKQSSKALQRPVASDF
SATGFKQQSPALMRPVASDF

SEQ ID NO: 13158 - protein, 20 aa, synthetic construct
  source 1..20: note = Seed: SATGFKQSSKALQRPVASDF
SATGFKQQSPALNRPVASDF

SEQ ID NO: 13159 - protein, 20 aa, synthetic construct
  source 1..20: note = Seed: SATGFKQSSKALQRPVASDF
SATGFKQQSPALPRPVASDF

SEQ ID NO: 13160 - protein, 20 aa, synthetic construct
  source 1..20: note = Seed: SATGFKQSSKALQRPVASDF
SATGFKQQSPALQRPVASDF

SEQ ID NO: 13161 - protein, 20 aa, synthetic construct
  source 1..20: note = Seed: SATGFKQSSKALQRPVASDF
SATGFKQQSPALSRPVASDF

SEQ ID NO: 13162 - protein, 20 aa, synthetic construct
  source 1..20: note = Seed: SATGFKQSSKALQRPVASDF
SATGFKQQSPALTRPVASDF

SEQ ID NO: 13163 - protein, 20 aa, synthetic construct
  source 1..20: note = Seed: SATGFKQSSKALQRPVASDF
SATGFKQQSPALVRPVASDF

SEQ ID NO: 13164 - protein, 20 aa, synthetic construct
  source 1..20: note = Seed: SATGFKQSSKALQRPVASDF
SATGFKQQSPALWRPVASDF

SEQ ID NO: 13165 - protein, 20 aa, synthetic construct
  source 1..20: note = Seed: SATGFKQSSKALQRPVASDF
SATGFKQQSPALYRPVASDF

SEQ ID NO: 13166 - protein, 20 aa, synthetic construct
  source 1..20: note = Seed: SATGFKQSSKALQRPVASDF
SATGFKQQSQALARPVASDF

SEQ ID NO: 13167 - protein, 20 aa, synthetic construct
  source 1..20: note = Seed: SATGFKQSSKALQRPVASDF
SATGFKQQSQALLRPVASDF

SEQ ID NO: 13168 - protein, 20 aa, synthetic construct
  source 1..20: note = Seed: SATGFKQSSKALQRPVASDF
SATGFKQQSQALVRPVASDF

SEQ ID NO: 13169 - protein, 20 aa, synthetic construct
  source 1..20: note = Seed: SATGFKQSSKALQRPVASDF
SATGFKQQSRALARPVASDF

SEQ ID NO: 13170 - protein, 20 aa, synthetic construct
  source 1..20: note = Seed: SATGFKQSSKALQRPVASDF
SATGFKQQSRALGRPVASDF

SEQ ID NO: 13171 - protein, 20 aa, synthetic construct
  source 1..20: note = Seed: SATGFKQSSKALQRPVASDF
SATGFKQQSRALHRPVASDF

SEQ ID NO: 13172 - protein, 20 aa, synthetic construct
  source 1..20: note = Seed: SATGFKQSSKALQRPVASDF
SATGFKQQSRALIRPVASDF

SEQ ID NO: 13173 - protein, 20 aa, synthetic construct
  source 1..20: note = Seed: SATGFKQSSKALQRPVASDF
SATGFKQQSRALKRPVASDF

SEQ ID NO: 13174 - protein, 20 aa, synthetic construct
  source 1..20: note = Seed: SATGFKQSSKALQRPVASDF
SATGFKQQSRALMRPVASDF

SEQ ID NO: 13175 - protein, 20 aa, synthetic construct
  source 1..20: note = Seed: SATGFKQSSKALQRPVASDF
SATGFKQQSRALNRPVASDF

SEQ ID NO: 13176 - protein, 20 aa, synthetic construct
  source 1..20: note = Seed: SATGFKQSSKALQRPVASDF
SATGFKQQSRALPRPVASDF

SEQ ID NO: 13177 - protein, 20 aa, synthetic construct
  source 1..20: note = Seed: SATGFKQSSKALQRPVASDF
SATGFKQQSRALQRPVASDF

SEQ ID NO: 13178 - protein, 20 aa, synthetic construct
  source 1..20: note = Seed: SATGFKQSSKALQRPVASDF
SATGFKQQSRALRRPVASDF

SEQ ID NO: 13179 - protein, 20 aa, synthetic construct
  source 1..20: note = Seed: SATGFKQSSKALQRPVASDF
SATGFKQQSRALSRPVASDF

SEQ ID NO: 13180 - protein, 20 aa, synthetic construct
  source 1..20: note = Seed: SATGFKQSSKALQRPVASDF
SATGFKQQSRALTRPVASDF

SEQ ID NO: 13181 - protein, 20 aa, synthetic construct
  source 1..20: note = Seed: SATGFKQSSKALQRPVASDF
SATGFKQQSRALVRPVASDF

SEQ ID NO: 13182 - protein, 20 aa, synthetic construct
  source 1..20: note = Seed: SATGFKQSSKALQRPVASDF
SATGFKQQSSALARPVASDF

SEQ ID NO: 13183 - protein, 20 aa, synthetic construct
  source 1..20: note = Seed: SATGFKQSSKALQRPVASDF
SATGFKQQSSALCRPVASDF

SEQ ID NO: 13184 - protein, 20 aa, synthetic construct
  source 1..20: note = Seed: SATGFKQSSKALQRPVASDF
SATGFKQQSSALDRPVASDF

SEQ ID NO: 13185 - protein, 20 aa, synthetic construct
  source 1..20: note = Seed: SATGFKQSSKALQRPVASDF
SATGFKQQSSALERPVASDF

SEQ ID NO: 13186 - protein, 20 aa, synthetic construct
  source 1..20: note = Seed: SATGFKQSSKALQRPVASDF
SATGFKQQSSALFRPVASDF

SEQ ID NO: 13187 - protein, 20 aa, synthetic construct
  source 1..20: note = Seed: SATGFKQSSKALQRPVASDF
SATGFKQQSSALGRPVASDF

SEQ ID NO: 13188 - protein, 20 aa, synthetic construct
  source 1..20: note = Seed: SATGFKQSSKALQRPVASDF
SATGFKQQSSALHRPVASDF

SEQ ID NO: 13189 - protein, 20 aa, synthetic construct
  source 1..20: note = Seed: SATGFKQSSKALQRPVASDF
SATGFKQQSSALIRPVASDF

SEQ ID NO: 13190 - protein, 20 aa, synthetic construct
  source 1..20: note = Seed: SATGFKQSSKALQRPVASDF
SATGFKQQSSALLRPVASDF

SEQ ID NO: 13191 - protein, 20 aa, synthetic construct
  source 1..20: note = Seed: SATGFKQSSKALQRPVASDF
SATGFKQQSSALMRPVASDF

SEQ ID NO: 13192 - protein, 20 aa, synthetic construct
  source 1..20: note = Seed: SATGFKQSSKALQRPVASDF
SATGFKQQSSALNRPVASDF

SEQ ID NO: 13193 - protein, 20 aa, synthetic construct
  source 1..20: note = Seed: SATGFKQSSKALQRPVASDF
SATGFKQQSSALPRPVASDF

SEQ ID NO: 13194 - protein, 20 aa, synthetic construct
  source 1..20: note = Seed: SATGFKQSSKALQRPVASDF
SATGFKQQSSALQRPVASDF

SEQ ID NO: 13195 - protein, 20 aa, synthetic construct
  source 1..20: note = Seed: SATGFKQSSKALQRPVASDF
SATGFKQQSSALSRPVASDF

SEQ ID NO: 13196 - protein, 20 aa, synthetic construct
  source 1..20: note = Seed: SATGFKQSSKALQRPVASDF
SATGFKQQSSALTRPVASDF

SEQ ID NO: 13197 - protein, 20 aa, synthetic construct
  source 1..20: note = Seed: SATGFKQSSKALQRPVASDF
SATGFKQQSSALVRPVASDF

SEQ ID NO: 13198 - protein, 20 aa, synthetic construct
  source 1..20: note = Seed: SATGFKQSSKALQRPVASDF
SATGFKQQSSALYRPVASDF

SEQ ID NO: 13199 - protein, 20 aa, synthetic construct
  source 1..20: note = Seed: SATGFKQSSKALQRPVASDF
SATGFKQQSTALARPVASDF

SEQ ID NO: 13200 - protein, 20 aa, synthetic construct
  source 1..20: note = Seed: SATGFKQSSKALQRPVASDF
SATGFKQQSTALCRPVASDF

SEQ ID NO: 13201 - protein, 20 aa, synthetic construct
  source 1..20: note = Seed: SATGFKQSSKALQRPVASDF
SATGFKQQSTALDRPVASDF

SEQ ID NO: 13202 - protein, 20 aa, synthetic construct
  source 1..20: note = Seed: SATGFKQSSKALQRPVASDF
SATGFKQQSTALERPVASDF

SEQ ID NO: 13203 - protein, 20 aa, synthetic construct
  source 1..20: note = Seed: SATGFKQSSKALQRPVASDF
SATGFKQQSTALFRPVASDF

SEQ ID NO: 13204 - protein, 20 aa, synthetic construct
  source 1..20: note = Seed: SATGFKQSSKALQRPVASDF
SATGFKQQSTALGRPVASDF

SEQ ID NO: 13205 - protein, 20 aa, synthetic construct
  source 1..20: note = Seed: SATGFKQSSKALQRPVASDF
SATGFKQQSTALHRPVASDF

SEQ ID NO: 13206 - protein, 20 aa, synthetic construct
  source 1..20: note = Seed: SATGFKQSSKALQRPVASDF
SATGFKQQSTALIRPVASDF

SEQ ID NO: 13207 - protein, 20 aa, synthetic construct
  source 1..20: note = Seed: SATGFKQSSKALQRPVASDF
SATGFKQQSTALLRPVASDF

SEQ ID NO: 13208 - protein, 20 aa, synthetic construct
  source 1..20: note = Seed: SATGFKQSSKALQRPVASDF
SATGFKQQSTALMRPVASDF

SEQ ID NO: 13209 - protein, 20 aa, synthetic construct
  source 1..20: note = Seed: SATGFKQSSKALQRPVASDF
SATGFKQQSTALNRPVASDF

SEQ ID NO: 13210 - protein, 20 aa, synthetic construct
  source 1..20: note = Seed: SATGFKQSSKALQRPVASDF
SATGFKQQSTALPRPVASDF

SEQ ID NO: 13211 - protein, 20 aa, synthetic construct
  source 1..20: note = Seed: SATGFKQSSKALQRPVASDF
SATGFKQQSTALQRPVASDF

SEQ ID NO: 13212 - protein, 20 aa, synthetic construct
  source 1..20: note = Seed: SATGFKQSSKALQRPVASDF
SATGFKQQSTALSRPVASDF

SEQ ID NO: 13213 - protein, 20 aa, synthetic construct
  source 1..20: note = Seed: SATGFKQSSKALQRPVASDF
SATGFKQQSTALTRPVASDF

SEQ ID NO: 13214 - protein, 20 aa, synthetic construct
  source 1..20: note = Seed: SATGFKQSSKALQRPVASDF
SATGFKQQSTALVRPVASDF

SEQ ID NO: 13215 - protein, 20 aa, synthetic construct
  source 1..20: note = Seed: SATGFKQSSKALQRPVASDF
SATGFKQQSVALARPVASDF

SEQ ID NO: 13216 - protein, 20 aa, synthetic construct
  source 1..20: note = Seed: SATGFKQSSKALQRPVASDF
SATGFKQQSVALCRPVASDF

SEQ ID NO: 13217 - protein, 20 aa, synthetic construct
  source 1..20: note = Seed: SATGFKQSSKALQRPVASDF
SATGFKQQSVALDRPVASDF

SEQ ID NO: 13218 - protein, 20 aa, synthetic construct
  source 1..20: note = Seed: SATGFKQSSKALQRPVASDF
SATGFKQQSVALERPVASDF

SEQ ID NO: 13219 - protein, 20 aa, synthetic construct
  source 1..20: note = Seed: SATGFKQSSKALQRPVASDF
SATGFKQQSVALFRPVASDF

SEQ ID NO: 13220 - protein, 20 aa, synthetic construct
  source 1..20: note = Seed: SATGFKQSSKALQRPVASDF
SATGFKQQSVALGRPVASDF

SEQ ID NO: 13221 - protein, 20 aa, synthetic construct
  source 1..20: note = Seed: SATGFKQSSKALQRPVASDF
SATGFKQQSVALHRPVASDF

SEQ ID NO: 13222 - protein, 20 aa, synthetic construct
  source 1..20: note = Seed: SATGFKQSSKALQRPVASDF
SATGFKQQSVALIRPVASDF

SEQ ID NO: 13223 - protein, 20 aa, synthetic construct
  source 1..20: note = Seed: SATGFKQSSKALQRPVASDF
SATGFKQQSVALLRPVASDF

SEQ ID NO: 13224 - protein, 20 aa, synthetic construct
  source 1..20: note = Seed: SATGFKQSSKALQRPVASDF
SATGFKQQSVALMRPVASDF

SEQ ID NO: 13225 - protein, 20 aa, synthetic construct
  source 1..20: note = Seed: SATGFKQSSKALQRPVASDF
SATGFKQQSVALNRPVASDF

SEQ ID NO: 13226 - protein, 20 aa, synthetic construct
  source 1..20: note = Seed: SATGFKQSSKALQRPVASDF
SATGFKQQSVALPRPVASDF

SEQ ID NO: 13227 - protein, 20 aa, synthetic construct
  source 1..20: note = Seed: SATGFKQSSKALQRPVASDF
SATGFKQQSVALQRPVASDF

SEQ ID NO: 13228 - protein, 20 aa, synthetic construct
  source 1..20: note = Seed: SATGFKQSSKALQRPVASDF
SATGFKQQSVALSRPVASDF

SEQ ID NO: 13229 - protein, 20 aa, synthetic construct
  source 1..20: note = Seed: SATGFKQSSKALQRPVASDF
SATGFKQQSVALTRPVASDF

SEQ ID NO: 13230 - protein, 20 aa, synthetic construct
  source 1..20: note = Seed: SATGFKQSSKALQRPVASDF
SATGFKQQSVALVRPVASDF

SEQ ID NO: 13231 - protein, 20 aa, synthetic construct
  source 1..20: note = Seed: SATGFKQSSKALQRPVASDF
SATGFKQQSVALWRPVASDF

SEQ ID NO: 13232 - protein, 20 aa, synthetic construct
  source 1..20: note = Seed: SATGFKQSSKALQRPVASDF
SATGFKQQSVALYRPVASDF

SEQ ID NO: 13233 - protein, 20 aa, synthetic construct
  source 1..20: note = Seed: SATGFKQSSKALQRPVASDF
SATGFKQRSAALARPVASDF

SEQ ID NO: 13234 - protein, 20 aa, synthetic construct
  source 1..20: note = Seed: SATGFKQSSKALQRPVASDF
SATGFKQRSAALIRPVASDF

SEQ ID NO: 13235 - protein, 20 aa, synthetic construct
  source 1..20: note = Seed: SATGFKQSSKALQRPVASDF
SATGFKQRSAALLRPVASDF

SEQ ID NO: 13236 - protein, 20 aa, synthetic construct
  source 1..20: note = Seed: SATGFKQSSKALQRPVASDF
SATGFKQRSAALMRPVASDF

SEQ ID NO: 13237 - protein, 20 aa, synthetic construct
  source 1..20: note = Seed: SATGFKQSSKALQRPVASDF
SATGFKQRSAALVRPVASDF

SEQ ID NO: 13238 - protein, 20 aa, synthetic construct
  source 1..20: note = Seed: SATGFKQSSKALQRPVASDF
SATGFKQRSFALVRPVASDF

SEQ ID NO: 13239 - protein, 20 aa, synthetic construct
  source 1..20: note = Seed: SATGFKQSSKALQRPVASDF
SATGFKQRSGALARPVASDF

SEQ ID NO: 13240 - protein, 20 aa, synthetic construct
  source 1..20: note = Seed: SATGFKQSSKALQRPVASDF
SATGFKQRSGALIRPVASDF

SEQ ID NO: 13241 - protein, 20 aa, synthetic construct
  source 1..20: note = Seed: SATGFKQSSKALQRPVASDF
SATGFKQRSGALLRPVASDF

SEQ ID NO: 13242 - protein, 20 aa, synthetic construct
  source 1..20: note = Seed: SATGFKQSSKALQRPVASDF
SATGFKQRSGALVRPVASDF

SEQ ID NO: 13243 - protein, 20 aa, synthetic construct
  source 1..20: note = Seed: SATGFKQSSKALQRPVASDF
SATGFKQRSIALARPVASDF

SEQ ID NO: 13244 - protein, 20 aa, synthetic construct
  source 1..20: note = Seed: SATGFKQSSKALQRPVASDF
SATGFKQRSIALRRPVASDF

SEQ ID NO: 13245 - protein, 20 aa, synthetic construct
  source 1..20: note = Seed: SATGFKQSSKALQRPVASDF
SATGFKQRSKALARPVASDF

SEQ ID NO: 13246 - protein, 20 aa, synthetic construct
  source 1..20: note = Seed: SATGFKQSSKALQRPVASDF
SATGFKQRSKALSRPVASDF

SEQ ID NO: 13247 - protein, 20 aa, synthetic construct
  source 1..20: note = Seed: SATGFKQSSKALQRPVASDF
SATGFKQRSRALARPVASDF

SEQ ID NO: 13248 - protein, 20 aa, synthetic construct
  source 1..20: note = Seed: SATGFKQSSKALQRPVASDF
SATGFKQRSRALRRPVASDF

SEQ ID NO: 13249 - protein, 20 aa, synthetic construct
  source 1..20: note = Seed: SATGFKQSSKALQRPVASDF
SATGFKQRSRALSRPVASDF

SEQ ID NO: 13250 - protein, 20 aa, synthetic construct
  source 1..20: note = Seed: SATGFKQSSKALQRPVASDF
SATGFKQRSSALARPVASDF

SEQ ID NO: 13251 - protein, 20 aa, synthetic construct
  source 1..20: note = Seed: SATGFKQSSKALQRPVASDF
SATGFKQRSSALIRPVASDF

SEQ ID NO: 13252 - protein, 20 aa, synthetic construct
  source 1..20: note = Seed: SATGFKQSSKALQRPVASDF
SATGFKQRSSALLRPVASDF

SEQ ID NO: 13253 - protein, 20 aa, synthetic construct
  source 1..20: note = Seed: SATGFKQSSKALQRPVASDF
SATGFKQRSSALVRPVASDF

SEQ ID NO: 13254 - protein, 20 aa, synthetic construct
  source 1..20: note = Seed: SATGFKQSSKALQRPVASDF
SATGFKQRSVALNRPVASDF

SEQ ID NO: 13255 - protein, 20 aa, synthetic construct
  source 1..20: note = Seed: SATGFKQSSKALQRPVASDF
SATGFKQRSVALSRPVASDF

SEQ ID NO: 13256 - protein, 20 aa, synthetic construct
  source 1..20: note = Seed: SATGFKQSSKALQRPVASDF
SATGFKQRSVALVRPVASDF

SEQ ID NO: 13257 - protein, 20 aa, synthetic construct
  source 1..20: note = Seed: SATGFKQSSKALQRPVASDF
SATGFKQSSAALARPVASDF

SEQ ID NO: 13258 - protein, 20 aa, synthetic construct
  source 1..20: note = Seed: SATGFKQSSKALQRPVASDF
SATGFKQSSAALCRPVASDF

SEQ ID NO: 13259 - protein, 20 aa, synthetic construct
  source 1..20: note = Seed: SATGFKQSSKALQRPVASDF
SATGFKQSSAALDRPVASDF

SEQ ID NO: 13260 - protein, 20 aa, synthetic construct
  source 1..20: note = Seed: SATGFKQSSKALQRPVASDF
SATGFKQSSAALERPVASDF

SEQ ID NO: 13261 - protein, 20 aa, synthetic construct
  source 1..20: note = Seed: SATGFKQSSKALQRPVASDF
SATGFKQSSAALFRPVASDF

SEQ ID NO: 13262 - protein, 20 aa, synthetic construct
  source 1..20: note = Seed: SATGFKQSSKALQRPVASDF
SATGFKQSSAALGRPVASDF

SEQ ID NO: 13263 - protein, 20 aa, synthetic construct
  source 1..20: note = Seed: SATGFKQSSKALQRPVASDF
SATGFKQSSAALHRPVASDF

SEQ ID NO: 13264 - protein, 20 aa, synthetic construct
  source 1..20: note = Seed: SATGFKQSSKALQRPVASDF
SATGFKQSSAALIRPVASDF

SEQ ID NO: 13265 - protein, 20 aa, synthetic construct
  source 1..20: note = Seed: SATGFKQSSKALQRPVASDF
SATGFKQSSAALKRPVASDF

SEQ ID NO: 13266 - protein, 20 aa, synthetic construct
  source 1..20: note = Seed: SATGFKQSSKALQRPVASDF
SATGFKQSSAALLRPVASDF

SEQ ID NO: 13267 - protein, 20 aa, synthetic construct
  source 1..20: note = Seed: SATGFKQSSKALQRPVASDF
SATGFKQSSAALMRPVASDF

SEQ ID NO: 13268 - protein, 20 aa, synthetic construct
  source 1..20: note = Seed: SATGFKQSSKALQRPVASDF
SATGFKQSSAALNRPVASDF

SEQ ID NO: 13269 - protein, 20 aa, synthetic construct
  source 1..20: note = Seed: SATGFKQSSKALQRPVASDF
SATGFKQSSAALPRPVASDF

SEQ ID NO: 13270 - protein, 20 aa, synthetic construct
  source 1..20: note = Seed: SATGFKQSSKALQRPVASDF
SATGFKQSSAALQRPVASDF

SEQ ID NO: 13271 - protein, 20 aa, synthetic construct
  source 1..20: note = Seed: SATGFKQSSKALQRPVASDF
SATGFKQSSAALRRPVASDF

SEQ ID NO: 13272 - protein, 20 aa, synthetic construct
  source 1..20: note = Seed: SATGFKQSSKALQRPVASDF
SATGFKQSSAALSRPVASDF

SEQ ID NO: 13273 - protein, 20 aa, synthetic construct
  source 1..20: note = Seed: SATGFKQSSKALQRPVASDF
SATGFKQSSAALTRPVASDF

SEQ ID NO: 13274 - protein, 20 aa, synthetic construct
  source 1..20: note = Seed: SATGFKQSSKALQRPVASDF
SATGFKQSSAALVRPVASDF

SEQ ID NO: 13275 - protein, 20 aa, synthetic construct
  source 1..20: note = Seed: SATGFKQSSKALQRPVASDF
SATGFKQSSAALWRPVASDF

SEQ ID NO: 13276 - protein, 20 aa, synthetic construct
  source 1..20: note = Seed: SATGFKQSSKALQRPVASDF
SATGFKQSSAALYRPVASDF

SEQ ID NO: 13277 - protein, 20 aa, synthetic construct
  source 1..20: note = Seed: SATGFKQSSKALQRPVASDF
SATGFKQSSCALVRPVASDF

SEQ ID NO: 13278 - protein, 20 aa, synthetic construct
  source 1..20: note = Seed: SATGFKQSSKALQRPVASDF
SATGFKQSSFALARPVASDF

SEQ ID NO: 13279 - protein, 20 aa, synthetic construct
  source 1..20: note = Seed: SATGFKQSSKALQRPVASDF
SATGFKQSSFALDRPVASDF

SEQ ID NO: 13280 - protein, 20 aa, synthetic construct
  source 1..20: note = Seed: SATGFKQSSKALQRPVASDF
SATGFKQSSFALERPVASDF

SEQ ID NO: 13281 - protein, 20 aa, synthetic construct
  source 1..20: note = Seed: SATGFKQSSKALQRPVASDF
SATGFKQSSFALFRPVASDF

SEQ ID NO: 13282 - protein, 20 aa, synthetic construct
  source 1..20: note = Seed: SATGFKQSSKALQRPVASDF
SATGFKQSSFALHRPVASDF

SEQ ID NO: 13283 - protein, 20 aa, synthetic construct
  source 1..20: note = Seed: SATGFKQSSKALQRPVASDF
SATGFKQSSFALLRPVASDF

SEQ ID NO: 13284 - protein, 20 aa, synthetic construct
  source 1..20: note = Seed: SATGFKQSSKALQRPVASDF
SATGFKQSSFALMRPVASDF

SEQ ID NO: 13285 - protein, 20 aa, synthetic construct
  source 1..20: note = Seed: SATGFKQSSKALQRPVASDF
SATGFKQSSFALNRPVASDF

SEQ ID NO: 13286 - protein, 20 aa, synthetic construct
  source 1..20: note = Seed: SATGFKQSSKALQRPVASDF
SATGFKQSSFALQRPVASDF

SEQ ID NO: 13287 - protein, 20 aa, synthetic construct
  source 1..20: note = Seed: SATGFKQSSKALQRPVASDF
SATGFKQSSFALSRPVASDF

SEQ ID NO: 13288 - protein, 20 aa, synthetic construct
  source 1..20: note = Seed: SATGFKQSSKALQRPVASDF
SATGFKQSSFALTRPVASDF

SEQ ID NO: 13289 - protein, 20 aa, synthetic construct
  source 1..20: note = Seed: SATGFKQSSKALQRPVASDF
SATGFKQSSFALVRPVASDF

SEQ ID NO: 13290 - protein, 20 aa, synthetic construct
  source 1..20: note = Seed: SATGFKQSSKALQRPVASDF
SATGFKQSSFALWRPVASDF

SEQ ID NO: 13291 - protein, 20 aa, synthetic construct
  source 1..20: note = Seed: SATGFKQSSKALQRPVASDF
SATGFKQSSFALYRPVASDF

SEQ ID NO: 13292 - protein, 20 aa, synthetic construct
  source 1..20: note = Seed: SATGFKQSSKALQRPVASDF
SATGFKQSSGALARPVASDF

SEQ ID NO: 13293 - protein, 20 aa, synthetic construct
  source 1..20: note = Seed: SATGFKQSSKALQRPVASDF
SATGFKQSSGALCRPVASDF

SEQ ID NO: 13294 - protein, 20 aa, synthetic construct
  source 1..20: note = Seed: SATGFKQSSKALQRPVASDF
SATGFKQSSGALFRPVASDF

SEQ ID NO: 13295 - protein, 20 aa, synthetic construct
  source 1..20: note = Seed: SATGFKQSSKALQRPVASDF
SATGFKQSSGALGRPVASDF

SEQ ID NO: 13296 - protein, 20 aa, synthetic construct
  source 1..20: note = Seed: SATGFKQSSKALQRPVASDF
SATGFKQSSGALIRPVASDF

SEQ ID NO: 13297 - protein, 20 aa, synthetic construct
  source 1..20: note = Seed: SATGFKQSSKALQRPVASDF
SATGFKQSSGALLRPVASDF

SEQ ID NO: 13298 - protein, 20 aa, synthetic construct
  source 1..20: note = Seed: SATGFKQSSKALQRPVASDF
SATGFKQSSGALMRPVASDF

SEQ ID NO: 13299 - protein, 20 aa, synthetic construct
  source 1..20: note = Seed: SATGFKQSSKALQRPVASDF
SATGFKQSSGALNRPVASDF

SEQ ID NO: 13300 - protein, 20 aa, synthetic construct
  source 1..20: note = Seed: SATGFKQSSKALQRPVASDF
SATGFKQSSGALSRPVASDF

SEQ ID NO: 13301 - protein, 20 aa, synthetic construct
  source 1..20: note = Seed: SATGFKQSSKALQRPVASDF
SATGFKQSSGALTRPVASDF

SEQ ID NO: 13302 - protein, 20 aa, synthetic construct
  source 1..20: note = Seed: SATGFKQSSKALQRPVASDF
SATGFKQSSGALVRPVASDF

SEQ ID NO: 13303 - protein, 20 aa, synthetic construct
  source 1..20: note = Seed: SATGFKQSSKALQRPVASDF
SATGFKQSSIALARPVASDF

SEQ ID NO: 13304 - protein, 20 aa, synthetic construct
  source 1..20: note = Seed: SATGFKQSSKALQRPVASDF
SATGFKQSSIALCRPVASDF

SEQ ID NO: 13305 - protein, 20 aa, synthetic construct
  source 1..20: note = Seed: SATGFKQSSKALQRPVASDF
SATGFKQSSIALFRPVASDF

SEQ ID NO: 13306 - protein, 20 aa, synthetic construct
  source 1..20: note = Seed: SATGFKQSSKALQRPVASDF
SATGFKQSSIALGRPVASDF

SEQ ID NO: 13307 - protein, 20 aa, synthetic construct
  source 1..20: note = Seed: SATGFKQSSKALQRPVASDF
SATGFKQSSIALHRPVASDF

SEQ ID NO: 13308 - protein, 20 aa, synthetic construct
  source 1..20: note = Seed: SATGFKQSSKALQRPVASDF
SATGFKQSSIALIRPVASDF

SEQ ID NO: 13309 - protein, 20 aa, synthetic construct
  source 1..20: note = Seed: SATGFKQSSKALQRPVASDF
SATGFKQSSIALLRPVASDF

SEQ ID NO: 13310 - protein, 20 aa, synthetic construct
  source 1..20: note = Seed: SATGFKQSSKALQRPVASDF
SATGFKQSSIALNRPVASDF

SEQ ID NO: 13311 - protein, 20 aa, synthetic construct
  source 1..20: note = Seed: SATGFKQSSKALQRPVASDF
SATGFKQSSIALSRPVASDF

SEQ ID NO: 13312 - protein, 20 aa, synthetic construct
  source 1..20: note = Seed: SATGFKQSSKALQRPVASDF
SATGFKQSSIALTRPVASDF

SEQ ID NO: 13313 - protein, 20 aa, synthetic construct
  source 1..20: note = Seed: SATGFKQSSKALQRPVASDF
SATGFKQSSIALVRPVASDF

SEQ ID NO: 13314 - protein, 20 aa, synthetic construct
  source 1..20: note = Seed: SATGFKQSSKALQRPVASDF
SATGFKQSSIALYRPVASDF

SEQ ID NO: 13315 - protein, 20 aa, synthetic construct
  source 1..20: note = Seed: SATGFKQSSKALQRPVASDF
SATGFKQSSKALARPVASDF

SEQ ID NO: 13316 - protein, 20 aa, synthetic construct
  source 1..20: note = Seed: SATGFKQSSKALQRPVASDF
SATGFKQSSKALGRPVASDF

SEQ ID NO: 13317 - protein, 20 aa, synthetic construct
  source 1..20: note = Seed: SATGFKQSSKALQRPVASDF
SATGFKQSSKALHRPVASDF

SEQ ID NO: 13318 - protein, 20 aa, synthetic construct
  source 1..20: note = Seed: SATGFKQSSKALQRPVASDF
SATGFKQSSKALIRPVASDF

SEQ ID NO: 13319 - protein, 20 aa, synthetic construct
  source 1..20: note = Seed: SATGFKQSSKALQRPVASDF
SATGFKQSSKALKRPVASDF

SEQ ID NO: 13320 - protein, 20 aa, synthetic construct
  source 1..20: note = Seed: SATGFKQSSKALQRPVASDF
SATGFKQSSKALMRPVASDF

SEQ ID NO: 13321 - protein, 20 aa, synthetic construct
  source 1..20: note = Seed: SATGFKQSSKALQRPVASDF
SATGFKQSSKALNRPVASDF

SEQ ID NO: 13322 - protein, 20 aa, synthetic construct
  source 1..20: note = Seed: SATGFKQSSKALQRPVASDF
SATGFKQSSKALRRPVASDF

SEQ ID NO: 13323 - protein, 20 aa, synthetic construct
  source 1..20: note = Seed: SATGFKQSSKALQRPVASDF
SATGFKQSSKALSRPVASDF

SEQ ID NO: 13324 - protein, 20 aa, synthetic construct
  source 1..20: note = Seed: SATGFKQSSKALQRPVASDF
SATGFKQSSKALTRPVASDF

SEQ ID NO: 13325 - protein, 20 aa, synthetic construct
  source 1..20: note = Seed: SATGFKQSSKALQRPVASDF
SATGFKQSSKALVRPVASDF

SEQ ID NO: 13326 - protein, 20 aa, synthetic construct
  source 1..20: note = Seed: SATGFKQSSKALQRPVASDF
SATGFKQSSLALFRPVASDF

SEQ ID NO: 13327 - protein, 20 aa, synthetic construct
  source 1..20: note = Seed: SATGFKQSSKALQRPVASDF
SATGFKQSSLALGRPVASDF

SEQ ID NO: 13328 - protein, 20 aa, synthetic construct
  source 1..20: note = Seed: SATGFKQSSKALQRPVASDF
SATGFKQSSLALHRPVASDF

SEQ ID NO: 13329 - protein, 20 aa, synthetic construct
  source 1..20: note = Seed: SATGFKQSSKALQRPVASDF
SATGFKQSSLALIRPVASDF

SEQ ID NO: 13330 - protein, 20 aa, synthetic construct
  source 1..20: note = Seed: SATGFKQSSKALQRPVASDF
SATGFKQSSLALLRPVASDF

SEQ ID NO: 13331 - protein, 20 aa, synthetic construct
  source 1..20: note = Seed: SATGFKQSSKALQRPVASDF
SATGFKQSSLALMRPVASDF

SEQ ID NO: 13332 - protein, 20 aa, synthetic construct
  source 1..20: note = Seed: SATGFKQSSKALQRPVASDF
SATGFKQSSLALNRPVASDF

SEQ ID NO: 13333 - protein, 20 aa, synthetic construct
  source 1..20: note = Seed: SATGFKQSSKALQRPVASDF
SATGFKQSSLALSRPVASDF

SEQ ID NO: 13334 - protein, 20 aa, synthetic construct
  source 1..20: note = Seed: SATGFKQSSKALQRPVASDF
SATGFKQSSLALTRPVASDF

SEQ ID NO: 13335 - protein, 20 aa, synthetic construct
  source 1..20: note = Seed: SATGFKQSSKALQRPVASDF
SATGFKQSSLALVRPVASDF

SEQ ID NO: 13336 - protein, 20 aa, synthetic construct
  source 1..20: note = Seed: SATGFKQSSKALQRPVASDF
SATGFKQSSMALHRPVASDF

SEQ ID NO: 13337 - protein, 20 aa, synthetic construct
  source 1..20: note = Seed: SATGFKQSSKALQRPVASDF
SATGFKQSSMALIRPVASDF

SEQ ID NO: 13338 - protein, 20 aa, synthetic construct
  source 1..20: note = Seed: SATGFKQSSKALQRPVASDF
SATGFKQSSMALNRPVASDF

SEQ ID NO: 13339 - protein, 20 aa, synthetic construct
  source 1..20: note = Seed: SATGFKQSSKALQRPVASDF
SATGFKQSSMALSRPVASDF

SEQ ID NO: 13340 - protein, 20 aa, synthetic construct
  source 1..20: note = Seed: SATGFKQSSKALQRPVASDF
SATGFKQSSMALTRPVASDF

SEQ ID NO: 13341 - protein, 20 aa, synthetic construct
  source 1..20: note = Seed: SATGFKQSSKALQRPVASDF
SATGFKQSSMALVRPVASDF

SEQ ID NO: 13342 - protein, 20 aa, synthetic construct
  source 1..20: note = Seed: SATGFKQSSKALQRPVASDF
SATGFKQSSNALARPVASDF

SEQ ID NO: 13343 - protein, 20 aa, synthetic construct
  source 1..20: note = Seed: SATGFKQSSKALQRPVASDF
SATGFKQSSNALGRPVASDF

SEQ ID NO: 13344 - protein, 20 aa, synthetic construct
  source 1..20: note = Seed: SATGFKQSSKALQRPVASDF
SATGFKQSSNALIRPVASDF

SEQ ID NO: 13345 - protein, 20 aa, synthetic construct
  source 1..20: note = Seed: SATGFKQSSKALQRPVASDF
SATGFKQSSNALLRPVASDF

SEQ ID NO: 13346 - protein, 20 aa, synthetic construct
  source 1..20: note = Seed: SATGFKQSSKALQRPVASDF
SATGFKQSSNALMRPVASDF

SEQ ID NO: 13347 - protein, 20 aa, synthetic construct
  source 1..20: note = Seed: SATGFKQSSKALQRPVASDF
SATGFKQSSNALNRPVASDF

SEQ ID NO: 13348 - protein, 20 aa, synthetic construct
  source 1..20: note = Seed: SATGFKQSSKALQRPVASDF
SATGFKQSSNALSRPVASDF

SEQ ID NO: 13349 - protein, 20 aa, synthetic construct
  source 1..20: note = Seed: SATGFKQSSKALQRPVASDF
SATGFKQSSNALTRPVASDF

SEQ ID NO: 13350 - protein, 20 aa, synthetic construct
  source 1..20: note = Seed: SATGFKQSSKALQRPVASDF
SATGFKQSSNALVRPVASDF

SEQ ID NO: 13351 - protein, 20 aa, synthetic construct
  source 1..20: note = Seed: SATGFKQSSKALQRPVASDF
SATGFKQSSPALARPVASDF

SEQ ID NO: 13352 - protein, 20 aa, synthetic construct
  source 1..20: note = Seed: SATGFKQSSKALQRPVASDF
SATGFKQSSPALCRPVASDF

SEQ ID NO: 13353 - protein, 20 aa, synthetic construct
  source 1..20: note = Seed: SATGFKQSSKALQRPVASDF
SATGFKQSSPALERPVASDF

SEQ ID NO: 13354 - protein, 20 aa, synthetic construct
  source 1..20: note = Seed: SATGFKQSSKALQRPVASDF
SATGFKQSSPALFRPVASDF

SEQ ID NO: 13355 - protein, 20 aa, synthetic construct
  source 1..20: note = Seed: SATGFKQSSKALQRPVASDF
SATGFKQSSPALGRPVASDF

SEQ ID NO: 13356 - protein, 20 aa, synthetic construct
  source 1..20: note = Seed: SATGFKQSSKALQRPVASDF
SATGFKQSSPALHRPVASDF

SEQ ID NO: 13357 - protein, 20 aa, synthetic construct
  source 1..20: note = Seed: SATGFKQSSKALQRPVASDF
SATGFKQSSPALIRPVASDF

SEQ ID NO: 13358 - protein, 20 aa, synthetic construct
  source 1..20: note = Seed: SATGFKQSSKALQRPVASDF
SATGFKQSSPALLRPVASDF

SEQ ID NO: 13359 - protein, 20 aa, synthetic construct
  source 1..20: note = Seed: SATGFKQSSKALQRPVASDF
SATGFKQSSPALMRPVASDF

SEQ ID NO: 13360 - protein, 20 aa, synthetic construct
  source 1..20: note = Seed: SATGFKQSSKALQRPVASDF
SATGFKQSSPALNRPVASDF

SEQ ID NO: 13361 - protein, 20 aa, synthetic construct
  source 1..20: note = Seed: SATGFKQSSKALQRPVASDF
SATGFKQSSPALPRPVASDF

SEQ ID NO: 13362 - protein, 20 aa, synthetic construct
  source 1..20: note = Seed: SATGFKQSSKALQRPVASDF
SATGFKQSSPALQRPVASDF

SEQ ID NO: 13363 - protein, 20 aa, synthetic construct
  source 1..20: note = Seed: SATGFKQSSKALQRPVASDF
SATGFKQSSPALSRPVASDF

SEQ ID NO: 13364 - protein, 20 aa, synthetic construct
  source 1..20: note = Seed: SATGFKQSSKALQRPVASDF
SATGFKQSSPALTRPVASDF

SEQ ID NO: 13365 - protein, 20 aa, synthetic construct
  source 1..20: note = Seed: SATGFKQSSKALQRPVASDF
SATGFKQSSPALVRPVASDF

SEQ ID NO: 13366 - protein, 20 aa, synthetic construct
  source 1..20: note = Seed: SATGFKQSSKALQRPVASDF
SATGFKQSSPALYRPVASDF

SEQ ID NO: 13367 - protein, 20 aa, synthetic construct
  source 1..20: note = Seed: SATGFKQSSKALQRPVASDF
SATGFKQSSQALARPVASDF

SEQ ID NO: 13368 - protein, 20 aa, synthetic construct
  source 1..20: note = Seed: SATGFKQSSKALQRPVASDF
SATGFKQSSQALVRPVASDF

SEQ ID NO: 13369 - protein, 20 aa, synthetic construct
  source 1..20: note = Seed: SATGFKQSSKALQRPVASDF
SATGFKQSSRALARPVASDF

SEQ ID NO: 13370 - protein, 20 aa, synthetic construct
  source 1..20: note = Seed: SATGFKQSSKALQRPVASDF
SATGFKQSSRALGRPVASDF

SEQ ID NO: 13371 - protein, 20 aa, synthetic construct
  source 1..20: note = Seed: SATGFKQSSKALQRPVASDF
SATGFKQSSRALHRPVASDF

SEQ ID NO: 13372 - protein, 20 aa, synthetic construct
  source 1..20: note = Seed: SATGFKQSSKALQRPVASDF
SATGFKQSSRALIRPVASDF

SEQ ID NO: 13373 - protein, 20 aa, synthetic construct
  source 1..20: note = Seed: SATGFKQSSKALQRPVASDF
SATGFKQSSRALKRPVASDF

SEQ ID NO: 13374 - protein, 20 aa, synthetic construct
  source 1..20: note = Seed: SATGFKQSSKALQRPVASDF
SATGFKQSSRALLRPVASDF

SEQ ID NO: 13375 - protein, 20 aa, synthetic construct
  source 1..20: note = Seed: SATGFKQSSKALQRPVASDF
SATGFKQSSRALMRPVASDF

SEQ ID NO: 13376 - protein, 20 aa, synthetic construct
  source 1..20: note = Seed: SATGFKQSSKALQRPVASDF
SATGFKQSSRALNRPVASDF

SEQ ID NO: 13377 - protein, 20 aa, synthetic construct
  source 1..20: note = Seed: SATGFKQSSKALQRPVASDF
SATGFKQSSRALQRPVASDF

SEQ ID NO: 13378 - protein, 20 aa, synthetic construct
  source 1..20: note = Seed: SATGFKQSSKALQRPVASDF
SATGFKQSSRALRRPVASDF

SEQ ID NO: 13379 - protein, 20 aa, synthetic construct
  source 1..20: note = Seed: SATGFKQSSKALQRPVASDF
SATGFKQSSRALSRPVASDF

SEQ ID NO: 13380 - protein, 20 aa, synthetic construct
  source 1..20: note = Seed: SATGFKQSSKALQRPVASDF
SATGFKQSSRALTRPVASDF

SEQ ID NO: 13381 - protein, 20 aa, synthetic construct
  source 1..20: note = Seed: SATGFKQSSKALQRPVASDF
SATGFKQSSRALVRPVASDF

SEQ ID NO: 13382 - protein, 20 aa, synthetic construct
  source 1..20: note = Seed: SATGFKQSSKALQRPVASDF
SATGFKQSSSALARPVASDF

SEQ ID NO: 13383 - protein, 20 aa, synthetic construct
  source 1..20: note = Seed: SATGFKQSSKALQRPVASDF
SATGFKQSSSALCRPVASDF

SEQ ID NO: 13384 - protein, 20 aa, synthetic construct
  source 1..20: note = Seed: SATGFKQSSKALQRPVASDF
SATGFKQSSSALFRPVASDF

SEQ ID NO: 13385 - protein, 20 aa, synthetic construct
  source 1..20: note = Seed: SATGFKQSSKALQRPVASDF
SATGFKQSSSALGRPVASDF

SEQ ID NO: 13386 - protein, 20 aa, synthetic construct
  source 1..20: note = Seed: SATGFKQSSKALQRPVASDF
SATGFKQSSSALHRPVASDF

SEQ ID NO: 13387 - protein, 20 aa, synthetic construct
  source 1..20: note = Seed: SATGFKQSSKALQRPVASDF
SATGFKQSSSALIRPVASDF

SEQ ID NO: 13388 - protein, 20 aa, synthetic construct
  source 1..20: note = Seed: SATGFKQSSKALQRPVASDF
SATGFKQSSSALLRPVASDF

SEQ ID NO: 13389 - protein, 20 aa, synthetic construct
  source 1..20: note = Seed: SATGFKQSSKALQRPVASDF
SATGFKQSSSALMRPVASDF

SEQ ID NO: 13390 - protein, 20 aa, synthetic construct
  source 1..20: note = Seed: SATGFKQSSKALQRPVASDF
SATGFKQSSSALNRPVASDF

SEQ ID NO: 13391 - protein, 20 aa, synthetic construct
  source 1..20: note = Seed: SATGFKQSSKALQRPVASDF
SATGFKQSSSALQRPVASDF

SEQ ID NO: 13392 - protein, 20 aa, synthetic construct
  source 1..20: note = Seed: SATGFKQSSKALQRPVASDF
SATGFKQSSSALSRPVASDF

SEQ ID NO: 13393 - protein, 20 aa, synthetic construct
  source 1..20: note = Seed: SATGFKQSSKALQRPVASDF
SATGFKQSSSALTRPVASDF

SEQ ID NO: 13394 - protein, 20 aa, synthetic construct
  source 1..20: note = Seed: SATGFKQSSKALQRPVASDF
SATGFKQSSSALVRPVASDF

SEQ ID NO: 13395 - protein, 20 aa, synthetic construct
  source 1..20: note = Seed: SATGFKQSSKALQRPVASDF
SATGFKQSSSALYRPVASDF

SEQ ID NO: 13396 - protein, 20 aa, synthetic construct
  source 1..20: note = Seed: SATGFKQSSKALQRPVASDF
SATGFKQSSTALARPVASDF

SEQ ID NO: 13397 - protein, 20 aa, synthetic construct
  source 1..20: note = Seed: SATGFKQSSKALQRPVASDF
SATGFKQSSTALGRPVASDF

SEQ ID NO: 13398 - protein, 20 aa, synthetic construct
  source 1..20: note = Seed: SATGFKQSSKALQRPVASDF
SATGFKQSSTALHRPVASDF

SEQ ID NO: 13399 - protein, 20 aa, synthetic construct
  source 1..20: note = Seed: SATGFKQSSKALQRPVASDF
SATGFKQSSTALIRPVASDF

SEQ ID NO: 13400 - protein, 20 aa, synthetic construct
  source 1..20: note = Seed: SATGFKQSSKALQRPVASDF
SATGFKQSSTALLRPVASDF

SEQ ID NO: 13401 - protein, 20 aa, synthetic construct
  source 1..20: note = Seed: SATGFKQSSKALQRPVASDF
SATGFKQSSTALMRPVASDF

SEQ ID NO: 13402 - protein, 20 aa, synthetic construct
  source 1..20: note = Seed: SATGFKQSSKALQRPVASDF
SATGFKQSSTALNRPVASDF

SEQ ID NO: 13403 - protein, 20 aa, synthetic construct
  source 1..20: note = Seed: SATGFKQSSKALQRPVASDF
SATGFKQSSTALQRPVASDF

SEQ ID NO: 13404 - protein, 20 aa, synthetic construct
  source 1..20: note = Seed: SATGFKQSSKALQRPVASDF
SATGFKQSSTALSRPVASDF

SEQ ID NO: 13405 - protein, 20 aa, synthetic construct
  source 1..20: note = Seed: SATGFKQSSKALQRPVASDF
SATGFKQSSTALTRPVASDF

SEQ ID NO: 13406 - protein, 20 aa, synthetic construct
  source 1..20: note = Seed: SATGFKQSSKALQRPVASDF
SATGFKQSSTALVRPVASDF

SEQ ID NO: 13407 - protein, 20 aa, synthetic construct
  source 1..20: note = Seed: SATGFKQSSKALQRPVASDF
SATGFKQSSVALARPVASDF

SEQ ID NO: 13408 - protein, 20 aa, synthetic construct
  source 1..20: note = Seed: SATGFKQSSKALQRPVASDF
SATGFKQSSVALCRPVASDF

SEQ ID NO: 13409 - protein, 20 aa, synthetic construct
  source 1..20: note = Seed: SATGFKQSSKALQRPVASDF
SATGFKQSSVALERPVASDF

SEQ ID NO: 13410 - protein, 20 aa, synthetic construct
  source 1..20: note = Seed: SATGFKQSSKALQRPVASDF
SATGFKQSSVALFRPVASDF

SEQ ID NO: 13411 - protein, 20 aa, synthetic construct
  source 1..20: note = Seed: SATGFKQSSKALQRPVASDF
SATGFKQSSVALGRPVASDF

SEQ ID NO: 13412 - protein, 20 aa, synthetic construct
  source 1..20: note = Seed: SATGFKQSSKALQRPVASDF
SATGFKQSSVALHRPVASDF

SEQ ID NO: 13413 - protein, 20 aa, synthetic construct
  source 1..20: note = Seed: SATGFKQSSKALQRPVASDF
SATGFKQSSVALIRPVASDF

SEQ ID NO: 13414 - protein, 20 aa, synthetic construct
  source 1..20: note = Seed: SATGFKQSSKALQRPVASDF
SATGFKQSSVALLRPVASDF

SEQ ID NO: 13415 - protein, 20 aa, synthetic construct
  source 1..20: note = Seed: SATGFKQSSKALQRPVASDF
SATGFKQSSVALMRPVASDF

SEQ ID NO: 13416 - protein, 20 aa, synthetic construct
  source 1..20: note = Seed: SATGFKQSSKALQRPVASDF
SATGFKQSSVALNRPVASDF

SEQ ID NO: 13417 - protein, 20 aa, synthetic construct
  source 1..20: note = Seed: SATGFKQSSKALQRPVASDF
SATGFKQSSVALPRPVASDF

SEQ ID NO: 13418 - protein, 20 aa, synthetic construct
  source 1..20: note = Seed: SATGFKQSSKALQRPVASDF
SATGFKQSSVALQRPVASDF

SEQ ID NO: 13419 - protein, 20 aa, synthetic construct
  source 1..20: note = Seed: SATGFKQSSKALQRPVASDF
SATGFKQSSVALSRPVASDF

SEQ ID NO: 13420 - protein, 20 aa, synthetic construct
  source 1..20: note = Seed: SATGFKQSSKALQRPVASDF
SATGFKQSSVALTRPVASDF

SEQ ID NO: 13421 - protein, 20 aa, synthetic construct
  source 1..20: note = Seed: SATGFKQSSKALQRPVASDF
SATGFKQSSVALVRPVASDF

SEQ ID NO: 13422 - protein, 20 aa, synthetic construct
  source 1..20: note = Seed: SATGFKQSSKALQRPVASDF
SATGFKQSSWALFRPVASDF

SEQ ID NO: 13423 - protein, 20 aa, synthetic construct
  source 1..20: note = Seed: SATGFKQSSKALQRPVASDF
SATGFKQSSWALIRPVASDF

SEQ ID NO: 13424 - protein, 20 aa, synthetic construct
  source 1..20: note = Seed: SATGFKQSSKALQRPVASDF
SATGFKQSSWALLRPVASDF

SEQ ID NO: 13425 - protein, 20 aa, synthetic construct
  source 1..20: note = Seed: SATGFKQSSKALQRPVASDF
SATGFKQSSWALVRPVASDF

SEQ ID NO: 13426 - protein, 20 aa, synthetic construct
  source 1..20: note = Seed: SATGFKQSSKALQRPVASDF
SATGFKQSSYALFRPVASDF

SEQ ID NO: 13427 - protein, 20 aa, synthetic construct
  source 1..20: note = Seed: SATGFKQSSKALQRPVASDF
SATGFKQSSYALIRPVASDF

SEQ ID NO: 13428 - protein, 20 aa, synthetic construct
  source 1..20: note = Seed: SATGFKQSSKALQRPVASDF
SATGFKQSSYALLRPVASDF

SEQ ID NO: 13429 - protein, 20 aa, synthetic construct
  source 1..20: note = Seed: SATGFKQSSKALQRPVASDF
SATGFKQSSYALMRPVASDF

SEQ ID NO: 13430 - protein, 20 aa, synthetic construct
  source 1..20: note = Seed: SATGFKQSSKALQRPVASDF
SATGFKQSSYALVRPVASDF

SEQ ID NO: 13431 - protein, 20 aa, synthetic construct
  source 1..20: note = Seed: SATGFKQSSKALQRPVASDF
SATGFKQTSAALARPVASDF

SEQ ID NO: 13432 - protein, 20 aa, synthetic construct
  source 1..20: note = Seed: SATGFKQSSKALQRPVASDF
SATGFKQTSAALCRPVASDF

SEQ ID NO: 13433 - protein, 20 aa, synthetic construct
  source 1..20: note = Seed: SATGFKQSSKALQRPVASDF
SATGFKQTSAALDRPVASDF

SEQ ID NO: 13434 - protein, 20 aa, synthetic construct
  source 1..20: note = Seed: SATGFKQSSKALQRPVASDF
SATGFKQTSAALERPVASDF

SEQ ID NO: 13435 - protein, 20 aa, synthetic construct
  source 1..20: note = Seed: SATGFKQSSKALQRPVASDF
SATGFKQTSAALFRPVASDF

SEQ ID NO: 13436 - protein, 20 aa, synthetic construct
  source 1..20: note = Seed: SATGFKQSSKALQRPVASDF
SATGFKQTSAALGRPVASDF

SEQ ID NO: 13437 - protein, 20 aa, synthetic construct
  source 1..20: note = Seed: SATGFKQSSKALQRPVASDF
SATGFKQTSAALHRPVASDF

SEQ ID NO: 13438 - protein, 20 aa, synthetic construct
  source 1..20: note = Seed: SATGFKQSSKALQRPVASDF
SATGFKQTSAALIRPVASDF

SEQ ID NO: 13439 - protein, 20 aa, synthetic construct
  source 1..20: note = Seed: SATGFKQSSKALQRPVASDF
SATGFKQTSAALLRPVASDF

SEQ ID NO: 13440 - protein, 20 aa, synthetic construct
  source 1..20: note = Seed: SATGFKQSSKALQRPVASDF
SATGFKQTSAALMRPVASDF

SEQ ID NO: 13441 - protein, 20 aa, synthetic construct
  source 1..20: note = Seed: SATGFKQSSKALQRPVASDF
SATGFKQTSAALNRPVASDF

SEQ ID NO: 13442 - protein, 20 aa, synthetic construct
  source 1..20: note = Seed: SATGFKQSSKALQRPVASDF
SATGFKQTSAALPRPVASDF

SEQ ID NO: 13443 - protein, 20 aa, synthetic construct
  source 1..20: note = Seed: SATGFKQSSKALQRPVASDF
SATGFKQTSAALQRPVASDF

SEQ ID NO: 13444 - protein, 20 aa, synthetic construct
  source 1..20: note = Seed: SATGFKQSSKALQRPVASDF
SATGFKQTSAALSRPVASDF

SEQ ID NO: 13445 - protein, 20 aa, synthetic construct
  source 1..20: note = Seed: SATGFKQSSKALQRPVASDF
SATGFKQTSAALTRPVASDF

SEQ ID NO: 13446 - protein, 20 aa, synthetic construct
  source 1..20: note = Seed: SATGFKQSSKALQRPVASDF
SATGFKQTSAALVRPVASDF

SEQ ID NO: 13447 - protein, 20 aa, synthetic construct
  source 1..20: note = Seed: SATGFKQSSKALQRPVASDF
SATGFKQTSAALYRPVASDF

SEQ ID NO: 13448 - protein, 20 aa, synthetic construct
  source 1..20: note = Seed: SATGFKQSSKALQRPVASDF
SATGFKQTSFALARPVASDF

SEQ ID NO: 13449 - protein, 20 aa, synthetic construct
  source 1..20: note = Seed: SATGFKQSSKALQRPVASDF
SATGFKQTSFALDRPVASDF

SEQ ID NO: 13450 - protein, 20 aa, synthetic construct
  source 1..20: note = Seed: SATGFKQSSKALQRPVASDF
SATGFKQTSFALERPVASDF

SEQ ID NO: 13451 - protein, 20 aa, synthetic construct
  source 1..20: note = Seed: SATGFKQSSKALQRPVASDF
SATGFKQTSFALFRPVASDF

SEQ ID NO: 13452 - protein, 20 aa, synthetic construct
  source 1..20: note = Seed: SATGFKQSSKALQRPVASDF
SATGFKQTSFALHRPVASDF

SEQ ID NO: 13453 - protein, 20 aa, synthetic construct
  source 1..20: note = Seed: SATGFKQSSKALQRPVASDF
SATGFKQTSFALLRPVASDF

SEQ ID NO: 13454 - protein, 20 aa, synthetic construct
  source 1..20: note = Seed: SATGFKQSSKALQRPVASDF
SATGFKQTSFALMRPVASDF

SEQ ID NO: 13455 - protein, 20 aa, synthetic construct
  source 1..20: note = Seed: SATGFKQSSKALQRPVASDF
SATGFKQTSFALNRPVASDF

SEQ ID NO: 13456 - protein, 20 aa, synthetic construct
  source 1..20: note = Seed: SATGFKQSSKALQRPVASDF
SATGFKQTSFALPRPVASDF

SEQ ID NO: 13457 - protein, 20 aa, synthetic construct
  source 1..20: note = Seed: SATGFKQSSKALQRPVASDF
SATGFKQTSFALQRPVASDF

SEQ ID NO: 13458 - protein, 20 aa, synthetic construct
  source 1..20: note = Seed: SATGFKQSSKALQRPVASDF
SATGFKQTSFALSRPVASDF

SEQ ID NO: 13459 - protein, 20 aa, synthetic construct
  source 1..20: note = Seed: SATGFKQSSKALQRPVASDF
SATGFKQTSFALTRPVASDF

SEQ ID NO: 13460 - protein, 20 aa, synthetic construct
  source 1..20: note = Seed: SATGFKQSSKALQRPVASDF
SATGFKQTSFALVRPVASDF

SEQ ID NO: 13461 - protein, 20 aa, synthetic construct
  source 1..20: note = Seed: SATGFKQSSKALQRPVASDF
SATGFKQTSFALYRPVASDF

SEQ ID NO: 13462 - protein, 20 aa, synthetic construct
  source 1..20: note = Seed: SATGFKQSSKALQRPVASDF
SATGFKQTSGALARPVASDF

SEQ ID NO: 13463 - protein, 20 aa, synthetic construct
  source 1..20: note = Seed: SATGFKQSSKALQRPVASDF
SATGFKQTSGALFRPVASDF

SEQ ID NO: 13464 - protein, 20 aa, synthetic construct
  source 1..20: note = Seed: SATGFKQSSKALQRPVASDF
SATGFKQTSGALGRPVASDF

SEQ ID NO: 13465 - protein, 20 aa, synthetic construct
  source 1..20: note = Seed: SATGFKQSSKALQRPVASDF
SATGFKQTSGALIRPVASDF

SEQ ID NO: 13466 - protein, 20 aa, synthetic construct
  source 1..20: note = Seed: SATGFKQSSKALQRPVASDF
SATGFKQTSGALLRPVASDF

SEQ ID NO: 13467 - protein, 20 aa, synthetic construct
  source 1..20: note = Seed: SATGFKQSSKALQRPVASDF
SATGFKQTSGALMRPVASDF

SEQ ID NO: 13468 - protein, 20 aa, synthetic construct
  source 1..20: note = Seed: SATGFKQSSKALQRPVASDF
SATGFKQTSGALNRPVASDF

SEQ ID NO: 13469 - protein, 20 aa, synthetic construct
  source 1..20: note = Seed: SATGFKQSSKALQRPVASDF
SATGFKQTSGALSRPVASDF

SEQ ID NO: 13470 - protein, 20 aa, synthetic construct
  source 1..20: note = Seed: SATGFKQSSKALQRPVASDF
SATGFKQTSGALTRPVASDF

SEQ ID NO: 13471 - protein, 20 aa, synthetic construct
  source 1..20: note = Seed: SATGFKQSSKALQRPVASDF
SATGFKQTSGALVRPVASDF

SEQ ID NO: 13472 - protein, 20 aa, synthetic construct
  source 1..20: note = Seed: SATGFKQSSKALQRPVASDF
SATGFKQTSIALARPVASDF

SEQ ID NO: 13473 - protein, 20 aa, synthetic construct
  source 1..20: note = Seed: SATGFKQSSKALQRPVASDF
SATGFKQTSIALCRPVASDF

SEQ ID NO: 13474 - protein, 20 aa, synthetic construct
  source 1..20: note = Seed: SATGFKQSSKALQRPVASDF
SATGFKQTSIALFRPVASDF

SEQ ID NO: 13475 - protein, 20 aa, synthetic construct
  source 1..20: note = Seed: SATGFKQSSKALQRPVASDF
SATGFKQTSIALGRPVASDF

SEQ ID NO: 13476 - protein, 20 aa, synthetic construct
  source 1..20: note = Seed: SATGFKQSSKALQRPVASDF
SATGFKQTSIALHRPVASDF

SEQ ID NO: 13477 - protein, 20 aa, synthetic construct
  source 1..20: note = Seed: SATGFKQSSKALQRPVASDF
SATGFKQTSIALIRPVASDF

SEQ ID NO: 13478 - protein, 20 aa, synthetic construct
  source 1..20: note = Seed: SATGFKQSSKALQRPVASDF
SATGFKQTSIALLRPVASDF

SEQ ID NO: 13479 - protein, 20 aa, synthetic construct
  source 1..20: note = Seed: SATGFKQSSKALQRPVASDF
SATGFKQTSIALNRPVASDF

SEQ ID NO: 13480 - protein, 20 aa, synthetic construct
  source 1..20: note = Seed: SATGFKQSSKALQRPVASDF
SATGFKQTSIALSRPVASDF

SEQ ID NO: 13481 - protein, 20 aa, synthetic construct
  source 1..20: note = Seed: SATGFKQSSKALQRPVASDF
SATGFKQTSIALTRPVASDF

SEQ ID NO: 13482 - protein, 20 aa, synthetic construct
  source 1..20: note = Seed: SATGFKQSSKALQRPVASDF
SATGFKQTSIALVRPVASDF

SEQ ID NO: 13483 - protein, 20 aa, synthetic construct
  source 1..20: note = Seed: SATGFKQSSKALQRPVASDF
SATGFKQTSIALYRPVASDF

SEQ ID NO: 13484 - protein, 20 aa, synthetic construct
  source 1..20: note = Seed: SATGFKQSSKALQRPVASDF
SATGFKQTSKALARPVASDF

SEQ ID NO: 13485 - protein, 20 aa, synthetic construct
  source 1..20: note = Seed: SATGFKQSSKALQRPVASDF
SATGFKQTSKALGRPVASDF

SEQ ID NO: 13486 - protein, 20 aa, synthetic construct
  source 1..20: note = Seed: SATGFKQSSKALQRPVASDF
SATGFKQTSKALHRPVASDF

SEQ ID NO: 13487 - protein, 20 aa, synthetic construct
  source 1..20: note = Seed: SATGFKQSSKALQRPVASDF
SATGFKQTSKALKRPVASDF

SEQ ID NO: 13488 - protein, 20 aa, synthetic construct
  source 1..20: note = Seed: SATGFKQSSKALQRPVASDF
SATGFKQTSKALMRPVASDF

SEQ ID NO: 13489 - protein, 20 aa, synthetic construct
  source 1..20: note = Seed: SATGFKQSSKALQRPVASDF
SATGFKQTSKALNRPVASDF

SEQ ID NO: 13490 - protein, 20 aa, synthetic construct
  source 1..20: note = Seed: SATGFKQSSKALQRPVASDF
SATGFKQTSKALQRPVASDF

SEQ ID NO: 13491 - protein, 20 aa, synthetic construct
  source 1..20: note = Seed: SATGFKQSSKALQRPVASDF
SATGFKQTSKALRRPVASDF

SEQ ID NO: 13492 - protein, 20 aa, synthetic construct
  source 1..20: note = Seed: SATGFKQSSKALQRPVASDF
SATGFKQTSKALSRPVASDF

SEQ ID NO: 13493 - protein, 20 aa, synthetic construct
  source 1..20: note = Seed: SATGFKQSSKALQRPVASDF
SATGFKQTSKALTRPVASDF

SEQ ID NO: 13494 - protein, 20 aa, synthetic construct
  source 1..20: note = Seed: SATGFKQSSKALQRPVASDF
SATGFKQTSKALVRPVASDF

SEQ ID NO: 13495 - protein, 20 aa, synthetic construct
  source 1..20: note = Seed: SATGFKQSSKALQRPVASDF
SATGFKQTSLALFRPVASDF

SEQ ID NO: 13496 - protein, 20 aa, synthetic construct
  source 1..20: note = Seed: SATGFKQSSKALQRPVASDF
SATGFKQTSLALGRPVASDF

SEQ ID NO: 13497 - protein, 20 aa, synthetic construct
  source 1..20: note = Seed: SATGFKQSSKALQRPVASDF
SATGFKQTSLALHRPVASDF

SEQ ID NO: 13498 - protein, 20 aa, synthetic construct
  source 1..20: note = Seed: SATGFKQSSKALQRPVASDF
SATGFKQTSLALIRPVASDF

SEQ ID NO: 13499 - protein, 20 aa, synthetic construct
  source 1..20: note = Seed: SATGFKQSSKALQRPVASDF
SATGFKQTSLALLRPVASDF

SEQ ID NO: 13500 - protein, 20 aa, synthetic construct
  source 1..20: note = Seed: SATGFKQSSKALQRPVASDF
SATGFKQTSLALMRPVASDF

SEQ ID NO: 13501 - protein, 20 aa, synthetic construct
  source 1..20: note = Seed: SATGFKQSSKALQRPVASDF
SATGFKQTSLALNRPVASDF

SEQ ID NO: 13502 - protein, 20 aa, synthetic construct
  source 1..20: note = Seed: SATGFKQSSKALQRPVASDF
SATGFKQTSLALSRPVASDF

SEQ ID NO: 13503 - protein, 20 aa, synthetic construct
  source 1..20: note = Seed: SATGFKQSSKALQRPVASDF
SATGFKQTSLALVRPVASDF

SEQ ID NO: 13504 - protein, 20 aa, synthetic construct
  source 1..20: note = Seed: SATGFKQSSKALQRPVASDF
SATGFKQTSMALFRPVASDF

SEQ ID NO: 13505 - protein, 20 aa, synthetic construct
  source 1..20: note = Seed: SATGFKQSSKALQRPVASDF
SATGFKQTSMALHRPVASDF

SEQ ID NO: 13506 - protein, 20 aa, synthetic construct
  source 1..20: note = Seed: SATGFKQSSKALQRPVASDF
SATGFKQTSMALIRPVASDF

SEQ ID NO: 13507 - protein, 20 aa, synthetic construct
  source 1..20: note = Seed: SATGFKQSSKALQRPVASDF
SATGFKQTSMALLRPVASDF

SEQ ID NO: 13508 - protein, 20 aa, synthetic construct
  source 1..20: note = Seed: SATGFKQSSKALQRPVASDF
SATGFKQTSMALNRPVASDF

SEQ ID NO: 13509 - protein, 20 aa, synthetic construct
  source 1..20: note = Seed: SATGFKQSSKALQRPVASDF
SATGFKQTSMALSRPVASDF

SEQ ID NO: 13510 - protein, 20 aa, synthetic construct
  source 1..20: note = Seed: SATGFKQSSKALQRPVASDF
SATGFKQTSMALVRPVASDF

SEQ ID NO: 13511 - protein, 20 aa, synthetic construct
  source 1..20: note = Seed: SATGFKQSSKALQRPVASDF
SATGFKQTSNALARPVASDF

SEQ ID NO: 13512 - protein, 20 aa, synthetic construct
  source 1..20: note = Seed: SATGFKQSSKALQRPVASDF
SATGFKQTSNALIRPVASDF

SEQ ID NO: 13513 - protein, 20 aa, synthetic construct
  source 1..20: note = Seed: SATGFKQSSKALQRPVASDF
SATGFKQTSNALLRPVASDF

SEQ ID NO: 13514 - protein, 20 aa, synthetic construct
  source 1..20: note = Seed: SATGFKQSSKALQRPVASDF
SATGFKQTSNALMRPVASDF

SEQ ID NO: 13515 - protein, 20 aa, synthetic construct
  source 1..20: note = Seed: SATGFKQSSKALQRPVASDF
SATGFKQTSNALNRPVASDF

SEQ ID NO: 13516 - protein, 20 aa, synthetic construct
  source 1..20: note = Seed: SATGFKQSSKALQRPVASDF
SATGFKQTSNALSRPVASDF

SEQ ID NO: 13517 - protein, 20 aa, synthetic construct
  source 1..20: note = Seed: SATGFKQSSKALQRPVASDF
SATGFKQTSNALTRPVASDF

SEQ ID NO: 13518 - protein, 20 aa, synthetic construct
  source 1..20: note = Seed: SATGFKQSSKALQRPVASDF
SATGFKQTSNALVRPVASDF

SEQ ID NO: 13519 - protein, 20 aa, synthetic construct
  source 1..20: note = Seed: SATGFKQSSKALQRPVASDF
SATGFKQTSPALARPVASDF

SEQ ID NO: 13520 - protein, 20 aa, synthetic construct
  source 1..20: note = Seed: SATGFKQSSKALQRPVASDF
SATGFKQTSPALFRPVASDF

SEQ ID NO: 13521 - protein, 20 aa, synthetic construct
  source 1..20: note = Seed: SATGFKQSSKALQRPVASDF
SATGFKQTSPALGRPVASDF

SEQ ID NO: 13522 - protein, 20 aa, synthetic construct
  source 1..20: note = Seed: SATGFKQSSKALQRPVASDF
SATGFKQTSPALHRPVASDF

SEQ ID NO: 13523 - protein, 20 aa, synthetic construct
  source 1..20: note = Seed: SATGFKQSSKALQRPVASDF
SATGFKQTSPALIRPVASDF

SEQ ID NO: 13524 - protein, 20 aa, synthetic construct
  source 1..20: note = Seed: SATGFKQSSKALQRPVASDF
SATGFKQTSPALLRPVASDF

SEQ ID NO: 13525 - protein, 20 aa, synthetic construct
  source 1..20: note = Seed: SATGFKQSSKALQRPVASDF
SATGFKQTSPALMRPVASDF

SEQ ID NO: 13526 - protein, 20 aa, synthetic construct
  source 1..20: note = Seed: SATGFKQSSKALQRPVASDF
SATGFKQTSPALNRPVASDF

SEQ ID NO: 13527 - protein, 20 aa, synthetic construct
  source 1..20: note = Seed: SATGFKQSSKALQRPVASDF
SATGFKQTSPALQRPVASDF

SEQ ID NO: 13528 - protein, 20 aa, synthetic construct
  source 1..20: note = Seed: SATGFKQSSKALQRPVASDF
SATGFKQTSPALSRPVASDF

SEQ ID NO: 13529 - protein, 20 aa, synthetic construct
  source 1..20: note = Seed: SATGFKQSSKALQRPVASDF
SATGFKQTSPALTRPVASDF

SEQ ID NO: 13530 - protein, 20 aa, synthetic construct
  source 1..20: note = Seed: SATGFKQSSKALQRPVASDF
SATGFKQTSPALVRPVASDF

SEQ ID NO: 13531 - protein, 20 aa, synthetic construct
  source 1..20: note = Seed: SATGFKQSSKALQRPVASDF
SATGFKQTSRALARPVASDF

SEQ ID NO: 13532 - protein, 20 aa, synthetic construct
  source 1..20: note = Seed: SATGFKQSSKALQRPVASDF
SATGFKQTSRALGRPVASDF

SEQ ID NO: 13533 - protein, 20 aa, synthetic construct
  source 1..20: note = Seed: SATGFKQSSKALQRPVASDF
SATGFKQTSRALHRPVASDF

SEQ ID NO: 13534 - protein, 20 aa, synthetic construct
  source 1..20: note = Seed: SATGFKQSSKALQRPVASDF
SATGFKQTSRALIRPVASDF

SEQ ID NO: 13535 - protein, 20 aa, synthetic construct
  source 1..20: note = Seed: SATGFKQSSKALQRPVASDF
SATGFKQTSRALKRPVASDF

SEQ ID NO: 13536 - protein, 20 aa, synthetic construct
  source 1..20: note = Seed: SATGFKQSSKALQRPVASDF
SATGFKQTSRALLRPVASDF

SEQ ID NO: 13537 - protein, 20 aa, synthetic construct
  source 1..20: note = Seed: SATGFKQSSKALQRPVASDF
SATGFKQTSRALMRPVASDF

SEQ ID NO: 13538 - protein, 20 aa, synthetic construct
  source 1..20: note = Seed: SATGFKQSSKALQRPVASDF
SATGFKQTSRALNRPVASDF

SEQ ID NO: 13539 - protein, 20 aa, synthetic construct
  source 1..20: note = Seed: SATGFKQSSKALQRPVASDF
SATGFKQTSRALPRPVASDF

SEQ ID NO: 13540 - protein, 20 aa, synthetic construct
  source 1..20: note = Seed: SATGFKQSSKALQRPVASDF
SATGFKQTSRALQRPVASDF

SEQ ID NO: 13541 - protein, 20 aa, synthetic construct
  source 1..20: note = Seed: SATGFKQSSKALQRPVASDF
SATGFKQTSRALRRPVASDF

SEQ ID NO: 13542 - protein, 20 aa, synthetic construct
  source 1..20: note = Seed: SATGFKQSSKALQRPVASDF
SATGFKQTSRALSRPVASDF

SEQ ID NO: 13543 - protein, 20 aa, synthetic construct
  source 1..20: note = Seed: SATGFKQSSKALQRPVASDF
SATGFKQTSRALTRPVASDF

SEQ ID NO: 13544 - protein, 20 aa, synthetic construct
  source 1..20: note = Seed: SATGFKQSSKALQRPVASDF
SATGFKQTSRALVRPVASDF

SEQ ID NO: 13545 - protein, 20 aa, synthetic construct
  source 1..20: note = Seed: SATGFKQSSKALQRPVASDF
SATGFKQTSSALARPVASDF

SEQ ID NO: 13546 - protein, 20 aa, synthetic construct
  source 1..20: note = Seed: SATGFKQSSKALQRPVASDF
SATGFKQTSSALFRPVASDF

SEQ ID NO: 13547 - protein, 20 aa, synthetic construct
  source 1..20: note = Seed: SATGFKQSSKALQRPVASDF
SATGFKQTSSALGRPVASDF

SEQ ID NO: 13548 - protein, 20 aa, synthetic construct
  source 1..20: note = Seed: SATGFKQSSKALQRPVASDF
SATGFKQTSSALHRPVASDF

SEQ ID NO: 13549 - protein, 20 aa, synthetic construct
  source 1..20: note = Seed: SATGFKQSSKALQRPVASDF
SATGFKQTSSALIRPVASDF

SEQ ID NO: 13550 - protein, 20 aa, synthetic construct
  source 1..20: note = Seed: SATGFKQSSKALQRPVASDF
SATGFKQTSSALLRPVASDF

SEQ ID NO: 13551 - protein, 20 aa, synthetic construct
  source 1..20: note = Seed: SATGFKQSSKALQRPVASDF
SATGFKQTSSALMRPVASDF

SEQ ID NO: 13552 - protein, 20 aa, synthetic construct
  source 1..20: note = Seed: SATGFKQSSKALQRPVASDF
SATGFKQTSSALNRPVASDF

SEQ ID NO: 13553 - protein, 20 aa, synthetic construct
  source 1..20: note = Seed: SATGFKQSSKALQRPVASDF
SATGFKQTSSALQRPVASDF

SEQ ID NO: 13554 - protein, 20 aa, synthetic construct
  source 1..20: note = Seed: SATGFKQSSKALQRPVASDF
SATGFKQTSSALSRPVASDF

SEQ ID NO: 13555 - protein, 20 aa, synthetic construct
  source 1..20: note = Seed: SATGFKQSSKALQRPVASDF
SATGFKQTSSALTRPVASDF

SEQ ID NO: 13556 - protein, 20 aa, synthetic construct
  source 1..20: note = Seed: SATGFKQSSKALQRPVASDF
SATGFKQTSSALVRPVASDF

SEQ ID NO: 13557 - protein, 20 aa, synthetic construct
  source 1..20: note = Seed: SATGFKQSSKALQRPVASDF
SATGFKQTSTALARPVASDF

SEQ ID NO: 13558 - protein, 20 aa, synthetic construct
  source 1..20: note = Seed: SATGFKQSSKALQRPVASDF
SATGFKQTSTALGRPVASDF

SEQ ID NO: 13559 - protein, 20 aa, synthetic construct
  source 1..20: note = Seed: SATGFKQSSKALQRPVASDF
SATGFKQTSTALHRPVASDF

SEQ ID NO: 13560 - protein, 20 aa, synthetic construct
  source 1..20: note = Seed: SATGFKQSSKALQRPVASDF
SATGFKQTSTALIRPVASDF

SEQ ID NO: 13561 - protein, 20 aa, synthetic construct
  source 1..20: note = Seed: SATGFKQSSKALQRPVASDF
SATGFKQTSTALLRPVASDF

SEQ ID NO: 13562 - protein, 20 aa, synthetic construct
  source 1..20: note = Seed: SATGFKQSSKALQRPVASDF
SATGFKQTSTALMRPVASDF

SEQ ID NO: 13563 - protein, 20 aa, synthetic construct
  source 1..20: note = Seed: SATGFKQSSKALQRPVASDF
SATGFKQTSTALNRPVASDF

SEQ ID NO: 13564 - protein, 20 aa, synthetic construct
  source 1..20: note = Seed: SATGFKQSSKALQRPVASDF
SATGFKQTSTALQRPVASDF

SEQ ID NO: 13565 - protein, 20 aa, synthetic construct
  source 1..20: note = Seed: SATGFKQSSKALQRPVASDF
SATGFKQTSTALSRPVASDF

SEQ ID NO: 13566 - protein, 20 aa, synthetic construct
  source 1..20: note = Seed: SATGFKQSSKALQRPVASDF
SATGFKQTSTALTRPVASDF

SEQ ID NO: 13567 - protein, 20 aa, synthetic construct
  source 1..20: note = Seed: SATGFKQSSKALQRPVASDF
SATGFKQTSTALVRPVASDF

SEQ ID NO: 13568 - protein, 20 aa, synthetic construct
  source 1..20: note = Seed: SATGFKQSSKALQRPVASDF
SATGFKQTSVALARPVASDF

SEQ ID NO: 13569 - protein, 20 aa, synthetic construct
  source 1..20: note = Seed: SATGFKQSSKALQRPVASDF
SATGFKQTSVALERPVASDF

SEQ ID NO: 13570 - protein, 20 aa, synthetic construct
  source 1..20: note = Seed: SATGFKQSSKALQRPVASDF
SATGFKQTSVALFRPVASDF

SEQ ID NO: 13571 - protein, 20 aa, synthetic construct
  source 1..20: note = Seed: SATGFKQSSKALQRPVASDF
SATGFKQTSVALGRPVASDF

SEQ ID NO: 13572 - protein, 20 aa, synthetic construct
  source 1..20: note = Seed: SATGFKQSSKALQRPVASDF
SATGFKQTSVALHRPVASDF

SEQ ID NO: 13573 - protein, 20 aa, synthetic construct
  source 1..20: note = Seed: SATGFKQSSKALQRPVASDF
SATGFKQTSVALIRPVASDF

SEQ ID NO: 13574 - protein, 20 aa, synthetic construct
  source 1..20: note = Seed: SATGFKQSSKALQRPVASDF
SATGFKQTSVALLRPVASDF

SEQ ID NO: 13575 - protein, 20 aa, synthetic construct
  source 1..20: note = Seed: SATGFKQSSKALQRPVASDF
SATGFKQTSVALMRPVASDF

SEQ ID NO: 13576 - protein, 20 aa, synthetic construct
  source 1..20: note = Seed: SATGFKQSSKALQRPVASDF
SATGFKQTSVALNRPVASDF

SEQ ID NO: 13577 - protein, 20 aa, synthetic construct
  source 1..20: note = Seed: SATGFKQSSKALQRPVASDF
SATGFKQTSVALQRPVASDF

SEQ ID NO: 13578 - protein, 20 aa, synthetic construct
  source 1..20: note = Seed: SATGFKQSSKALQRPVASDF
SATGFKQTSVALSRPVASDF

SEQ ID NO: 13579 - protein, 20 aa, synthetic construct
  source 1..20: note = Seed: SATGFKQSSKALQRPVASDF
SATGFKQTSVALTRPVASDF

SEQ ID NO: 13580 - protein, 20 aa, synthetic construct
  source 1..20: note = Seed: SATGFKQSSKALQRPVASDF
SATGFKQTSVALVRPVASDF

SEQ ID NO: 13581 - protein, 20 aa, synthetic construct
  source 1..20: note = Seed: SATGFKQSSKALQRPVASDF
SATGFKQTSWALFRPVASDF

SEQ ID NO: 13582 - protein, 20 aa, synthetic construct
  source 1..20: note = Seed: SATGFKQSSKALQRPVASDF
SATGFKQTSWALIRPVASDF

SEQ ID NO: 13583 - protein, 20 aa, synthetic construct
  source 1..20: note = Seed: SATGFKQSSKALQRPVASDF
SATGFKQTSWALLRPVASDF

SEQ ID NO: 13584 - protein, 20 aa, synthetic construct
  source 1..20: note = Seed: SATGFKQSSKALQRPVASDF
SATGFKQTSWALMRPVASDF

SEQ ID NO: 13585 - protein, 20 aa, synthetic construct
  source 1..20: note = Seed: SATGFKQSSKALQRPVASDF
SATGFKQTSWALVRPVASDF

SEQ ID NO: 13586 - protein, 20 aa, synthetic construct
  source 1..20: note = Seed: SATGFKQSSKALQRPVASDF
SATGFKQTSYALFRPVASDF

SEQ ID NO: 13587 - protein, 20 aa, synthetic construct
  source 1..20: note = Seed: SATGFKQSSKALQRPVASDF
SATGFKQTSYALIRPVASDF

SEQ ID NO: 13588 - protein, 20 aa, synthetic construct
  source 1..20: note = Seed: SATGFKQSSKALQRPVASDF
SATGFKQTSYALLRPVASDF

SEQ ID NO: 13589 - protein, 20 aa, synthetic construct
  source 1..20: note = Seed: SATGFKQSSKALQRPVASDF
SATGFKQTSYALMRPVASDF

SEQ ID NO: 13590 - protein, 20 aa, synthetic construct
  source 1..20: note = Seed: SATGFKQSSKALQRPVASDF
SATGFKQTSYALVRPVASDF

SEQ ID NO: 13591 - protein, 20 aa, synthetic construct
  source 1..20: note = Seed: SATGFKQSSKALQRPVASDF
SATGFKQVSAALARPVASDF

SEQ ID NO: 13592 - protein, 20 aa, synthetic construct
  source 1..20: note = Seed: SATGFKQSSKALQRPVASDF
SATGFKQVSAALCRPVASDF

SEQ ID NO: 13593 - protein, 20 aa, synthetic construct
  source 1..20: note = Seed: SATGFKQSSKALQRPVASDF
SATGFKQVSAALDRPVASDF

SEQ ID NO: 13594 - protein, 20 aa, synthetic construct
  source 1..20: note = Seed: SATGFKQSSKALQRPVASDF
SATGFKQVSAALERPVASDF

SEQ ID NO: 13595 - protein, 20 aa, synthetic construct
  source 1..20: note = Seed: SATGFKQSSKALQRPVASDF
SATGFKQVSAALFRPVASDF

SEQ ID NO: 13596 - protein, 20 aa, synthetic construct
  source 1..20: note = Seed: SATGFKQSSKALQRPVASDF
SATGFKQVSAALGRPVASDF

SEQ ID NO: 13597 - protein, 20 aa, synthetic construct
  source 1..20: note = Seed: SATGFKQSSKALQRPVASDF
SATGFKQVSAALHRPVASDF

SEQ ID NO: 13598 - protein, 20 aa, synthetic construct
  source 1..20: note = Seed: SATGFKQSSKALQRPVASDF
SATGFKQVSAALIRPVASDF

SEQ ID NO: 13599 - protein, 20 aa, synthetic construct
  source 1..20: note = Seed: SATGFKQSSKALQRPVASDF
SATGFKQVSAALKRPVASDF

SEQ ID NO: 13600 - protein, 20 aa, synthetic construct
  source 1..20: note = Seed: SATGFKQSSKALQRPVASDF
SATGFKQVSAALLRPVASDF

SEQ ID NO: 13601 - protein, 20 aa, synthetic construct
  source 1..20: note = Seed: SATGFKQSSKALQRPVASDF
SATGFKQVSAALMRPVASDF

SEQ ID NO: 13602 - protein, 20 aa, synthetic construct
  source 1..20: note = Seed: SATGFKQSSKALQRPVASDF
SATGFKQVSAALNRPVASDF

SEQ ID NO: 13603 - protein, 20 aa, synthetic construct
  source 1..20: note = Seed: SATGFKQSSKALQRPVASDF
SATGFKQVSAALPRPVASDF

SEQ ID NO: 13604 - protein, 20 aa, synthetic construct
  source 1..20: note = Seed: SATGFKQSSKALQRPVASDF
SATGFKQVSAALQRPVASDF

SEQ ID NO: 13605 - protein, 20 aa, synthetic construct
  source 1..20: note = Seed: SATGFKQSSKALQRPVASDF
SATGFKQVSAALRRPVASDF

SEQ ID NO: 13606 - protein, 20 aa, synthetic construct
  source 1..20: note = Seed: SATGFKQSSKALQRPVASDF
SATGFKQVSAALSRPVASDF

SEQ ID NO: 13607 - protein, 20 aa, synthetic construct
  source 1..20: note = Seed: SATGFKQSSKALQRPVASDF
SATGFKQVSAALTRPVASDF

SEQ ID NO: 13608 - protein, 20 aa, synthetic construct
  source 1..20: note = Seed: SATGFKQSSKALQRPVASDF
SATGFKQVSAALVRPVASDF

SEQ ID NO: 13609 - protein, 20 aa, synthetic construct
  source 1..20: note = Seed: SATGFKQSSKALQRPVASDF
SATGFKQVSAALWRPVASDF

SEQ ID NO: 13610 - protein, 20 aa, synthetic construct
  source 1..20: note = Seed: SATGFKQSSKALQRPVASDF
SATGFKQVSAALYRPVASDF

SEQ ID NO: 13611 - protein, 20 aa, synthetic construct
  source 1..20: note = Seed: SATGFKQSSKALQRPVASDF
SATGFKQVSCALARPVASDF

SEQ ID NO: 13612 - protein, 20 aa, synthetic construct
  source 1..20: note = Seed: SATGFKQSSKALQRPVASDF
SATGFKQVSCALNRPVASDF

SEQ ID NO: 13613 - protein, 20 aa, synthetic construct
  source 1..20: note = Seed: SATGFKQSSKALQRPVASDF
SATGFKQVSCALSRPVASDF

SEQ ID NO: 13614 - protein, 20 aa, synthetic construct
  source 1..20: note = Seed: SATGFKQSSKALQRPVASDF
SATGFKQVSCALVRPVASDF

SEQ ID NO: 13615 - protein, 20 aa, synthetic construct
  source 1..20: note = Seed: SATGFKQSSKALQRPVASDF
SATGFKQVSDALARPVASDF

SEQ ID NO: 13616 - protein, 20 aa, synthetic construct
  source 1..20: note = Seed: SATGFKQSSKALQRPVASDF
SATGFKQVSEALARPVASDF

SEQ ID NO: 13617 - protein, 20 aa, synthetic construct
  source 1..20: note = Seed: SATGFKQSSKALQRPVASDF
SATGFKQVSEALNRPVASDF

SEQ ID NO: 13618 - protein, 20 aa, synthetic construct
  source 1..20: note = Seed: SATGFKQSSKALQRPVASDF
SATGFKQVSEALSRPVASDF

SEQ ID NO: 13619 - protein, 20 aa, synthetic construct
  source 1..20: note = Seed: SATGFKQSSKALQRPVASDF
SATGFKQVSFALARPVASDF

SEQ ID NO: 13620 - protein, 20 aa, synthetic construct
  source 1..20: note = Seed: SATGFKQSSKALQRPVASDF
SATGFKQVSFALDRPVASDF

SEQ ID NO: 13621 - protein, 20 aa, synthetic construct
  source 1..20: note = Seed: SATGFKQSSKALQRPVASDF
SATGFKQVSFALERPVASDF

SEQ ID NO: 13622 - protein, 20 aa, synthetic construct
  source 1..20: note = Seed: SATGFKQSSKALQRPVASDF
SATGFKQVSFALHRPVASDF

SEQ ID NO: 13623 - protein, 20 aa, synthetic construct
  source 1..20: note = Seed: SATGFKQSSKALQRPVASDF
SATGFKQVSFALIRPVASDF

SEQ ID NO: 13624 - protein, 20 aa, synthetic construct
  source 1..20: note = Seed: SATGFKQSSKALQRPVASDF
SATGFKQVSFALLRPVASDF

SEQ ID NO: 13625 - protein, 20 aa, synthetic construct
  source 1..20: note = Seed: SATGFKQSSKALQRPVASDF
SATGFKQVSFALMRPVASDF

SEQ ID NO: 13626 - protein, 20 aa, synthetic construct
  source 1..20: note = Seed: SATGFKQSSKALQRPVASDF
SATGFKQVSFALNRPVASDF

SEQ ID NO: 13627 - protein, 20 aa, synthetic construct
  source 1..20: note = Seed: SATGFKQSSKALQRPVASDF
SATGFKQVSFALPRPVASDF

SEQ ID NO: 13628 - protein, 20 aa, synthetic construct
  source 1..20: note = Seed: SATGFKQSSKALQRPVASDF
SATGFKQVSFALQRPVASDF

SEQ ID NO: 13629 - protein, 20 aa, synthetic construct
  source 1..20: note = Seed: SATGFKQSSKALQRPVASDF
SATGFKQVSFALSRPVASDF

SEQ ID NO: 13630 - protein, 20 aa, synthetic construct
  source 1..20: note = Seed: SATGFKQSSKALQRPVASDF
SATGFKQVSFALTRPVASDF

SEQ ID NO: 13631 - protein, 20 aa, synthetic construct
  source 1..20: note = Seed: SATGFKQSSKALQRPVASDF
SATGFKQVSFALVRPVASDF

SEQ ID NO: 13632 - protein, 20 aa, synthetic construct
  source 1..20: note = Seed: SATGFKQSSKALQRPVASDF
SATGFKQVSFALYRPVASDF

SEQ ID NO: 13633 - protein, 20 aa, synthetic construct
  source 1..20: note = Seed: SATGFKQSSKALQRPVASDF
SATGFKQVSGALARPVASDF

SEQ ID NO: 13634 - protein, 20 aa, synthetic construct
  source 1..20: note = Seed: SATGFKQSSKALQRPVASDF
SATGFKQVSGALCRPVASDF

SEQ ID NO: 13635 - protein, 20 aa, synthetic construct
  source 1..20: note = Seed: SATGFKQSSKALQRPVASDF
SATGFKQVSGALDRPVASDF

SEQ ID NO: 13636 - protein, 20 aa, synthetic construct
  source 1..20: note = Seed: SATGFKQSSKALQRPVASDF
SATGFKQVSGALERPVASDF

SEQ ID NO: 13637 - protein, 20 aa, synthetic construct
  source 1..20: note = Seed: SATGFKQSSKALQRPVASDF
SATGFKQVSGALFRPVASDF

SEQ ID NO: 13638 - protein, 20 aa, synthetic construct
  source 1..20: note = Seed: SATGFKQSSKALQRPVASDF
SATGFKQVSGALGRPVASDF

SEQ ID NO: 13639 - protein, 20 aa, synthetic construct
  source 1..20: note = Seed: SATGFKQSSKALQRPVASDF
SATGFKQVSGALHRPVASDF

SEQ ID NO: 13640 - protein, 20 aa, synthetic construct
  source 1..20: note = Seed: SATGFKQSSKALQRPVASDF
SATGFKQVSGALIRPVASDF

SEQ ID NO: 13641 - protein, 20 aa, synthetic construct
  source 1..20: note = Seed: SATGFKQSSKALQRPVASDF
SATGFKQVSGALLRPVASDF

SEQ ID NO: 13642 - protein, 20 aa, synthetic construct
  source 1..20: note = Seed: SATGFKQSSKALQRPVASDF
SATGFKQVSGALMRPVASDF

SEQ ID NO: 13643 - protein, 20 aa, synthetic construct
  source 1..20: note = Seed: SATGFKQSSKALQRPVASDF
SATGFKQVSGALNRPVASDF

SEQ ID NO: 13644 - protein, 20 aa, synthetic construct
  source 1..20: note = Seed: SATGFKQSSKALQRPVASDF
SATGFKQVSGALPRPVASDF

SEQ ID NO: 13645 - protein, 20 aa, synthetic construct
  source 1..20: note = Seed: SATGFKQSSKALQRPVASDF
SATGFKQVSGALQRPVASDF

SEQ ID NO: 13646 - protein, 20 aa, synthetic construct
  source 1..20: note = Seed: SATGFKQSSKALQRPVASDF
SATGFKQVSGALRRPVASDF

SEQ ID NO: 13647 - protein, 20 aa, synthetic construct
  source 1..20: note = Seed: SATGFKQSSKALQRPVASDF
SATGFKQVSGALSRPVASDF

SEQ ID NO: 13648 - protein, 20 aa, synthetic construct
  source 1..20: note = Seed: SATGFKQSSKALQRPVASDF
SATGFKQVSGALTRPVASDF

SEQ ID NO: 13649 - protein, 20 aa, synthetic construct
  source 1..20: note = Seed: SATGFKQSSKALQRPVASDF
SATGFKQVSGALVRPVASDF

SEQ ID NO: 13650 - protein, 20 aa, synthetic construct
  source 1..20: note = Seed: SATGFKQSSKALQRPVASDF
SATGFKQVSGALYRPVASDF

SEQ ID NO: 13651 - protein, 20 aa, synthetic construct
  source 1..20: note = Seed: SATGFKQSSKALQRPVASDF
SATGFKQVSHALARPVASDF

SEQ ID NO: 13652 - protein, 20 aa, synthetic construct
  source 1..20: note = Seed: SATGFKQSSKALQRPVASDF
SATGFKQVSHALGRPVASDF

SEQ ID NO: 13653 - protein, 20 aa, synthetic construct
  source 1..20: note = Seed: SATGFKQSSKALQRPVASDF
SATGFKQVSHALHRPVASDF

SEQ ID NO: 13654 - protein, 20 aa, synthetic construct
  source 1..20: note = Seed: SATGFKQSSKALQRPVASDF
SATGFKQVSHALIRPVASDF

SEQ ID NO: 13655 - protein, 20 aa, synthetic construct
  source 1..20: note = Seed: SATGFKQSSKALQRPVASDF
SATGFKQVSHALKRPVASDF

SEQ ID NO: 13656 - protein, 20 aa, synthetic construct
  source 1..20: note = Seed: SATGFKQSSKALQRPVASDF
SATGFKQVSHALLRPVASDF

SEQ ID NO: 13657 - protein, 20 aa, synthetic construct
  source 1..20: note = Seed: SATGFKQSSKALQRPVASDF
SATGFKQVSHALMRPVASDF

SEQ ID NO: 13658 - protein, 20 aa, synthetic construct
  source 1..20: note = Seed: SATGFKQSSKALQRPVASDF
SATGFKQVSHALNRPVASDF

SEQ ID NO: 13659 - protein, 20 aa, synthetic construct
  source 1..20: note = Seed: SATGFKQSSKALQRPVASDF
SATGFKQVSHALRRPVASDF

SEQ ID NO: 13660 - protein, 20 aa, synthetic construct
  source 1..20: note = Seed: SATGFKQSSKALQRPVASDF
SATGFKQVSHALSRPVASDF

SEQ ID NO: 13661 - protein, 20 aa, synthetic construct
  source 1..20: note = Seed: SATGFKQSSKALQRPVASDF
SATGFKQVSHALTRPVASDF

SEQ ID NO: 13662 - protein, 20 aa, synthetic construct
  source 1..20: note = Seed: SATGFKQSSKALQRPVASDF
SATGFKQVSHALVRPVASDF

SEQ ID NO: 13663 - protein, 20 aa, synthetic construct
  source 1..20: note = Seed: SATGFKQSSKALQRPVASDF
SATGFKQVSIALARPVASDF

SEQ ID NO: 13664 - protein, 20 aa, synthetic construct
  source 1..20: note = Seed: SATGFKQSSKALQRPVASDF
SATGFKQVSIALCRPVASDF

SEQ ID NO: 13665 - protein, 20 aa, synthetic construct
  source 1..20: note = Seed: SATGFKQSSKALQRPVASDF
SATGFKQVSIALDRPVASDF

SEQ ID NO: 13666 - protein, 20 aa, synthetic construct
  source 1..20: note = Seed: SATGFKQSSKALQRPVASDF
SATGFKQVSIALGRPVASDF

SEQ ID NO: 13667 - protein, 20 aa, synthetic construct
  source 1..20: note = Seed: SATGFKQSSKALQRPVASDF
SATGFKQVSIALHRPVASDF

SEQ ID NO: 13668 - protein, 20 aa, synthetic construct
  source 1..20: note = Seed: SATGFKQSSKALQRPVASDF
SATGFKQVSIALKRPVASDF

SEQ ID NO: 13669 - protein, 20 aa, synthetic construct
  source 1..20: note = Seed: SATGFKQSSKALQRPVASDF
SATGFKQVSIALMRPVASDF

SEQ ID NO: 13670 - protein, 20 aa, synthetic construct
  source 1..20: note = Seed: SATGFKQSSKALQRPVASDF
SATGFKQVSIALNRPVASDF

SEQ ID NO: 13671 - protein, 20 aa, synthetic construct
  source 1..20: note = Seed: SATGFKQSSKALQRPVASDF
SATGFKQVSIALPRPVASDF

SEQ ID NO: 13672 - protein, 20 aa, synthetic construct
  source 1..20: note = Seed: SATGFKQSSKALQRPVASDF
SATGFKQVSIALQRPVASDF

SEQ ID NO: 13673 - protein, 20 aa, synthetic construct
  source 1..20: note = Seed: SATGFKQSSKALQRPVASDF
SATGFKQVSIALSRPVASDF

SEQ ID NO: 13674 - protein, 20 aa, synthetic construct
  source 1..20: note = Seed: SATGFKQSSKALQRPVASDF
SATGFKQVSIALTRPVASDF

SEQ ID NO: 13675 - protein, 20 aa, synthetic construct
  source 1..20: note = Seed: SATGFKQSSKALQRPVASDF
SATGFKQVSIALVRPVASDF

SEQ ID NO: 13676 - protein, 20 aa, synthetic construct
  source 1..20: note = Seed: SATGFKQSSKALQRPVASDF
SATGFKQVSIALYRPVASDF

SEQ ID NO: 13677 - protein, 20 aa, synthetic construct
  source 1..20: note = Seed: SATGFKQSSKALQRPVASDF
SATGFKQVSKALARPVASDF

SEQ ID NO: 13678 - protein, 20 aa, synthetic construct
  source 1..20: note = Seed: SATGFKQSSKALQRPVASDF
SATGFKQVSKALCRPVASDF

SEQ ID NO: 13679 - protein, 20 aa, synthetic construct
  source 1..20: note = Seed: SATGFKQSSKALQRPVASDF
SATGFKQVSKALDRPVASDF

SEQ ID NO: 13680 - protein, 20 aa, synthetic construct
  source 1..20: note = Seed: SATGFKQSSKALQRPVASDF
SATGFKQVSKALERPVASDF

SEQ ID NO: 13681 - protein, 20 aa, synthetic construct
  source 1..20: note = Seed: SATGFKQSSKALQRPVASDF
SATGFKQVSKALFRPVASDF

SEQ ID NO: 13682 - protein, 20 aa, synthetic construct
  source 1..20: note = Seed: SATGFKQSSKALQRPVASDF
SATGFKQVSKALGRPVASDF

SEQ ID NO: 13683 - protein, 20 aa, synthetic construct
  source 1..20: note = Seed: SATGFKQSSKALQRPVASDF
SATGFKQVSKALHRPVASDF

SEQ ID NO: 13684 - protein, 20 aa, synthetic construct
  source 1..20: note = Seed: SATGFKQSSKALQRPVASDF
SATGFKQVSKALIRPVASDF

SEQ ID NO: 13685 - protein, 20 aa, synthetic construct
  source 1..20: note = Seed: SATGFKQSSKALQRPVASDF
SATGFKQVSKALKRPVASDF

SEQ ID NO: 13686 - protein, 20 aa, synthetic construct
  source 1..20: note = Seed: SATGFKQSSKALQRPVASDF
SATGFKQVSKALLRPVASDF

SEQ ID NO: 13687 - protein, 20 aa, synthetic construct
  source 1..20: note = Seed: SATGFKQSSKALQRPVASDF
SATGFKQVSKALMRPVASDF

SEQ ID NO: 13688 - protein, 20 aa, synthetic construct
  source 1..20: note = Seed: SATGFKQSSKALQRPVASDF
SATGFKQVSKALNRPVASDF

SEQ ID NO: 13689 - protein, 20 aa, synthetic construct
  source 1..20: note = Seed: SATGFKQSSKALQRPVASDF
SATGFKQVSKALPRPVASDF

SEQ ID NO: 13690 - protein, 20 aa, synthetic construct
  source 1..20: note = Seed: SATGFKQSSKALQRPVASDF
SATGFKQVSKALQRPVASDF

SEQ ID NO: 13691 - protein, 20 aa, synthetic construct
  source 1..20: note = Seed: SATGFKQSSKALQRPVASDF
SATGFKQVSKALRRPVASDF

SEQ ID NO: 13692 - protein, 20 aa, synthetic construct
  source 1..20: note = Seed: SATGFKQSSKALQRPVASDF
SATGFKQVSKALSRPVASDF

SEQ ID NO: 13693 - protein, 20 aa, synthetic construct
  source 1..20: note = Seed: SATGFKQSSKALQRPVASDF
SATGFKQVSKALTRPVASDF

SEQ ID NO: 13694 - protein, 20 aa, synthetic construct
  source 1..20: note = Seed: SATGFKQSSKALQRPVASDF
SATGFKQVSKALVRPVASDF

SEQ ID NO: 13695 - protein, 20 aa, synthetic construct
  source 1..20: note = Seed: SATGFKQSSKALQRPVASDF
SATGFKQVSKALWRPVASDF

SEQ ID NO: 13696 - protein, 20 aa, synthetic construct
  source 1..20: note = Seed: SATGFKQSSKALQRPVASDF
SATGFKQVSKALYRPVASDF

SEQ ID NO: 13697 - protein, 20 aa, synthetic construct
  source 1..20: note = Seed: SATGFKQSSKALQRPVASDF
SATGFKQVSLALARPVASDF

SEQ ID NO: 13698 - protein, 20 aa, synthetic construct
  source 1..20: note = Seed: SATGFKQSSKALQRPVASDF
SATGFKQVSLALCRPVASDF

SEQ ID NO: 13699 - protein, 20 aa, synthetic construct
  source 1..20: note = Seed: SATGFKQSSKALQRPVASDF
SATGFKQVSLALDRPVASDF

SEQ ID NO: 13700 - protein, 20 aa, synthetic construct
  source 1..20: note = Seed: SATGFKQSSKALQRPVASDF
SATGFKQVSLALGRPVASDF

SEQ ID NO: 13701 - protein, 20 aa, synthetic construct
  source 1..20: note = Seed: SATGFKQSSKALQRPVASDF
SATGFKQVSLALHRPVASDF

SEQ ID NO: 13702 - protein, 20 aa, synthetic construct
  source 1..20: note = Seed: SATGFKQSSKALQRPVASDF
SATGFKQVSLALIRPVASDF

SEQ ID NO: 13703 - protein, 20 aa, synthetic construct
  source 1..20: note = Seed: SATGFKQSSKALQRPVASDF
SATGFKQVSLALLRPVASDF

SEQ ID NO: 13704 - protein, 20 aa, synthetic construct
  source 1..20: note = Seed: SATGFKQSSKALQRPVASDF
SATGFKQVSLALMRPVASDF

SEQ ID NO: 13705 - protein, 20 aa, synthetic construct
  source 1..20: note = Seed: SATGFKQSSKALQRPVASDF
SATGFKQVSLALNRPVASDF

SEQ ID NO: 13706 - protein, 20 aa, synthetic construct
  source 1..20: note = Seed: SATGFKQSSKALQRPVASDF
SATGFKQVSLALSRPVASDF

SEQ ID NO: 13707 - protein, 20 aa, synthetic construct
  source 1..20: note = Seed: SATGFKQSSKALQRPVASDF
SATGFKQVSLALTRPVASDF

SEQ ID NO: 13708 - protein, 20 aa, synthetic construct
  source 1..20: note = Seed: SATGFKQSSKALQRPVASDF
SATGFKQVSLALVRPVASDF

SEQ ID NO: 13709 - protein, 20 aa, synthetic construct
  source 1..20: note = Seed: SATGFKQSSKALQRPVASDF
SATGFKQVSMALARPVASDF

SEQ ID NO: 13710 - protein, 20 aa, synthetic construct
  source 1..20: note = Seed: SATGFKQSSKALQRPVASDF
SATGFKQVSMALCRPVASDF

SEQ ID NO: 13711 - protein, 20 aa, synthetic construct
  source 1..20: note = Seed: SATGFKQSSKALQRPVASDF
SATGFKQVSMALDRPVASDF

SEQ ID NO: 13712 - protein, 20 aa, synthetic construct
  source 1..20: note = Seed: SATGFKQSSKALQRPVASDF
SATGFKQVSMALGRPVASDF

SEQ ID NO: 13713 - protein, 20 aa, synthetic construct
  source 1..20: note = Seed: SATGFKQSSKALQRPVASDF
SATGFKQVSMALHRPVASDF

SEQ ID NO: 13714 - protein, 20 aa, synthetic construct
  source 1..20: note = Seed: SATGFKQSSKALQRPVASDF
SATGFKQVSMALIRPVASDF

SEQ ID NO: 13715 - protein, 20 aa, synthetic construct
  source 1..20: note = Seed: SATGFKQSSKALQRPVASDF
SATGFKQVSMALMRPVASDF

SEQ ID NO: 13716 - protein, 20 aa, synthetic construct
  source 1..20: note = Seed: SATGFKQSSKALQRPVASDF
SATGFKQVSMALNRPVASDF

SEQ ID NO: 13717 - protein, 20 aa, synthetic construct
  source 1..20: note = Seed: SATGFKQSSKALQRPVASDF
SATGFKQVSMALSRPVASDF

SEQ ID NO: 13718 - protein, 20 aa, synthetic construct
  source 1..20: note = Seed: SATGFKQSSKALQRPVASDF
SATGFKQVSMALVRPVASDF

SEQ ID NO: 13719 - protein, 20 aa, synthetic construct
  source 1..20: note = Seed: SATGFKQSSKALQRPVASDF
SATGFKQVSNALARPVASDF

SEQ ID NO: 13720 - protein, 20 aa, synthetic construct
  source 1..20: note = Seed: SATGFKQSSKALQRPVASDF
SATGFKQVSNALCRPVASDF

SEQ ID NO: 13721 - protein, 20 aa, synthetic construct
  source 1..20: note = Seed: SATGFKQSSKALQRPVASDF
SATGFKQVSNALDRPVASDF

SEQ ID NO: 13722 - protein, 20 aa, synthetic construct
  source 1..20: note = Seed: SATGFKQSSKALQRPVASDF
SATGFKQVSNALFRPVASDF

SEQ ID NO: 13723 - protein, 20 aa, synthetic construct
  source 1..20: note = Seed: SATGFKQSSKALQRPVASDF
SATGFKQVSNALGRPVASDF

SEQ ID NO: 13724 - protein, 20 aa, synthetic construct
  source 1..20: note = Seed: SATGFKQSSKALQRPVASDF
SATGFKQVSNALHRPVASDF

SEQ ID NO: 13725 - protein, 20 aa, synthetic construct
  source 1..20: note = Seed: SATGFKQSSKALQRPVASDF
SATGFKQVSNALIRPVASDF

SEQ ID NO: 13726 - protein, 20 aa, synthetic construct
  source 1..20: note = Seed: SATGFKQSSKALQRPVASDF
SATGFKQVSNALLRPVASDF

SEQ ID NO: 13727 - protein, 20 aa, synthetic construct
  source 1..20: note = Seed: SATGFKQSSKALQRPVASDF
SATGFKQVSNALMRPVASDF

SEQ ID NO: 13728 - protein, 20 aa, synthetic construct
  source 1..20: note = Seed: SATGFKQSSKALQRPVASDF
SATGFKQVSNALNRPVASDF

SEQ ID NO: 13729 - protein, 20 aa, synthetic construct
  source 1..20: note = Seed: SATGFKQSSKALQRPVASDF
SATGFKQVSNALPRPVASDF

SEQ ID NO: 13730 - protein, 20 aa, synthetic construct
  source 1..20: note = Seed: SATGFKQSSKALQRPVASDF
SATGFKQVSNALQRPVASDF

SEQ ID NO: 13731 - protein, 20 aa, synthetic construct
  source 1..20: note = Seed: SATGFKQSSKALQRPVASDF
SATGFKQVSNALSRPVASDF

SEQ ID NO: 13732 - protein, 20 aa, synthetic construct
  source 1..20: note = Seed: SATGFKQSSKALQRPVASDF
SATGFKQVSNALTRPVASDF

SEQ ID NO: 13733 - protein, 20 aa, synthetic construct
  source 1..20: note = Seed: SATGFKQSSKALQRPVASDF
SATGFKQVSNALVRPVASDF

SEQ ID NO: 13734 - protein, 20 aa, synthetic construct
  source 1..20: note = Seed: SATGFKQSSKALQRPVASDF
SATGFKQVSPALARPVASDF

SEQ ID NO: 13735 - protein, 20 aa, synthetic construct
  source 1..20: note = Seed: SATGFKQSSKALQRPVASDF
SATGFKQVSPALCRPVASDF

SEQ ID NO: 13736 - protein, 20 aa, synthetic construct
  source 1..20: note = Seed: SATGFKQSSKALQRPVASDF
SATGFKQVSPALDRPVASDF

SEQ ID NO: 13737 - protein, 20 aa, synthetic construct
  source 1..20: note = Seed: SATGFKQSSKALQRPVASDF
SATGFKQVSPALERPVASDF

SEQ ID NO: 13738 - protein, 20 aa, synthetic construct
  source 1..20: note = Seed: SATGFKQSSKALQRPVASDF
SATGFKQVSPALFRPVASDF

SEQ ID NO: 13739 - protein, 20 aa, synthetic construct
  source 1..20: note = Seed: SATGFKQSSKALQRPVASDF
SATGFKQVSPALGRPVASDF

SEQ ID NO: 13740 - protein, 20 aa, synthetic construct
  source 1..20: note = Seed: SATGFKQSSKALQRPVASDF
SATGFKQVSPALHRPVASDF

SEQ ID NO: 13741 - protein, 20 aa, synthetic construct
  source 1..20: note = Seed: SATGFKQSSKALQRPVASDF
SATGFKQVSPALIRPVASDF

SEQ ID NO: 13742 - protein, 20 aa, synthetic construct
  source 1..20: note = Seed: SATGFKQSSKALQRPVASDF
SATGFKQVSPALLRPVASDF

SEQ ID NO: 13743 - protein, 20 aa, synthetic construct
  source 1..20: note = Seed: SATGFKQSSKALQRPVASDF
SATGFKQVSPALMRPVASDF

SEQ ID NO: 13744 - protein, 20 aa, synthetic construct
  source 1..20: note = Seed: SATGFKQSSKALQRPVASDF
SATGFKQVSPALNRPVASDF

SEQ ID NO: 13745 - protein, 20 aa, synthetic construct
  source 1..20: note = Seed: SATGFKQSSKALQRPVASDF
SATGFKQVSPALPRPVASDF

SEQ ID NO: 13746 - protein, 20 aa, synthetic construct
  source 1..20: note = Seed: SATGFKQSSKALQRPVASDF
SATGFKQVSPALQRPVASDF

SEQ ID NO: 13747 - protein, 20 aa, synthetic construct
  source 1..20: note = Seed: SATGFKQSSKALQRPVASDF
SATGFKQVSPALSRPVASDF

SEQ ID NO: 13748 - protein, 20 aa, synthetic construct
  source 1..20: note = Seed: SATGFKQSSKALQRPVASDF
SATGFKQVSPALTRPVASDF

SEQ ID NO: 13749 - protein, 20 aa, synthetic construct
  source 1..20: note = Seed: SATGFKQSSKALQRPVASDF
SATGFKQVSPALVRPVASDF

SEQ ID NO: 13750 - protein, 20 aa, synthetic construct
  source 1..20: note = Seed: SATGFKQSSKALQRPVASDF
SATGFKQVSPALWRPVASDF

SEQ ID NO: 13751 - protein, 20 aa, synthetic construct
  source 1..20: note = Seed: SATGFKQSSKALQRPVASDF
SATGFKQVSPALYRPVASDF

SEQ ID NO: 13752 - protein, 20 aa, synthetic construct
  source 1..20: note = Seed: SATGFKQSSKALQRPVASDF
SATGFKQVSQALARPVASDF

SEQ ID NO: 13753 - protein, 20 aa, synthetic construct
  source 1..20: note = Seed: SATGFKQSSKALQRPVASDF
SATGFKQVSQALIRPVASDF

SEQ ID NO: 13754 - protein, 20 aa, synthetic construct
  source 1..20: note = Seed: SATGFKQSSKALQRPVASDF
SATGFKQVSQALLRPVASDF

SEQ ID NO: 13755 - protein, 20 aa, synthetic construct
  source 1..20: note = Seed: SATGFKQSSKALQRPVASDF
SATGFKQVSQALMRPVASDF

SEQ ID NO: 13756 - protein, 20 aa, synthetic construct
  source 1..20: note = Seed: SATGFKQSSKALQRPVASDF
SATGFKQVSQALNRPVASDF

SEQ ID NO: 13757 - protein, 20 aa, synthetic construct
  source 1..20: note = Seed: SATGFKQSSKALQRPVASDF
SATGFKQVSQALSRPVASDF

SEQ ID NO: 13758 - protein, 20 aa, synthetic construct
  source 1..20: note = Seed: SATGFKQSSKALQRPVASDF
SATGFKQVSQALTRPVASDF

SEQ ID NO: 13759 - protein, 20 aa, synthetic construct
  source 1..20: note = Seed: SATGFKQSSKALQRPVASDF
SATGFKQVSQALVRPVASDF

SEQ ID NO: 13760 - protein, 20 aa, synthetic construct
  source 1..20: note = Seed: SATGFKQSSKALQRPVASDF
SATGFKQVSRALARPVASDF

SEQ ID NO: 13761 - protein, 20 aa, synthetic construct
  source 1..20: note = Seed: SATGFKQSSKALQRPVASDF
SATGFKQVSRALCRPVASDF

SEQ ID NO: 13762 - protein, 20 aa, synthetic construct
  source 1..20: note = Seed: SATGFKQSSKALQRPVASDF
SATGFKQVSRALDRPVASDF

SEQ ID NO: 13763 - protein, 20 aa, synthetic construct
  source 1..20: note = Seed: SATGFKQSSKALQRPVASDF
SATGFKQVSRALERPVASDF

SEQ ID NO: 13764 - protein, 20 aa, synthetic construct
  source 1..20: note = Seed: SATGFKQSSKALQRPVASDF
SATGFKQVSRALFRPVASDF

SEQ ID NO: 13765 - protein, 20 aa, synthetic construct
  source 1..20: note = Seed: SATGFKQSSKALQRPVASDF
SATGFKQVSRALGRPVASDF

SEQ ID NO: 13766 - protein, 20 aa, synthetic construct
  source 1..20: note = Seed: SATGFKQSSKALQRPVASDF
SATGFKQVSRALHRPVASDF

SEQ ID NO: 13767 - protein, 20 aa, synthetic construct
  source 1..20: note = Seed: SATGFKQSSKALQRPVASDF
SATGFKQVSRALIRPVASDF

SEQ ID NO: 13768 - protein, 20 aa, synthetic construct
  source 1..20: note = Seed: SATGFKQSSKALQRPVASDF
SATGFKQVSRALKRPVASDF

SEQ ID NO: 13769 - protein, 20 aa, synthetic construct
  source 1..20: note = Seed: SATGFKQSSKALQRPVASDF
SATGFKQVSRALLRPVASDF

SEQ ID NO: 13770 - protein, 20 aa, synthetic construct
  source 1..20: note = Seed: SATGFKQSSKALQRPVASDF
SATGFKQVSRALMRPVASDF

SEQ ID NO: 13771 - protein, 20 aa, synthetic construct
  source 1..20: note = Seed: SATGFKQSSKALQRPVASDF
SATGFKQVSRALNRPVASDF

SEQ ID NO: 13772 - protein, 20 aa, synthetic construct
  source 1..20: note = Seed: SATGFKQSSKALQRPVASDF
SATGFKQVSRALPRPVASDF

SEQ ID NO: 13773 - protein, 20 aa, synthetic construct
  source 1..20: note = Seed: SATGFKQSSKALQRPVASDF
SATGFKQVSRALQRPVASDF

SEQ ID NO: 13774 - protein, 20 aa, synthetic construct
  source 1..20: note = Seed: SATGFKQSSKALQRPVASDF
SATGFKQVSRALRRPVASDF

SEQ ID NO: 13775 - protein, 20 aa, synthetic construct
  source 1..20: note = Seed: SATGFKQSSKALQRPVASDF
SATGFKQVSRALSRPVASDF

SEQ ID NO: 13776 - protein, 20 aa, synthetic construct
  source 1..20: note = Seed: SATGFKQSSKALQRPVASDF
SATGFKQVSRALTRPVASDF

SEQ ID NO: 13777 - protein, 20 aa, synthetic construct
  source 1..20: note = Seed: SATGFKQSSKALQRPVASDF
SATGFKQVSRALVRPVASDF

SEQ ID NO: 13778 - protein, 20 aa, synthetic construct
  source 1..20: note = Seed: SATGFKQSSKALQRPVASDF
SATGFKQVSRALWRPVASDF

SEQ ID NO: 13779 - protein, 20 aa, synthetic construct
  source 1..20: note = Seed: SATGFKQSSKALQRPVASDF
SATGFKQVSRALYRPVASDF

SEQ ID NO: 13780 - protein, 20 aa, synthetic construct
  source 1..20: note = Seed: SATGFKQSSKALQRPVASDF
SATGFKQVSSALARPVASDF

SEQ ID NO: 13781 - protein, 20 aa, synthetic construct
  source 1..20: note = Seed: SATGFKQSSKALQRPVASDF
SATGFKQVSSALCRPVASDF

SEQ ID NO: 13782 - protein, 20 aa, synthetic construct
  source 1..20: note = Seed: SATGFKQSSKALQRPVASDF
SATGFKQVSSALDRPVASDF

SEQ ID NO: 13783 - protein, 20 aa, synthetic construct
  source 1..20: note = Seed: SATGFKQSSKALQRPVASDF
SATGFKQVSSALERPVASDF

SEQ ID NO: 13784 - protein, 20 aa, synthetic construct
  source 1..20: note = Seed: SATGFKQSSKALQRPVASDF
SATGFKQVSSALFRPVASDF

SEQ ID NO: 13785 - protein, 20 aa, synthetic construct
  source 1..20: note = Seed: SATGFKQSSKALQRPVASDF
SATGFKQVSSALGRPVASDF

SEQ ID NO: 13786 - protein, 20 aa, synthetic construct
  source 1..20: note = Seed: SATGFKQSSKALQRPVASDF
SATGFKQVSSALHRPVASDF

SEQ ID NO: 13787 - protein, 20 aa, synthetic construct
  source 1..20: note = Seed: SATGFKQSSKALQRPVASDF
SATGFKQVSSALIRPVASDF

SEQ ID NO: 13788 - protein, 20 aa, synthetic construct
  source 1..20: note = Seed: SATGFKQSSKALQRPVASDF
SATGFKQVSSALKRPVASDF

SEQ ID NO: 13789 - protein, 20 aa, synthetic construct
  source 1..20: note = Seed: SATGFKQSSKALQRPVASDF
SATGFKQVSSALLRPVASDF

SEQ ID NO: 13790 - protein, 20 aa, synthetic construct
  source 1..20: note = Seed: SATGFKQSSKALQRPVASDF
SATGFKQVSSALMRPVASDF

SEQ ID NO: 13791 - protein, 20 aa, synthetic construct
  source 1..20: note = Seed: SATGFKQSSKALQRPVASDF
SATGFKQVSSALNRPVASDF

SEQ ID NO: 13792 - protein, 20 aa, synthetic construct
  source 1..20: note = Seed: SATGFKQSSKALQRPVASDF
SATGFKQVSSALPRPVASDF

SEQ ID NO: 13793 - protein, 20 aa, synthetic construct
  source 1..20: note = Seed: SATGFKQSSKALQRPVASDF
SATGFKQVSSALQRPVASDF

SEQ ID NO: 13794 - protein, 20 aa, synthetic construct
  source 1..20: note = Seed: SATGFKQSSKALQRPVASDF
SATGFKQVSSALRRPVASDF

SEQ ID NO: 13795 - protein, 20 aa, synthetic construct
  source 1..20: note = Seed: SATGFKQSSKALQRPVASDF
SATGFKQVSSALSRPVASDF

SEQ ID NO: 13796 - protein, 20 aa, synthetic construct
  source 1..20: note = Seed: SATGFKQSSKALQRPVASDF
SATGFKQVSSALTRPVASDF

SEQ ID NO: 13797 - protein, 20 aa, synthetic construct
  source 1..20: note = Seed: SATGFKQSSKALQRPVASDF
SATGFKQVSSALVRPVASDF

SEQ ID NO: 13798 - protein, 20 aa, synthetic construct
  source 1..20: note = Seed: SATGFKQSSKALQRPVASDF
SATGFKQVSSALYRPVASDF

SEQ ID NO: 13799 - protein, 20 aa, synthetic construct
  source 1..20: note = Seed: SATGFKQSSKALQRPVASDF
SATGFKQVSTALARPVASDF

SEQ ID NO: 13800 - protein, 20 aa, synthetic construct
  source 1..20: note = Seed: SATGFKQSSKALQRPVASDF
SATGFKQVSTALCRPVASDF

SEQ ID NO: 13801 - protein, 20 aa, synthetic construct
  source 1..20: note = Seed: SATGFKQSSKALQRPVASDF
SATGFKQVSTALDRPVASDF

SEQ ID NO: 13802 - protein, 20 aa, synthetic construct
  source 1..20: note = Seed: SATGFKQSSKALQRPVASDF
SATGFKQVSTALERPVASDF

SEQ ID NO: 13803 - protein, 20 aa, synthetic construct
  source 1..20: note = Seed: SATGFKQSSKALQRPVASDF
SATGFKQVSTALFRPVASDF

SEQ ID NO: 13804 - protein, 20 aa, synthetic construct
  source 1..20: note = Seed: SATGFKQSSKALQRPVASDF
SATGFKQVSTALGRPVASDF

SEQ ID NO: 13805 - protein, 20 aa, synthetic construct
  source 1..20: note = Seed: SATGFKQSSKALQRPVASDF
SATGFKQVSTALHRPVASDF

SEQ ID NO: 13806 - protein, 20 aa, synthetic construct
  source 1..20: note = Seed: SATGFKQSSKALQRPVASDF
SATGFKQVSTALIRPVASDF

SEQ ID NO: 13807 - protein, 20 aa, synthetic construct
  source 1..20: note = Seed: SATGFKQSSKALQRPVASDF
SATGFKQVSTALKRPVASDF

SEQ ID NO: 13808 - protein, 20 aa, synthetic construct
  source 1..20: note = Seed: SATGFKQSSKALQRPVASDF
SATGFKQVSTALLRPVASDF

SEQ ID NO: 13809 - protein, 20 aa, synthetic construct
  source 1..20: note = Seed: SATGFKQSSKALQRPVASDF
SATGFKQVSTALMRPVASDF

SEQ ID NO: 13810 - protein, 20 aa, synthetic construct
  source 1..20: note = Seed: SATGFKQSSKALQRPVASDF
SATGFKQVSTALNRPVASDF

SEQ ID NO: 13811 - protein, 20 aa, synthetic construct
  source 1..20: note = Seed: SATGFKQSSKALQRPVASDF
SATGFKQVSTALPRPVASDF

SEQ ID NO: 13812 - protein, 20 aa, synthetic construct
  source 1..20: note = Seed: SATGFKQSSKALQRPVASDF
SATGFKQVSTALQRPVASDF

SEQ ID NO: 13813 - protein, 20 aa, synthetic construct
  source 1..20: note = Seed: SATGFKQSSKALQRPVASDF
SATGFKQVSTALSRPVASDF

SEQ ID NO: 13814 - protein, 20 aa, synthetic construct
  source 1..20: note = Seed: SATGFKQSSKALQRPVASDF
SATGFKQVSTALTRPVASDF

SEQ ID NO: 13815 - protein, 20 aa, synthetic construct
  source 1..20: note = Seed: SATGFKQSSKALQRPVASDF
SATGFKQVSTALVRPVASDF

SEQ ID NO: 13816 - protein, 20 aa, synthetic construct
  source 1..20: note = Seed: SATGFKQSSKALQRPVASDF
SATGFKQVSTALYRPVASDF

SEQ ID NO: 13817 - protein, 20 aa, synthetic construct
  source 1..20: note = Seed: SATGFKQSSKALQRPVASDF
SATGFKQVSVALARPVASDF

SEQ ID NO: 13818 - protein, 20 aa, synthetic construct
  source 1..20: note = Seed: SATGFKQSSKALQRPVASDF
SATGFKQVSVALCRPVASDF

SEQ ID NO: 13819 - protein, 20 aa, synthetic construct
  source 1..20: note = Seed: SATGFKQSSKALQRPVASDF
SATGFKQVSVALDRPVASDF

SEQ ID NO: 13820 - protein, 20 aa, synthetic construct
  source 1..20: note = Seed: SATGFKQSSKALQRPVASDF
SATGFKQVSVALERPVASDF

SEQ ID NO: 13821 - protein, 20 aa, synthetic construct
  source 1..20: note = Seed: SATGFKQSSKALQRPVASDF
SATGFKQVSVALFRPVASDF

SEQ ID NO: 13822 - protein, 20 aa, synthetic construct
  source 1..20: note = Seed: SATGFKQSSKALQRPVASDF
SATGFKQVSVALGRPVASDF

SEQ ID NO: 13823 - protein, 20 aa, synthetic construct
  source 1..20: note = Seed: SATGFKQSSKALQRPVASDF
SATGFKQVSVALHRPVASDF

SEQ ID NO: 13824 - protein, 20 aa, synthetic construct
  source 1..20: note = Seed: SATGFKQSSKALQRPVASDF
SATGFKQVSVALIRPVASDF

SEQ ID NO: 13825 - protein, 20 aa, synthetic construct
  source 1..20: note = Seed: SATGFKQSSKALQRPVASDF
SATGFKQVSVALKRPVASDF

SEQ ID NO: 13826 - protein, 20 aa, synthetic construct
  source 1..20: note = Seed: SATGFKQSSKALQRPVASDF
SATGFKQVSVALLRPVASDF

SEQ ID NO: 13827 - protein, 20 aa, synthetic construct
  source 1..20: note = Seed: SATGFKQSSKALQRPVASDF
SATGFKQVSVALMRPVASDF

SEQ ID NO: 13828 - protein, 20 aa, synthetic construct
  source 1..20: note = Seed: SATGFKQSSKALQRPVASDF
SATGFKQVSVALNRPVASDF

SEQ ID NO: 13829 - protein, 20 aa, synthetic construct
  source 1..20: note = Seed: SATGFKQSSKALQRPVASDF
SATGFKQVSVALPRPVASDF

SEQ ID NO: 13830 - protein, 20 aa, synthetic construct
  source 1..20: note = Seed: SATGFKQSSKALQRPVASDF
SATGFKQVSVALQRPVASDF

SEQ ID NO: 13831 - protein, 20 aa, synthetic construct
  source 1..20: note = Seed: SATGFKQSSKALQRPVASDF
SATGFKQVSVALRRPVASDF

SEQ ID NO: 13832 - protein, 20 aa, synthetic construct
  source 1..20: note = Seed: SATGFKQSSKALQRPVASDF
SATGFKQVSVALSRPVASDF

SEQ ID NO: 13833 - protein, 20 aa, synthetic construct
  source 1..20: note = Seed: SATGFKQSSKALQRPVASDF
SATGFKQVSVALTRPVASDF

SEQ ID NO: 13834 - protein, 20 aa, synthetic construct
  source 1..20: note = Seed: SATGFKQSSKALQRPVASDF
SATGFKQVSVALVRPVASDF

SEQ ID NO: 13835 - protein, 20 aa, synthetic construct
  source 1..20: note = Seed: SATGFKQSSKALQRPVASDF
SATGFKQVSVALYRPVASDF

SEQ ID NO: 13836 - protein, 20 aa, synthetic construct
  source 1..20: note = Seed: SATGFKQSSKALQRPVASDF
SATGFKQVSWALARPVASDF

SEQ ID NO: 13837 - protein, 20 aa, synthetic construct
  source 1..20: note = Seed: SATGFKQSSKALQRPVASDF
SATGFKQVSWALIRPVASDF

SEQ ID NO: 13838 - protein, 20 aa, synthetic construct
  source 1..20: note = Seed: SATGFKQSSKALQRPVASDF
SATGFKQVSWALLRPVASDF

SEQ ID NO: 13839 - protein, 20 aa, synthetic construct
  source 1..20: note = Seed: SATGFKQSSKALQRPVASDF
SATGFKQVSWALVRPVASDF

SEQ ID NO: 13840 - protein, 20 aa, synthetic construct
  source 1..20: note = Seed: SATGFKQSSKALQRPVASDF
SATGFKQVSYALARPVASDF

SEQ ID NO: 13841 - protein, 20 aa, synthetic construct
  source 1..20: note = Seed: SATGFKQSSKALQRPVASDF
SATGFKQVSYALERPVASDF

SEQ ID NO: 13842 - protein, 20 aa, synthetic construct
  source 1..20: note = Seed: SATGFKQSSKALQRPVASDF
SATGFKQVSYALIRPVASDF

SEQ ID NO: 13843 - protein, 20 aa, synthetic construct
  source 1..20: note = Seed: SATGFKQSSKALQRPVASDF
SATGFKQVSYALLRPVASDF

SEQ ID NO: 13844 - protein, 20 aa, synthetic construct
  source 1..20: note = Seed: SATGFKQSSKALQRPVASDF
SATGFKQVSYALMRPVASDF

SEQ ID NO: 13845 - protein, 20 aa, synthetic construct
  source 1..20: note = Seed: SATGFKQSSKALQRPVASDF
SATGFKQVSYALVRPVASDF

SEQ ID NO: 13846 - protein, 20 aa, synthetic construct
  source 1..20: note = Seed: SATGFKQSSKALQRPVASDF
SATGFKQWSAALARPVASDF

SEQ ID NO: 13847 - protein, 20 aa, synthetic construct
  source 1..20: note = Seed: SATGFKQSSKALQRPVASDF
SATGFKQWSAALCRPVASDF

SEQ ID NO: 13848 - protein, 20 aa, synthetic construct
  source 1..20: note = Seed: SATGFKQSSKALQRPVASDF
SATGFKQWSAALDRPVASDF

SEQ ID NO: 13849 - protein, 20 aa, synthetic construct
  source 1..20: note = Seed: SATGFKQSSKALQRPVASDF
SATGFKQWSAALERPVASDF

SEQ ID NO: 13850 - protein, 20 aa, synthetic construct
  source 1..20: note = Seed: SATGFKQSSKALQRPVASDF
SATGFKQWSAALFRPVASDF

SEQ ID NO: 13851 - protein, 20 aa, synthetic construct
  source 1..20: note = Seed: SATGFKQSSKALQRPVASDF
SATGFKQWSAALGRPVASDF

SEQ ID NO: 13852 - protein, 20 aa, synthetic construct
  source 1..20: note = Seed: SATGFKQSSKALQRPVASDF
SATGFKQWSAALHRPVASDF

SEQ ID NO: 13853 - protein, 20 aa, synthetic construct
  source 1..20: note = Seed: SATGFKQSSKALQRPVASDF
SATGFKQWSAALIRPVASDF

SEQ ID NO: 13854 - protein, 20 aa, synthetic construct
  source 1..20: note = Seed: SATGFKQSSKALQRPVASDF
SATGFKQWSAALLRPVASDF

SEQ ID NO: 13855 - protein, 20 aa, synthetic construct
  source 1..20: note = Seed: SATGFKQSSKALQRPVASDF
SATGFKQWSAALMRPVASDF

SEQ ID NO: 13856 - protein, 20 aa, synthetic construct
  source 1..20: note = Seed: SATGFKQSSKALQRPVASDF
SATGFKQWSAALNRPVASDF

SEQ ID NO: 13857 - protein, 20 aa, synthetic construct
  source 1..20: note = Seed: SATGFKQSSKALQRPVASDF
SATGFKQWSAALQRPVASDF

SEQ ID NO: 13858 - protein, 20 aa, synthetic construct
  source 1..20: note = Seed: SATGFKQSSKALQRPVASDF
SATGFKQWSAALRRPVASDF

SEQ ID NO: 13859 - protein, 20 aa, synthetic construct
  source 1..20: note = Seed: SATGFKQSSKALQRPVASDF
SATGFKQWSAALSRPVASDF

SEQ ID NO: 13860 - protein, 20 aa, synthetic construct
  source 1..20: note = Seed: SATGFKQSSKALQRPVASDF
SATGFKQWSAALTRPVASDF

SEQ ID NO: 13861 - protein, 20 aa, synthetic construct
  source 1..20: note = Seed: SATGFKQSSKALQRPVASDF
SATGFKQWSAALVRPVASDF

SEQ ID NO: 13862 - protein, 20 aa, synthetic construct
  source 1..20: note = Seed: SATGFKQSSKALQRPVASDF
SATGFKQWSFALARPVASDF

SEQ ID NO: 13863 - protein, 20 aa, synthetic construct
  source 1..20: note = Seed: SATGFKQSSKALQRPVASDF
SATGFKQWSFALERPVASDF

SEQ ID NO: 13864 - protein, 20 aa, synthetic construct
  source 1..20: note = Seed: SATGFKQSSKALQRPVASDF
SATGFKQWSFALIRPVASDF

SEQ ID NO: 13865 - protein, 20 aa, synthetic construct
  source 1..20: note = Seed: SATGFKQSSKALQRPVASDF
SATGFKQWSFALMRPVASDF

SEQ ID NO: 13866 - protein, 20 aa, synthetic construct
  source 1..20: note = Seed: SATGFKQSSKALQRPVASDF
SATGFKQWSFALSRPVASDF

SEQ ID NO: 13867 - protein, 20 aa, synthetic construct
  source 1..20: note = Seed: SATGFKQSSKALQRPVASDF
SATGFKQWSFALTRPVASDF

SEQ ID NO: 13868 - protein, 20 aa, synthetic construct
  source 1..20: note = Seed: SATGFKQSSKALQRPVASDF
SATGFKQWSFALVRPVASDF

SEQ ID NO: 13869 - protein, 20 aa, synthetic construct
  source 1..20: note = Seed: SATGFKQSSKALQRPVASDF
SATGFKQWSGALARPVASDF

SEQ ID NO: 13870 - protein, 20 aa, synthetic construct
  source 1..20: note = Seed: SATGFKQSSKALQRPVASDF
SATGFKQWSGALGRPVASDF

SEQ ID NO: 13871 - protein, 20 aa, synthetic construct
  source 1..20: note = Seed: SATGFKQSSKALQRPVASDF
SATGFKQWSGALIRPVASDF

SEQ ID NO: 13872 - protein, 20 aa, synthetic construct
  source 1..20: note = Seed: SATGFKQSSKALQRPVASDF
SATGFKQWSGALLRPVASDF

SEQ ID NO: 13873 - protein, 20 aa, synthetic construct
  source 1..20: note = Seed: SATGFKQSSKALQRPVASDF
SATGFKQWSGALMRPVASDF

SEQ ID NO: 13874 - protein, 20 aa, synthetic construct
  source 1..20: note = Seed: SATGFKQSSKALQRPVASDF
SATGFKQWSGALNRPVASDF

SEQ ID NO: 13875 - protein, 20 aa, synthetic construct
  source 1..20: note = Seed: SATGFKQSSKALQRPVASDF
SATGFKQWSGALSRPVASDF

SEQ ID NO: 13876 - protein, 20 aa, synthetic construct
  source 1..20: note = Seed: SATGFKQSSKALQRPVASDF
SATGFKQWSGALTRPVASDF

SEQ ID NO: 13877 - protein, 20 aa, synthetic construct
  source 1..20: note = Seed: SATGFKQSSKALQRPVASDF
SATGFKQWSGALVRPVASDF

SEQ ID NO: 13878 - protein, 20 aa, synthetic construct
  source 1..20: note = Seed: SATGFKQSSKALQRPVASDF
SATGFKQWSHALLRPVASDF

SEQ ID NO: 13879 - protein, 20 aa, synthetic construct
  source 1..20: note = Seed: SATGFKQSSKALQRPVASDF
SATGFKQWSHALRRPVASDF

SEQ ID NO: 13880 - protein, 20 aa, synthetic construct
  source 1..20: note = Seed: SATGFKQSSKALQRPVASDF
SATGFKQWSIALARPVASDF

SEQ ID NO: 13881 - protein, 20 aa, synthetic construct
  source 1..20: note = Seed: SATGFKQSSKALQRPVASDF
SATGFKQWSIALCRPVASDF

SEQ ID NO: 13882 - protein, 20 aa, synthetic construct
  source 1..20: note = Seed: SATGFKQSSKALQRPVASDF
SATGFKQWSIALDRPVASDF

SEQ ID NO: 13883 - protein, 20 aa, synthetic construct
  source 1..20: note = Seed: SATGFKQSSKALQRPVASDF
SATGFKQWSIALHRPVASDF

SEQ ID NO: 13884 - protein, 20 aa, synthetic construct
  source 1..20: note = Seed: SATGFKQSSKALQRPVASDF
SATGFKQWSIALIRPVASDF

SEQ ID NO: 13885 - protein, 20 aa, synthetic construct
  source 1..20: note = Seed: SATGFKQSSKALQRPVASDF
SATGFKQWSIALMRPVASDF

SEQ ID NO: 13886 - protein, 20 aa, synthetic construct
  source 1..20: note = Seed: SATGFKQSSKALQRPVASDF
SATGFKQWSIALNRPVASDF

SEQ ID NO: 13887 - protein, 20 aa, synthetic construct
  source 1..20: note = Seed: SATGFKQSSKALQRPVASDF
SATGFKQWSIALRRPVASDF

SEQ ID NO: 13888 - protein, 20 aa, synthetic construct
  source 1..20: note = Seed: SATGFKQSSKALQRPVASDF
SATGFKQWSIALSRPVASDF

SEQ ID NO: 13889 - protein, 20 aa, synthetic construct
  source 1..20: note = Seed: SATGFKQSSKALQRPVASDF
SATGFKQWSIALVRPVASDF

SEQ ID NO: 13890 - protein, 20 aa, synthetic construct
  source 1..20: note = Seed: SATGFKQSSKALQRPVASDF
SATGFKQWSIALYRPVASDF

SEQ ID NO: 13891 - protein, 20 aa, synthetic construct
  source 1..20: note = Seed: SATGFKQSSKALQRPVASDF
SATGFKQWSKALARPVASDF

SEQ ID NO: 13892 - protein, 20 aa, synthetic construct
  source 1..20: note = Seed: SATGFKQSSKALQRPVASDF
SATGFKQWSKALKRPVASDF

SEQ ID NO: 13893 - protein, 20 aa, synthetic construct
  source 1..20: note = Seed: SATGFKQSSKALQRPVASDF
SATGFKQWSKALRRPVASDF

SEQ ID NO: 13894 - protein, 20 aa, synthetic construct
  source 1..20: note = Seed: SATGFKQSSKALQRPVASDF
SATGFKQWSKALSRPVASDF

SEQ ID NO: 13895 - protein, 20 aa, synthetic construct
  source 1..20: note = Seed: SATGFKQSSKALQRPVASDF
SATGFKQWSLALARPVASDF

SEQ ID NO: 13896 - protein, 20 aa, synthetic construct
  source 1..20: note = Seed: SATGFKQSSKALQRPVASDF
SATGFKQWSLALHRPVASDF

SEQ ID NO: 13897 - protein, 20 aa, synthetic construct
  source 1..20: note = Seed: SATGFKQSSKALQRPVASDF
SATGFKQWSLALIRPVASDF

SEQ ID NO: 13898 - protein, 20 aa, synthetic construct
  source 1..20: note = Seed: SATGFKQSSKALQRPVASDF
SATGFKQWSLALLRPVASDF

SEQ ID NO: 13899 - protein, 20 aa, synthetic construct
  source 1..20: note = Seed: SATGFKQSSKALQRPVASDF
SATGFKQWSLALMRPVASDF

SEQ ID NO: 13900 - protein, 20 aa, synthetic construct
  source 1..20: note = Seed: SATGFKQSSKALQRPVASDF
SATGFKQWSLALRRPVASDF

SEQ ID NO: 13901 - protein, 20 aa, synthetic construct
  source 1..20: note = Seed: SATGFKQSSKALQRPVASDF
SATGFKQWSLALSRPVASDF

SEQ ID NO: 13902 - protein, 20 aa, synthetic construct
  source 1..20: note = Seed: SATGFKQSSKALQRPVASDF
SATGFKQWSLALVRPVASDF

SEQ ID NO: 13903 - protein, 20 aa, synthetic construct
  source 1..20: note = Seed: SATGFKQSSKALQRPVASDF
SATGFKQWSLALYRPVASDF

SEQ ID NO: 13904 - protein, 20 aa, synthetic construct
  source 1..20: note = Seed: SATGFKQSSKALQRPVASDF
SATGFKQWSMALARPVASDF

SEQ ID NO: 13905 - protein, 20 aa, synthetic construct
  source 1..20: note = Seed: SATGFKQSSKALQRPVASDF
SATGFKQWSMALMRPVASDF

SEQ ID NO: 13906 - protein, 20 aa, synthetic construct
  source 1..20: note = Seed: SATGFKQSSKALQRPVASDF
SATGFKQWSMALVRPVASDF

SEQ ID NO: 13907 - protein, 20 aa, synthetic construct
  source 1..20: note = Seed: SATGFKQSSKALQRPVASDF
SATGFKQWSNALARPVASDF

SEQ ID NO: 13908 - protein, 20 aa, synthetic construct
  source 1..20: note = Seed: SATGFKQSSKALQRPVASDF
SATGFKQWSNALIRPVASDF

SEQ ID NO: 13909 - protein, 20 aa, synthetic construct
  source 1..20: note = Seed: SATGFKQSSKALQRPVASDF
SATGFKQWSNALLRPVASDF

SEQ ID NO: 13910 - protein, 20 aa, synthetic construct
  source 1..20: note = Seed: SATGFKQSSKALQRPVASDF
SATGFKQWSNALMRPVASDF

SEQ ID NO: 13911 - protein, 20 aa, synthetic construct
  source 1..20: note = Seed: SATGFKQSSKALQRPVASDF
SATGFKQWSNALNRPVASDF

SEQ ID NO: 13912 - protein, 20 aa, synthetic construct
  source 1..20: note = Seed: SATGFKQSSKALQRPVASDF
SATGFKQWSNALSRPVASDF

SEQ ID NO: 13913 - protein, 20 aa, synthetic construct
  source 1..20: note = Seed: SATGFKQSSKALQRPVASDF
SATGFKQWSNALVRPVASDF

SEQ ID NO: 13914 - protein, 20 aa, synthetic construct
  source 1..20: note = Seed: SATGFKQSSKALQRPVASDF
SATGFKQWSPALARPVASDF

SEQ ID NO: 13915 - protein, 20 aa, synthetic construct
  source 1..20: note = Seed: SATGFKQSSKALQRPVASDF
SATGFKQWSPALGRPVASDF

SEQ ID NO: 13916 - protein, 20 aa, synthetic construct
  source 1..20: note = Seed: SATGFKQSSKALQRPVASDF
SATGFKQWSPALHRPVASDF

SEQ ID NO: 13917 - protein, 20 aa, synthetic construct
  source 1..20: note = Seed: SATGFKQSSKALQRPVASDF
SATGFKQWSPALIRPVASDF

SEQ ID NO: 13918 - protein, 20 aa, synthetic construct
  source 1..20: note = Seed: SATGFKQSSKALQRPVASDF
SATGFKQWSPALLRPVASDF

SEQ ID NO: 13919 - protein, 20 aa, synthetic construct
  source 1..20: note = Seed: SATGFKQSSKALQRPVASDF
SATGFKQWSPALMRPVASDF

SEQ ID NO: 13920 - protein, 20 aa, synthetic construct
  source 1..20: note = Seed: SATGFKQSSKALQRPVASDF
SATGFKQWSPALNRPVASDF

SEQ ID NO: 13921 - protein, 20 aa, synthetic construct
  source 1..20: note = Seed: SATGFKQSSKALQRPVASDF
SATGFKQWSPALSRPVASDF

SEQ ID NO: 13922 - protein, 20 aa, synthetic construct
  source 1..20: note = Seed: SATGFKQSSKALQRPVASDF
SATGFKQWSPALTRPVASDF

SEQ ID NO: 13923 - protein, 20 aa, synthetic construct
  source 1..20: note = Seed: SATGFKQSSKALQRPVASDF
SATGFKQWSPALVRPVASDF

SEQ ID NO: 13924 - protein, 20 aa, synthetic construct
  source 1..20: note = Seed: SATGFKQSSKALQRPVASDF
SATGFKQWSRALARPVASDF

SEQ ID NO: 13925 - protein, 20 aa, synthetic construct
  source 1..20: note = Seed: SATGFKQSSKALQRPVASDF
SATGFKQWSRALHRPVASDF

SEQ ID NO: 13926 - protein, 20 aa, synthetic construct
  source 1..20: note = Seed: SATGFKQSSKALQRPVASDF
SATGFKQWSRALKRPVASDF

SEQ ID NO: 13927 - protein, 20 aa, synthetic construct
  source 1..20: note = Seed: SATGFKQSSKALQRPVASDF
SATGFKQWSRALRRPVASDF

SEQ ID NO: 13928 - protein, 20 aa, synthetic construct
  source 1..20: note = Seed: SATGFKQSSKALQRPVASDF
SATGFKQWSRALSRPVASDF

SEQ ID NO: 13929 - protein, 20 aa, synthetic construct
  source 1..20: note = Seed: SATGFKQSSKALQRPVASDF
SATGFKQWSSALARPVASDF

SEQ ID NO: 13930 - protein, 20 aa, synthetic construct
  source 1..20: note = Seed: SATGFKQSSKALQRPVASDF
SATGFKQWSSALGRPVASDF

SEQ ID NO: 13931 - protein, 20 aa, synthetic construct
  source 1..20: note = Seed: SATGFKQSSKALQRPVASDF
SATGFKQWSSALIRPVASDF

SEQ ID NO: 13932 - protein, 20 aa, synthetic construct
  source 1..20: note = Seed: SATGFKQSSKALQRPVASDF
SATGFKQWSSALLRPVASDF

SEQ ID NO: 13933 - protein, 20 aa, synthetic construct
  source 1..20: note = Seed: SATGFKQSSKALQRPVASDF
SATGFKQWSSALMRPVASDF

SEQ ID NO: 13934 - protein, 20 aa, synthetic construct
  source 1..20: note = Seed: SATGFKQSSKALQRPVASDF
SATGFKQWSSALNRPVASDF

SEQ ID NO: 13935 - protein, 20 aa, synthetic construct
  source 1..20: note = Seed: SATGFKQSSKALQRPVASDF
SATGFKQWSSALRRPVASDF

SEQ ID NO: 13936 - protein, 20 aa, synthetic construct
  source 1..20: note = Seed: SATGFKQSSKALQRPVASDF
SATGFKQWSSALSRPVASDF

SEQ ID NO: 13937 - protein, 20 aa, synthetic construct
  source 1..20: note = Seed: SATGFKQSSKALQRPVASDF
SATGFKQWSSALTRPVASDF

SEQ ID NO: 13938 - protein, 20 aa, synthetic construct
  source 1..20: note = Seed: SATGFKQSSKALQRPVASDF
SATGFKQWSSALVRPVASDF

SEQ ID NO: 13939 - protein, 20 aa, synthetic construct
  source 1..20: note = Seed: SATGFKQSSKALQRPVASDF
SATGFKQWSTALARPVASDF

SEQ ID NO: 13940 - protein, 20 aa, synthetic construct
  source 1..20: note = Seed: SATGFKQSSKALQRPVASDF
SATGFKQWSTALGRPVASDF

SEQ ID NO: 13941 - protein, 20 aa, synthetic construct
  source 1..20: note = Seed: SATGFKQSSKALQRPVASDF
SATGFKQWSTALHRPVASDF

SEQ ID NO: 13942 - protein, 20 aa, synthetic construct
  source 1..20: note = Seed: SATGFKQSSKALQRPVASDF
SATGFKQWSTALIRPVASDF

SEQ ID NO: 13943 - protein, 20 aa, synthetic construct
  source 1..20: note = Seed: SATGFKQSSKALQRPVASDF
SATGFKQWSTALLRPVASDF

SEQ ID NO: 13944 - protein, 20 aa, synthetic construct
  source 1..20: note = Seed: SATGFKQSSKALQRPVASDF
SATGFKQWSTALMRPVASDF

SEQ ID NO: 13945 - protein, 20 aa, synthetic construct
  source 1..20: note = Seed: SATGFKQSSKALQRPVASDF
SATGFKQWSTALNRPVASDF

SEQ ID NO: 13946 - protein, 20 aa, synthetic construct
  source 1..20: note = Seed: SATGFKQSSKALQRPVASDF
SATGFKQWSTALSRPVASDF

SEQ ID NO: 13947 - protein, 20 aa, synthetic construct
  source 1..20: note = Seed: SATGFKQSSKALQRPVASDF
SATGFKQWSTALVRPVASDF

SEQ ID NO: 13948 - protein, 20 aa, synthetic construct
  source 1..20: note = Seed: SATGFKQSSKALQRPVASDF
SATGFKQWSVALARPVASDF

SEQ ID NO: 13949 - protein, 20 aa, synthetic construct
  source 1..20: note = Seed: SATGFKQSSKALQRPVASDF
SATGFKQWSVALCRPVASDF

SEQ ID NO: 13950 - protein, 20 aa, synthetic construct
  source 1..20: note = Seed: SATGFKQSSKALQRPVASDF
SATGFKQWSVALDRPVASDF

SEQ ID NO: 13951 - protein, 20 aa, synthetic construct
  source 1..20: note = Seed: SATGFKQSSKALQRPVASDF
SATGFKQWSVALERPVASDF

SEQ ID NO: 13952 - protein, 20 aa, synthetic construct
  source 1..20: note = Seed: SATGFKQSSKALQRPVASDF
SATGFKQWSVALFRPVASDF

SEQ ID NO: 13953 - protein, 20 aa, synthetic construct
  source 1..20: note = Seed: SATGFKQSSKALQRPVASDF
SATGFKQWSVALGRPVASDF

SEQ ID NO: 13954 - protein, 20 aa, synthetic construct
  source 1..20: note = Seed: SATGFKQSSKALQRPVASDF
SATGFKQWSVALHRPVASDF

SEQ ID NO: 13955 - protein, 20 aa, synthetic construct
  source 1..20: note = Seed: SATGFKQSSKALQRPVASDF
SATGFKQWSVALIRPVASDF

SEQ ID NO: 13956 - protein, 20 aa, synthetic construct
  source 1..20: note = Seed: SATGFKQSSKALQRPVASDF
SATGFKQWSVALKRPVASDF

SEQ ID NO: 13957 - protein, 20 aa, synthetic construct
  source 1..20: note = Seed: SATGFKQSSKALQRPVASDF
SATGFKQWSVALLRPVASDF

SEQ ID NO: 13958 - protein, 20 aa, synthetic construct
  source 1..20: note = Seed: SATGFKQSSKALQRPVASDF
SATGFKQWSVALMRPVASDF

SEQ ID NO: 13959 - protein, 20 aa, synthetic construct
  source 1..20: note = Seed: SATGFKQSSKALQRPVASDF
SATGFKQWSVALNRPVASDF

SEQ ID NO: 13960 - protein, 20 aa, synthetic construct
  source 1..20: note = Seed: SATGFKQSSKALQRPVASDF
SATGFKQWSVALQRPVASDF

SEQ ID NO: 13961 - protein, 20 aa, synthetic construct
  source 1..20: note = Seed: SATGFKQSSKALQRPVASDF
SATGFKQWSVALRRPVASDF

SEQ ID NO: 13962 - protein, 20 aa, synthetic construct
  source 1..20: note = Seed: SATGFKQSSKALQRPVASDF
SATGFKQWSVALSRPVASDF

SEQ ID NO: 13963 - protein, 20 aa, synthetic construct
  source 1..20: note = Seed: SATGFKQSSKALQRPVASDF
SATGFKQWSVALYRPVASDF

SEQ ID NO: 13964 - protein, 20 aa, synthetic construct
  source 1..20: note = Seed: SATGFKQSSKALQRPVASDF
SATGFKQYSAALARPVASDF

SEQ ID NO: 13965 - protein, 20 aa, synthetic construct
  source 1..20: note = Seed: SATGFKQSSKALQRPVASDF
SATGFKQYSAALFRPVASDF

SEQ ID NO: 13966 - protein, 20 aa, synthetic construct
  source 1..20: note = Seed: SATGFKQSSKALQRPVASDF
SATGFKQYSAALGRPVASDF

SEQ ID NO: 13967 - protein, 20 aa, synthetic construct
  source 1..20: note = Seed: SATGFKQSSKALQRPVASDF
SATGFKQYSAALHRPVASDF

SEQ ID NO: 13968 - protein, 20 aa, synthetic construct
  source 1..20: note = Seed: SATGFKQSSKALQRPVASDF
SATGFKQYSAALIRPVASDF

SEQ ID NO: 13969 - protein, 20 aa, synthetic construct
  source 1..20: note = Seed: SATGFKQSSKALQRPVASDF
SATGFKQYSAALKRPVASDF

SEQ ID NO: 13970 - protein, 20 aa, synthetic construct
  source 1..20: note = Seed: SATGFKQSSKALQRPVASDF
SATGFKQYSAALLRPVASDF

SEQ ID NO: 13971 - protein, 20 aa, synthetic construct
  source 1..20: note = Seed: SATGFKQSSKALQRPVASDF
SATGFKQYSAALMRPVASDF

SEQ ID NO: 13972 - protein, 20 aa, synthetic construct
  source 1..20: note = Seed: SATGFKQSSKALQRPVASDF
SATGFKQYSAALQRPVASDF

SEQ ID NO: 13973 - protein, 20 aa, synthetic construct
  source 1..20: note = Seed: SATGFKQSSKALQRPVASDF
SATGFKQYSAALRRPVASDF

SEQ ID NO: 13974 - protein, 20 aa, synthetic construct
  source 1..20: note = Seed: SATGFKQSSKALQRPVASDF
SATGFKQYSAALVRPVASDF

SEQ ID NO: 13975 - protein, 20 aa, synthetic construct
  source 1..20: note = Seed: SATGFKQSSKALQRPVASDF
SATGFKQYSFALERPVASDF

SEQ ID NO: 13976 - protein, 20 aa, synthetic construct
  source 1..20: note = Seed: SATGFKQSSKALQRPVASDF
SATGFKQYSFALMRPVASDF

SEQ ID NO: 13977 - protein, 20 aa, synthetic construct
  source 1..20: note = Seed: SATGFKQSSKALQRPVASDF
SATGFKQYSFALNRPVASDF

SEQ ID NO: 13978 - protein, 20 aa, synthetic construct
  source 1..20: note = Seed: SATGFKQSSKALQRPVASDF
SATGFKQYSGALARPVASDF

SEQ ID NO: 13979 - protein, 20 aa, synthetic construct
  source 1..20: note = Seed: SATGFKQSSKALQRPVASDF
SATGFKQYSGALGRPVASDF

SEQ ID NO: 13980 - protein, 20 aa, synthetic construct
  source 1..20: note = Seed: SATGFKQSSKALQRPVASDF
SATGFKQYSGALIRPVASDF

SEQ ID NO: 13981 - protein, 20 aa, synthetic construct
  source 1..20: note = Seed: SATGFKQSSKALQRPVASDF
SATGFKQYSGALLRPVASDF

SEQ ID NO: 13982 - protein, 20 aa, synthetic construct
  source 1..20: note = Seed: SATGFKQSSKALQRPVASDF
SATGFKQYSGALMRPVASDF

SEQ ID NO: 13983 - protein, 20 aa, synthetic construct
  source 1..20: note = Seed: SATGFKQSSKALQRPVASDF
SATGFKQYSGALSRPVASDF

SEQ ID NO: 13984 - protein, 20 aa, synthetic construct
  source 1..20: note = Seed: SATGFKQSSKALQRPVASDF
SATGFKQYSGALTRPVASDF

SEQ ID NO: 13985 - protein, 20 aa, synthetic construct
  source 1..20: note = Seed: SATGFKQSSKALQRPVASDF
SATGFKQYSGALVRPVASDF

SEQ ID NO: 13986 - protein, 20 aa, synthetic construct
  source 1..20: note = Seed: SATGFKQSSKALQRPVASDF
SATGFKQYSHALRRPVASDF

SEQ ID NO: 13987 - protein, 20 aa, synthetic construct
  source 1..20: note = Seed: SATGFKQSSKALQRPVASDF
SATGFKQYSIALARPVASDF

SEQ ID NO: 13988 - protein, 20 aa, synthetic construct
  source 1..20: note = Seed: SATGFKQSSKALQRPVASDF
SATGFKQYSIALRRPVASDF

SEQ ID NO: 13989 - protein, 20 aa, synthetic construct
  source 1..20: note = Seed: SATGFKQSSKALQRPVASDF
SATGFKQYSIALSRPVASDF

SEQ ID NO: 13990 - protein, 20 aa, synthetic construct
  source 1..20: note = Seed: SATGFKQSSKALQRPVASDF
SATGFKQYSIALVRPVASDF

SEQ ID NO: 13991 - protein, 20 aa, synthetic construct
  source 1..20: note = Seed: SATGFKQSSKALQRPVASDF
SATGFKQYSKALARPVASDF

SEQ ID NO: 13992 - protein, 20 aa, synthetic construct
  source 1..20: note = Seed: SATGFKQSSKALQRPVASDF
SATGFKQYSKALHRPVASDF

SEQ ID NO: 13993 - protein, 20 aa, synthetic construct
  source 1..20: note = Seed: SATGFKQSSKALQRPVASDF
SATGFKQYSKALKRPVASDF

SEQ ID NO: 13994 - protein, 20 aa, synthetic construct
  source 1..20: note = Seed: SATGFKQSSKALQRPVASDF
SATGFKQYSKALRRPVASDF

SEQ ID NO: 13995 - protein, 20 aa, synthetic construct
  source 1..20: note = Seed: SATGFKQSSKALQRPVASDF
SATGFKQYSKALSRPVASDF

SEQ ID NO: 13996 - protein, 20 aa, synthetic construct
  source 1..20: note = Seed: SATGFKQSSKALQRPVASDF
SATGFKQYSKALTRPVASDF

SEQ ID NO: 13997 - protein, 20 aa, synthetic construct
  source 1..20: note = Seed: SATGFKQSSKALQRPVASDF
SATGFKQYSLALERPVASDF

SEQ ID NO: 13998 - protein, 20 aa, synthetic construct
  source 1..20: note = Seed: SATGFKQSSKALQRPVASDF
SATGFKQYSLALMRPVASDF

SEQ ID NO: 13999 - protein, 20 aa, synthetic construct
  source 1..20: note = Seed: SATGFKQSSKALQRPVASDF
SATGFKQYSLALSRPVASDF

SEQ ID NO: 14000 - protein, 20 aa, synthetic construct
  source 1..20: note = Seed: SATGFKQSSKALQRPVASDF
SATGFKQYSLALVRPVASDF

SEQ ID NO: 14001 - protein, 20 aa, synthetic construct
  source 1..20: note = Seed: SATGFKQSSKALQRPVASDF
SATGFKQYSNALARPVASDF

SEQ ID NO: 14002 - protein, 20 aa, synthetic construct
  source 1..20: note = Seed: SATGFKQSSKALQRPVASDF
SATGFKQYSNALGRPVASDF

SEQ ID NO: 14003 - protein, 20 aa, synthetic construct
  source 1..20: note = Seed: SATGFKQSSKALQRPVASDF
SATGFKQYSNALIRPVASDF

SEQ ID NO: 14004 - protein, 20 aa, synthetic construct
  source 1..20: note = Seed: SATGFKQSSKALQRPVASDF
SATGFKQYSNALLRPVASDF

SEQ ID NO: 14005 - protein, 20 aa, synthetic construct
  source 1..20: note = Seed: SATGFKQSSKALQRPVASDF
SATGFKQYSNALMRPVASDF

SEQ ID NO: 14006 - protein, 20 aa, synthetic construct
  source 1..20: note = Seed: SATGFKQSSKALQRPVASDF
SATGFKQYSNALTRPVASDF

SEQ ID NO: 14007 - protein, 20 aa, synthetic construct
  source 1..20: note = Seed: SATGFKQSSKALQRPVASDF
SATGFKQYSNALVRPVASDF

SEQ ID NO: 14008 - protein, 20 aa, synthetic construct
  source 1..20: note = Seed: SATGFKQSSKALQRPVASDF
SATGFKQYSPALHRPVASDF

SEQ ID NO: 14009 - protein, 20 aa, synthetic construct
  source 1..20: note = Seed: SATGFKQSSKALQRPVASDF
SATGFKQYSPALIRPVASDF

SEQ ID NO: 14010 - protein, 20 aa, synthetic construct
  source 1..20: note = Seed: SATGFKQSSKALQRPVASDF
SATGFKQYSPALLRPVASDF

SEQ ID NO: 14011 - protein, 20 aa, synthetic construct
  source 1..20: note = Seed: SATGFKQSSKALQRPVASDF
SATGFKQYSPALMRPVASDF

SEQ ID NO: 14012 - protein, 20 aa, synthetic construct
  source 1..20: note = Seed: SATGFKQSSKALQRPVASDF
SATGFKQYSPALNRPVASDF

SEQ ID NO: 14013 - protein, 20 aa, synthetic construct
  source 1..20: note = Seed: SATGFKQSSKALQRPVASDF
SATGFKQYSPALQRPVASDF

SEQ ID NO: 14014 - protein, 20 aa, synthetic construct
  source 1..20: note = Seed: SATGFKQSSKALQRPVASDF
SATGFKQYSRALARPVASDF

SEQ ID NO: 14015 - protein, 20 aa, synthetic construct
  source 1..20: note = Seed: SATGFKQSSKALQRPVASDF
SATGFKQYSRALGRPVASDF

SEQ ID NO: 14016 - protein, 20 aa, synthetic construct
  source 1..20: note = Seed: SATGFKQSSKALQRPVASDF
SATGFKQYSRALHRPVASDF

SEQ ID NO: 14017 - protein, 20 aa, synthetic construct
  source 1..20: note = Seed: SATGFKQSSKALQRPVASDF
SATGFKQYSRALKRPVASDF

SEQ ID NO: 14018 - protein, 20 aa, synthetic construct
  source 1..20: note = Seed: SATGFKQSSKALQRPVASDF
SATGFKQYSRALRRPVASDF

SEQ ID NO: 14019 - protein, 20 aa, synthetic construct
  source 1..20: note = Seed: SATGFKQSSKALQRPVASDF
SATGFKQYSRALSRPVASDF

SEQ ID NO: 14020 - protein, 20 aa, synthetic construct
  source 1..20: note = Seed: SATGFKQSSKALQRPVASDF
SATGFKQYSRALTRPVASDF

SEQ ID NO: 14021 - protein, 20 aa, synthetic construct
  source 1..20: note = Seed: SATGFKQSSKALQRPVASDF
SATGFKQYSRALVRPVASDF

SEQ ID NO: 14022 - protein, 20 aa, synthetic construct
  source 1..20: note = Seed: SATGFKQSSKALQRPVASDF
SATGFKQYSSALARPVASDF

SEQ ID NO: 14023 - protein, 20 aa, synthetic construct
  source 1..20: note = Seed: SATGFKQSSKALQRPVASDF
SATGFKQYSSALGRPVASDF

SEQ ID NO: 14024 - protein, 20 aa, synthetic construct
  source 1..20: note = Seed: SATGFKQSSKALQRPVASDF
SATGFKQYSSALHRPVASDF

SEQ ID NO: 14025 - protein, 20 aa, synthetic construct
  source 1..20: note = Seed: SATGFKQSSKALQRPVASDF
SATGFKQYSSALIRPVASDF

SEQ ID NO: 14026 - protein, 20 aa, synthetic construct
  source 1..20: note = Seed: SATGFKQSSKALQRPVASDF
SATGFKQYSSALKRPVASDF

SEQ ID NO: 14027 - protein, 20 aa, synthetic construct
  source 1..20: note = Seed: SATGFKQSSKALQRPVASDF
SATGFKQYSSALLRPVASDF

SEQ ID NO: 14028 - protein, 20 aa, synthetic construct
  source 1..20: note = Seed: SATGFKQSSKALQRPVASDF
SATGFKQYSSALRRPVASDF

SEQ ID NO: 14029 - protein, 20 aa, synthetic construct
  source 1..20: note = Seed: SATGFKQSSKALQRPVASDF
SATGFKQYSSALTRPVASDF

SEQ ID NO: 14030 - protein, 20 aa, synthetic construct
  source 1..20: note = Seed: SATGFKQSSKALQRPVASDF
SATGFKQYSSALVRPVASDF

SEQ ID NO: 14031 - protein, 20 aa, synthetic construct
  source 1..20: note = Seed: SATGFKQSSKALQRPVASDF
SATGFKQYSTALARPVASDF

SEQ ID NO: 14032 - protein, 20 aa, synthetic construct
  source 1..20: note = Seed: SATGFKQSSKALQRPVASDF
SATGFKQYSTALGRPVASDF

SEQ ID NO: 14033 - protein, 20 aa, synthetic construct
  source 1..20: note = Seed: SATGFKQSSKALQRPVASDF
SATGFKQYSTALHRPVASDF

SEQ ID NO: 14034 - protein, 20 aa, synthetic construct
  source 1..20: note = Seed: SATGFKQSSKALQRPVASDF
SATGFKQYSTALLRPVASDF

SEQ ID NO: 14035 - protein, 20 aa, synthetic construct
  source 1..20: note = Seed: SATGFKQSSKALQRPVASDF
SATGFKQYSTALQRPVASDF

SEQ ID NO: 14036 - protein, 20 aa, synthetic construct
  source 1..20: note = Seed: SATGFKQSSKALQRPVASDF
SATGFKQYSTALRRPVASDF

SEQ ID NO: 14037 - protein, 20 aa, synthetic construct
  source 1..20: note = Seed: SATGFKQSSKALQRPVASDF
SATGFKQYSTALTRPVASDF

SEQ ID NO: 14038 - protein, 20 aa, synthetic construct
  source 1..20: note = Seed: SATGFKQSSKALQRPVASDF
SATGFKQYSTALVRPVASDF

SEQ ID NO: 14039 - protein, 20 aa, synthetic construct
  source 1..20: note = Seed: SATGFKQSSKALQRPVASDF
SATGFKQYSVALARPVASDF

SEQ ID NO: 14040 - protein, 20 aa, synthetic construct
  source 1..20: note = Seed: SATGFKQSSKALQRPVASDF
SATGFKQYSVALRRPVASDF

SEQ ID NO: 14041 - protein, 20 aa, synthetic construct
  source 1..20: note = Seed: SATGFKQSSKALQRPVASDF
SATGFKQYSVALSRPVASDF

SEQ ID NO: 14042 - protein, 20 aa, synthetic construct
  source 1..20: note = Seed: SATGFKQSSKALQRPVASDF
SATGFKQYSVALVRPVASDF

SEQ ID NO: 14043 - protein, 20 aa, synthetic construct
  source 1..20: note = Seed: SATGFKQSSKALQRPVASDF
SATGGKQLSAALLRPVASDF

SEQ ID NO: 14044 - protein, 20 aa, synthetic construct
  source 1..20: note = Seed: SATGFKQSSKALQRPVASDF
SATGGKQLSGALIRPVASDF

SEQ ID NO: 14045 - protein, 20 aa, synthetic construct
  source 1..20: note = Seed: SATGFKQSSKALQRPVASDF
SATGGKQLSGALVRPVASDF

SEQ ID NO: 14046 - protein, 20 aa, synthetic construct
  source 1..20: note = Seed: SATGFKQSSKALQRPVASDF
SATGGKQMSAALIRPVASDF

SEQ ID NO: 14047 - protein, 20 aa, synthetic construct
  source 1..20: note = Seed: SATGFKQSSKALQRPVASDF
SATGHKQISAALLRPVASDF

SEQ ID NO: 14048 - protein, 20 aa, synthetic construct
  source 1..20: note = Seed: SATGFKQSSKALQRPVASDF
SATGHKQISAALMRPVASDF

SEQ ID NO: 14049 - protein, 20 aa, synthetic construct
  source 1..20: note = Seed: SATGFKQSSKALQRPVASDF
SATGHKQISGALIRPVASDF

SEQ ID NO: 14050 - protein, 20 aa, synthetic construct
  source 1..20: note = Seed: SATGFKQSSKALQRPVASDF
SATGHKQLSAALIRPVASDF

SEQ ID NO: 14051 - protein, 20 aa, synthetic construct
  source 1..20: note = Seed: SATGFKQSSKALQRPVASDF
SATGHKQLSAALLRPVASDF

SEQ ID NO: 14052 - protein, 20 aa, synthetic construct
  source 1..20: note = Seed: SATGFKQSSKALQRPVASDF
SATGHKQLSAALMRPVASDF

SEQ ID NO: 14053 - protein, 20 aa, synthetic construct
  source 1..20: note = Seed: SATGFKQSSKALQRPVASDF
SATGHKQLSAALVRPVASDF

SEQ ID NO: 14054 - protein, 20 aa, synthetic construct
  source 1..20: note = Seed: SATGFKQSSKALQRPVASDF
SATGHKQLSGALIRPVASDF

SEQ ID NO: 14055 - protein, 20 aa, synthetic construct
  source 1..20: note = Seed: SATGFKQSSKALQRPVASDF
SATGHKQLSGALLRPVASDF

SEQ ID NO: 14056 - protein, 20 aa, synthetic construct
  source 1..20: note = Seed: SATGFKQSSKALQRPVASDF
SATGHKQLSGALVRPVASDF

SEQ ID NO: 14057 - protein, 20 aa, synthetic construct
  source 1..20: note = Seed: SATGFKQSSKALQRPVASDF
SATGHKQLSPALIRPVASDF

SEQ ID NO: 14058 - protein, 20 aa, synthetic construct
  source 1..20: note = Seed: SATGFKQSSKALQRPVASDF
SATGHKQLSPALVRPVASDF

SEQ ID NO: 14059 - protein, 20 aa, synthetic construct
  source 1..20: note = Seed: SATGFKQSSKALQRPVASDF
SATGHKQLSSALIRPVASDF

SEQ ID NO: 14060 - protein, 20 aa, synthetic construct
  source 1..20: note = Seed: SATGFKQSSKALQRPVASDF
SATGHKQLSSALLRPVASDF

SEQ ID NO: 14061 - protein, 20 aa, synthetic construct
  source 1..20: note = Seed: SATGFKQSSKALQRPVASDF
SATGHKQLSSALVRPVASDF

SEQ ID NO: 14062 - protein, 20 aa, synthetic construct
  source 1..20: note = Seed: SATGFKQSSKALQRPVASDF
SATGHKQLSTALSRPVASDF

SEQ ID NO: 14063 - protein, 20 aa, synthetic construct
  source 1..20: note = Seed: SATGFKQSSKALQRPVASDF
SATGHKQMSAALIRPVASDF

SEQ ID NO: 14064 - protein, 20 aa, synthetic construct
  source 1..20: note = Seed: SATGFKQSSKALQRPVASDF
SATGHKQMSAALLRPVASDF

SEQ ID NO: 14065 - protein, 20 aa, synthetic construct
  source 1..20: note = Seed: SATGFKQSSKALQRPVASDF
SATGHKQMSAALMRPVASDF

SEQ ID NO: 14066 - protein, 20 aa, synthetic construct
  source 1..20: note = Seed: SATGFKQSSKALQRPVASDF
SATGHKQMSAALSRPVASDF

SEQ ID NO: 14067 - protein, 20 aa, synthetic construct
  source 1..20: note = Seed: SATGFKQSSKALQRPVASDF
SATGHKQMSAALVRPVASDF

SEQ ID NO: 14068 - protein, 20 aa, synthetic construct
  source 1..20: note = Seed: SATGFKQSSKALQRPVASDF
SATGHKQMSGALIRPVASDF

SEQ ID NO: 14069 - protein, 20 aa, synthetic construct
  source 1..20: note = Seed: SATGFKQSSKALQRPVASDF
SATGHKQMSGALLRPVASDF

SEQ ID NO: 14070 - protein, 20 aa, synthetic construct
  source 1..20: note = Seed: SATGFKQSSKALQRPVASDF
SATGHKQMSGALVRPVASDF

SEQ ID NO: 14071 - protein, 20 aa, synthetic construct
  source 1..20: note = Seed: SATGFKQSSKALQRPVASDF
SATGHKQMSSALIRPVASDF

SEQ ID NO: 14072 - protein, 20 aa, synthetic construct
  source 1..20: note = Seed: SATGFKQSSKALQRPVASDF
SATGHKQMSSALLRPVASDF

SEQ ID NO: 14073 - protein, 20 aa, synthetic construct
  source 1..20: note = Seed: SATGFKQSSKALQRPVASDF
SATGHKQMSSALVRPVASDF

SEQ ID NO: 14074 - protein, 20 aa, synthetic construct
  source 1..20: note = Seed: SATGFKQSSKALQRPVASDF
SATGHKQMSTALVRPVASDF

SEQ ID NO: 14075 - protein, 20 aa, synthetic construct
  source 1..20: note = Seed: SATGFKQSSKALQRPVASDF
SATGHKQMSVALNRPVASDF

SEQ ID NO: 14076 - protein, 20 aa, synthetic construct
  source 1..20: note = Seed: SATGFKQSSKALQRPVASDF
SATGIKQASAALARPVASDF

SEQ ID NO: 14077 - protein, 20 aa, synthetic construct
  source 1..20: note = Seed: SATGFKQSSKALQRPVASDF
SATGIKQASAALCRPVASDF

SEQ ID NO: 14078 - protein, 20 aa, synthetic construct
  source 1..20: note = Seed: SATGFKQSSKALQRPVASDF
SATGIKQASAALFRPVASDF

SEQ ID NO: 14079 - protein, 20 aa, synthetic construct
  source 1..20: note = Seed: SATGFKQSSKALQRPVASDF
SATGIKQASAALGRPVASDF

SEQ ID NO: 14080 - protein, 20 aa, synthetic construct
  source 1..20: note = Seed: SATGFKQSSKALQRPVASDF
SATGIKQASAALHRPVASDF

SEQ ID NO: 14081 - protein, 20 aa, synthetic construct
  source 1..20: note = Seed: SATGFKQSSKALQRPVASDF
SATGIKQASAALIRPVASDF

SEQ ID NO: 14082 - protein, 20 aa, synthetic construct
  source 1..20: note = Seed: SATGFKQSSKALQRPVASDF
SATGIKQASAALLRPVASDF

SEQ ID NO: 14083 - protein, 20 aa, synthetic construct
  source 1..20: note = Seed: SATGFKQSSKALQRPVASDF
SATGIKQASAALMRPVASDF

SEQ ID NO: 14084 - protein, 20 aa, synthetic construct
  source 1..20: note = Seed: SATGFKQSSKALQRPVASDF
SATGIKQASAALNRPVASDF

SEQ ID NO: 14085 - protein, 20 aa, synthetic construct
  source 1..20: note = Seed: SATGFKQSSKALQRPVASDF
SATGIKQASAALQRPVASDF

SEQ ID NO: 14086 - protein, 20 aa, synthetic construct
  source 1..20: note = Seed: SATGFKQSSKALQRPVASDF
SATGIKQASAALSRPVASDF

SEQ ID NO: 14087 - protein, 20 aa, synthetic construct
  source 1..20: note = Seed: SATGFKQSSKALQRPVASDF
SATGIKQASAALTRPVASDF

SEQ ID NO: 14088 - protein, 20 aa, synthetic construct
  source 1..20: note = Seed: SATGFKQSSKALQRPVASDF
SATGIKQASAALVRPVASDF

SEQ ID NO: 14089 - protein, 20 aa, synthetic construct
  source 1..20: note = Seed: SATGFKQSSKALQRPVASDF
SATGIKQASAALYRPVASDF

SEQ ID NO: 14090 - protein, 20 aa, synthetic construct
  source 1..20: note = Seed: SATGFKQSSKALQRPVASDF
SATGIKQASFALARPVASDF

SEQ ID NO: 14091 - protein, 20 aa, synthetic construct
  source 1..20: note = Seed: SATGFKQSSKALQRPVASDF
SATGIKQASFALERPVASDF

SEQ ID NO: 14092 - protein, 20 aa, synthetic construct
  source 1..20: note = Seed: SATGFKQSSKALQRPVASDF
SATGIKQASFALFRPVASDF

SEQ ID NO: 14093 - protein, 20 aa, synthetic construct
  source 1..20: note = Seed: SATGFKQSSKALQRPVASDF
SATGIKQASFALIRPVASDF

SEQ ID NO: 14094 - protein, 20 aa, synthetic construct
  source 1..20: note = Seed: SATGFKQSSKALQRPVASDF
SATGIKQASFALLRPVASDF

SEQ ID NO: 14095 - protein, 20 aa, synthetic construct
  source 1..20: note = Seed: SATGFKQSSKALQRPVASDF
SATGIKQASFALMRPVASDF

SEQ ID NO: 14096 - protein, 20 aa, synthetic construct
  source 1..20: note = Seed: SATGFKQSSKALQRPVASDF
SATGIKQASFALVRPVASDF

SEQ ID NO: 14097 - protein, 20 aa, synthetic construct
  source 1..20: note = Seed: SATGFKQSSKALQRPVASDF
SATGIKQASGALARPVASDF

SEQ ID NO: 14098 - protein, 20 aa, synthetic construct
  source 1..20: note = Seed: SATGFKQSSKALQRPVASDF
SATGIKQASGALCRPVASDF

SEQ ID NO: 14099 - protein, 20 aa, synthetic construct
  source 1..20: note = Seed: SATGFKQSSKALQRPVASDF
SATGIKQASGALGRPVASDF

SEQ ID NO: 14100 - protein, 20 aa, synthetic construct
  source 1..20: note = Seed: SATGFKQSSKALQRPVASDF
SATGIKQASGALIRPVASDF

SEQ ID NO: 14101 - protein, 20 aa, synthetic construct
  source 1..20: note = Seed: SATGFKQSSKALQRPVASDF
SATGIKQASGALLRPVASDF

SEQ ID NO: 14102 - protein, 20 aa, synthetic construct
  source 1..20: note = Seed: SATGFKQSSKALQRPVASDF
SATGIKQASGALMRPVASDF

SEQ ID NO: 14103 - protein, 20 aa, synthetic construct
  source 1..20: note = Seed: SATGFKQSSKALQRPVASDF
SATGIKQASGALNRPVASDF

SEQ ID NO: 14104 - protein, 20 aa, synthetic construct
  source 1..20: note = Seed: SATGFKQSSKALQRPVASDF
SATGIKQASGALSRPVASDF

SEQ ID NO: 14105 - protein, 20 aa, synthetic construct
  source 1..20: note = Seed: SATGFKQSSKALQRPVASDF
SATGIKQASGALTRPVASDF

SEQ ID NO: 14106 - protein, 20 aa, synthetic construct
  source 1..20: note = Seed: SATGFKQSSKALQRPVASDF
SATGIKQASGALVRPVASDF

SEQ ID NO: 14107 - protein, 20 aa, synthetic construct
  source 1..20: note = Seed: SATGFKQSSKALQRPVASDF
SATGIKQASIALARPVASDF

SEQ ID NO: 14108 - protein, 20 aa, synthetic construct
  source 1..20: note = Seed: SATGFKQSSKALQRPVASDF
SATGIKQASIALGRPVASDF

SEQ ID NO: 14109 - protein, 20 aa, synthetic construct
  source 1..20: note = Seed: SATGFKQSSKALQRPVASDF
SATGIKQASIALHRPVASDF

SEQ ID NO: 14110 - protein, 20 aa, synthetic construct
  source 1..20: note = Seed: SATGFKQSSKALQRPVASDF
SATGIKQASIALNRPVASDF

SEQ ID NO: 14111 - protein, 20 aa, synthetic construct
  source 1..20: note = Seed: SATGFKQSSKALQRPVASDF
SATGIKQASIALRRPVASDF

SEQ ID NO: 14112 - protein, 20 aa, synthetic construct
  source 1..20: note = Seed: SATGFKQSSKALQRPVASDF
SATGIKQASIALSRPVASDF

SEQ ID NO: 14113 - protein, 20 aa, synthetic construct
  source 1..20: note = Seed: SATGFKQSSKALQRPVASDF
SATGIKQASIALTRPVASDF

SEQ ID NO: 14114 - protein, 20 aa, synthetic construct
  source 1..20: note = Seed: SATGFKQSSKALQRPVASDF
SATGIKQASIALVRPVASDF

SEQ ID NO: 14115 - protein, 20 aa, synthetic construct
  source 1..20: note = Seed: SATGFKQSSKALQRPVASDF
SATGIKQASKALARPVASDF

SEQ ID NO: 14116 - protein, 20 aa, synthetic construct
  source 1..20: note = Seed: SATGFKQSSKALQRPVASDF
SATGIKQASKALFRPVASDF

SEQ ID NO: 14117 - protein, 20 aa, synthetic construct
  source 1..20: note = Seed: SATGFKQSSKALQRPVASDF
SATGIKQASKALGRPVASDF

SEQ ID NO: 14118 - protein, 20 aa, synthetic construct
  source 1..20: note = Seed: SATGFKQSSKALQRPVASDF
SATGIKQASKALHRPVASDF

SEQ ID NO: 14119 - protein, 20 aa, synthetic construct
  source 1..20: note = Seed: SATGFKQSSKALQRPVASDF
SATGIKQASKALIRPVASDF

SEQ ID NO: 14120 - protein, 20 aa, synthetic construct
  source 1..20: note = Seed: SATGFKQSSKALQRPVASDF
SATGIKQASKALKRPVASDF

SEQ ID NO: 14121 - protein, 20 aa, synthetic construct
  source 1..20: note = Seed: SATGFKQSSKALQRPVASDF
SATGIKQASKALLRPVASDF

SEQ ID NO: 14122 - protein, 20 aa, synthetic construct
  source 1..20: note = Seed: SATGFKQSSKALQRPVASDF
SATGIKQASKALMRPVASDF

SEQ ID NO: 14123 - protein, 20 aa, synthetic construct
  source 1..20: note = Seed: SATGFKQSSKALQRPVASDF
SATGIKQASKALQRPVASDF

SEQ ID NO: 14124 - protein, 20 aa, synthetic construct
  source 1..20: note = Seed: SATGFKQSSKALQRPVASDF
SATGIKQASKALRRPVASDF

SEQ ID NO: 14125 - protein, 20 aa, synthetic construct
  source 1..20: note = Seed: SATGFKQSSKALQRPVASDF
SATGIKQASKALSRPVASDF

SEQ ID NO: 14126 - protein, 20 aa, synthetic construct
  source 1..20: note = Seed: SATGFKQSSKALQRPVASDF
SATGIKQASKALTRPVASDF

SEQ ID NO: 14127 - protein, 20 aa, synthetic construct
  source 1..20: note = Seed: SATGFKQSSKALQRPVASDF
SATGIKQASKALVRPVASDF

SEQ ID NO: 14128 - protein, 20 aa, synthetic construct
  source 1..20: note = Seed: SATGFKQSSKALQRPVASDF
SATGIKQASKALYRPVASDF

SEQ ID NO: 14129 - protein, 20 aa, synthetic construct
  source 1..20: note = Seed: SATGFKQSSKALQRPVASDF
SATGIKQASLALARPVASDF

SEQ ID NO: 14130 - protein, 20 aa, synthetic construct
  source 1..20: note = Seed: SATGFKQSSKALQRPVASDF
SATGIKQASLALGRPVASDF

SEQ ID NO: 14131 - protein, 20 aa, synthetic construct
  source 1..20: note = Seed: SATGFKQSSKALQRPVASDF
SATGIKQASLALHRPVASDF

SEQ ID NO: 14132 - protein, 20 aa, synthetic construct
  source 1..20: note = Seed: SATGFKQSSKALQRPVASDF
SATGIKQASLALNRPVASDF

SEQ ID NO: 14133 - protein, 20 aa, synthetic construct
  source 1..20: note = Seed: SATGFKQSSKALQRPVASDF
SATGIKQASLALSRPVASDF

SEQ ID NO: 14134 - protein, 20 aa, synthetic construct
  source 1..20: note = Seed: SATGFKQSSKALQRPVASDF
SATGIKQASLALVRPVASDF

SEQ ID NO: 14135 - protein, 20 aa, synthetic construct
  source 1..20: note = Seed: SATGFKQSSKALQRPVASDF
SATGIKQASMALNRPVASDF

SEQ ID NO: 14136 - protein, 20 aa, synthetic construct
  source 1..20: note = Seed: SATGFKQSSKALQRPVASDF
SATGIKQASMALSRPVASDF

SEQ ID NO: 14137 - protein, 20 aa, synthetic construct
  source 1..20: note = Seed: SATGFKQSSKALQRPVASDF
SATGIKQASMALVRPVASDF

SEQ ID NO: 14138 - protein, 20 aa, synthetic construct
  source 1..20: note = Seed: SATGFKQSSKALQRPVASDF
SATGIKQASNALARPVASDF

SEQ ID NO: 14139 - protein, 20 aa, synthetic construct
  source 1..20: note = Seed: SATGFKQSSKALQRPVASDF
SATGIKQASNALIRPVASDF

SEQ ID NO: 14140 - protein, 20 aa, synthetic construct
  source 1..20: note = Seed: SATGFKQSSKALQRPVASDF
SATGIKQASNALLRPVASDF

SEQ ID NO: 14141 - protein, 20 aa, synthetic construct
  source 1..20: note = Seed: SATGFKQSSKALQRPVASDF
SATGIKQASNALMRPVASDF

SEQ ID NO: 14142 - protein, 20 aa, synthetic construct
  source 1..20: note = Seed: SATGFKQSSKALQRPVASDF
SATGIKQASNALNRPVASDF

SEQ ID NO: 14143 - protein, 20 aa, synthetic construct
  source 1..20: note = Seed: SATGFKQSSKALQRPVASDF
SATGIKQASNALSRPVASDF

SEQ ID NO: 14144 - protein, 20 aa, synthetic construct
  source 1..20: note = Seed: SATGFKQSSKALQRPVASDF
SATGIKQASNALTRPVASDF

SEQ ID NO: 14145 - protein, 20 aa, synthetic construct
  source 1..20: note = Seed: SATGFKQSSKALQRPVASDF
SATGIKQASNALVRPVASDF

SEQ ID NO: 14146 - protein, 20 aa, synthetic construct
  source 1..20: note = Seed: SATGFKQSSKALQRPVASDF
SATGIKQASPALARPVASDF

SEQ ID NO: 14147 - protein, 20 aa, synthetic construct
  source 1..20: note = Seed: SATGFKQSSKALQRPVASDF
SATGIKQASPALIRPVASDF

SEQ ID NO: 14148 - protein, 20 aa, synthetic construct
  source 1..20: note = Seed: SATGFKQSSKALQRPVASDF
SATGIKQASPALLRPVASDF

SEQ ID NO: 14149 - protein, 20 aa, synthetic construct
  source 1..20: note = Seed: SATGFKQSSKALQRPVASDF
SATGIKQASPALMRPVASDF

SEQ ID NO: 14150 - protein, 20 aa, synthetic construct
  source 1..20: note = Seed: SATGFKQSSKALQRPVASDF
SATGIKQASPALNRPVASDF

SEQ ID NO: 14151 - protein, 20 aa, synthetic construct
  source 1..20: note = Seed: SATGFKQSSKALQRPVASDF
SATGIKQASPALQRPVASDF

SEQ ID NO: 14152 - protein, 20 aa, synthetic construct
  source 1..20: note = Seed: SATGFKQSSKALQRPVASDF
SATGIKQASPALSRPVASDF

SEQ ID NO: 14153 - protein, 20 aa, synthetic construct
  source 1..20: note = Seed: SATGFKQSSKALQRPVASDF
SATGIKQASPALTRPVASDF

SEQ ID NO: 14154 - protein, 20 aa, synthetic construct
  source 1..20: note = Seed: SATGFKQSSKALQRPVASDF
SATGIKQASPALVRPVASDF

SEQ ID NO: 14155 - protein, 20 aa, synthetic construct
  source 1..20: note = Seed: SATGFKQSSKALQRPVASDF
SATGIKQASRALARPVASDF

SEQ ID NO: 14156 - protein, 20 aa, synthetic construct
  source 1..20: note = Seed: SATGFKQSSKALQRPVASDF
SATGIKQASRALFRPVASDF

SEQ ID NO: 14157 - protein, 20 aa, synthetic construct
  source 1..20: note = Seed: SATGFKQSSKALQRPVASDF
SATGIKQASRALGRPVASDF

SEQ ID NO: 14158 - protein, 20 aa, synthetic construct
  source 1..20: note = Seed: SATGFKQSSKALQRPVASDF
SATGIKQASRALHRPVASDF

SEQ ID NO: 14159 - protein, 20 aa, synthetic construct
  source 1..20: note = Seed: SATGFKQSSKALQRPVASDF
SATGIKQASRALIRPVASDF

SEQ ID NO: 14160 - protein, 20 aa, synthetic construct
  source 1..20: note = Seed: SATGFKQSSKALQRPVASDF
SATGIKQASRALKRPVASDF

SEQ ID NO: 14161 - protein, 20 aa, synthetic construct
  source 1..20: note = Seed: SATGFKQSSKALQRPVASDF
SATGIKQASRALLRPVASDF

SEQ ID NO: 14162 - protein, 20 aa, synthetic construct
  source 1..20: note = Seed: SATGFKQSSKALQRPVASDF
SATGIKQASRALMRPVASDF

SEQ ID NO: 14163 - protein, 20 aa, synthetic construct
  source 1..20: note = Seed: SATGFKQSSKALQRPVASDF
SATGIKQASRALNRPVASDF

SEQ ID NO: 14164 - protein, 20 aa, synthetic construct
  source 1..20: note = Seed: SATGFKQSSKALQRPVASDF
SATGIKQASRALQRPVASDF

SEQ ID NO: 14165 - protein, 20 aa, synthetic construct
  source 1..20: note = Seed: SATGFKQSSKALQRPVASDF
SATGIKQASRALRRPVASDF

SEQ ID NO: 14166 - protein, 20 aa, synthetic construct
  source 1..20: note = Seed: SATGFKQSSKALQRPVASDF
SATGIKQASRALSRPVASDF

SEQ ID NO: 14167 - protein, 20 aa, synthetic construct
  source 1..20: note = Seed: SATGFKQSSKALQRPVASDF
SATGIKQASRALTRPVASDF

SEQ ID NO: 14168 - protein, 20 aa, synthetic construct
  source 1..20: note = Seed: SATGFKQSSKALQRPVASDF
SATGIKQASRALVRPVASDF

SEQ ID NO: 14169 - protein, 20 aa, synthetic construct
  source 1..20: note = Seed: SATGFKQSSKALQRPVASDF
SATGIKQASRALYRPVASDF

SEQ ID NO: 14170 - protein, 20 aa, synthetic construct
  source 1..20: note = Seed: SATGFKQSSKALQRPVASDF
SATGIKQASSALARPVASDF

SEQ ID NO: 14171 - protein, 20 aa, synthetic construct
  source 1..20: note = Seed: SATGFKQSSKALQRPVASDF
SATGIKQASSALCRPVASDF

SEQ ID NO: 14172 - protein, 20 aa, synthetic construct
  source 1..20: note = Seed: SATGFKQSSKALQRPVASDF
SATGIKQASSALGRPVASDF

SEQ ID NO: 14173 - protein, 20 aa, synthetic construct
  source 1..20: note = Seed: SATGFKQSSKALQRPVASDF
SATGIKQASSALIRPVASDF

SEQ ID NO: 14174 - protein, 20 aa, synthetic construct
  source 1..20: note = Seed: SATGFKQSSKALQRPVASDF
SATGIKQASSALLRPVASDF

SEQ ID NO: 14175 - protein, 20 aa, synthetic construct
  source 1..20: note = Seed: SATGFKQSSKALQRPVASDF
SATGIKQASSALMRPVASDF

SEQ ID NO: 14176 - protein, 20 aa, synthetic construct
  source 1..20: note = Seed: SATGFKQSSKALQRPVASDF
SATGIKQASSALNRPVASDF

SEQ ID NO: 14177 - protein, 20 aa, synthetic construct
  source 1..20: note = Seed: SATGFKQSSKALQRPVASDF
SATGIKQASSALSRPVASDF

SEQ ID NO: 14178 - protein, 20 aa, synthetic construct
  source 1..20: note = Seed: SATGFKQSSKALQRPVASDF
SATGIKQASSALTRPVASDF

SEQ ID NO: 14179 - protein, 20 aa, synthetic construct
  source 1..20: note = Seed: SATGFKQSSKALQRPVASDF
SATGIKQASSALVRPVASDF

SEQ ID NO: 14180 - protein, 20 aa, synthetic construct
  source 1..20: note = Seed: SATGFKQSSKALQRPVASDF
SATGIKQASTALARPVASDF

SEQ ID NO: 14181 - protein, 20 aa, synthetic construct
  source 1..20: note = Seed: SATGFKQSSKALQRPVASDF
SATGIKQASTALIRPVASDF

SEQ ID NO: 14182 - protein, 20 aa, synthetic construct
  source 1..20: note = Seed: SATGFKQSSKALQRPVASDF
SATGIKQASTALLRPVASDF

SEQ ID NO: 14183 - protein, 20 aa, synthetic construct
  source 1..20: note = Seed: SATGFKQSSKALQRPVASDF
SATGIKQASTALMRPVASDF

SEQ ID NO: 14184 - protein, 20 aa, synthetic construct
  source 1..20: note = Seed: SATGFKQSSKALQRPVASDF
SATGIKQASTALNRPVASDF

SEQ ID NO: 14185 - protein, 20 aa, synthetic construct
  source 1..20: note = Seed: SATGFKQSSKALQRPVASDF
SATGIKQASTALSRPVASDF

SEQ ID NO: 14186 - protein, 20 aa, synthetic construct
  source 1..20: note = Seed: SATGFKQSSKALQRPVASDF
SATGIKQASTALTRPVASDF

SEQ ID NO: 14187 - protein, 20 aa, synthetic construct
  source 1..20: note = Seed: SATGFKQSSKALQRPVASDF
SATGIKQASTALVRPVASDF

SEQ ID NO: 14188 - protein, 20 aa, synthetic construct
  source 1..20: note = Seed: SATGFKQSSKALQRPVASDF
SATGIKQASVALARPVASDF

SEQ ID NO: 14189 - protein, 20 aa, synthetic construct
  source 1..20: note = Seed: SATGFKQSSKALQRPVASDF
SATGIKQASVALGRPVASDF

SEQ ID NO: 14190 - protein, 20 aa, synthetic construct
  source 1..20: note = Seed: SATGFKQSSKALQRPVASDF
SATGIKQASVALHRPVASDF

SEQ ID NO: 14191 - protein, 20 aa, synthetic construct
  source 1..20: note = Seed: SATGFKQSSKALQRPVASDF
SATGIKQASVALIRPVASDF

SEQ ID NO: 14192 - protein, 20 aa, synthetic construct
  source 1..20: note = Seed: SATGFKQSSKALQRPVASDF
SATGIKQASVALLRPVASDF

SEQ ID NO: 14193 - protein, 20 aa, synthetic construct
  source 1..20: note = Seed: SATGFKQSSKALQRPVASDF
SATGIKQASVALMRPVASDF

SEQ ID NO: 14194 - protein, 20 aa, synthetic construct
  source 1..20: note = Seed: SATGFKQSSKALQRPVASDF
SATGIKQASVALNRPVASDF

SEQ ID NO: 14195 - protein, 20 aa, synthetic construct
  source 1..20: note = Seed: SATGFKQSSKALQRPVASDF
SATGIKQASVALQRPVASDF

SEQ ID NO: 14196 - protein, 20 aa, synthetic construct
  source 1..20: note = Seed: SATGFKQSSKALQRPVASDF
SATGIKQASVALSRPVASDF

SEQ ID NO: 14197 - protein, 20 aa, synthetic construct
  source 1..20: note = Seed: SATGFKQSSKALQRPVASDF
SATGIKQASVALTRPVASDF

SEQ ID NO: 14198 - protein, 20 aa, synthetic construct
  source 1..20: note = Seed: SATGFKQSSKALQRPVASDF
SATGIKQASVALVRPVASDF

SEQ ID NO: 14199 - protein, 20 aa, synthetic construct
  source 1..20: note = Seed: SATGFKQSSKALQRPVASDF
SATGIKQCSAALARPVASDF

SEQ ID NO: 14200 - protein, 20 aa, synthetic construct
  source 1..20: note = Seed: SATGFKQSSKALQRPVASDF
SATGIKQCSAALGRPVASDF

SEQ ID NO: 14201 - protein, 20 aa, synthetic construct
  source 1..20: note = Seed: SATGFKQSSKALQRPVASDF
SATGIKQCSAALIRPVASDF

SEQ ID NO: 14202 - protein, 20 aa, synthetic construct
  source 1..20: note = Seed: SATGFKQSSKALQRPVASDF
SATGIKQCSAALLRPVASDF

SEQ ID NO: 14203 - protein, 20 aa, synthetic construct
  source 1..20: note = Seed: SATGFKQSSKALQRPVASDF
SATGIKQCSAALSRPVASDF

SEQ ID NO: 14204 - protein, 20 aa, synthetic construct
  source 1..20: note = Seed: SATGFKQSSKALQRPVASDF
SATGIKQCSAALTRPVASDF

SEQ ID NO: 14205 - protein, 20 aa, synthetic construct
  source 1..20: note = Seed: SATGFKQSSKALQRPVASDF
SATGIKQCSAALVRPVASDF

SEQ ID NO: 14206 - protein, 20 aa, synthetic construct
  source 1..20: note = Seed: SATGFKQSSKALQRPVASDF
SATGIKQCSFALFRPVASDF

SEQ ID NO: 14207 - protein, 20 aa, synthetic construct
  source 1..20: note = Seed: SATGFKQSSKALQRPVASDF
SATGIKQCSGALARPVASDF

SEQ ID NO: 14208 - protein, 20 aa, synthetic construct
  source 1..20: note = Seed: SATGFKQSSKALQRPVASDF
SATGIKQCSGALIRPVASDF

SEQ ID NO: 14209 - protein, 20 aa, synthetic construct
  source 1..20: note = Seed: SATGFKQSSKALQRPVASDF
SATGIKQCSGALLRPVASDF

SEQ ID NO: 14210 - protein, 20 aa, synthetic construct
  source 1..20: note = Seed: SATGFKQSSKALQRPVASDF
SATGIKQCSGALVRPVASDF

SEQ ID NO: 14211 - protein, 20 aa, synthetic construct
  source 1..20: note = Seed: SATGFKQSSKALQRPVASDF
SATGIKQCSIALSRPVASDF

SEQ ID NO: 14212 - protein, 20 aa, synthetic construct
  source 1..20: note = Seed: SATGFKQSSKALQRPVASDF
SATGIKQCSIALTRPVASDF

SEQ ID NO: 14213 - protein, 20 aa, synthetic construct
  source 1..20: note = Seed: SATGFKQSSKALQRPVASDF
SATGIKQCSIALVRPVASDF

SEQ ID NO: 14214 - protein, 20 aa, synthetic construct
  source 1..20: note = Seed: SATGFKQSSKALQRPVASDF
SATGIKQCSKALARPVASDF

SEQ ID NO: 14215 - protein, 20 aa, synthetic construct
  source 1..20: note = Seed: SATGFKQSSKALQRPVASDF
SATGIKQCSKALRRPVASDF

SEQ ID NO: 14216 - protein, 20 aa, synthetic construct
  source 1..20: note = Seed: SATGFKQSSKALQRPVASDF
SATGIKQCSKALSRPVASDF

SEQ ID NO: 14217 - protein, 20 aa, synthetic construct
  source 1..20: note = Seed: SATGFKQSSKALQRPVASDF
SATGIKQCSLALSRPVASDF

SEQ ID NO: 14218 - protein, 20 aa, synthetic construct
  source 1..20: note = Seed: SATGFKQSSKALQRPVASDF
SATGIKQCSMALSRPVASDF

SEQ ID NO: 14219 - protein, 20 aa, synthetic construct
  source 1..20: note = Seed: SATGFKQSSKALQRPVASDF
SATGIKQCSPALARPVASDF

SEQ ID NO: 14220 - protein, 20 aa, synthetic construct
  source 1..20: note = Seed: SATGFKQSSKALQRPVASDF
SATGIKQCSRALARPVASDF

SEQ ID NO: 14221 - protein, 20 aa, synthetic construct
  source 1..20: note = Seed: SATGFKQSSKALQRPVASDF
SATGIKQCSRALGRPVASDF

SEQ ID NO: 14222 - protein, 20 aa, synthetic construct
  source 1..20: note = Seed: SATGFKQSSKALQRPVASDF
SATGIKQCSRALHRPVASDF

SEQ ID NO: 14223 - protein, 20 aa, synthetic construct
  source 1..20: note = Seed: SATGFKQSSKALQRPVASDF
SATGIKQCSRALKRPVASDF

SEQ ID NO: 14224 - protein, 20 aa, synthetic construct
  source 1..20: note = Seed: SATGFKQSSKALQRPVASDF
SATGIKQCSRALQRPVASDF

SEQ ID NO: 14225 - protein, 20 aa, synthetic construct
  source 1..20: note = Seed: SATGFKQSSKALQRPVASDF
SATGIKQCSRALRRPVASDF

SEQ ID NO: 14226 - protein, 20 aa, synthetic construct
  source 1..20: note = Seed: SATGFKQSSKALQRPVASDF
SATGIKQCSRALSRPVASDF

SEQ ID NO: 14227 - protein, 20 aa, synthetic construct
  source 1..20: note = Seed: SATGFKQSSKALQRPVASDF
SATGIKQCSSALARPVASDF

SEQ ID NO: 14228 - protein, 20 aa, synthetic construct
  source 1..20: note = Seed: SATGFKQSSKALQRPVASDF
SATGIKQCSSALIRPVASDF

SEQ ID NO: 14229 - protein, 20 aa, synthetic construct
  source 1..20: note = Seed: SATGFKQSSKALQRPVASDF
SATGIKQCSSALLRPVASDF

SEQ ID NO: 14230 - protein, 20 aa, synthetic construct
  source 1..20: note = Seed: SATGFKQSSKALQRPVASDF
SATGIKQCSSALSRPVASDF

SEQ ID NO: 14231 - protein, 20 aa, synthetic construct
  source 1..20: note = Seed: SATGFKQSSKALQRPVASDF
SATGIKQCSSALVRPVASDF

SEQ ID NO: 14232 - protein, 20 aa, synthetic construct
  source 1..20: note = Seed: SATGFKQSSKALQRPVASDF
SATGIKQCSTALARPVASDF

SEQ ID NO: 14233 - protein, 20 aa, synthetic construct
  source 1..20: note = Seed: SATGFKQSSKALQRPVASDF
SATGIKQCSVALARPVASDF

SEQ ID NO: 14234 - protein, 20 aa, synthetic construct
  source 1..20: note = Seed: SATGFKQSSKALQRPVASDF
SATGIKQCSVALGRPVASDF

SEQ ID NO: 14235 - protein, 20 aa, synthetic construct
  source 1..20: note = Seed: SATGFKQSSKALQRPVASDF
SATGIKQCSVALIRPVASDF

SEQ ID NO: 14236 - protein, 20 aa, synthetic construct
  source 1..20: note = Seed: SATGFKQSSKALQRPVASDF
SATGIKQCSVALMRPVASDF

SEQ ID NO: 14237 - protein, 20 aa, synthetic construct
  source 1..20: note = Seed: SATGFKQSSKALQRPVASDF
SATGIKQCSVALSRPVASDF

SEQ ID NO: 14238 - protein, 20 aa, synthetic construct
  source 1..20: note = Seed: SATGFKQSSKALQRPVASDF
SATGIKQDSFALIRPVASDF

SEQ ID NO: 14239 - protein, 20 aa, synthetic construct
  source 1..20: note = Seed: SATGFKQSSKALQRPVASDF
SATGIKQDSFALVRPVASDF

SEQ ID NO: 14240 - protein, 20 aa, synthetic construct
  source 1..20: note = Seed: SATGFKQSSKALQRPVASDF
SATGIKQDSIALSRPVASDF

SEQ ID NO: 14241 - protein, 20 aa, synthetic construct
  source 1..20: note = Seed: SATGFKQSSKALQRPVASDF
SATGIKQDSVALARPVASDF

SEQ ID NO: 14242 - protein, 20 aa, synthetic construct
  source 1..20: note = Seed: SATGFKQSSKALQRPVASDF
SATGIKQESAALARPVASDF

SEQ ID NO: 14243 - protein, 20 aa, synthetic construct
  source 1..20: note = Seed: SATGFKQSSKALQRPVASDF
SATGIKQESAALIRPVASDF

SEQ ID NO: 14244 - protein, 20 aa, synthetic construct
  source 1..20: note = Seed: SATGFKQSSKALQRPVASDF
SATGIKQESAALLRPVASDF

SEQ ID NO: 14245 - protein, 20 aa, synthetic construct
  source 1..20: note = Seed: SATGFKQSSKALQRPVASDF
SATGIKQESAALMRPVASDF

SEQ ID NO: 14246 - protein, 20 aa, synthetic construct
  source 1..20: note = Seed: SATGFKQSSKALQRPVASDF
SATGIKQESAALNRPVASDF

SEQ ID NO: 14247 - protein, 20 aa, synthetic construct
  source 1..20: note = Seed: SATGFKQSSKALQRPVASDF
SATGIKQESAALSRPVASDF

SEQ ID NO: 14248 - protein, 20 aa, synthetic construct
  source 1..20: note = Seed: SATGFKQSSKALQRPVASDF
SATGIKQESAALTRPVASDF

SEQ ID NO: 14249 - protein, 20 aa, synthetic construct
  source 1..20: note = Seed: SATGFKQSSKALQRPVASDF
SATGIKQESAALVRPVASDF

SEQ ID NO: 14250 - protein, 20 aa, synthetic construct
  source 1..20: note = Seed: SATGFKQSSKALQRPVASDF
SATGIKQESFALARPVASDF

SEQ ID NO: 14251 - protein, 20 aa, synthetic construct
  source 1..20: note = Seed: SATGFKQSSKALQRPVASDF
SATGIKQESFALFRPVASDF

SEQ ID NO: 14252 - protein, 20 aa, synthetic construct
  source 1..20: note = Seed: SATGFKQSSKALQRPVASDF
SATGIKQESFALIRPVASDF

SEQ ID NO: 14253 - protein, 20 aa, synthetic construct
  source 1..20: note = Seed: SATGFKQSSKALQRPVASDF
SATGIKQESFALLRPVASDF

SEQ ID NO: 14254 - protein, 20 aa, synthetic construct
  source 1..20: note = Seed: SATGFKQSSKALQRPVASDF
SATGIKQESFALVRPVASDF

SEQ ID NO: 14255 - protein, 20 aa, synthetic construct
  source 1..20: note = Seed: SATGFKQSSKALQRPVASDF
SATGIKQESGALARPVASDF

SEQ ID NO: 14256 - protein, 20 aa, synthetic construct
  source 1..20: note = Seed: SATGFKQSSKALQRPVASDF
SATGIKQESGALIRPVASDF

SEQ ID NO: 14257 - protein, 20 aa, synthetic construct
  source 1..20: note = Seed: SATGFKQSSKALQRPVASDF
SATGIKQESGALLRPVASDF

SEQ ID NO: 14258 - protein, 20 aa, synthetic construct
  source 1..20: note = Seed: SATGFKQSSKALQRPVASDF
SATGIKQESGALMRPVASDF

SEQ ID NO: 14259 - protein, 20 aa, synthetic construct
  source 1..20: note = Seed: SATGFKQSSKALQRPVASDF
SATGIKQESGALSRPVASDF

SEQ ID NO: 14260 - protein, 20 aa, synthetic construct
  source 1..20: note = Seed: SATGFKQSSKALQRPVASDF
SATGIKQESGALTRPVASDF

SEQ ID NO: 14261 - protein, 20 aa, synthetic construct
  source 1..20: note = Seed: SATGFKQSSKALQRPVASDF
SATGIKQESGALVRPVASDF

SEQ ID NO: 14262 - protein, 20 aa, synthetic construct
  source 1..20: note = Seed: SATGFKQSSKALQRPVASDF
SATGIKQESIALARPVASDF

SEQ ID NO: 14263 - protein, 20 aa, synthetic construct
  source 1..20: note = Seed: SATGFKQSSKALQRPVASDF
SATGIKQESIALNRPVASDF

SEQ ID NO: 14264 - protein, 20 aa, synthetic construct
  source 1..20: note = Seed: SATGFKQSSKALQRPVASDF
SATGIKQESIALSRPVASDF

SEQ ID NO: 14265 - protein, 20 aa, synthetic construct
  source 1..20: note = Seed: SATGFKQSSKALQRPVASDF
SATGIKQESIALTRPVASDF

SEQ ID NO: 14266 - protein, 20 aa, synthetic construct
  source 1..20: note = Seed: SATGFKQSSKALQRPVASDF
SATGIKQESIALVRPVASDF

SEQ ID NO: 14267 - protein, 20 aa, synthetic construct
  source 1..20: note = Seed: SATGFKQSSKALQRPVASDF
SATGIKQESLALSRPVASDF

SEQ ID NO: 14268 - protein, 20 aa, synthetic construct
  source 1..20: note = Seed: SATGFKQSSKALQRPVASDF
SATGIKQESMALSRPVASDF

SEQ ID NO: 14269 - protein, 20 aa, synthetic construct
  source 1..20: note = Seed: SATGFKQSSKALQRPVASDF
SATGIKQESPALARPVASDF

SEQ ID NO: 14270 - protein, 20 aa, synthetic construct
  source 1..20: note = Seed: SATGFKQSSKALQRPVASDF
SATGIKQESPALIRPVASDF

SEQ ID NO: 14271 - protein, 20 aa, synthetic construct
  source 1..20: note = Seed: SATGFKQSSKALQRPVASDF
SATGIKQESPALLRPVASDF

SEQ ID NO: 14272 - protein, 20 aa, synthetic construct
  source 1..20: note = Seed: SATGFKQSSKALQRPVASDF
SATGIKQESPALVRPVASDF

SEQ ID NO: 14273 - protein, 20 aa, synthetic construct
  source 1..20: note = Seed: SATGFKQSSKALQRPVASDF
SATGIKQESSALARPVASDF

SEQ ID NO: 14274 - protein, 20 aa, synthetic construct
  source 1..20: note = Seed: SATGFKQSSKALQRPVASDF
SATGIKQESSALIRPVASDF

SEQ ID NO: 14275 - protein, 20 aa, synthetic construct
  source 1..20: note = Seed: SATGFKQSSKALQRPVASDF
SATGIKQESSALLRPVASDF

SEQ ID NO: 14276 - protein, 20 aa, synthetic construct
  source 1..20: note = Seed: SATGFKQSSKALQRPVASDF
SATGIKQESSALTRPVASDF

SEQ ID NO: 14277 - protein, 20 aa, synthetic construct
  source 1..20: note = Seed: SATGFKQSSKALQRPVASDF
SATGIKQESSALVRPVASDF

SEQ ID NO: 14278 - protein, 20 aa, synthetic construct
  source 1..20: note = Seed: SATGFKQSSKALQRPVASDF
SATGIKQESVALARPVASDF

SEQ ID NO: 14279 - protein, 20 aa, synthetic construct
  source 1..20: note = Seed: SATGFKQSSKALQRPVASDF
SATGIKQESVALIRPVASDF

SEQ ID NO: 14280 - protein, 20 aa, synthetic construct
  source 1..20: note = Seed: SATGFKQSSKALQRPVASDF
SATGIKQESVALLRPVASDF

SEQ ID NO: 14281 - protein, 20 aa, synthetic construct
  source 1..20: note = Seed: SATGFKQSSKALQRPVASDF
SATGIKQESVALQRPVASDF

SEQ ID NO: 14282 - protein, 20 aa, synthetic construct
  source 1..20: note = Seed: SATGFKQSSKALQRPVASDF
SATGIKQESVALSRPVASDF

SEQ ID NO: 14283 - protein, 20 aa, synthetic construct
  source 1..20: note = Seed: SATGFKQSSKALQRPVASDF
SATGIKQESVALVRPVASDF

SEQ ID NO: 14284 - protein, 20 aa, synthetic construct
  source 1..20: note = Seed: SATGFKQSSKALQRPVASDF
SATGIKQFSAALARPVASDF

SEQ ID NO: 14285 - protein, 20 aa, synthetic construct
  source 1..20: note = Seed: SATGFKQSSKALQRPVASDF
SATGIKQFSAALFRPVASDF

SEQ ID NO: 14286 - protein, 20 aa, synthetic construct
  source 1..20: note = Seed: SATGFKQSSKALQRPVASDF
SATGIKQFSAALGRPVASDF

SEQ ID NO: 14287 - protein, 20 aa, synthetic construct
  source 1..20: note = Seed: SATGFKQSSKALQRPVASDF
SATGIKQFSAALHRPVASDF

SEQ ID NO: 14288 - protein, 20 aa, synthetic construct
  source 1..20: note = Seed: SATGFKQSSKALQRPVASDF
SATGIKQFSAALIRPVASDF

SEQ ID NO: 14289 - protein, 20 aa, synthetic construct
  source 1..20: note = Seed: SATGFKQSSKALQRPVASDF
SATGIKQFSAALKRPVASDF

SEQ ID NO: 14290 - protein, 20 aa, synthetic construct
  source 1..20: note = Seed: SATGFKQSSKALQRPVASDF
SATGIKQFSAALLRPVASDF

SEQ ID NO: 14291 - protein, 20 aa, synthetic construct
  source 1..20: note = Seed: SATGFKQSSKALQRPVASDF
SATGIKQFSAALMRPVASDF

SEQ ID NO: 14292 - protein, 20 aa, synthetic construct
  source 1..20: note = Seed: SATGFKQSSKALQRPVASDF
SATGIKQFSAALQRPVASDF

SEQ ID NO: 14293 - protein, 20 aa, synthetic construct
  source 1..20: note = Seed: SATGFKQSSKALQRPVASDF
SATGIKQFSAALRRPVASDF

SEQ ID NO: 14294 - protein, 20 aa, synthetic construct
  source 1..20: note = Seed: SATGFKQSSKALQRPVASDF
SATGIKQFSAALVRPVASDF

SEQ ID NO: 14295 - protein, 20 aa, synthetic construct
  source 1..20: note = Seed: SATGFKQSSKALQRPVASDF
SATGIKQFSAALYRPVASDF

SEQ ID NO: 14296 - protein, 20 aa, synthetic construct
  source 1..20: note = Seed: SATGFKQSSKALQRPVASDF
SATGIKQFSFALARPVASDF

SEQ ID NO: 14297 - protein, 20 aa, synthetic construct
  source 1..20: note = Seed: SATGFKQSSKALQRPVASDF
SATGIKQFSFALERPVASDF

SEQ ID NO: 14298 - protein, 20 aa, synthetic construct
  source 1..20: note = Seed: SATGFKQSSKALQRPVASDF
SATGIKQFSFALQRPVASDF

SEQ ID NO: 14299 - protein, 20 aa, synthetic construct
  source 1..20: note = Seed: SATGFKQSSKALQRPVASDF
SATGIKQFSFALSRPVASDF

SEQ ID NO: 14300 - protein, 20 aa, synthetic construct
  source 1..20: note = Seed: SATGFKQSSKALQRPVASDF
SATGIKQFSGALARPVASDF

SEQ ID NO: 14301 - protein, 20 aa, synthetic construct
  source 1..20: note = Seed: SATGFKQSSKALQRPVASDF
SATGIKQFSGALIRPVASDF

SEQ ID NO: 14302 - protein, 20 aa, synthetic construct
  source 1..20: note = Seed: SATGFKQSSKALQRPVASDF
SATGIKQFSGALLRPVASDF

SEQ ID NO: 14303 - protein, 20 aa, synthetic construct
  source 1..20: note = Seed: SATGFKQSSKALQRPVASDF
SATGIKQFSGALMRPVASDF

SEQ ID NO: 14304 - protein, 20 aa, synthetic construct
  source 1..20: note = Seed: SATGFKQSSKALQRPVASDF
SATGIKQFSGALRRPVASDF

SEQ ID NO: 14305 - protein, 20 aa, synthetic construct
  source 1..20: note = Seed: SATGFKQSSKALQRPVASDF
SATGIKQFSGALSRPVASDF

SEQ ID NO: 14306 - protein, 20 aa, synthetic construct
  source 1..20: note = Seed: SATGFKQSSKALQRPVASDF
SATGIKQFSGALTRPVASDF

SEQ ID NO: 14307 - protein, 20 aa, synthetic construct
  source 1..20: note = Seed: SATGFKQSSKALQRPVASDF
SATGIKQFSGALVRPVASDF

SEQ ID NO: 14308 - protein, 20 aa, synthetic construct
  source 1..20: note = Seed: SATGFKQSSKALQRPVASDF
SATGIKQFSHALARPVASDF

SEQ ID NO: 14309 - protein, 20 aa, synthetic construct
  source 1..20: note = Seed: SATGFKQSSKALQRPVASDF
SATGIKQFSHALKRPVASDF

SEQ ID NO: 14310 - protein, 20 aa, synthetic construct
  source 1..20: note = Seed: SATGFKQSSKALQRPVASDF
SATGIKQFSHALMRPVASDF

SEQ ID NO: 14311 - protein, 20 aa, synthetic construct
  source 1..20: note = Seed: SATGFKQSSKALQRPVASDF
SATGIKQFSHALRRPVASDF

SEQ ID NO: 14312 - protein, 20 aa, synthetic construct
  source 1..20: note = Seed: SATGFKQSSKALQRPVASDF
SATGIKQFSHALSRPVASDF

SEQ ID NO: 14313 - protein, 20 aa, synthetic construct
  source 1..20: note = Seed: SATGFKQSSKALQRPVASDF
SATGIKQFSIALARPVASDF

SEQ ID NO: 14314 - protein, 20 aa, synthetic construct
  source 1..20: note = Seed: SATGFKQSSKALQRPVASDF
SATGIKQFSIALHRPVASDF

SEQ ID NO: 14315 - protein, 20 aa, synthetic construct
  source 1..20: note = Seed: SATGFKQSSKALQRPVASDF
SATGIKQFSIALRRPVASDF

SEQ ID NO: 14316 - protein, 20 aa, synthetic construct
  source 1..20: note = Seed: SATGFKQSSKALQRPVASDF
SATGIKQFSIALSRPVASDF

SEQ ID NO: 14317 - protein, 20 aa, synthetic construct
  source 1..20: note = Seed: SATGFKQSSKALQRPVASDF
SATGIKQFSKALARPVASDF

SEQ ID NO: 14318 - protein, 20 aa, synthetic construct
  source 1..20: note = Seed: SATGFKQSSKALQRPVASDF
SATGIKQFSKALFRPVASDF

SEQ ID NO: 14319 - protein, 20 aa, synthetic construct
  source 1..20: note = Seed: SATGFKQSSKALQRPVASDF
SATGIKQFSKALGRPVASDF

SEQ ID NO: 14320 - protein, 20 aa, synthetic construct
  source 1..20: note = Seed: SATGFKQSSKALQRPVASDF
SATGIKQFSKALHRPVASDF

SEQ ID NO: 14321 - protein, 20 aa, synthetic construct
  source 1..20: note = Seed: SATGFKQSSKALQRPVASDF
SATGIKQFSKALIRPVASDF

SEQ ID NO: 14322 - protein, 20 aa, synthetic construct
  source 1..20: note = Seed: SATGFKQSSKALQRPVASDF
SATGIKQFSKALKRPVASDF

SEQ ID NO: 14323 - protein, 20 aa, synthetic construct
  source 1..20: note = Seed: SATGFKQSSKALQRPVASDF
SATGIKQFSKALLRPVASDF

SEQ ID NO: 14324 - protein, 20 aa, synthetic construct
  source 1..20: note = Seed: SATGFKQSSKALQRPVASDF
SATGIKQFSKALMRPVASDF

SEQ ID NO: 14325 - protein, 20 aa, synthetic construct
  source 1..20: note = Seed: SATGFKQSSKALQRPVASDF
SATGIKQFSKALNRPVASDF

SEQ ID NO: 14326 - protein, 20 aa, synthetic construct
  source 1..20: note = Seed: SATGFKQSSKALQRPVASDF
SATGIKQFSKALQRPVASDF

SEQ ID NO: 14327 - protein, 20 aa, synthetic construct
  source 1..20: note = Seed: SATGFKQSSKALQRPVASDF
SATGIKQFSKALRRPVASDF

SEQ ID NO: 14328 - protein, 20 aa, synthetic construct
  source 1..20: note = Seed: SATGFKQSSKALQRPVASDF
SATGIKQFSKALSRPVASDF

SEQ ID NO: 14329 - protein, 20 aa, synthetic construct
  source 1..20: note = Seed: SATGFKQSSKALQRPVASDF
SATGIKQFSKALTRPVASDF

SEQ ID NO: 14330 - protein, 20 aa, synthetic construct
  source 1..20: note = Seed: SATGFKQSSKALQRPVASDF
SATGIKQFSKALVRPVASDF

SEQ ID NO: 14331 - protein, 20 aa, synthetic construct
  source 1..20: note = Seed: SATGFKQSSKALQRPVASDF
SATGIKQFSKALYRPVASDF

SEQ ID NO: 14332 - protein, 20 aa, synthetic construct
  source 1..20: note = Seed: SATGFKQSSKALQRPVASDF
SATGIKQFSLALARPVASDF

SEQ ID NO: 14333 - protein, 20 aa, synthetic construct
  source 1..20: note = Seed: SATGFKQSSKALQRPVASDF
SATGIKQFSLALRRPVASDF

SEQ ID NO: 14334 - protein, 20 aa, synthetic construct
  source 1..20: note = Seed: SATGFKQSSKALQRPVASDF
SATGIKQFSLALSRPVASDF

SEQ ID NO: 14335 - protein, 20 aa, synthetic construct
  source 1..20: note = Seed: SATGFKQSSKALQRPVASDF
SATGIKQFSLALVRPVASDF

SEQ ID NO: 14336 - protein, 20 aa, synthetic construct
  source 1..20: note = Seed: SATGFKQSSKALQRPVASDF
SATGIKQFSMALRRPVASDF

SEQ ID NO: 14337 - protein, 20 aa, synthetic construct
  source 1..20: note = Seed: SATGFKQSSKALQRPVASDF
SATGIKQFSMALSRPVASDF

SEQ ID NO: 14338 - protein, 20 aa, synthetic construct
  source 1..20: note = Seed: SATGFKQSSKALQRPVASDF
SATGIKQFSNALARPVASDF

SEQ ID NO: 14339 - protein, 20 aa, synthetic construct
  source 1..20: note = Seed: SATGFKQSSKALQRPVASDF
SATGIKQFSNALGRPVASDF

SEQ ID NO: 14340 - protein, 20 aa, synthetic construct
  source 1..20: note = Seed: SATGFKQSSKALQRPVASDF
SATGIKQFSNALIRPVASDF

SEQ ID NO: 14341 - protein, 20 aa, synthetic construct
  source 1..20: note = Seed: SATGFKQSSKALQRPVASDF
SATGIKQFSNALLRPVASDF

SEQ ID NO: 14342 - protein, 20 aa, synthetic construct
  source 1..20: note = Seed: SATGFKQSSKALQRPVASDF
SATGIKQFSNALMRPVASDF

SEQ ID NO: 14343 - protein, 20 aa, synthetic construct
  source 1..20: note = Seed: SATGFKQSSKALQRPVASDF
SATGIKQFSNALRRPVASDF

SEQ ID NO: 14344 - protein, 20 aa, synthetic construct
  source 1..20: note = Seed: SATGFKQSSKALQRPVASDF
SATGIKQFSNALTRPVASDF

SEQ ID NO: 14345 - protein, 20 aa, synthetic construct
  source 1..20: note = Seed: SATGFKQSSKALQRPVASDF
SATGIKQFSNALVRPVASDF

SEQ ID NO: 14346 - protein, 20 aa, synthetic construct
  source 1..20: note = Seed: SATGFKQSSKALQRPVASDF
SATGIKQFSPALHRPVASDF

SEQ ID NO: 14347 - protein, 20 aa, synthetic construct
  source 1..20: note = Seed: SATGFKQSSKALQRPVASDF
SATGIKQFSPALIRPVASDF

SEQ ID NO: 14348 - protein, 20 aa, synthetic construct
  source 1..20: note = Seed: SATGFKQSSKALQRPVASDF
SATGIKQFSPALLRPVASDF

SEQ ID NO: 14349 - protein, 20 aa, synthetic construct
  source 1..20: note = Seed: SATGFKQSSKALQRPVASDF
SATGIKQFSPALMRPVASDF

SEQ ID NO: 14350 - protein, 20 aa, synthetic construct
  source 1..20: note = Seed: SATGFKQSSKALQRPVASDF
SATGIKQFSPALNRPVASDF

SEQ ID NO: 14351 - protein, 20 aa, synthetic construct
  source 1..20: note = Seed: SATGFKQSSKALQRPVASDF
SATGIKQFSPALQRPVASDF

SEQ ID NO: 14352 - protein, 20 aa, synthetic construct
  source 1..20: note = Seed: SATGFKQSSKALQRPVASDF
SATGIKQFSPALRRPVASDF

SEQ ID NO: 14353 - protein, 20 aa, synthetic construct
  source 1..20: note = Seed: SATGFKQSSKALQRPVASDF
SATGIKQFSQALRRPVASDF

SEQ ID NO: 14354 - protein, 20 aa, synthetic construct
  source 1..20: note = Seed: SATGFKQSSKALQRPVASDF
SATGIKQFSRALARPVASDF

SEQ ID NO: 14355 - protein, 20 aa, synthetic construct
  source 1..20: note = Seed: SATGFKQSSKALQRPVASDF
SATGIKQFSRALFRPVASDF

SEQ ID NO: 14356 - protein, 20 aa, synthetic construct
  source 1..20: note = Seed: SATGFKQSSKALQRPVASDF
SATGIKQFSRALGRPVASDF

SEQ ID NO: 14357 - protein, 20 aa, synthetic construct
  source 1..20: note = Seed: SATGFKQSSKALQRPVASDF
SATGIKQFSRALHRPVASDF

SEQ ID NO: 14358 - protein, 20 aa, synthetic construct
  source 1..20: note = Seed: SATGFKQSSKALQRPVASDF
SATGIKQFSRALIRPVASDF

SEQ ID NO: 14359 - protein, 20 aa, synthetic construct
  source 1..20: note = Seed: SATGFKQSSKALQRPVASDF
SATGIKQFSRALKRPVASDF

SEQ ID NO: 14360 - protein, 20 aa, synthetic construct
  source 1..20: note = Seed: SATGFKQSSKALQRPVASDF
SATGIKQFSRALLRPVASDF

SEQ ID NO: 14361 - protein, 20 aa, synthetic construct
  source 1..20: note = Seed: SATGFKQSSKALQRPVASDF
SATGIKQFSRALMRPVASDF

SEQ ID NO: 14362 - protein, 20 aa, synthetic construct
  source 1..20: note = Seed: SATGFKQSSKALQRPVASDF
SATGIKQFSRALNRPVASDF

SEQ ID NO: 14363 - protein, 20 aa, synthetic construct
  source 1..20: note = Seed: SATGFKQSSKALQRPVASDF
SATGIKQFSRALPRPVASDF

SEQ ID NO: 14364 - protein, 20 aa, synthetic construct
  source 1..20: note = Seed: SATGFKQSSKALQRPVASDF
SATGIKQFSRALQRPVASDF

SEQ ID NO: 14365 - protein, 20 aa, synthetic construct
  source 1..20: note = Seed: SATGFKQSSKALQRPVASDF
SATGIKQFSRALRRPVASDF

SEQ ID NO: 14366 - protein, 20 aa, synthetic construct
  source 1..20: note = Seed: SATGFKQSSKALQRPVASDF
SATGIKQFSRALSRPVASDF

SEQ ID NO: 14367 - protein, 20 aa, synthetic construct
  source 1..20: note = Seed: SATGFKQSSKALQRPVASDF
SATGIKQFSRALTRPVASDF

SEQ ID NO: 14368 - protein, 20 aa, synthetic construct
  source 1..20: note = Seed: SATGFKQSSKALQRPVASDF
SATGIKQFSRALVRPVASDF

SEQ ID NO: 14369 - protein, 20 aa, synthetic construct
  source 1..20: note = Seed: SATGFKQSSKALQRPVASDF
SATGIKQFSRALYRPVASDF

SEQ ID NO: 14370 - protein, 20 aa, synthetic construct
  source 1..20: note = Seed: SATGFKQSSKALQRPVASDF
SATGIKQFSSALARPVASDF

SEQ ID NO: 14371 - protein, 20 aa, synthetic construct
  source 1..20: note = Seed: SATGFKQSSKALQRPVASDF
SATGIKQFSSALFRPVASDF

SEQ ID NO: 14372 - protein, 20 aa, synthetic construct
  source 1..20: note = Seed: SATGFKQSSKALQRPVASDF
SATGIKQFSSALGRPVASDF

SEQ ID NO: 14373 - protein, 20 aa, synthetic construct
  source 1..20: note = Seed: SATGFKQSSKALQRPVASDF
SATGIKQFSSALIRPVASDF

SEQ ID NO: 14374 - protein, 20 aa, synthetic construct
  source 1..20: note = Seed: SATGFKQSSKALQRPVASDF
SATGIKQFSSALKRPVASDF

SEQ ID NO: 14375 - protein, 20 aa, synthetic construct
  source 1..20: note = Seed: SATGFKQSSKALQRPVASDF
SATGIKQFSSALLRPVASDF

SEQ ID NO: 14376 - protein, 20 aa, synthetic construct
  source 1..20: note = Seed: SATGFKQSSKALQRPVASDF
SATGIKQFSSALMRPVASDF

SEQ ID NO: 14377 - protein, 20 aa, synthetic construct
  source 1..20: note = Seed: SATGFKQSSKALQRPVASDF
SATGIKQFSSALRRPVASDF

SEQ ID NO: 14378 - protein, 20 aa, synthetic construct
  source 1..20: note = Seed: SATGFKQSSKALQRPVASDF
SATGIKQFSSALTRPVASDF

SEQ ID NO: 14379 - protein, 20 aa, synthetic construct
  source 1..20: note = Seed: SATGFKQSSKALQRPVASDF
SATGIKQFSSALVRPVASDF

SEQ ID NO: 14380 - protein, 20 aa, synthetic construct
  source 1..20: note = Seed: SATGFKQSSKALQRPVASDF
SATGIKQFSSALYRPVASDF

SEQ ID NO: 14381 - protein, 20 aa, synthetic construct
  source 1..20: note = Seed: SATGFKQSSKALQRPVASDF
SATGIKQFSTALARPVASDF

SEQ ID NO: 14382 - protein, 20 aa, synthetic construct
  source 1..20: note = Seed: SATGFKQSSKALQRPVASDF
SATGIKQFSTALGRPVASDF

SEQ ID NO: 14383 - protein, 20 aa, synthetic construct
  source 1..20: note = Seed: SATGFKQSSKALQRPVASDF
SATGIKQFSTALHRPVASDF

SEQ ID NO: 14384 - protein, 20 aa, synthetic construct
  source 1..20: note = Seed: SATGFKQSSKALQRPVASDF
SATGIKQFSTALKRPVASDF

SEQ ID NO: 14385 - protein, 20 aa, synthetic construct
  source 1..20: note = Seed: SATGFKQSSKALQRPVASDF
SATGIKQFSTALLRPVASDF

SEQ ID NO: 14386 - protein, 20 aa, synthetic construct
  source 1..20: note = Seed: SATGFKQSSKALQRPVASDF
SATGIKQFSTALMRPVASDF

SEQ ID NO: 14387 - protein, 20 aa, synthetic construct
  source 1..20: note = Seed: SATGFKQSSKALQRPVASDF
SATGIKQFSTALQRPVASDF

SEQ ID NO: 14388 - protein, 20 aa, synthetic construct
  source 1..20: note = Seed: SATGFKQSSKALQRPVASDF
SATGIKQFSTALRRPVASDF

SEQ ID NO: 14389 - protein, 20 aa, synthetic construct
  source 1..20: note = Seed: SATGFKQSSKALQRPVASDF
SATGIKQFSTALVRPVASDF

SEQ ID NO: 14390 - protein, 20 aa, synthetic construct
  source 1..20: note = Seed: SATGFKQSSKALQRPVASDF
SATGIKQFSVALARPVASDF

SEQ ID NO: 14391 - protein, 20 aa, synthetic construct
  source 1..20: note = Seed: SATGFKQSSKALQRPVASDF
SATGIKQFSVALHRPVASDF

SEQ ID NO: 14392 - protein, 20 aa, synthetic construct
  source 1..20: note = Seed: SATGFKQSSKALQRPVASDF
SATGIKQFSVALQRPVASDF

SEQ ID NO: 14393 - protein, 20 aa, synthetic construct
  source 1..20: note = Seed: SATGFKQSSKALQRPVASDF
SATGIKQFSVALRRPVASDF

SEQ ID NO: 14394 - protein, 20 aa, synthetic construct
  source 1..20: note = Seed: SATGFKQSSKALQRPVASDF
SATGIKQFSVALSRPVASDF

SEQ ID NO: 14395 - protein, 20 aa, synthetic construct
  source 1..20: note = Seed: SATGFKQSSKALQRPVASDF
SATGIKQGSAALARPVASDF

SEQ ID NO: 14396 - protein, 20 aa, synthetic construct
  source 1..20: note = Seed: SATGFKQSSKALQRPVASDF
SATGIKQGSAALIRPVASDF

SEQ ID NO: 14397 - protein, 20 aa, synthetic construct
  source 1..20: note = Seed: SATGFKQSSKALQRPVASDF
SATGIKQGSAALLRPVASDF

SEQ ID NO: 14398 - protein, 20 aa, synthetic construct
  source 1..20: note = Seed: SATGFKQSSKALQRPVASDF
SATGIKQGSAALMRPVASDF

SEQ ID NO: 14399 - protein, 20 aa, synthetic construct
  source 1..20: note = Seed: SATGFKQSSKALQRPVASDF
SATGIKQGSAALSRPVASDF

SEQ ID NO: 14400 - protein, 20 aa, synthetic construct
  source 1..20: note = Seed: SATGFKQSSKALQRPVASDF
SATGIKQGSAALTRPVASDF

SEQ ID NO: 14401 - protein, 20 aa, synthetic construct
  source 1..20: note = Seed: SATGFKQSSKALQRPVASDF
SATGIKQGSAALVRPVASDF

SEQ ID NO: 14402 - protein, 20 aa, synthetic construct
  source 1..20: note = Seed: SATGFKQSSKALQRPVASDF
SATGIKQGSGALARPVASDF

SEQ ID NO: 14403 - protein, 20 aa, synthetic construct
  source 1..20: note = Seed: SATGFKQSSKALQRPVASDF
SATGIKQGSGALIRPVASDF

SEQ ID NO: 14404 - protein, 20 aa, synthetic construct
  source 1..20: note = Seed: SATGFKQSSKALQRPVASDF
SATGIKQGSGALLRPVASDF

SEQ ID NO: 14405 - protein, 20 aa, synthetic construct
  source 1..20: note = Seed: SATGFKQSSKALQRPVASDF
SATGIKQGSGALVRPVASDF

SEQ ID NO: 14406 - protein, 20 aa, synthetic construct
  source 1..20: note = Seed: SATGFKQSSKALQRPVASDF
SATGIKQGSPALIRPVASDF

SEQ ID NO: 14407 - protein, 20 aa, synthetic construct
  source 1..20: note = Seed: SATGFKQSSKALQRPVASDF
SATGIKQGSPALLRPVASDF

SEQ ID NO: 14408 - protein, 20 aa, synthetic construct
  source 1..20: note = Seed: SATGFKQSSKALQRPVASDF
SATGIKQGSPALVRPVASDF

SEQ ID NO: 14409 - protein, 20 aa, synthetic construct
  source 1..20: note = Seed: SATGFKQSSKALQRPVASDF
SATGIKQGSSALARPVASDF

SEQ ID NO: 14410 - protein, 20 aa, synthetic construct
  source 1..20: note = Seed: SATGFKQSSKALQRPVASDF
SATGIKQGSSALIRPVASDF

SEQ ID NO: 14411 - protein, 20 aa, synthetic construct
  source 1..20: note = Seed: SATGFKQSSKALQRPVASDF
SATGIKQGSSALLRPVASDF

SEQ ID NO: 14412 - protein, 20 aa, synthetic construct
  source 1..20: note = Seed: SATGFKQSSKALQRPVASDF
SATGIKQGSSALMRPVASDF

SEQ ID NO: 14413 - protein, 20 aa, synthetic construct
  source 1..20: note = Seed: SATGFKQSSKALQRPVASDF
SATGIKQGSSALVRPVASDF

SEQ ID NO: 14414 - protein, 20 aa, synthetic construct
  source 1..20: note = Seed: SATGFKQSSKALQRPVASDF
SATGIKQGSVALARPVASDF

SEQ ID NO: 14415 - protein, 20 aa, synthetic construct
  source 1..20: note = Seed: SATGFKQSSKALQRPVASDF
SATGIKQGSVALIRPVASDF

SEQ ID NO: 14416 - protein, 20 aa, synthetic construct
  source 1..20: note = Seed: SATGFKQSSKALQRPVASDF
SATGIKQGSVALVRPVASDF

SEQ ID NO: 14417 - protein, 20 aa, synthetic construct
  source 1..20: note = Seed: SATGFKQSSKALQRPVASDF
SATGIKQHSAALARPVASDF

SEQ ID NO: 14418 - protein, 20 aa, synthetic construct
  source 1..20: note = Seed: SATGFKQSSKALQRPVASDF
SATGIKQHSAALIRPVASDF

SEQ ID NO: 14419 - protein, 20 aa, synthetic construct
  source 1..20: note = Seed: SATGFKQSSKALQRPVASDF
SATGIKQHSAALLRPVASDF

SEQ ID NO: 14420 - protein, 20 aa, synthetic construct
  source 1..20: note = Seed: SATGFKQSSKALQRPVASDF
SATGIKQHSAALRRPVASDF

SEQ ID NO: 14421 - protein, 20 aa, synthetic construct
  source 1..20: note = Seed: SATGFKQSSKALQRPVASDF
SATGIKQHSAALVRPVASDF

SEQ ID NO: 14422 - protein, 20 aa, synthetic construct
  source 1..20: note = Seed: SATGFKQSSKALQRPVASDF
SATGIKQHSAALYRPVASDF

SEQ ID NO: 14423 - protein, 20 aa, synthetic construct
  source 1..20: note = Seed: SATGFKQSSKALQRPVASDF
SATGIKQHSFALFRPVASDF

SEQ ID NO: 14424 - protein, 20 aa, synthetic construct
  source 1..20: note = Seed: SATGFKQSSKALQRPVASDF
SATGIKQHSFALIRPVASDF

SEQ ID NO: 14425 - protein, 20 aa, synthetic construct
  source 1..20: note = Seed: SATGFKQSSKALQRPVASDF
SATGIKQHSFALLRPVASDF

SEQ ID NO: 14426 - protein, 20 aa, synthetic construct
  source 1..20: note = Seed: SATGFKQSSKALQRPVASDF
SATGIKQHSGALARPVASDF

SEQ ID NO: 14427 - protein, 20 aa, synthetic construct
  source 1..20: note = Seed: SATGFKQSSKALQRPVASDF
SATGIKQHSGALLRPVASDF

SEQ ID NO: 14428 - protein, 20 aa, synthetic construct
  source 1..20: note = Seed: SATGFKQSSKALQRPVASDF
SATGIKQHSGALVRPVASDF

SEQ ID NO: 14429 - protein, 20 aa, synthetic construct
  source 1..20: note = Seed: SATGFKQSSKALQRPVASDF
SATGIKQHSIALHRPVASDF

SEQ ID NO: 14430 - protein, 20 aa, synthetic construct
  source 1..20: note = Seed: SATGFKQSSKALQRPVASDF
SATGIKQHSIALKRPVASDF

SEQ ID NO: 14431 - protein, 20 aa, synthetic construct
  source 1..20: note = Seed: SATGFKQSSKALQRPVASDF
SATGIKQHSIALRRPVASDF

SEQ ID NO: 14432 - protein, 20 aa, synthetic construct
  source 1..20: note = Seed: SATGFKQSSKALQRPVASDF
SATGIKQHSIALYRPVASDF

SEQ ID NO: 14433 - protein, 20 aa, synthetic construct
  source 1..20: note = Seed: SATGFKQSSKALQRPVASDF
SATGIKQHSKALFRPVASDF

SEQ ID NO: 14434 - protein, 20 aa, synthetic construct
  source 1..20: note = Seed: SATGFKQSSKALQRPVASDF
SATGIKQHSKALIRPVASDF

SEQ ID NO: 14435 - protein, 20 aa, synthetic construct
  source 1..20: note = Seed: SATGFKQSSKALQRPVASDF
SATGIKQHSKALKRPVASDF

SEQ ID NO: 14436 - protein, 20 aa, synthetic construct
  source 1..20: note = Seed: SATGFKQSSKALQRPVASDF
SATGIKQHSKALLRPVASDF

SEQ ID NO: 14437 - protein, 20 aa, synthetic construct
  source 1..20: note = Seed: SATGFKQSSKALQRPVASDF
SATGIKQHSKALMRPVASDF

SEQ ID NO: 14438 - protein, 20 aa, synthetic construct
  source 1..20: note = Seed: SATGFKQSSKALQRPVASDF
SATGIKQHSKALRRPVASDF

SEQ ID NO: 14439 - protein, 20 aa, synthetic construct
  source 1..20: note = Seed: SATGFKQSSKALQRPVASDF
SATGIKQHSKALVRPVASDF

SEQ ID NO: 14440 - protein, 20 aa, synthetic construct
  source 1..20: note = Seed: SATGFKQSSKALQRPVASDF
SATGIKQHSKALYRPVASDF

SEQ ID NO: 14441 - protein, 20 aa, synthetic construct
  source 1..20: note = Seed: SATGFKQSSKALQRPVASDF
SATGIKQHSLALRRPVASDF

SEQ ID NO: 14442 - protein, 20 aa, synthetic construct
  source 1..20: note = Seed: SATGFKQSSKALQRPVASDF
SATGIKQHSMALRRPVASDF

SEQ ID NO: 14443 - protein, 20 aa, synthetic construct
  source 1..20: note = Seed: SATGFKQSSKALQRPVASDF
SATGIKQHSNALRRPVASDF

SEQ ID NO: 14444 - protein, 20 aa, synthetic construct
  source 1..20: note = Seed: SATGFKQSSKALQRPVASDF
SATGIKQHSNALYRPVASDF

SEQ ID NO: 14445 - protein, 20 aa, synthetic construct
  source 1..20: note = Seed: SATGFKQSSKALQRPVASDF
SATGIKQHSPALRRPVASDF

SEQ ID NO: 14446 - protein, 20 aa, synthetic construct
  source 1..20: note = Seed: SATGFKQSSKALQRPVASDF
SATGIKQHSRALARPVASDF

SEQ ID NO: 14447 - protein, 20 aa, synthetic construct
  source 1..20: note = Seed: SATGFKQSSKALQRPVASDF
SATGIKQHSRALFRPVASDF

SEQ ID NO: 14448 - protein, 20 aa, synthetic construct
  source 1..20: note = Seed: SATGFKQSSKALQRPVASDF
SATGIKQHSRALHRPVASDF

SEQ ID NO: 14449 - protein, 20 aa, synthetic construct
  source 1..20: note = Seed: SATGFKQSSKALQRPVASDF
SATGIKQHSRALIRPVASDF

SEQ ID NO: 14450 - protein, 20 aa, synthetic construct
  source 1..20: note = Seed: SATGFKQSSKALQRPVASDF
SATGIKQHSRALKRPVASDF

SEQ ID NO: 14451 - protein, 20 aa, synthetic construct
  source 1..20: note = Seed: SATGFKQSSKALQRPVASDF
SATGIKQHSRALLRPVASDF

SEQ ID NO: 14452 - protein, 20 aa, synthetic construct
  source 1..20: note = Seed: SATGFKQSSKALQRPVASDF
SATGIKQHSRALMRPVASDF

SEQ ID NO: 14453 - protein, 20 aa, synthetic construct
  source 1..20: note = Seed: SATGFKQSSKALQRPVASDF
SATGIKQHSRALRRPVASDF

SEQ ID NO: 14454 - protein, 20 aa, synthetic construct
  source 1..20: note = Seed: SATGFKQSSKALQRPVASDF
SATGIKQHSRALSRPVASDF

SEQ ID NO: 14455 - protein, 20 aa, synthetic construct
  source 1..20: note = Seed: SATGFKQSSKALQRPVASDF
SATGIKQHSRALVRPVASDF

SEQ ID NO: 14456 - protein, 20 aa, synthetic construct
  source 1..20: note = Seed: SATGFKQSSKALQRPVASDF
SATGIKQHSRALYRPVASDF

SEQ ID NO: 14457 - protein, 20 aa, synthetic construct
  source 1..20: note = Seed: SATGFKQSSKALQRPVASDF
SATGIKQHSSALARPVASDF

SEQ ID NO: 14458 - protein, 20 aa, synthetic construct
  source 1..20: note = Seed: SATGFKQSSKALQRPVASDF
SATGIKQHSSALIRPVASDF

SEQ ID NO: 14459 - protein, 20 aa, synthetic construct
  source 1..20: note = Seed: SATGFKQSSKALQRPVASDF
SATGIKQHSSALLRPVASDF

SEQ ID NO: 14460 - protein, 20 aa, synthetic construct
  source 1..20: note = Seed: SATGFKQSSKALQRPVASDF
SATGIKQHSSALRRPVASDF

SEQ ID NO: 14461 - protein, 20 aa, synthetic construct
  source 1..20: note = Seed: SATGFKQSSKALQRPVASDF
SATGIKQHSSALVRPVASDF

SEQ ID NO: 14462 - protein, 20 aa, synthetic construct
  source 1..20: note = Seed: SATGFKQSSKALQRPVASDF
SATGIKQHSSALYRPVASDF

SEQ ID NO: 14463 - protein, 20 aa, synthetic construct
  source 1..20: note = Seed: SATGFKQSSKALQRPVASDF
SATGIKQHSTALRRPVASDF

SEQ ID NO: 14464 - protein, 20 aa, synthetic construct
  source 1..20: note = Seed: SATGFKQSSKALQRPVASDF
SATGIKQHSTALYRPVASDF

SEQ ID NO: 14465 - protein, 20 aa, synthetic construct
  source 1..20: note = Seed: SATGFKQSSKALQRPVASDF
SATGIKQHSVALRRPVASDF

SEQ ID NO: 14466 - protein, 20 aa, synthetic construct
  source 1..20: note = Seed: SATGFKQSSKALQRPVASDF
SATGIKQHSVALSRPVASDF

SEQ ID NO: 14467 - protein, 20 aa, synthetic construct
  source 1..20: note = Seed: SATGFKQSSKALQRPVASDF
SATGIKQHSVALYRPVASDF

SEQ ID NO: 14468 - protein, 20 aa, synthetic construct
  source 1..20: note = Seed: SATGFKQSSKALQRPVASDF
SATGIKQISAALARPVASDF

SEQ ID NO: 14469 - protein, 20 aa, synthetic construct
  source 1..20: note = Seed: SATGFKQSSKALQRPVASDF
SATGIKQISAALCRPVASDF

SEQ ID NO: 14470 - protein, 20 aa, synthetic construct
  source 1..20: note = Seed: SATGFKQSSKALQRPVASDF
SATGIKQISAALFRPVASDF

SEQ ID NO: 14471 - protein, 20 aa, synthetic construct
  source 1..20: note = Seed: SATGFKQSSKALQRPVASDF
SATGIKQISAALGRPVASDF

SEQ ID NO: 14472 - protein, 20 aa, synthetic construct
  source 1..20: note = Seed: SATGFKQSSKALQRPVASDF
SATGIKQISAALHRPVASDF

SEQ ID NO: 14473 - protein, 20 aa, synthetic construct
  source 1..20: note = Seed: SATGFKQSSKALQRPVASDF
SATGIKQISAALIRPVASDF

SEQ ID NO: 14474 - protein, 20 aa, synthetic construct
  source 1..20: note = Seed: SATGFKQSSKALQRPVASDF
SATGIKQISAALLRPVASDF

SEQ ID NO: 14475 - protein, 20 aa, synthetic construct
  source 1..20: note = Seed: SATGFKQSSKALQRPVASDF
SATGIKQISAALMRPVASDF

SEQ ID NO: 14476 - protein, 20 aa, synthetic construct
  source 1..20: note = Seed: SATGFKQSSKALQRPVASDF
SATGIKQISAALNRPVASDF

SEQ ID NO: 14477 - protein, 20 aa, synthetic construct
  source 1..20: note = Seed: SATGFKQSSKALQRPVASDF
SATGIKQISAALQRPVASDF

SEQ ID NO: 14478 - protein, 20 aa, synthetic construct
  source 1..20: note = Seed: SATGFKQSSKALQRPVASDF
SATGIKQISAALRRPVASDF

SEQ ID NO: 14479 - protein, 20 aa, synthetic construct
  source 1..20: note = Seed: SATGFKQSSKALQRPVASDF
SATGIKQISAALSRPVASDF

SEQ ID NO: 14480 - protein, 20 aa, synthetic construct
  source 1..20: note = Seed: SATGFKQSSKALQRPVASDF
SATGIKQISAALTRPVASDF

SEQ ID NO: 14481 - protein, 20 aa, synthetic construct
  source 1..20: note = Seed: SATGFKQSSKALQRPVASDF
SATGIKQISAALVRPVASDF

SEQ ID NO: 14482 - protein, 20 aa, synthetic construct
  source 1..20: note = Seed: SATGFKQSSKALQRPVASDF
SATGIKQISAALYRPVASDF

SEQ ID NO: 14483 - protein, 20 aa, synthetic construct
  source 1..20: note = Seed: SATGFKQSSKALQRPVASDF
SATGIKQISCALARPVASDF

SEQ ID NO: 14484 - protein, 20 aa, synthetic construct
  source 1..20: note = Seed: SATGFKQSSKALQRPVASDF
SATGIKQISFALARPVASDF

SEQ ID NO: 14485 - protein, 20 aa, synthetic construct
  source 1..20: note = Seed: SATGFKQSSKALQRPVASDF
SATGIKQISFALERPVASDF

SEQ ID NO: 14486 - protein, 20 aa, synthetic construct
  source 1..20: note = Seed: SATGFKQSSKALQRPVASDF
SATGIKQISFALIRPVASDF

SEQ ID NO: 14487 - protein, 20 aa, synthetic construct
  source 1..20: note = Seed: SATGFKQSSKALQRPVASDF
SATGIKQISFALMRPVASDF

SEQ ID NO: 14488 - protein, 20 aa, synthetic construct
  source 1..20: note = Seed: SATGFKQSSKALQRPVASDF
SATGIKQISFALSRPVASDF

SEQ ID NO: 14489 - protein, 20 aa, synthetic construct
  source 1..20: note = Seed: SATGFKQSSKALQRPVASDF
SATGIKQISFALTRPVASDF

SEQ ID NO: 14490 - protein, 20 aa, synthetic construct
  source 1..20: note = Seed: SATGFKQSSKALQRPVASDF
SATGIKQISFALVRPVASDF

SEQ ID NO: 14491 - protein, 20 aa, synthetic construct
  source 1..20: note = Seed: SATGFKQSSKALQRPVASDF
SATGIKQISGALARPVASDF

SEQ ID NO: 14492 - protein, 20 aa, synthetic construct
  source 1..20: note = Seed: SATGFKQSSKALQRPVASDF
SATGIKQISGALCRPVASDF

SEQ ID NO: 14493 - protein, 20 aa, synthetic construct
  source 1..20: note = Seed: SATGFKQSSKALQRPVASDF
SATGIKQISGALFRPVASDF

SEQ ID NO: 14494 - protein, 20 aa, synthetic construct
  source 1..20: note = Seed: SATGFKQSSKALQRPVASDF
SATGIKQISGALGRPVASDF

SEQ ID NO: 14495 - protein, 20 aa, synthetic construct
  source 1..20: note = Seed: SATGFKQSSKALQRPVASDF
SATGIKQISGALIRPVASDF

SEQ ID NO: 14496 - protein, 20 aa, synthetic construct
  source 1..20: note = Seed: SATGFKQSSKALQRPVASDF
SATGIKQISGALLRPVASDF

SEQ ID NO: 14497 - protein, 20 aa, synthetic construct
  source 1..20: note = Seed: SATGFKQSSKALQRPVASDF
SATGIKQISGALMRPVASDF

SEQ ID NO: 14498 - protein, 20 aa, synthetic construct
  source 1..20: note = Seed: SATGFKQSSKALQRPVASDF
SATGIKQISGALNRPVASDF

SEQ ID NO: 14499 - protein, 20 aa, synthetic construct
  source 1..20: note = Seed: SATGFKQSSKALQRPVASDF
SATGIKQISGALSRPVASDF

SEQ ID NO: 14500 - protein, 20 aa, synthetic construct
  source 1..20: note = Seed: SATGFKQSSKALQRPVASDF
SATGIKQISGALTRPVASDF

SEQ ID NO: 14501 - protein, 20 aa, synthetic construct
  source 1..20: note = Seed: SATGFKQSSKALQRPVASDF
SATGIKQISGALVRPVASDF

SEQ ID NO: 14502 - protein, 20 aa, synthetic construct
  source 1..20: note = Seed: SATGFKQSSKALQRPVASDF
SATGIKQISHALARPVASDF

SEQ ID NO: 14503 - protein, 20 aa, synthetic construct
  source 1..20: note = Seed: SATGFKQSSKALQRPVASDF
SATGIKQISHALGRPVASDF

SEQ ID NO: 14504 - protein, 20 aa, synthetic construct
  source 1..20: note = Seed: SATGFKQSSKALQRPVASDF
SATGIKQISHALHRPVASDF

SEQ ID NO: 14505 - protein, 20 aa, synthetic construct
  source 1..20: note = Seed: SATGFKQSSKALQRPVASDF
SATGIKQISHALIRPVASDF

SEQ ID NO: 14506 - protein, 20 aa, synthetic construct
  source 1..20: note = Seed: SATGFKQSSKALQRPVASDF
SATGIKQISHALKRPVASDF

SEQ ID NO: 14507 - protein, 20 aa, synthetic construct
  source 1..20: note = Seed: SATGFKQSSKALQRPVASDF
SATGIKQISHALLRPVASDF

SEQ ID NO: 14508 - protein, 20 aa, synthetic construct
  source 1..20: note = Seed: SATGFKQSSKALQRPVASDF
SATGIKQISHALMRPVASDF

SEQ ID NO: 14509 - protein, 20 aa, synthetic construct
  source 1..20: note = Seed: SATGFKQSSKALQRPVASDF
SATGIKQISHALRRPVASDF

SEQ ID NO: 14510 - protein, 20 aa, synthetic construct
  source 1..20: note = Seed: SATGFKQSSKALQRPVASDF
SATGIKQISHALSRPVASDF

SEQ ID NO: 14511 - protein, 20 aa, synthetic construct
  source 1..20: note = Seed: SATGFKQSSKALQRPVASDF
SATGIKQISHALVRPVASDF

SEQ ID NO: 14512 - protein, 20 aa, synthetic construct
  source 1..20: note = Seed: SATGFKQSSKALQRPVASDF
SATGIKQISHALYRPVASDF

SEQ ID NO: 14513 - protein, 20 aa, synthetic construct
  source 1..20: note = Seed: SATGFKQSSKALQRPVASDF
SATGIKQISIALARPVASDF

SEQ ID NO: 14514 - protein, 20 aa, synthetic construct
  source 1..20: note = Seed: SATGFKQSSKALQRPVASDF
SATGIKQISIALCRPVASDF

SEQ ID NO: 14515 - protein, 20 aa, synthetic construct
  source 1..20: note = Seed: SATGFKQSSKALQRPVASDF
SATGIKQISIALGRPVASDF

SEQ ID NO: 14516 - protein, 20 aa, synthetic construct
  source 1..20: note = Seed: SATGFKQSSKALQRPVASDF
SATGIKQISIALHRPVASDF

SEQ ID NO: 14517 - protein, 20 aa, synthetic construct
  source 1..20: note = Seed: SATGFKQSSKALQRPVASDF
SATGIKQISIALIRPVASDF

SEQ ID NO: 14518 - protein, 20 aa, synthetic construct
  source 1..20: note = Seed: SATGFKQSSKALQRPVASDF
SATGIKQISIALMRPVASDF

SEQ ID NO: 14519 - protein, 20 aa, synthetic construct
  source 1..20: note = Seed: SATGFKQSSKALQRPVASDF
SATGIKQISIALNRPVASDF

SEQ ID NO: 14520 - protein, 20 aa, synthetic construct
  source 1..20: note = Seed: SATGFKQSSKALQRPVASDF
SATGIKQISIALSRPVASDF

SEQ ID NO: 14521 - protein, 20 aa, synthetic construct
  source 1..20: note = Seed: SATGFKQSSKALQRPVASDF
SATGIKQISIALVRPVASDF

SEQ ID NO: 14522 - protein, 20 aa, synthetic construct
  source 1..20: note = Seed: SATGFKQSSKALQRPVASDF
SATGIKQISIALYRPVASDF

SEQ ID NO: 14523 - protein, 20 aa, synthetic construct
  source 1..20: note = Seed: SATGFKQSSKALQRPVASDF
SATGIKQISKALARPVASDF

SEQ ID NO: 14524 - protein, 20 aa, synthetic construct
  source 1..20: note = Seed: SATGFKQSSKALQRPVASDF
SATGIKQISKALCRPVASDF

SEQ ID NO: 14525 - protein, 20 aa, synthetic construct
  source 1..20: note = Seed: SATGFKQSSKALQRPVASDF
SATGIKQISKALFRPVASDF

SEQ ID NO: 14526 - protein, 20 aa, synthetic construct
  source 1..20: note = Seed: SATGFKQSSKALQRPVASDF
SATGIKQISKALGRPVASDF

SEQ ID NO: 14527 - protein, 20 aa, synthetic construct
  source 1..20: note = Seed: SATGFKQSSKALQRPVASDF
SATGIKQISKALHRPVASDF

SEQ ID NO: 14528 - protein, 20 aa, synthetic construct
  source 1..20: note = Seed: SATGFKQSSKALQRPVASDF
SATGIKQISKALIRPVASDF

SEQ ID NO: 14529 - protein, 20 aa, synthetic construct
  source 1..20: note = Seed: SATGFKQSSKALQRPVASDF
SATGIKQISKALKRPVASDF

SEQ ID NO: 14530 - protein, 20 aa, synthetic construct
  source 1..20: note = Seed: SATGFKQSSKALQRPVASDF
SATGIKQISKALLRPVASDF

SEQ ID NO: 14531 - protein, 20 aa, synthetic construct
  source 1..20: note = Seed: SATGFKQSSKALQRPVASDF
SATGIKQISKALMRPVASDF

SEQ ID NO: 14532 - protein, 20 aa, synthetic construct
  source 1..20: note = Seed: SATGFKQSSKALQRPVASDF
SATGIKQISKALNRPVASDF

SEQ ID NO: 14533 - protein, 20 aa, synthetic construct
  source 1..20: note = Seed: SATGFKQSSKALQRPVASDF
SATGIKQISKALPRPVASDF

SEQ ID NO: 14534 - protein, 20 aa, synthetic construct
  source 1..20: note = Seed: SATGFKQSSKALQRPVASDF
SATGIKQISKALQRPVASDF

SEQ ID NO: 14535 - protein, 20 aa, synthetic construct
  source 1..20: note = Seed: SATGFKQSSKALQRPVASDF
SATGIKQISKALRRPVASDF

SEQ ID NO: 14536 - protein, 20 aa, synthetic construct
  source 1..20: note = Seed: SATGFKQSSKALQRPVASDF
SATGIKQISKALSRPVASDF

SEQ ID NO: 14537 - protein, 20 aa, synthetic construct
  source 1..20: note = Seed: SATGFKQSSKALQRPVASDF
SATGIKQISKALTRPVASDF

SEQ ID NO: 14538 - protein, 20 aa, synthetic construct
  source 1..20: note = Seed: SATGFKQSSKALQRPVASDF
SATGIKQISKALVRPVASDF

SEQ ID NO: 14539 - protein, 20 aa, synthetic construct
  source 1..20: note = Seed: SATGFKQSSKALQRPVASDF
SATGIKQISKALWRPVASDF

SEQ ID NO: 14540 - protein, 20 aa, synthetic construct
  source 1..20: note = Seed: SATGFKQSSKALQRPVASDF
SATGIKQISKALYRPVASDF

SEQ ID NO: 14541 - protein, 20 aa, synthetic construct
  source 1..20: note = Seed: SATGFKQSSKALQRPVASDF
SATGIKQISLALARPVASDF

SEQ ID NO: 14542 - protein, 20 aa, synthetic construct
  source 1..20: note = Seed: SATGFKQSSKALQRPVASDF
SATGIKQISLALGRPVASDF

SEQ ID NO: 14543 - protein, 20 aa, synthetic construct
  source 1..20: note = Seed: SATGFKQSSKALQRPVASDF
SATGIKQISLALHRPVASDF

SEQ ID NO: 14544 - protein, 20 aa, synthetic construct
  source 1..20: note = Seed: SATGFKQSSKALQRPVASDF
SATGIKQISLALIRPVASDF

SEQ ID NO: 14545 - protein, 20 aa, synthetic construct
  source 1..20: note = Seed: SATGFKQSSKALQRPVASDF
SATGIKQISLALMRPVASDF

SEQ ID NO: 14546 - protein, 20 aa, synthetic construct
  source 1..20: note = Seed: SATGFKQSSKALQRPVASDF
SATGIKQISLALNRPVASDF

SEQ ID NO: 14547 - protein, 20 aa, synthetic construct
  source 1..20: note = Seed: SATGFKQSSKALQRPVASDF
SATGIKQISLALSRPVASDF

SEQ ID NO: 14548 - protein, 20 aa, synthetic construct
  source 1..20: note = Seed: SATGFKQSSKALQRPVASDF
SATGIKQISLALVRPVASDF

SEQ ID NO: 14549 - protein, 20 aa, synthetic construct
  source 1..20: note = Seed: SATGFKQSSKALQRPVASDF
SATGIKQISMALHRPVASDF

SEQ ID NO: 14550 - protein, 20 aa, synthetic construct
  source 1..20: note = Seed: SATGFKQSSKALQRPVASDF
SATGIKQISMALNRPVASDF

SEQ ID NO: 14551 - protein, 20 aa, synthetic construct
  source 1..20: note = Seed: SATGFKQSSKALQRPVASDF
SATGIKQISMALVRPVASDF

SEQ ID NO: 14552 - protein, 20 aa, synthetic construct
  source 1..20: note = Seed: SATGFKQSSKALQRPVASDF
SATGIKQISNALARPVASDF

SEQ ID NO: 14553 - protein, 20 aa, synthetic construct
  source 1..20: note = Seed: SATGFKQSSKALQRPVASDF
SATGIKQISNALIRPVASDF

SEQ ID NO: 14554 - protein, 20 aa, synthetic construct
  source 1..20: note = Seed: SATGFKQSSKALQRPVASDF
SATGIKQISNALLRPVASDF

SEQ ID NO: 14555 - protein, 20 aa, synthetic construct
  source 1..20: note = Seed: SATGFKQSSKALQRPVASDF
SATGIKQISNALMRPVASDF

SEQ ID NO: 14556 - protein, 20 aa, synthetic construct
  source 1..20: note = Seed: SATGFKQSSKALQRPVASDF
SATGIKQISNALNRPVASDF

SEQ ID NO: 14557 - protein, 20 aa, synthetic construct
  source 1..20: note = Seed: SATGFKQSSKALQRPVASDF
SATGIKQISNALRRPVASDF

SEQ ID NO: 14558 - protein, 20 aa, synthetic construct
  source 1..20: note = Seed: SATGFKQSSKALQRPVASDF
SATGIKQISNALSRPVASDF

SEQ ID NO: 14559 - protein, 20 aa, synthetic construct
  source 1..20: note = Seed: SATGFKQSSKALQRPVASDF
SATGIKQISNALTRPVASDF

SEQ ID NO: 14560 - protein, 20 aa, synthetic construct
  source 1..20: note = Seed: SATGFKQSSKALQRPVASDF
SATGIKQISNALVRPVASDF

SEQ ID NO: 14561 - protein, 20 aa, synthetic construct
  source 1..20: note = Seed: SATGFKQSSKALQRPVASDF
SATGIKQISPALARPVASDF

SEQ ID NO: 14562 - protein, 20 aa, synthetic construct
  source 1..20: note = Seed: SATGFKQSSKALQRPVASDF
SATGIKQISPALCRPVASDF

SEQ ID NO: 14563 - protein, 20 aa, synthetic construct
  source 1..20: note = Seed: SATGFKQSSKALQRPVASDF
SATGIKQISPALGRPVASDF

SEQ ID NO: 14564 - protein, 20 aa, synthetic construct
  source 1..20: note = Seed: SATGFKQSSKALQRPVASDF
SATGIKQISPALHRPVASDF

SEQ ID NO: 14565 - protein, 20 aa, synthetic construct
  source 1..20: note = Seed: SATGFKQSSKALQRPVASDF
SATGIKQISPALIRPVASDF

SEQ ID NO: 14566 - protein, 20 aa, synthetic construct
  source 1..20: note = Seed: SATGFKQSSKALQRPVASDF
SATGIKQISPALLRPVASDF

SEQ ID NO: 14567 - protein, 20 aa, synthetic construct
  source 1..20: note = Seed: SATGFKQSSKALQRPVASDF
SATGIKQISPALMRPVASDF

SEQ ID NO: 14568 - protein, 20 aa, synthetic construct
  source 1..20: note = Seed: SATGFKQSSKALQRPVASDF
SATGIKQISPALNRPVASDF

SEQ ID NO: 14569 - protein, 20 aa, synthetic construct
  source 1..20: note = Seed: SATGFKQSSKALQRPVASDF
SATGIKQISPALPRPVASDF

SEQ ID NO: 14570 - protein, 20 aa, synthetic construct
  source 1..20: note = Seed: SATGFKQSSKALQRPVASDF
SATGIKQISPALQRPVASDF

SEQ ID NO: 14571 - protein, 20 aa, synthetic construct
  source 1..20: note = Seed: SATGFKQSSKALQRPVASDF
SATGIKQISPALRRPVASDF

SEQ ID NO: 14572 - protein, 20 aa, synthetic construct
  source 1..20: note = Seed: SATGFKQSSKALQRPVASDF
SATGIKQISPALSRPVASDF

SEQ ID NO: 14573 - protein, 20 aa, synthetic construct
  source 1..20: note = Seed: SATGFKQSSKALQRPVASDF
SATGIKQISPALTRPVASDF

SEQ ID NO: 14574 - protein, 20 aa, synthetic construct
  source 1..20: note = Seed: SATGFKQSSKALQRPVASDF
SATGIKQISPALVRPVASDF

SEQ ID NO: 14575 - protein, 20 aa, synthetic construct
  source 1..20: note = Seed: SATGFKQSSKALQRPVASDF
SATGIKQISQALRRPVASDF

SEQ ID NO: 14576 - protein, 20 aa, synthetic construct
  source 1..20: note = Seed: SATGFKQSSKALQRPVASDF
SATGIKQISRALARPVASDF

SEQ ID NO: 14577 - protein, 20 aa, synthetic construct
  source 1..20: note = Seed: SATGFKQSSKALQRPVASDF
SATGIKQISRALCRPVASDF

SEQ ID NO: 14578 - protein, 20 aa, synthetic construct
  source 1..20: note = Seed: SATGFKQSSKALQRPVASDF
SATGIKQISRALERPVASDF

SEQ ID NO: 14579 - protein, 20 aa, synthetic construct
  source 1..20: note = Seed: SATGFKQSSKALQRPVASDF
SATGIKQISRALFRPVASDF

SEQ ID NO: 14580 - protein, 20 aa, synthetic construct
  source 1..20: note = Seed: SATGFKQSSKALQRPVASDF
SATGIKQISRALGRPVASDF

SEQ ID NO: 14581 - protein, 20 aa, synthetic construct
  source 1..20: note = Seed: SATGFKQSSKALQRPVASDF
SATGIKQISRALHRPVASDF

SEQ ID NO: 14582 - protein, 20 aa, synthetic construct
  source 1..20: note = Seed: SATGFKQSSKALQRPVASDF
SATGIKQISRALIRPVASDF

SEQ ID NO: 14583 - protein, 20 aa, synthetic construct
  source 1..20: note = Seed: SATGFKQSSKALQRPVASDF
SATGIKQISRALKRPVASDF

SEQ ID NO: 14584 - protein, 20 aa, synthetic construct
  source 1..20: note = Seed: SATGFKQSSKALQRPVASDF
SATGIKQISRALLRPVASDF

SEQ ID NO: 14585 - protein, 20 aa, synthetic construct
  source 1..20: note = Seed: SATGFKQSSKALQRPVASDF
SATGIKQISRALMRPVASDF

SEQ ID NO: 14586 - protein, 20 aa, synthetic construct
  source 1..20: note = Seed: SATGFKQSSKALQRPVASDF
SATGIKQISRALNRPVASDF

SEQ ID NO: 14587 - protein, 20 aa, synthetic construct
  source 1..20: note = Seed: SATGFKQSSKALQRPVASDF
SATGIKQISRALPRPVASDF

SEQ ID NO: 14588 - protein, 20 aa, synthetic construct
  source 1..20: note = Seed: SATGFKQSSKALQRPVASDF
SATGIKQISRALQRPVASDF

SEQ ID NO: 14589 - protein, 20 aa, synthetic construct
  source 1..20: note = Seed: SATGFKQSSKALQRPVASDF
SATGIKQISRALRRPVASDF

SEQ ID NO: 14590 - protein, 20 aa, synthetic construct
  source 1..20: note = Seed: SATGFKQSSKALQRPVASDF
SATGIKQISRALSRPVASDF

SEQ ID NO: 14591 - protein, 20 aa, synthetic construct
  source 1..20: note = Seed: SATGFKQSSKALQRPVASDF
SATGIKQISRALTRPVASDF

SEQ ID NO: 14592 - protein, 20 aa, synthetic construct
  source 1..20: note = Seed: SATGFKQSSKALQRPVASDF
SATGIKQISRALVRPVASDF

SEQ ID NO: 14593 - protein, 20 aa, synthetic construct
  source 1..20: note = Seed: SATGFKQSSKALQRPVASDF
SATGIKQISRALWRPVASDF

SEQ ID NO: 14594 - protein, 20 aa, synthetic construct
  source 1..20: note = Seed: SATGFKQSSKALQRPVASDF
SATGIKQISRALYRPVASDF

SEQ ID NO: 14595 - protein, 20 aa, synthetic construct
  source 1..20: note = Seed: SATGFKQSSKALQRPVASDF
SATGIKQISSALARPVASDF

SEQ ID NO: 14596 - protein, 20 aa, synthetic construct
  source 1..20: note = Seed: SATGFKQSSKALQRPVASDF
SATGIKQISSALCRPVASDF

SEQ ID NO: 14597 - protein, 20 aa, synthetic construct
  source 1..20: note = Seed: SATGFKQSSKALQRPVASDF
SATGIKQISSALFRPVASDF

SEQ ID NO: 14598 - protein, 20 aa, synthetic construct
  source 1..20: note = Seed: SATGFKQSSKALQRPVASDF
SATGIKQISSALGRPVASDF

SEQ ID NO: 14599 - protein, 20 aa, synthetic construct
  source 1..20: note = Seed: SATGFKQSSKALQRPVASDF
SATGIKQISSALHRPVASDF

SEQ ID NO: 14600 - protein, 20 aa, synthetic construct
  source 1..20: note = Seed: SATGFKQSSKALQRPVASDF
SATGIKQISSALIRPVASDF

SEQ ID NO: 14601 - protein, 20 aa, synthetic construct
  source 1..20: note = Seed: SATGFKQSSKALQRPVASDF
SATGIKQISSALLRPVASDF

SEQ ID NO: 14602 - protein, 20 aa, synthetic construct
  source 1..20: note = Seed: SATGFKQSSKALQRPVASDF
SATGIKQISSALMRPVASDF

SEQ ID NO: 14603 - protein, 20 aa, synthetic construct
  source 1..20: note = Seed: SATGFKQSSKALQRPVASDF
SATGIKQISSALNRPVASDF

SEQ ID NO: 14604 - protein, 20 aa, synthetic construct
  source 1..20: note = Seed: SATGFKQSSKALQRPVASDF
SATGIKQISSALRRPVASDF

SEQ ID NO: 14605 - protein, 20 aa, synthetic construct
  source 1..20: note = Seed: SATGFKQSSKALQRPVASDF
SATGIKQISSALSRPVASDF

SEQ ID NO: 14606 - protein, 20 aa, synthetic construct
  source 1..20: note = Seed: SATGFKQSSKALQRPVASDF
SATGIKQISSALTRPVASDF

SEQ ID NO: 14607 - protein, 20 aa, synthetic construct
  source 1..20: note = Seed: SATGFKQSSKALQRPVASDF
SATGIKQISSALVRPVASDF

SEQ ID NO: 14608 - protein, 20 aa, synthetic construct
  source 1..20: note = Seed: SATGFKQSSKALQRPVASDF
SATGIKQISTALARPVASDF

SEQ ID NO: 14609 - protein, 20 aa, synthetic construct
  source 1..20: note = Seed: SATGFKQSSKALQRPVASDF
SATGIKQISTALGRPVASDF

SEQ ID NO: 14610 - protein, 20 aa, synthetic construct
  source 1..20: note = Seed: SATGFKQSSKALQRPVASDF
SATGIKQISTALHRPVASDF

SEQ ID NO: 14611 - protein, 20 aa, synthetic construct
  source 1..20: note = Seed: SATGFKQSSKALQRPVASDF
SATGIKQISTALIRPVASDF

SEQ ID NO: 14612 - protein, 20 aa, synthetic construct
  source 1..20: note = Seed: SATGFKQSSKALQRPVASDF
SATGIKQISTALKRPVASDF

SEQ ID NO: 14613 - protein, 20 aa, synthetic construct
  source 1..20: note = Seed: SATGFKQSSKALQRPVASDF
SATGIKQISTALLRPVASDF

SEQ ID NO: 14614 - protein, 20 aa, synthetic construct
  source 1..20: note = Seed: SATGFKQSSKALQRPVASDF
SATGIKQISTALMRPVASDF

SEQ ID NO: 14615 - protein, 20 aa, synthetic construct
  source 1..20: note = Seed: SATGFKQSSKALQRPVASDF
SATGIKQISTALNRPVASDF

SEQ ID NO: 14616 - protein, 20 aa, synthetic construct
  source 1..20: note = Seed: SATGFKQSSKALQRPVASDF
SATGIKQISTALRRPVASDF

SEQ ID NO: 14617 - protein, 20 aa, synthetic construct
  source 1..20: note = Seed: SATGFKQSSKALQRPVASDF
SATGIKQISTALSRPVASDF

SEQ ID NO: 14618 - protein, 20 aa, synthetic construct
  source 1..20: note = Seed: SATGFKQSSKALQRPVASDF
SATGIKQISTALTRPVASDF

SEQ ID NO: 14619 - protein, 20 aa, synthetic construct
  source 1..20: note = Seed: SATGFKQSSKALQRPVASDF
SATGIKQISTALVRPVASDF

SEQ ID NO: 14620 - protein, 20 aa, synthetic construct
  source 1..20: note = Seed: SATGFKQSSKALQRPVASDF
SATGIKQISVALARPVASDF

SEQ ID NO: 14621 - protein, 20 aa, synthetic construct
  source 1..20: note = Seed: SATGFKQSSKALQRPVASDF
SATGIKQISVALERPVASDF

SEQ ID NO: 14622 - protein, 20 aa, synthetic construct
  source 1..20: note = Seed: SATGFKQSSKALQRPVASDF
SATGIKQISVALGRPVASDF

SEQ ID NO: 14623 - protein, 20 aa, synthetic construct
  source 1..20: note = Seed: SATGFKQSSKALQRPVASDF
SATGIKQISVALHRPVASDF

SEQ ID NO: 14624 - protein, 20 aa, synthetic construct
  source 1..20: note = Seed: SATGFKQSSKALQRPVASDF
SATGIKQISVALIRPVASDF

SEQ ID NO: 14625 - protein, 20 aa, synthetic construct
  source 1..20: note = Seed: SATGFKQSSKALQRPVASDF
SATGIKQISVALLRPVASDF

SEQ ID NO: 14626 - protein, 20 aa, synthetic construct
  source 1..20: note = Seed: SATGFKQSSKALQRPVASDF
SATGIKQISVALMRPVASDF

SEQ ID NO: 14627 - protein, 20 aa, synthetic construct
  source 1..20: note = Seed: SATGFKQSSKALQRPVASDF
SATGIKQISVALNRPVASDF

SEQ ID NO: 14628 - protein, 20 aa, synthetic construct
  source 1..20: note = Seed: SATGFKQSSKALQRPVASDF
SATGIKQISVALQRPVASDF

SEQ ID NO: 14629 - protein, 20 aa, synthetic construct
  source 1..20: note = Seed: SATGFKQSSKALQRPVASDF
SATGIKQISVALRRPVASDF

SEQ ID NO: 14630 - protein, 20 aa, synthetic construct
  source 1..20: note = Seed: SATGFKQSSKALQRPVASDF
SATGIKQISVALSRPVASDF

SEQ ID NO: 14631 - protein, 20 aa, synthetic construct
  source 1..20: note = Seed: SATGFKQSSKALQRPVASDF
SATGIKQISVALTRPVASDF

SEQ ID NO: 14632 - protein, 20 aa, synthetic construct
  source 1..20: note = Seed: SATGFKQSSKALQRPVASDF
SATGIKQISVALVRPVASDF

SEQ ID NO: 14633 - protein, 20 aa, synthetic construct
  source 1..20: note = Seed: SATGFKQSSKALQRPVASDF
SATGIKQKSAALLRPVASDF

SEQ ID NO: 14634 - protein, 20 aa, synthetic construct
  source 1..20: note = Seed: SATGFKQSSKALQRPVASDF
SATGIKQKSIALARPVASDF

SEQ ID NO: 14635 - protein, 20 aa, synthetic construct
  source 1..20: note = Seed: SATGFKQSSKALQRPVASDF
SATGIKQKSIALRRPVASDF

SEQ ID NO: 14636 - protein, 20 aa, synthetic construct
  source 1..20: note = Seed: SATGFKQSSKALQRPVASDF
SATGIKQKSKALARPVASDF

SEQ ID NO: 14637 - protein, 20 aa, synthetic construct
  source 1..20: note = Seed: SATGFKQSSKALQRPVASDF
SATGIKQKSKALKRPVASDF

SEQ ID NO: 14638 - protein, 20 aa, synthetic construct
  source 1..20: note = Seed: SATGFKQSSKALQRPVASDF
SATGIKQKSKALRRPVASDF

SEQ ID NO: 14639 - protein, 20 aa, synthetic construct
  source 1..20: note = Seed: SATGFKQSSKALQRPVASDF
SATGIKQKSKALSRPVASDF

SEQ ID NO: 14640 - protein, 20 aa, synthetic construct
  source 1..20: note = Seed: SATGFKQSSKALQRPVASDF
SATGIKQKSLALRRPVASDF

SEQ ID NO: 14641 - protein, 20 aa, synthetic construct
  source 1..20: note = Seed: SATGFKQSSKALQRPVASDF
SATGIKQKSRALARPVASDF

SEQ ID NO: 14642 - protein, 20 aa, synthetic construct
  source 1..20: note = Seed: SATGFKQSSKALQRPVASDF
SATGIKQKSRALFRPVASDF

SEQ ID NO: 14643 - protein, 20 aa, synthetic construct
  source 1..20: note = Seed: SATGFKQSSKALQRPVASDF
SATGIKQKSRALHRPVASDF

SEQ ID NO: 14644 - protein, 20 aa, synthetic construct
  source 1..20: note = Seed: SATGFKQSSKALQRPVASDF
SATGIKQKSRALIRPVASDF

SEQ ID NO: 14645 - protein, 20 aa, synthetic construct
  source 1..20: note = Seed: SATGFKQSSKALQRPVASDF
SATGIKQKSRALKRPVASDF

SEQ ID NO: 14646 - protein, 20 aa, synthetic construct
  source 1..20: note = Seed: SATGFKQSSKALQRPVASDF
SATGIKQKSRALLRPVASDF

SEQ ID NO: 14647 - protein, 20 aa, synthetic construct
  source 1..20: note = Seed: SATGFKQSSKALQRPVASDF
SATGIKQKSRALMRPVASDF

SEQ ID NO: 14648 - protein, 20 aa, synthetic construct
  source 1..20: note = Seed: SATGFKQSSKALQRPVASDF
SATGIKQKSRALRRPVASDF

SEQ ID NO: 14649 - protein, 20 aa, synthetic construct
  source 1..20: note = Seed: SATGFKQSSKALQRPVASDF
SATGIKQKSRALSRPVASDF

SEQ ID NO: 14650 - protein, 20 aa, synthetic construct
  source 1..20: note = Seed: SATGFKQSSKALQRPVASDF
SATGIKQKSRALVRPVASDF

SEQ ID NO: 14651 - protein, 20 aa, synthetic construct
  source 1..20: note = Seed: SATGFKQSSKALQRPVASDF
SATGIKQKSRALYRPVASDF

SEQ ID NO: 14652 - protein, 20 aa, synthetic construct
  source 1..20: note = Seed: SATGFKQSSKALQRPVASDF
SATGIKQKSVALRRPVASDF

SEQ ID NO: 14653 - protein, 20 aa, synthetic construct
  source 1..20: note = Seed: SATGFKQSSKALQRPVASDF
SATGIKQKSVALSRPVASDF

SEQ ID NO: 14654 - protein, 20 aa, synthetic construct
  source 1..20: note = Seed: SATGFKQSSKALQRPVASDF
SATGIKQLSAALARPVASDF

SEQ ID NO: 14655 - protein, 20 aa, synthetic construct
  source 1..20: note = Seed: SATGFKQSSKALQRPVASDF
SATGIKQLSAALCRPVASDF

SEQ ID NO: 14656 - protein, 20 aa, synthetic construct
  source 1..20: note = Seed: SATGFKQSSKALQRPVASDF
SATGIKQLSAALDRPVASDF

SEQ ID NO: 14657 - protein, 20 aa, synthetic construct
  source 1..20: note = Seed: SATGFKQSSKALQRPVASDF
SATGIKQLSAALERPVASDF

SEQ ID NO: 14658 - protein, 20 aa, synthetic construct
  source 1..20: note = Seed: SATGFKQSSKALQRPVASDF
SATGIKQLSAALFRPVASDF

SEQ ID NO: 14659 - protein, 20 aa, synthetic construct
  source 1..20: note = Seed: SATGFKQSSKALQRPVASDF
SATGIKQLSAALGRPVASDF

SEQ ID NO: 14660 - protein, 20 aa, synthetic construct
  source 1..20: note = Seed: SATGFKQSSKALQRPVASDF
SATGIKQLSAALHRPVASDF

SEQ ID NO: 14661 - protein, 20 aa, synthetic construct
  source 1..20: note = Seed: SATGFKQSSKALQRPVASDF
SATGIKQLSAALIRPVASDF

SEQ ID NO: 14662 - protein, 20 aa, synthetic construct
  source 1..20: note = Seed: SATGFKQSSKALQRPVASDF
SATGIKQLSAALKRPVASDF

SEQ ID NO: 14663 - protein, 20 aa, synthetic construct
  source 1..20: note = Seed: SATGFKQSSKALQRPVASDF
SATGIKQLSAALLRPVASDF

SEQ ID NO: 14664 - protein, 20 aa, synthetic construct
  source 1..20: note = Seed: SATGFKQSSKALQRPVASDF
SATGIKQLSAALMRPVASDF

SEQ ID NO: 14665 - protein, 20 aa, synthetic construct
  source 1..20: note = Seed: SATGFKQSSKALQRPVASDF
SATGIKQLSAALNRPVASDF

SEQ ID NO: 14666 - protein, 20 aa, synthetic construct
  source 1..20: note = Seed: SATGFKQSSKALQRPVASDF
SATGIKQLSAALPRPVASDF

SEQ ID NO: 14667 - protein, 20 aa, synthetic construct
  source 1..20: note = Seed: SATGFKQSSKALQRPVASDF
SATGIKQLSAALQRPVASDF

SEQ ID NO: 14668 - protein, 20 aa, synthetic construct
  source 1..20: note = Seed: SATGFKQSSKALQRPVASDF
SATGIKQLSAALRRPVASDF

SEQ ID NO: 14669 - protein, 20 aa, synthetic construct
  source 1..20: note = Seed: SATGFKQSSKALQRPVASDF
SATGIKQLSAALSRPVASDF

SEQ ID NO: 14670 - protein, 20 aa, synthetic construct
  source 1..20: note = Seed: SATGFKQSSKALQRPVASDF
SATGIKQLSAALTRPVASDF

SEQ ID NO: 14671 - protein, 20 aa, synthetic construct
  source 1..20: note = Seed: SATGFKQSSKALQRPVASDF
SATGIKQLSAALVRPVASDF

SEQ ID NO: 14672 - protein, 20 aa, synthetic construct
  source 1..20: note = Seed: SATGFKQSSKALQRPVASDF
SATGIKQLSAALYRPVASDF

SEQ ID NO: 14673 - protein, 20 aa, synthetic construct
  source 1..20: note = Seed: SATGFKQSSKALQRPVASDF
SATGIKQLSCALARPVASDF

SEQ ID NO: 14674 - protein, 20 aa, synthetic construct
  source 1..20: note = Seed: SATGFKQSSKALQRPVASDF
SATGIKQLSCALIRPVASDF

SEQ ID NO: 14675 - protein, 20 aa, synthetic construct
  source 1..20: note = Seed: SATGFKQSSKALQRPVASDF
SATGIKQLSCALLRPVASDF

SEQ ID NO: 14676 - protein, 20 aa, synthetic construct
  source 1..20: note = Seed: SATGFKQSSKALQRPVASDF
SATGIKQLSCALSRPVASDF

SEQ ID NO: 14677 - protein, 20 aa, synthetic construct
  source 1..20: note = Seed: SATGFKQSSKALQRPVASDF
SATGIKQLSCALTRPVASDF

SEQ ID NO: 14678 - protein, 20 aa, synthetic construct
  source 1..20: note = Seed: SATGFKQSSKALQRPVASDF
SATGIKQLSCALVRPVASDF

SEQ ID NO: 14679 - protein, 20 aa, synthetic construct
  source 1..20: note = Seed: SATGFKQSSKALQRPVASDF
SATGIKQLSDALARPVASDF

SEQ ID NO: 14680 - protein, 20 aa, synthetic construct
  source 1..20: note = Seed: SATGFKQSSKALQRPVASDF
SATGIKQLSEALARPVASDF

SEQ ID NO: 14681 - protein, 20 aa, synthetic construct
  source 1..20: note = Seed: SATGFKQSSKALQRPVASDF
SATGIKQLSEALSRPVASDF

SEQ ID NO: 14682 - protein, 20 aa, synthetic construct
  source 1..20: note = Seed: SATGFKQSSKALQRPVASDF
SATGIKQLSFALARPVASDF

SEQ ID NO: 14683 - protein, 20 aa, synthetic construct
  source 1..20: note = Seed: SATGFKQSSKALQRPVASDF
SATGIKQLSFALERPVASDF

SEQ ID NO: 14684 - protein, 20 aa, synthetic construct
  source 1..20: note = Seed: SATGFKQSSKALQRPVASDF
SATGIKQLSFALSRPVASDF

SEQ ID NO: 14685 - protein, 20 aa, synthetic construct
  source 1..20: note = Seed: SATGFKQSSKALQRPVASDF
SATGIKQLSFALTRPVASDF

SEQ ID NO: 14686 - protein, 20 aa, synthetic construct
  source 1..20: note = Seed: SATGFKQSSKALQRPVASDF
SATGIKQLSFALVRPVASDF

SEQ ID NO: 14687 - protein, 20 aa, synthetic construct
  source 1..20: note = Seed: SATGFKQSSKALQRPVASDF
SATGIKQLSGALARPVASDF

SEQ ID NO: 14688 - protein, 20 aa, synthetic construct
  source 1..20: note = Seed: SATGFKQSSKALQRPVASDF
SATGIKQLSGALCRPVASDF

SEQ ID NO: 14689 - protein, 20 aa, synthetic construct
  source 1..20: note = Seed: SATGFKQSSKALQRPVASDF
SATGIKQLSGALFRPVASDF

SEQ ID NO: 14690 - protein, 20 aa, synthetic construct
  source 1..20: note = Seed: SATGFKQSSKALQRPVASDF
SATGIKQLSGALGRPVASDF

SEQ ID NO: 14691 - protein, 20 aa, synthetic construct
  source 1..20: note = Seed: SATGFKQSSKALQRPVASDF
SATGIKQLSGALHRPVASDF

SEQ ID NO: 14692 - protein, 20 aa, synthetic construct
  source 1..20: note = Seed: SATGFKQSSKALQRPVASDF
SATGIKQLSGALIRPVASDF

SEQ ID NO: 14693 - protein, 20 aa, synthetic construct
  source 1..20: note = Seed: SATGFKQSSKALQRPVASDF
SATGIKQLSGALLRPVASDF

SEQ ID NO: 14694 - protein, 20 aa, synthetic construct
  source 1..20: note = Seed: SATGFKQSSKALQRPVASDF
SATGIKQLSGALMRPVASDF

SEQ ID NO: 14695 - protein, 20 aa, synthetic construct
  source 1..20: note = Seed: SATGFKQSSKALQRPVASDF
SATGIKQLSGALNRPVASDF

SEQ ID NO: 14696 - protein, 20 aa, synthetic construct
  source 1..20: note = Seed: SATGFKQSSKALQRPVASDF
SATGIKQLSGALPRPVASDF

SEQ ID NO: 14697 - protein, 20 aa, synthetic construct
  source 1..20: note = Seed: SATGFKQSSKALQRPVASDF
SATGIKQLSGALQRPVASDF

SEQ ID NO: 14698 - protein, 20 aa, synthetic construct
  source 1..20: note = Seed: SATGFKQSSKALQRPVASDF
SATGIKQLSGALSRPVASDF

SEQ ID NO: 14699 - protein, 20 aa, synthetic construct
  source 1..20: note = Seed: SATGFKQSSKALQRPVASDF
SATGIKQLSGALTRPVASDF

SEQ ID NO: 14700 - protein, 20 aa, synthetic construct
  source 1..20: note = Seed: SATGFKQSSKALQRPVASDF
SATGIKQLSGALVRPVASDF

SEQ ID NO: 14701 - protein, 20 aa, synthetic construct
  source 1..20: note = Seed: SATGFKQSSKALQRPVASDF
SATGIKQLSGALYRPVASDF

SEQ ID NO: 14702 - protein, 20 aa, synthetic construct
  source 1..20: note = Seed: SATGFKQSSKALQRPVASDF
SATGIKQLSHALARPVASDF

SEQ ID NO: 14703 - protein, 20 aa, synthetic construct
  source 1..20: note = Seed: SATGFKQSSKALQRPVASDF
SATGIKQLSHALGRPVASDF

SEQ ID NO: 14704 - protein, 20 aa, synthetic construct
  source 1..20: note = Seed: SATGFKQSSKALQRPVASDF
SATGIKQLSHALHRPVASDF

SEQ ID NO: 14705 - protein, 20 aa, synthetic construct
  source 1..20: note = Seed: SATGFKQSSKALQRPVASDF
SATGIKQLSHALIRPVASDF

SEQ ID NO: 14706 - protein, 20 aa, synthetic construct
  source 1..20: note = Seed: SATGFKQSSKALQRPVASDF
SATGIKQLSHALKRPVASDF

SEQ ID NO: 14707 - protein, 20 aa, synthetic construct
  source 1..20: note = Seed: SATGFKQSSKALQRPVASDF
SATGIKQLSHALLRPVASDF

SEQ ID NO: 14708 - protein, 20 aa, synthetic construct
  source 1..20: note = Seed: SATGFKQSSKALQRPVASDF
SATGIKQLSHALMRPVASDF

SEQ ID NO: 14709 - protein, 20 aa, synthetic construct
  source 1..20: note = Seed: SATGFKQSSKALQRPVASDF
SATGIKQLSHALRRPVASDF

SEQ ID NO: 14710 - protein, 20 aa, synthetic construct
  source 1..20: note = Seed: SATGFKQSSKALQRPVASDF
SATGIKQLSHALSRPVASDF

SEQ ID NO: 14711 - protein, 20 aa, synthetic construct
  source 1..20: note = Seed: SATGFKQSSKALQRPVASDF
SATGIKQLSHALVRPVASDF

SEQ ID NO: 14712 - protein, 20 aa, synthetic construct
  source 1..20: note = Seed: SATGFKQSSKALQRPVASDF
SATGIKQLSIALARPVASDF

SEQ ID NO: 14713 - protein, 20 aa, synthetic construct
  source 1..20: note = Seed: SATGFKQSSKALQRPVASDF
SATGIKQLSIALCRPVASDF

SEQ ID NO: 14714 - protein, 20 aa, synthetic construct
  source 1..20: note = Seed: SATGFKQSSKALQRPVASDF
SATGIKQLSIALDRPVASDF

SEQ ID NO: 14715 - protein, 20 aa, synthetic construct
  source 1..20: note = Seed: SATGFKQSSKALQRPVASDF
SATGIKQLSIALGRPVASDF

SEQ ID NO: 14716 - protein, 20 aa, synthetic construct
  source 1..20: note = Seed: SATGFKQSSKALQRPVASDF
SATGIKQLSIALHRPVASDF

SEQ ID NO: 14717 - protein, 20 aa, synthetic construct
  source 1..20: note = Seed: SATGFKQSSKALQRPVASDF
SATGIKQLSIALIRPVASDF

SEQ ID NO: 14718 - protein, 20 aa, synthetic construct
  source 1..20: note = Seed: SATGFKQSSKALQRPVASDF
SATGIKQLSIALNRPVASDF

SEQ ID NO: 14719 - protein, 20 aa, synthetic construct
  source 1..20: note = Seed: SATGFKQSSKALQRPVASDF
SATGIKQLSIALQRPVASDF

SEQ ID NO: 14720 - protein, 20 aa, synthetic construct
  source 1..20: note = Seed: SATGFKQSSKALQRPVASDF
SATGIKQLSIALRRPVASDF

SEQ ID NO: 14721 - protein, 20 aa, synthetic construct
  source 1..20: note = Seed: SATGFKQSSKALQRPVASDF
SATGIKQLSIALSRPVASDF

SEQ ID NO: 14722 - protein, 20 aa, synthetic construct
  source 1..20: note = Seed: SATGFKQSSKALQRPVASDF
SATGIKQLSIALTRPVASDF

SEQ ID NO: 14723 - protein, 20 aa, synthetic construct
  source 1..20: note = Seed: SATGFKQSSKALQRPVASDF
SATGIKQLSIALVRPVASDF

SEQ ID NO: 14724 - protein, 20 aa, synthetic construct
  source 1..20: note = Seed: SATGFKQSSKALQRPVASDF
SATGIKQLSIALYRPVASDF

SEQ ID NO: 14725 - protein, 20 aa, synthetic construct
  source 1..20: note = Seed: SATGFKQSSKALQRPVASDF
SATGIKQLSKALARPVASDF

SEQ ID NO: 14726 - protein, 20 aa, synthetic construct
  source 1..20: note = Seed: SATGFKQSSKALQRPVASDF
SATGIKQLSKALCRPVASDF

SEQ ID NO: 14727 - protein, 20 aa, synthetic construct
  source 1..20: note = Seed: SATGFKQSSKALQRPVASDF
SATGIKQLSKALERPVASDF

SEQ ID NO: 14728 - protein, 20 aa, synthetic construct
  source 1..20: note = Seed: SATGFKQSSKALQRPVASDF
SATGIKQLSKALFRPVASDF

SEQ ID NO: 14729 - protein, 20 aa, synthetic construct
  source 1..20: note = Seed: SATGFKQSSKALQRPVASDF
SATGIKQLSKALGRPVASDF

SEQ ID NO: 14730 - protein, 20 aa, synthetic construct
  source 1..20: note = Seed: SATGFKQSSKALQRPVASDF
SATGIKQLSKALHRPVASDF

SEQ ID NO: 14731 - protein, 20 aa, synthetic construct
  source 1..20: note = Seed: SATGFKQSSKALQRPVASDF
SATGIKQLSKALIRPVASDF

SEQ ID NO: 14732 - protein, 20 aa, synthetic construct
  source 1..20: note = Seed: SATGFKQSSKALQRPVASDF
SATGIKQLSKALKRPVASDF

SEQ ID NO: 14733 - protein, 20 aa, synthetic construct
  source 1..20: note = Seed: SATGFKQSSKALQRPVASDF
SATGIKQLSKALLRPVASDF

SEQ ID NO: 14734 - protein, 20 aa, synthetic construct
  source 1..20: note = Seed: SATGFKQSSKALQRPVASDF
SATGIKQLSKALMRPVASDF

SEQ ID NO: 14735 - protein, 20 aa, synthetic construct
  source 1..20: note = Seed: SATGFKQSSKALQRPVASDF
SATGIKQLSKALNRPVASDF

SEQ ID NO: 14736 - protein, 20 aa, synthetic construct
  source 1..20: note = Seed: SATGFKQSSKALQRPVASDF
SATGIKQLSKALPRPVASDF

SEQ ID NO: 14737 - protein, 20 aa, synthetic construct
  source 1..20: note = Seed: SATGFKQSSKALQRPVASDF
SATGIKQLSKALQRPVASDF

SEQ ID NO: 14738 - protein, 20 aa, synthetic construct
  source 1..20: note = Seed: SATGFKQSSKALQRPVASDF
SATGIKQLSKALRRPVASDF

SEQ ID NO: 14739 - protein, 20 aa, synthetic construct
  source 1..20: note = Seed: SATGFKQSSKALQRPVASDF
SATGIKQLSKALSRPVASDF

SEQ ID NO: 14740 - protein, 20 aa, synthetic construct
  source 1..20: note = Seed: SATGFKQSSKALQRPVASDF
SATGIKQLSKALTRPVASDF

SEQ ID NO: 14741 - protein, 20 aa, synthetic construct
  source 1..20: note = Seed: SATGFKQSSKALQRPVASDF
SATGIKQLSKALVRPVASDF

SEQ ID NO: 14742 - protein, 20 aa, synthetic construct
  source 1..20: note = Seed: SATGFKQSSKALQRPVASDF
SATGIKQLSKALWRPVASDF

SEQ ID NO: 14743 - protein, 20 aa, synthetic construct
  source 1..20: note = Seed: SATGFKQSSKALQRPVASDF
SATGIKQLSKALYRPVASDF

SEQ ID NO: 14744 - protein, 20 aa, synthetic construct
  source 1..20: note = Seed: SATGFKQSSKALQRPVASDF
SATGIKQLSLALARPVASDF

SEQ ID NO: 14745 - protein, 20 aa, synthetic construct
  source 1..20: note = Seed: SATGFKQSSKALQRPVASDF
SATGIKQLSLALCRPVASDF

SEQ ID NO: 14746 - protein, 20 aa, synthetic construct
  source 1..20: note = Seed: SATGFKQSSKALQRPVASDF
SATGIKQLSLALGRPVASDF

SEQ ID NO: 14747 - protein, 20 aa, synthetic construct
  source 1..20: note = Seed: SATGFKQSSKALQRPVASDF
SATGIKQLSLALHRPVASDF

SEQ ID NO: 14748 - protein, 20 aa, synthetic construct
  source 1..20: note = Seed: SATGFKQSSKALQRPVASDF
SATGIKQLSLALIRPVASDF

SEQ ID NO: 14749 - protein, 20 aa, synthetic construct
  source 1..20: note = Seed: SATGFKQSSKALQRPVASDF
SATGIKQLSLALMRPVASDF

SEQ ID NO: 14750 - protein, 20 aa, synthetic construct
  source 1..20: note = Seed: SATGFKQSSKALQRPVASDF
SATGIKQLSLALNRPVASDF

SEQ ID NO: 14751 - protein, 20 aa, synthetic construct
  source 1..20: note = Seed: SATGFKQSSKALQRPVASDF
SATGIKQLSLALRRPVASDF

SEQ ID NO: 14752 - protein, 20 aa, synthetic construct
  source 1..20: note = Seed: SATGFKQSSKALQRPVASDF
SATGIKQLSLALSRPVASDF

SEQ ID NO: 14753 - protein, 20 aa, synthetic construct
  source 1..20: note = Seed: SATGFKQSSKALQRPVASDF
SATGIKQLSLALTRPVASDF

SEQ ID NO: 14754 - protein, 20 aa, synthetic construct
  source 1..20: note = Seed: SATGFKQSSKALQRPVASDF
SATGIKQLSLALVRPVASDF

SEQ ID NO: 14755 - protein, 20 aa, synthetic construct
  source 1..20: note = Seed: SATGFKQSSKALQRPVASDF
SATGIKQLSMALCRPVASDF

SEQ ID NO: 14756 - protein, 20 aa, synthetic construct
  source 1..20: note = Seed: SATGFKQSSKALQRPVASDF
SATGIKQLSMALGRPVASDF

SEQ ID NO: 14757 - protein, 20 aa, synthetic construct
  source 1..20: note = Seed: SATGFKQSSKALQRPVASDF
SATGIKQLSMALHRPVASDF

SEQ ID NO: 14758 - protein, 20 aa, synthetic construct
  source 1..20: note = Seed: SATGFKQSSKALQRPVASDF
SATGIKQLSMALMRPVASDF

SEQ ID NO: 14759 - protein, 20 aa, synthetic construct
  source 1..20: note = Seed: SATGFKQSSKALQRPVASDF
SATGIKQLSMALNRPVASDF

SEQ ID NO: 14760 - protein, 20 aa, synthetic construct
  source 1..20: note = Seed: SATGFKQSSKALQRPVASDF
SATGIKQLSMALRRPVASDF

SEQ ID NO: 14761 - protein, 20 aa, synthetic construct
  source 1..20: note = Seed: SATGFKQSSKALQRPVASDF
SATGIKQLSMALSRPVASDF

SEQ ID NO: 14762 - protein, 20 aa, synthetic construct
  source 1..20: note = Seed: SATGFKQSSKALQRPVASDF
SATGIKQLSNALARPVASDF

SEQ ID NO: 14763 - protein, 20 aa, synthetic construct
  source 1..20: note = Seed: SATGFKQSSKALQRPVASDF
SATGIKQLSNALCRPVASDF

SEQ ID NO: 14764 - protein, 20 aa, synthetic construct
  source 1..20: note = Seed: SATGFKQSSKALQRPVASDF
SATGIKQLSNALFRPVASDF

SEQ ID NO: 14765 - protein, 20 aa, synthetic construct
  source 1..20: note = Seed: SATGFKQSSKALQRPVASDF
SATGIKQLSNALGRPVASDF

SEQ ID NO: 14766 - protein, 20 aa, synthetic construct
  source 1..20: note = Seed: SATGFKQSSKALQRPVASDF
SATGIKQLSNALIRPVASDF

SEQ ID NO: 14767 - protein, 20 aa, synthetic construct
  source 1..20: note = Seed: SATGFKQSSKALQRPVASDF
SATGIKQLSNALLRPVASDF

SEQ ID NO: 14768 - protein, 20 aa, synthetic construct
  source 1..20: note = Seed: SATGFKQSSKALQRPVASDF
SATGIKQLSNALMRPVASDF

SEQ ID NO: 14769 - protein, 20 aa, synthetic construct
  source 1..20: note = Seed: SATGFKQSSKALQRPVASDF
SATGIKQLSNALNRPVASDF

SEQ ID NO: 14770 - protein, 20 aa, synthetic construct
  source 1..20: note = Seed: SATGFKQSSKALQRPVASDF
SATGIKQLSNALRRPVASDF

SEQ ID NO: 14771 - protein, 20 aa, synthetic construct
  source 1..20: note = Seed: SATGFKQSSKALQRPVASDF
SATGIKQLSNALSRPVASDF

SEQ ID NO: 14772 - protein, 20 aa, synthetic construct
  source 1..20: note = Seed: SATGFKQSSKALQRPVASDF
SATGIKQLSNALTRPVASDF

SEQ ID NO: 14773 - protein, 20 aa, synthetic construct
  source 1..20: note = Seed: SATGFKQSSKALQRPVASDF
SATGIKQLSNALVRPVASDF

SEQ ID NO: 14774 - protein, 20 aa, synthetic construct
  source 1..20: note = Seed: SATGFKQSSKALQRPVASDF
SATGIKQLSPALARPVASDF

SEQ ID NO: 14775 - protein, 20 aa, synthetic construct
  source 1..20: note = Seed: SATGFKQSSKALQRPVASDF
SATGIKQLSPALCRPVASDF

SEQ ID NO: 14776 - protein, 20 aa, synthetic construct
  source 1..20: note = Seed: SATGFKQSSKALQRPVASDF
SATGIKQLSPALDRPVASDF

SEQ ID NO: 14777 - protein, 20 aa, synthetic construct
  source 1..20: note = Seed: SATGFKQSSKALQRPVASDF
SATGIKQLSPALFRPVASDF

SEQ ID NO: 14778 - protein, 20 aa, synthetic construct
  source 1..20: note = Seed: SATGFKQSSKALQRPVASDF
SATGIKQLSPALGRPVASDF

SEQ ID NO: 14779 - protein, 20 aa, synthetic construct
  source 1..20: note = Seed: SATGFKQSSKALQRPVASDF
SATGIKQLSPALHRPVASDF

SEQ ID NO: 14780 - protein, 20 aa, synthetic construct
  source 1..20: note = Seed: SATGFKQSSKALQRPVASDF
SATGIKQLSPALIRPVASDF

SEQ ID NO: 14781 - protein, 20 aa, synthetic construct
  source 1..20: note = Seed: SATGFKQSSKALQRPVASDF
SATGIKQLSPALLRPVASDF

SEQ ID NO: 14782 - protein, 20 aa, synthetic construct
  source 1..20: note = Seed: SATGFKQSSKALQRPVASDF
SATGIKQLSPALMRPVASDF

SEQ ID NO: 14783 - protein, 20 aa, synthetic construct
  source 1..20: note = Seed: SATGFKQSSKALQRPVASDF
SATGIKQLSPALNRPVASDF

SEQ ID NO: 14784 - protein, 20 aa, synthetic construct
  source 1..20: note = Seed: SATGFKQSSKALQRPVASDF
SATGIKQLSPALPRPVASDF

SEQ ID NO: 14785 - protein, 20 aa, synthetic construct
  source 1..20: note = Seed: SATGFKQSSKALQRPVASDF
SATGIKQLSPALQRPVASDF

SEQ ID NO: 14786 - protein, 20 aa, synthetic construct
  source 1..20: note = Seed: SATGFKQSSKALQRPVASDF
SATGIKQLSPALSRPVASDF

SEQ ID NO: 14787 - protein, 20 aa, synthetic construct
  source 1..20: note = Seed: SATGFKQSSKALQRPVASDF
SATGIKQLSPALTRPVASDF

SEQ ID NO: 14788 - protein, 20 aa, synthetic construct
  source 1..20: note = Seed: SATGFKQSSKALQRPVASDF
SATGIKQLSPALVRPVASDF

SEQ ID NO: 14789 - protein, 20 aa, synthetic construct
  source 1..20: note = Seed: SATGFKQSSKALQRPVASDF
SATGIKQLSPALYRPVASDF

SEQ ID NO: 14790 - protein, 20 aa, synthetic construct
  source 1..20: note = Seed: SATGFKQSSKALQRPVASDF
SATGIKQLSQALARPVASDF

SEQ ID NO: 14791 - protein, 20 aa, synthetic construct
  source 1..20: note = Seed: SATGFKQSSKALQRPVASDF
SATGIKQLSQALIRPVASDF

SEQ ID NO: 14792 - protein, 20 aa, synthetic construct
  source 1..20: note = Seed: SATGFKQSSKALQRPVASDF
SATGIKQLSQALLRPVASDF

SEQ ID NO: 14793 - protein, 20 aa, synthetic construct
  source 1..20: note = Seed: SATGFKQSSKALQRPVASDF
SATGIKQLSQALMRPVASDF

SEQ ID NO: 14794 - protein, 20 aa, synthetic construct
  source 1..20: note = Seed: SATGFKQSSKALQRPVASDF
SATGIKQLSQALRRPVASDF

SEQ ID NO: 14795 - protein, 20 aa, synthetic construct
  source 1..20: note = Seed: SATGFKQSSKALQRPVASDF
SATGIKQLSQALSRPVASDF

SEQ ID NO: 14796 - protein, 20 aa, synthetic construct
  source 1..20: note = Seed: SATGFKQSSKALQRPVASDF
SATGIKQLSQALVRPVASDF

SEQ ID NO: 14797 - protein, 20 aa, synthetic construct
  source 1..20: note = Seed: SATGFKQSSKALQRPVASDF
SATGIKQLSRALARPVASDF

SEQ ID NO: 14798 - protein, 20 aa, synthetic construct
  source 1..20: note = Seed: SATGFKQSSKALQRPVASDF
SATGIKQLSRALCRPVASDF

SEQ ID NO: 14799 - protein, 20 aa, synthetic construct
  source 1..20: note = Seed: SATGFKQSSKALQRPVASDF
SATGIKQLSRALDRPVASDF

SEQ ID NO: 14800 - protein, 20 aa, synthetic construct
  source 1..20: note = Seed: SATGFKQSSKALQRPVASDF
SATGIKQLSRALERPVASDF

SEQ ID NO: 14801 - protein, 20 aa, synthetic construct
  source 1..20: note = Seed: SATGFKQSSKALQRPVASDF
SATGIKQLSRALFRPVASDF

SEQ ID NO: 14802 - protein, 20 aa, synthetic construct
  source 1..20: note = Seed: SATGFKQSSKALQRPVASDF
SATGIKQLSRALGRPVASDF

SEQ ID NO: 14803 - protein, 20 aa, synthetic construct
  source 1..20: note = Seed: SATGFKQSSKALQRPVASDF
SATGIKQLSRALHRPVASDF

SEQ ID NO: 14804 - protein, 20 aa, synthetic construct
  source 1..20: note = Seed: SATGFKQSSKALQRPVASDF
SATGIKQLSRALIRPVASDF

SEQ ID NO: 14805 - protein, 20 aa, synthetic construct
  source 1..20: note = Seed: SATGFKQSSKALQRPVASDF
SATGIKQLSRALKRPVASDF

SEQ ID NO: 14806 - protein, 20 aa, synthetic construct
  source 1..20: note = Seed: SATGFKQSSKALQRPVASDF
SATGIKQLSRALLRPVASDF

SEQ ID NO: 14807 - protein, 20 aa, synthetic construct
  source 1..20: note = Seed: SATGFKQSSKALQRPVASDF
SATGIKQLSRALMRPVASDF

SEQ ID NO: 14808 - protein, 20 aa, synthetic construct
  source 1..20: note = Seed: SATGFKQSSKALQRPVASDF
SATGIKQLSRALNRPVASDF

SEQ ID NO: 14809 - protein, 20 aa, synthetic construct
  source 1..20: note = Seed: SATGFKQSSKALQRPVASDF
SATGIKQLSRALPRPVASDF

SEQ ID NO: 14810 - protein, 20 aa, synthetic construct
  source 1..20: note = Seed: SATGFKQSSKALQRPVASDF
SATGIKQLSRALQRPVASDF

SEQ ID NO: 14811 - protein, 20 aa, synthetic construct
  source 1..20: note = Seed: SATGFKQSSKALQRPVASDF
SATGIKQLSRALRRPVASDF

SEQ ID NO: 14812 - protein, 20 aa, synthetic construct
  source 1..20: note = Seed: SATGFKQSSKALQRPVASDF
SATGIKQLSRALSRPVASDF

SEQ ID NO: 14813 - protein, 20 aa, synthetic construct
  source 1..20: note = Seed: SATGFKQSSKALQRPVASDF
SATGIKQLSRALTRPVASDF

SEQ ID NO: 14814 - protein, 20 aa, synthetic construct
  source 1..20: note = Seed: SATGFKQSSKALQRPVASDF
SATGIKQLSRALVRPVASDF

SEQ ID NO: 14815 - protein, 20 aa, synthetic construct
  source 1..20: note = Seed: SATGFKQSSKALQRPVASDF
SATGIKQLSRALWRPVASDF

SEQ ID NO: 14816 - protein, 20 aa, synthetic construct
  source 1..20: note = Seed: SATGFKQSSKALQRPVASDF
SATGIKQLSRALYRPVASDF

SEQ ID NO: 14817 - protein, 20 aa, synthetic construct
  source 1..20: note = Seed: SATGFKQSSKALQRPVASDF
SATGIKQLSSALARPVASDF

SEQ ID NO: 14818 - protein, 20 aa, synthetic construct
  source 1..20: note = Seed: SATGFKQSSKALQRPVASDF
SATGIKQLSSALCRPVASDF

SEQ ID NO: 14819 - protein, 20 aa, synthetic construct
  source 1..20: note = Seed: SATGFKQSSKALQRPVASDF
SATGIKQLSSALFRPVASDF

SEQ ID NO: 14820 - protein, 20 aa, synthetic construct
  source 1..20: note = Seed: SATGFKQSSKALQRPVASDF
SATGIKQLSSALGRPVASDF

SEQ ID NO: 14821 - protein, 20 aa, synthetic construct
  source 1..20: note = Seed: SATGFKQSSKALQRPVASDF
SATGIKQLSSALHRPVASDF

SEQ ID NO: 14822 - protein, 20 aa, synthetic construct
  source 1..20: note = Seed: SATGFKQSSKALQRPVASDF
SATGIKQLSSALIRPVASDF

SEQ ID NO: 14823 - protein, 20 aa, synthetic construct
  source 1..20: note = Seed: SATGFKQSSKALQRPVASDF
SATGIKQLSSALLRPVASDF

SEQ ID NO: 14824 - protein, 20 aa, synthetic construct
  source 1..20: note = Seed: SATGFKQSSKALQRPVASDF
SATGIKQLSSALMRPVASDF

SEQ ID NO: 14825 - protein, 20 aa, synthetic construct
  source 1..20: note = Seed: SATGFKQSSKALQRPVASDF
SATGIKQLSSALNRPVASDF

SEQ ID NO: 14826 - protein, 20 aa, synthetic construct
  source 1..20: note = Seed: SATGFKQSSKALQRPVASDF
SATGIKQLSSALPRPVASDF

SEQ ID NO: 14827 - protein, 20 aa, synthetic construct
  source 1..20: note = Seed: SATGFKQSSKALQRPVASDF
SATGIKQLSSALQRPVASDF

SEQ ID NO: 14828 - protein, 20 aa, synthetic construct
  source 1..20: note = Seed: SATGFKQSSKALQRPVASDF
SATGIKQLSSALRRPVASDF

SEQ ID NO: 14829 - protein, 20 aa, synthetic construct
  source 1..20: note = Seed: SATGFKQSSKALQRPVASDF
SATGIKQLSSALSRPVASDF

SEQ ID NO: 14830 - protein, 20 aa, synthetic construct
  source 1..20: note = Seed: SATGFKQSSKALQRPVASDF
SATGIKQLSSALTRPVASDF

SEQ ID NO: 14831 - protein, 20 aa, synthetic construct
  source 1..20: note = Seed: SATGFKQSSKALQRPVASDF
SATGIKQLSSALVRPVASDF

SEQ ID NO: 14832 - protein, 20 aa, synthetic construct
  source 1..20: note = Seed: SATGFKQSSKALQRPVASDF
SATGIKQLSSALYRPVASDF

SEQ ID NO: 14833 - protein, 20 aa, synthetic construct
  source 1..20: note = Seed: SATGFKQSSKALQRPVASDF
SATGIKQLSTALARPVASDF

SEQ ID NO: 14834 - protein, 20 aa, synthetic construct
  source 1..20: note = Seed: SATGFKQSSKALQRPVASDF
SATGIKQLSTALCRPVASDF

SEQ ID NO: 14835 - protein, 20 aa, synthetic construct
  source 1..20: note = Seed: SATGFKQSSKALQRPVASDF
SATGIKQLSTALFRPVASDF

SEQ ID NO: 14836 - protein, 20 aa, synthetic construct
  source 1..20: note = Seed: SATGFKQSSKALQRPVASDF
SATGIKQLSTALGRPVASDF

SEQ ID NO: 14837 - protein, 20 aa, synthetic construct
  source 1..20: note = Seed: SATGFKQSSKALQRPVASDF
SATGIKQLSTALHRPVASDF

SEQ ID NO: 14838 - protein, 20 aa, synthetic construct
  source 1..20: note = Seed: SATGFKQSSKALQRPVASDF
SATGIKQLSTALIRPVASDF

SEQ ID NO: 14839 - protein, 20 aa, synthetic construct
  source 1..20: note = Seed: SATGFKQSSKALQRPVASDF
SATGIKQLSTALKRPVASDF

SEQ ID NO: 14840 - protein, 20 aa, synthetic construct
  source 1..20: note = Seed: SATGFKQSSKALQRPVASDF
SATGIKQLSTALLRPVASDF

SEQ ID NO: 14841 - protein, 20 aa, synthetic construct
  source 1..20: note = Seed: SATGFKQSSKALQRPVASDF
SATGIKQLSTALMRPVASDF

SEQ ID NO: 14842 - protein, 20 aa, synthetic construct
  source 1..20: note = Seed: SATGFKQSSKALQRPVASDF
SATGIKQLSTALNRPVASDF

SEQ ID NO: 14843 - protein, 20 aa, synthetic construct
  source 1..20: note = Seed: SATGFKQSSKALQRPVASDF
SATGIKQLSTALPRPVASDF

SEQ ID NO: 14844 - protein, 20 aa, synthetic construct
  source 1..20: note = Seed: SATGFKQSSKALQRPVASDF
SATGIKQLSTALQRPVASDF

SEQ ID NO: 14845 - protein, 20 aa, synthetic construct
  source 1..20: note = Seed: SATGFKQSSKALQRPVASDF
SATGIKQLSTALRRPVASDF

SEQ ID NO: 14846 - protein, 20 aa, synthetic construct
  source 1..20: note = Seed: SATGFKQSSKALQRPVASDF
SATGIKQLSTALSRPVASDF

SEQ ID NO: 14847 - protein, 20 aa, synthetic construct
  source 1..20: note = Seed: SATGFKQSSKALQRPVASDF
SATGIKQLSTALTRPVASDF

SEQ ID NO: 14848 - protein, 20 aa, synthetic construct
  source 1..20: note = Seed: SATGFKQSSKALQRPVASDF
SATGIKQLSTALVRPVASDF

SEQ ID NO: 14849 - protein, 20 aa, synthetic construct
  source 1..20: note = Seed: SATGFKQSSKALQRPVASDF
SATGIKQLSVALARPVASDF

SEQ ID NO: 14850 - protein, 20 aa, synthetic construct
  source 1..20: note = Seed: SATGFKQSSKALQRPVASDF
SATGIKQLSVALCRPVASDF

SEQ ID NO: 14851 - protein, 20 aa, synthetic construct
  source 1..20: note = Seed: SATGFKQSSKALQRPVASDF
SATGIKQLSVALDRPVASDF

SEQ ID NO: 14852 - protein, 20 aa, synthetic construct
  source 1..20: note = Seed: SATGFKQSSKALQRPVASDF
SATGIKQLSVALERPVASDF

SEQ ID NO: 14853 - protein, 20 aa, synthetic construct
  source 1..20: note = Seed: SATGFKQSSKALQRPVASDF
SATGIKQLSVALFRPVASDF

SEQ ID NO: 14854 - protein, 20 aa, synthetic construct
  source 1..20: note = Seed: SATGFKQSSKALQRPVASDF
SATGIKQLSVALGRPVASDF

SEQ ID NO: 14855 - protein, 20 aa, synthetic construct
  source 1..20: note = Seed: SATGFKQSSKALQRPVASDF
SATGIKQLSVALHRPVASDF

SEQ ID NO: 14856 - protein, 20 aa, synthetic construct
  source 1..20: note = Seed: SATGFKQSSKALQRPVASDF
SATGIKQLSVALIRPVASDF

SEQ ID NO: 14857 - protein, 20 aa, synthetic construct
  source 1..20: note = Seed: SATGFKQSSKALQRPVASDF
SATGIKQLSVALLRPVASDF

SEQ ID NO: 14858 - protein, 20 aa, synthetic construct
  source 1..20: note = Seed: SATGFKQSSKALQRPVASDF
SATGIKQLSVALMRPVASDF

SEQ ID NO: 14859 - protein, 20 aa, synthetic construct
  source 1..20: note = Seed: SATGFKQSSKALQRPVASDF
SATGIKQLSVALNRPVASDF

SEQ ID NO: 14860 - protein, 20 aa, synthetic construct
  source 1..20: note = Seed: SATGFKQSSKALQRPVASDF
SATGIKQLSVALPRPVASDF

SEQ ID NO: 14861 - protein, 20 aa, synthetic construct
  source 1..20: note = Seed: SATGFKQSSKALQRPVASDF
SATGIKQLSVALQRPVASDF

SEQ ID NO: 14862 - protein, 20 aa, synthetic construct
  source 1..20: note = Seed: SATGFKQSSKALQRPVASDF
SATGIKQLSVALRRPVASDF

SEQ ID NO: 14863 - protein, 20 aa, synthetic construct
  source 1..20: note = Seed: SATGFKQSSKALQRPVASDF
SATGIKQLSVALSRPVASDF

SEQ ID NO: 14864 - protein, 20 aa, synthetic construct
  source 1..20: note = Seed: SATGFKQSSKALQRPVASDF
SATGIKQLSVALTRPVASDF

SEQ ID NO: 14865 - protein, 20 aa, synthetic construct
  source 1..20: note = Seed: SATGFKQSSKALQRPVASDF
SATGIKQLSVALVRPVASDF

SEQ ID NO: 14866 - protein, 20 aa, synthetic construct
  source 1..20: note = Seed: SATGFKQSSKALQRPVASDF
SATGIKQMSAALARPVASDF

SEQ ID NO: 14867 - protein, 20 aa, synthetic construct
  source 1..20: note = Seed: SATGFKQSSKALQRPVASDF
SATGIKQMSAALCRPVASDF

SEQ ID NO: 14868 - protein, 20 aa, synthetic construct
  source 1..20: note = Seed: SATGFKQSSKALQRPVASDF
SATGIKQMSAALDRPVASDF

SEQ ID NO: 14869 - protein, 20 aa, synthetic construct
  source 1..20: note = Seed: SATGFKQSSKALQRPVASDF
SATGIKQMSAALERPVASDF

SEQ ID NO: 14870 - protein, 20 aa, synthetic construct
  source 1..20: note = Seed: SATGFKQSSKALQRPVASDF
SATGIKQMSAALFRPVASDF

SEQ ID NO: 14871 - protein, 20 aa, synthetic construct
  source 1..20: note = Seed: SATGFKQSSKALQRPVASDF
SATGIKQMSAALGRPVASDF

SEQ ID NO: 14872 - protein, 20 aa, synthetic construct
  source 1..20: note = Seed: SATGFKQSSKALQRPVASDF
SATGIKQMSAALHRPVASDF

SEQ ID NO: 14873 - protein, 20 aa, synthetic construct
  source 1..20: note = Seed: SATGFKQSSKALQRPVASDF
SATGIKQMSAALIRPVASDF

SEQ ID NO: 14874 - protein, 20 aa, synthetic construct
  source 1..20: note = Seed: SATGFKQSSKALQRPVASDF
SATGIKQMSAALKRPVASDF

SEQ ID NO: 14875 - protein, 20 aa, synthetic construct
  source 1..20: note = Seed: SATGFKQSSKALQRPVASDF
SATGIKQMSAALLRPVASDF

SEQ ID NO: 14876 - protein, 20 aa, synthetic construct
  source 1..20: note = Seed: SATGFKQSSKALQRPVASDF
SATGIKQMSAALMRPVASDF

SEQ ID NO: 14877 - protein, 20 aa, synthetic construct
  source 1..20: note = Seed: SATGFKQSSKALQRPVASDF
SATGIKQMSAALNRPVASDF

SEQ ID NO: 14878 - protein, 20 aa, synthetic construct
  source 1..20: note = Seed: SATGFKQSSKALQRPVASDF
SATGIKQMSAALPRPVASDF

SEQ ID NO: 14879 - protein, 20 aa, synthetic construct
  source 1..20: note = Seed: SATGFKQSSKALQRPVASDF
SATGIKQMSAALQRPVASDF

SEQ ID NO: 14880 - protein, 20 aa, synthetic construct
  source 1..20: note = Seed: SATGFKQSSKALQRPVASDF
SATGIKQMSAALRRPVASDF

SEQ ID NO: 14881 - protein, 20 aa, synthetic construct
  source 1..20: note = Seed: SATGFKQSSKALQRPVASDF
SATGIKQMSAALSRPVASDF

SEQ ID NO: 14882 - protein, 20 aa, synthetic construct
  source 1..20: note = Seed: SATGFKQSSKALQRPVASDF
SATGIKQMSAALTRPVASDF

SEQ ID NO: 14883 - protein, 20 aa, synthetic construct
  source 1..20: note = Seed: SATGFKQSSKALQRPVASDF
SATGIKQMSAALVRPVASDF

SEQ ID NO: 14884 - protein, 20 aa, synthetic construct
  source 1..20: note = Seed: SATGFKQSSKALQRPVASDF
SATGIKQMSAALWRPVASDF

SEQ ID NO: 14885 - protein, 20 aa, synthetic construct
  source 1..20: note = Seed: SATGFKQSSKALQRPVASDF
SATGIKQMSAALYRPVASDF

SEQ ID NO: 14886 - protein, 20 aa, synthetic construct
  source 1..20: note = Seed: SATGFKQSSKALQRPVASDF
SATGIKQMSCALARPVASDF

SEQ ID NO: 14887 - protein, 20 aa, synthetic construct
  source 1..20: note = Seed: SATGFKQSSKALQRPVASDF
SATGIKQMSCALIRPVASDF

SEQ ID NO: 14888 - protein, 20 aa, synthetic construct
  source 1..20: note = Seed: SATGFKQSSKALQRPVASDF
SATGIKQMSCALLRPVASDF

SEQ ID NO: 14889 - protein, 20 aa, synthetic construct
  source 1..20: note = Seed: SATGFKQSSKALQRPVASDF
SATGIKQMSCALSRPVASDF

SEQ ID NO: 14890 - protein, 20 aa, synthetic construct
  source 1..20: note = Seed: SATGFKQSSKALQRPVASDF
SATGIKQMSCALTRPVASDF

SEQ ID NO: 14891 - protein, 20 aa, synthetic construct
  source 1..20: note = Seed: SATGFKQSSKALQRPVASDF
SATGIKQMSCALVRPVASDF

SEQ ID NO: 14892 - protein, 20 aa, synthetic construct
  source 1..20: note = Seed: SATGFKQSSKALQRPVASDF
SATGIKQMSEALARPVASDF

SEQ ID NO: 14893 - protein, 20 aa, synthetic construct
  source 1..20: note = Seed: SATGFKQSSKALQRPVASDF
SATGIKQMSFALARPVASDF

SEQ ID NO: 14894 - protein, 20 aa, synthetic construct
  source 1..20: note = Seed: SATGFKQSSKALQRPVASDF
SATGIKQMSFALERPVASDF

SEQ ID NO: 14895 - protein, 20 aa, synthetic construct
  source 1..20: note = Seed: SATGFKQSSKALQRPVASDF
SATGIKQMSFALIRPVASDF

SEQ ID NO: 14896 - protein, 20 aa, synthetic construct
  source 1..20: note = Seed: SATGFKQSSKALQRPVASDF
SATGIKQMSFALMRPVASDF

SEQ ID NO: 14897 - protein, 20 aa, synthetic construct
  source 1..20: note = Seed: SATGFKQSSKALQRPVASDF
SATGIKQMSFALVRPVASDF

SEQ ID NO: 14898 - protein, 20 aa, synthetic construct
  source 1..20: note = Seed: SATGFKQSSKALQRPVASDF
SATGIKQMSGALARPVASDF

SEQ ID NO: 14899 - protein, 20 aa, synthetic construct
  source 1..20: note = Seed: SATGFKQSSKALQRPVASDF
SATGIKQMSGALCRPVASDF

SEQ ID NO: 14900 - protein, 20 aa, synthetic construct
  source 1..20: note = Seed: SATGFKQSSKALQRPVASDF
SATGIKQMSGALFRPVASDF

SEQ ID NO: 14901 - protein, 20 aa, synthetic construct
  source 1..20: note = Seed: SATGFKQSSKALQRPVASDF
SATGIKQMSGALGRPVASDF

SEQ ID NO: 14902 - protein, 20 aa, synthetic construct
  source 1..20: note = Seed: SATGFKQSSKALQRPVASDF
SATGIKQMSGALHRPVASDF

SEQ ID NO: 14903 - protein, 20 aa, synthetic construct
  source 1..20: note = Seed: SATGFKQSSKALQRPVASDF
SATGIKQMSGALIRPVASDF

SEQ ID NO: 14904 - protein, 20 aa, synthetic construct
  source 1..20: note = Seed: SATGFKQSSKALQRPVASDF
SATGIKQMSGALLRPVASDF

SEQ ID NO: 14905 - protein, 20 aa, synthetic construct
  source 1..20: note = Seed: SATGFKQSSKALQRPVASDF
SATGIKQMSGALMRPVASDF

SEQ ID NO: 14906 - protein, 20 aa, synthetic construct
  source 1..20: note = Seed: SATGFKQSSKALQRPVASDF
SATGIKQMSGALNRPVASDF

SEQ ID NO: 14907 - protein, 20 aa, synthetic construct
  source 1..20: note = Seed: SATGFKQSSKALQRPVASDF
SATGIKQMSGALPRPVASDF

SEQ ID NO: 14908 - protein, 20 aa, synthetic construct
  source 1..20: note = Seed: SATGFKQSSKALQRPVASDF
SATGIKQMSGALQRPVASDF

SEQ ID NO: 14909 - protein, 20 aa, synthetic construct
  source 1..20: note = Seed: SATGFKQSSKALQRPVASDF
SATGIKQMSGALSRPVASDF

SEQ ID NO: 14910 - protein, 20 aa, synthetic construct
  source 1..20: note = Seed: SATGFKQSSKALQRPVASDF
SATGIKQMSGALTRPVASDF

SEQ ID NO: 14911 - protein, 20 aa, synthetic construct
  source 1..20: note = Seed: SATGFKQSSKALQRPVASDF
SATGIKQMSGALVRPVASDF

SEQ ID NO: 14912 - protein, 20 aa, synthetic construct
  source 1..20: note = Seed: SATGFKQSSKALQRPVASDF
SATGIKQMSGALYRPVASDF

SEQ ID NO: 14913 - protein, 20 aa, synthetic construct
  source 1..20: note = Seed: SATGFKQSSKALQRPVASDF
SATGIKQMSHALARPVASDF

SEQ ID NO: 14914 - protein, 20 aa, synthetic construct
  source 1..20: note = Seed: SATGFKQSSKALQRPVASDF
SATGIKQMSHALGRPVASDF

SEQ ID NO: 14915 - protein, 20 aa, synthetic construct
  source 1..20: note = Seed: SATGFKQSSKALQRPVASDF
SATGIKQMSHALHRPVASDF

SEQ ID NO: 14916 - protein, 20 aa, synthetic construct
  source 1..20: note = Seed: SATGFKQSSKALQRPVASDF
SATGIKQMSHALIRPVASDF

SEQ ID NO: 14917 - protein, 20 aa, synthetic construct
  source 1..20: note = Seed: SATGFKQSSKALQRPVASDF
SATGIKQMSHALKRPVASDF

SEQ ID NO: 14918 - protein, 20 aa, synthetic construct
  source 1..20: note = Seed: SATGFKQSSKALQRPVASDF
SATGIKQMSHALLRPVASDF

SEQ ID NO: 14919 - protein, 20 aa, synthetic construct
  source 1..20: note = Seed: SATGFKQSSKALQRPVASDF
SATGIKQMSHALMRPVASDF

SEQ ID NO: 14920 - protein, 20 aa, synthetic construct
  source 1..20: note = Seed: SATGFKQSSKALQRPVASDF
SATGIKQMSHALNRPVASDF

SEQ ID NO: 14921 - protein, 20 aa, synthetic construct
  source 1..20: note = Seed: SATGFKQSSKALQRPVASDF
SATGIKQMSHALQRPVASDF

SEQ ID NO: 14922 - protein, 20 aa, synthetic construct
  source 1..20: note = Seed: SATGFKQSSKALQRPVASDF
SATGIKQMSHALRRPVASDF

SEQ ID NO: 14923 - protein, 20 aa, synthetic construct
  source 1..20: note = Seed: SATGFKQSSKALQRPVASDF
SATGIKQMSHALSRPVASDF

SEQ ID NO: 14924 - protein, 20 aa, synthetic construct
  source 1..20: note = Seed: SATGFKQSSKALQRPVASDF
SATGIKQMSHALTRPVASDF

SEQ ID NO: 14925 - protein, 20 aa, synthetic construct
  source 1..20: note = Seed: SATGFKQSSKALQRPVASDF
SATGIKQMSHALVRPVASDF

SEQ ID NO: 14926 - protein, 20 aa, synthetic construct
  source 1..20: note = Seed: SATGFKQSSKALQRPVASDF
SATGIKQMSIALARPVASDF

SEQ ID NO: 14927 - protein, 20 aa, synthetic construct
  source 1..20: note = Seed: SATGFKQSSKALQRPVASDF
SATGIKQMSIALCRPVASDF

SEQ ID NO: 14928 - protein, 20 aa, synthetic construct
  source 1..20: note = Seed: SATGFKQSSKALQRPVASDF
SATGIKQMSIALDRPVASDF

SEQ ID NO: 14929 - protein, 20 aa, synthetic construct
  source 1..20: note = Seed: SATGFKQSSKALQRPVASDF
SATGIKQMSIALERPVASDF

SEQ ID NO: 14930 - protein, 20 aa, synthetic construct
  source 1..20: note = Seed: SATGFKQSSKALQRPVASDF
SATGIKQMSIALGRPVASDF

SEQ ID NO: 14931 - protein, 20 aa, synthetic construct
  source 1..20: note = Seed: SATGFKQSSKALQRPVASDF
SATGIKQMSIALHRPVASDF

SEQ ID NO: 14932 - protein, 20 aa, synthetic construct
  source 1..20: note = Seed: SATGFKQSSKALQRPVASDF
SATGIKQMSIALIRPVASDF

SEQ ID NO: 14933 - protein, 20 aa, synthetic construct
  source 1..20: note = Seed: SATGFKQSSKALQRPVASDF
SATGIKQMSIALKRPVASDF

SEQ ID NO: 14934 - protein, 20 aa, synthetic construct
  source 1..20: note = Seed: SATGFKQSSKALQRPVASDF
SATGIKQMSIALMRPVASDF

SEQ ID NO: 14935 - protein, 20 aa, synthetic construct
  source 1..20: note = Seed: SATGFKQSSKALQRPVASDF
SATGIKQMSIALNRPVASDF

SEQ ID NO: 14936 - protein, 20 aa, synthetic construct
  source 1..20: note = Seed: SATGFKQSSKALQRPVASDF
SATGIKQMSIALPRPVASDF

SEQ ID NO: 14937 - protein, 20 aa, synthetic construct
  source 1..20: note = Seed: SATGFKQSSKALQRPVASDF
SATGIKQMSIALQRPVASDF

SEQ ID NO: 14938 - protein, 20 aa, synthetic construct
  source 1..20: note = Seed: SATGFKQSSKALQRPVASDF
SATGIKQMSIALRRPVASDF

SEQ ID NO: 14939 - protein, 20 aa, synthetic construct
  source 1..20: note = Seed: SATGFKQSSKALQRPVASDF
SATGIKQMSIALSRPVASDF

SEQ ID NO: 14940 - protein, 20 aa, synthetic construct
  source 1..20: note = Seed: SATGFKQSSKALQRPVASDF
SATGIKQMSIALTRPVASDF

SEQ ID NO: 14941 - protein, 20 aa, synthetic construct
  source 1..20: note = Seed: SATGFKQSSKALQRPVASDF
SATGIKQMSIALVRPVASDF

SEQ ID NO: 14942 - protein, 20 aa, synthetic construct
  source 1..20: note = Seed: SATGFKQSSKALQRPVASDF
SATGIKQMSIALYRPVASDF

SEQ ID NO: 14943 - protein, 20 aa, synthetic construct
  source 1..20: note = Seed: SATGFKQSSKALQRPVASDF
SATGIKQMSKALARPVASDF

SEQ ID NO: 14944 - protein, 20 aa, synthetic construct
  source 1..20: note = Seed: SATGFKQSSKALQRPVASDF
SATGIKQMSKALCRPVASDF

SEQ ID NO: 14945 - protein, 20 aa, synthetic construct
  source 1..20: note = Seed: SATGFKQSSKALQRPVASDF
SATGIKQMSKALERPVASDF

SEQ ID NO: 14946 - protein, 20 aa, synthetic construct
  source 1..20: note = Seed: SATGFKQSSKALQRPVASDF
SATGIKQMSKALFRPVASDF

SEQ ID NO: 14947 - protein, 20 aa, synthetic construct
  source 1..20: note = Seed: SATGFKQSSKALQRPVASDF
SATGIKQMSKALGRPVASDF

SEQ ID NO: 14948 - protein, 20 aa, synthetic construct
  source 1..20: note = Seed: SATGFKQSSKALQRPVASDF
SATGIKQMSKALHRPVASDF

SEQ ID NO: 14949 - protein, 20 aa, synthetic construct
  source 1..20: note = Seed: SATGFKQSSKALQRPVASDF
SATGIKQMSKALIRPVASDF

SEQ ID NO: 14950 - protein, 20 aa, synthetic construct
  source 1..20: note = Seed: SATGFKQSSKALQRPVASDF
SATGIKQMSKALKRPVASDF

SEQ ID NO: 14951 - protein, 20 aa, synthetic construct
  source 1..20: note = Seed: SATGFKQSSKALQRPVASDF
SATGIKQMSKALLRPVASDF

SEQ ID NO: 14952 - protein, 20 aa, synthetic construct
  source 1..20: note = Seed: SATGFKQSSKALQRPVASDF
SATGIKQMSKALMRPVASDF

SEQ ID NO: 14953 - protein, 20 aa, synthetic construct
  source 1..20: note = Seed: SATGFKQSSKALQRPVASDF
SATGIKQMSKALNRPVASDF

SEQ ID NO: 14954 - protein, 20 aa, synthetic construct
  source 1..20: note = Seed: SATGFKQSSKALQRPVASDF
SATGIKQMSKALPRPVASDF

SEQ ID NO: 14955 - protein, 20 aa, synthetic construct
  source 1..20: note = Seed: SATGFKQSSKALQRPVASDF
SATGIKQMSKALQRPVASDF

SEQ ID NO: 14956 - protein, 20 aa, synthetic construct
  source 1..20: note = Seed: SATGFKQSSKALQRPVASDF
SATGIKQMSKALRRPVASDF

SEQ ID NO: 14957 - protein, 20 aa, synthetic construct
  source 1..20: note = Seed: SATGFKQSSKALQRPVASDF
SATGIKQMSKALSRPVASDF

SEQ ID NO: 14958 - protein, 20 aa, synthetic construct
  source 1..20: note = Seed: SATGFKQSSKALQRPVASDF
SATGIKQMSKALTRPVASDF

SEQ ID NO: 14959 - protein, 20 aa, synthetic construct
  source 1..20: note = Seed: SATGFKQSSKALQRPVASDF
SATGIKQMSKALVRPVASDF

SEQ ID NO: 14960 - protein, 20 aa, synthetic construct
  source 1..20: note = Seed: SATGFKQSSKALQRPVASDF
SATGIKQMSKALWRPVASDF

SEQ ID NO: 14961 - protein, 20 aa, synthetic construct
  source 1..20: note = Seed: SATGFKQSSKALQRPVASDF
SATGIKQMSKALYRPVASDF

SEQ ID NO: 14962 - protein, 20 aa, synthetic construct
  source 1..20: note = Seed: SATGFKQSSKALQRPVASDF
SATGIKQMSLALARPVASDF

SEQ ID NO: 14963 - protein, 20 aa, synthetic construct
  source 1..20: note = Seed: SATGFKQSSKALQRPVASDF
SATGIKQMSLALCRPVASDF

SEQ ID NO: 14964 - protein, 20 aa, synthetic construct
  source 1..20: note = Seed: SATGFKQSSKALQRPVASDF
SATGIKQMSLALGRPVASDF

SEQ ID NO: 14965 - protein, 20 aa, synthetic construct
  source 1..20: note = Seed: SATGFKQSSKALQRPVASDF
SATGIKQMSLALHRPVASDF

SEQ ID NO: 14966 - protein, 20 aa, synthetic construct
  source 1..20: note = Seed: SATGFKQSSKALQRPVASDF
SATGIKQMSLALIRPVASDF

SEQ ID NO: 14967 - protein, 20 aa, synthetic construct
  source 1..20: note = Seed: SATGFKQSSKALQRPVASDF
SATGIKQMSLALKRPVASDF

SEQ ID NO: 14968 - protein, 20 aa, synthetic construct
  source 1..20: note = Seed: SATGFKQSSKALQRPVASDF
SATGIKQMSLALLRPVASDF

SEQ ID NO: 14969 - protein, 20 aa, synthetic construct
  source 1..20: note = Seed: SATGFKQSSKALQRPVASDF
SATGIKQMSLALMRPVASDF

SEQ ID NO: 14970 - protein, 20 aa, synthetic construct
  source 1..20: note = Seed: SATGFKQSSKALQRPVASDF
SATGIKQMSLALNRPVASDF

SEQ ID NO: 14971 - protein, 20 aa, synthetic construct
  source 1..20: note = Seed: SATGFKQSSKALQRPVASDF
SATGIKQMSLALRRPVASDF

SEQ ID NO: 14972 - protein, 20 aa, synthetic construct
  source 1..20: note = Seed: SATGFKQSSKALQRPVASDF
SATGIKQMSLALSRPVASDF

SEQ ID NO: 14973 - protein, 20 aa, synthetic construct
  source 1..20: note = Seed: SATGFKQSSKALQRPVASDF
SATGIKQMSLALTRPVASDF

SEQ ID NO: 14974 - protein, 20 aa, synthetic construct
  source 1..20: note = Seed: SATGFKQSSKALQRPVASDF
SATGIKQMSLALVRPVASDF

SEQ ID NO: 14975 - protein, 20 aa, synthetic construct
  source 1..20: note = Seed: SATGFKQSSKALQRPVASDF
SATGIKQMSLALYRPVASDF

SEQ ID NO: 14976 - protein, 20 aa, synthetic construct
  source 1..20: note = Seed: SATGFKQSSKALQRPVASDF
SATGIKQMSMALARPVASDF

SEQ ID NO: 14977 - protein, 20 aa, synthetic construct
  source 1..20: note = Seed: SATGFKQSSKALQRPVASDF
SATGIKQMSMALCRPVASDF

SEQ ID NO: 14978 - protein, 20 aa, synthetic construct
  source 1..20: note = Seed: SATGFKQSSKALQRPVASDF
SATGIKQMSMALGRPVASDF

SEQ ID NO: 14979 - protein, 20 aa, synthetic construct
  source 1..20: note = Seed: SATGFKQSSKALQRPVASDF
SATGIKQMSMALHRPVASDF

SEQ ID NO: 14980 - protein, 20 aa, synthetic construct
  source 1..20: note = Seed: SATGFKQSSKALQRPVASDF
SATGIKQMSMALIRPVASDF

SEQ ID NO: 14981 - protein, 20 aa, synthetic construct
  source 1..20: note = Seed: SATGFKQSSKALQRPVASDF
SATGIKQMSMALMRPVASDF

SEQ ID NO: 14982 - protein, 20 aa, synthetic construct
  source 1..20: note = Seed: SATGFKQSSKALQRPVASDF
SATGIKQMSMALNRPVASDF

SEQ ID NO: 14983 - protein, 20 aa, synthetic construct
  source 1..20: note = Seed: SATGFKQSSKALQRPVASDF
SATGIKQMSMALRRPVASDF

SEQ ID NO: 14984 - protein, 20 aa, synthetic construct
  source 1..20: note = Seed: SATGFKQSSKALQRPVASDF
SATGIKQMSMALSRPVASDF

SEQ ID NO: 14985 - protein, 20 aa, synthetic construct
  source 1..20: note = Seed: SATGFKQSSKALQRPVASDF
SATGIKQMSMALYRPVASDF

SEQ ID NO: 14986 - protein, 20 aa, synthetic construct
  source 1..20: note = Seed: SATGFKQSSKALQRPVASDF
SATGIKQMSNALARPVASDF

SEQ ID NO: 14987 - protein, 20 aa, synthetic construct
  source 1..20: note = Seed: SATGFKQSSKALQRPVASDF
SATGIKQMSNALCRPVASDF

SEQ ID NO: 14988 - protein, 20 aa, synthetic construct
  source 1..20: note = Seed: SATGFKQSSKALQRPVASDF
SATGIKQMSNALFRPVASDF

SEQ ID NO: 14989 - protein, 20 aa, synthetic construct
  source 1..20: note = Seed: SATGFKQSSKALQRPVASDF
SATGIKQMSNALGRPVASDF

SEQ ID NO: 14990 - protein, 20 aa, synthetic construct
  source 1..20: note = Seed: SATGFKQSSKALQRPVASDF
SATGIKQMSNALIRPVASDF

SEQ ID NO: 14991 - protein, 20 aa, synthetic construct
  source 1..20: note = Seed: SATGFKQSSKALQRPVASDF
SATGIKQMSNALKRPVASDF

SEQ ID NO: 14992 - protein, 20 aa, synthetic construct
  source 1..20: note = Seed: SATGFKQSSKALQRPVASDF
SATGIKQMSNALLRPVASDF

SEQ ID NO: 14993 - protein, 20 aa, synthetic construct
  source 1..20: note = Seed: SATGFKQSSKALQRPVASDF
SATGIKQMSNALMRPVASDF

SEQ ID NO: 14994 - protein, 20 aa, synthetic construct
  source 1..20: note = Seed: SATGFKQSSKALQRPVASDF
SATGIKQMSNALNRPVASDF

SEQ ID NO: 14995 - protein, 20 aa, synthetic construct
  source 1..20: note = Seed: SATGFKQSSKALQRPVASDF
SATGIKQMSNALRRPVASDF

SEQ ID NO: 14996 - protein, 20 aa, synthetic construct
  source 1..20: note = Seed: SATGFKQSSKALQRPVASDF
SATGIKQMSNALSRPVASDF

SEQ ID NO: 14997 - protein, 20 aa, synthetic construct
  source 1..20: note = Seed: SATGFKQSSKALQRPVASDF
SATGIKQMSNALTRPVASDF

SEQ ID NO: 14998 - protein, 20 aa, synthetic construct
  source 1..20: note = Seed: SATGFKQSSKALQRPVASDF
SATGIKQMSNALVRPVASDF

SEQ ID NO: 14999 - protein, 20 aa, synthetic construct
  source 1..20: note = Seed: SATGFKQSSKALQRPVASDF
SATGIKQMSPALARPVASDF

SEQ ID NO: 15000 - protein, 20 aa, synthetic construct
  source 1..20: note = Seed: SATGFKQSSKALQRPVASDF
SATGIKQMSPALCRPVASDF

SEQ ID NO: 15001 - protein, 20 aa, synthetic construct
  source 1..20: note = Seed: SATGFKQSSKALQRPVASDF
SATGIKQMSPALDRPVASDF

SEQ ID NO: 15002 - protein, 20 aa, synthetic construct
  source 1..20: note = Seed: SATGFKQSSKALQRPVASDF
SATGIKQMSPALERPVASDF

SEQ ID NO: 15003 - protein, 20 aa, synthetic construct
  source 1..20: note = Seed: SATGFKQSSKALQRPVASDF
SATGIKQMSPALFRPVASDF

SEQ ID NO: 15004 - protein, 20 aa, synthetic construct
  source 1..20: note = Seed: SATGFKQSSKALQRPVASDF
SATGIKQMSPALGRPVASDF

SEQ ID NO: 15005 - protein, 20 aa, synthetic construct
  source 1..20: note = Seed: SATGFKQSSKALQRPVASDF
SATGIKQMSPALHRPVASDF

SEQ ID NO: 15006 - protein, 20 aa, synthetic construct
  source 1..20: note = Seed: SATGFKQSSKALQRPVASDF
SATGIKQMSPALIRPVASDF

SEQ ID NO: 15007 - protein, 20 aa, synthetic construct
  source 1..20: note = Seed: SATGFKQSSKALQRPVASDF
SATGIKQMSPALKRPVASDF

SEQ ID NO: 15008 - protein, 20 aa, synthetic construct
  source 1..20: note = Seed: SATGFKQSSKALQRPVASDF
SATGIKQMSPALLRPVASDF

SEQ ID NO: 15009 - protein, 20 aa, synthetic construct
  source 1..20: note = Seed: SATGFKQSSKALQRPVASDF
SATGIKQMSPALMRPVASDF

SEQ ID NO: 15010 - protein, 20 aa, synthetic construct
  source 1..20: note = Seed: SATGFKQSSKALQRPVASDF
SATGIKQMSPALNRPVASDF

SEQ ID NO: 15011 - protein, 20 aa, synthetic construct
  source 1..20: note = Seed: SATGFKQSSKALQRPVASDF
SATGIKQMSPALPRPVASDF

SEQ ID NO: 15012 - protein, 20 aa, synthetic construct
  source 1..20: note = Seed: SATGFKQSSKALQRPVASDF
SATGIKQMSPALQRPVASDF

SEQ ID NO: 15013 - protein, 20 aa, synthetic construct
  source 1..20: note = Seed: SATGFKQSSKALQRPVASDF
SATGIKQMSPALRRPVASDF

SEQ ID NO: 15014 - protein, 20 aa, synthetic construct
  source 1..20: note = Seed: SATGFKQSSKALQRPVASDF
SATGIKQMSPALSRPVASDF

SEQ ID NO: 15015 - protein, 20 aa, synthetic construct
  source 1..20: note = Seed: SATGFKQSSKALQRPVASDF
SATGIKQMSPALTRPVASDF

SEQ ID NO: 15016 - protein, 20 aa, synthetic construct
  source 1..20: note = Seed: SATGFKQSSKALQRPVASDF
SATGIKQMSPALVRPVASDF

SEQ ID NO: 15017 - protein, 20 aa, synthetic construct
  source 1..20: note = Seed: SATGFKQSSKALQRPVASDF
SATGIKQMSPALWRPVASDF

SEQ ID NO: 15018 - protein, 20 aa, synthetic construct
  source 1..20: note = Seed: SATGFKQSSKALQRPVASDF
SATGIKQMSPALYRPVASDF

SEQ ID NO: 15019 - protein, 20 aa, synthetic construct
  source 1..20: note = Seed: SATGFKQSSKALQRPVASDF
SATGIKQMSQALARPVASDF

SEQ ID NO: 15020 - protein, 20 aa, synthetic construct
  source 1..20: note = Seed: SATGFKQSSKALQRPVASDF
SATGIKQMSQALIRPVASDF

SEQ ID NO: 15021 - protein, 20 aa, synthetic construct
  source 1..20: note = Seed: SATGFKQSSKALQRPVASDF
SATGIKQMSQALKRPVASDF

SEQ ID NO: 15022 - protein, 20 aa, synthetic construct
  source 1..20: note = Seed: SATGFKQSSKALQRPVASDF
SATGIKQMSQALLRPVASDF

SEQ ID NO: 15023 - protein, 20 aa, synthetic construct
  source 1..20: note = Seed: SATGFKQSSKALQRPVASDF
SATGIKQMSQALRRPVASDF

SEQ ID NO: 15024 - protein, 20 aa, synthetic construct
  source 1..20: note = Seed: SATGFKQSSKALQRPVASDF
SATGIKQMSQALSRPVASDF

SEQ ID NO: 15025 - protein, 20 aa, synthetic construct
  source 1..20: note = Seed: SATGFKQSSKALQRPVASDF
SATGIKQMSQALVRPVASDF

SEQ ID NO: 15026 - protein, 20 aa, synthetic construct
  source 1..20: note = Seed: SATGFKQSSKALQRPVASDF
SATGIKQMSRALARPVASDF

SEQ ID NO: 15027 - protein, 20 aa, synthetic construct
  source 1..20: note = Seed: SATGFKQSSKALQRPVASDF
SATGIKQMSRALCRPVASDF

SEQ ID NO: 15028 - protein, 20 aa, synthetic construct
  source 1..20: note = Seed: SATGFKQSSKALQRPVASDF
SATGIKQMSRALDRPVASDF

SEQ ID NO: 15029 - protein, 20 aa, synthetic construct
  source 1..20: note = Seed: SATGFKQSSKALQRPVASDF
SATGIKQMSRALERPVASDF

SEQ ID NO: 15030 - protein, 20 aa, synthetic construct
  source 1..20: note = Seed: SATGFKQSSKALQRPVASDF
SATGIKQMSRALFRPVASDF

SEQ ID NO: 15031 - protein, 20 aa, synthetic construct
  source 1..20: note = Seed: SATGFKQSSKALQRPVASDF
SATGIKQMSRALGRPVASDF

SEQ ID NO: 15032 - protein, 20 aa, synthetic construct
  source 1..20: note = Seed: SATGFKQSSKALQRPVASDF
SATGIKQMSRALHRPVASDF

SEQ ID NO: 15033 - protein, 20 aa, synthetic construct
  source 1..20: note = Seed: SATGFKQSSKALQRPVASDF
SATGIKQMSRALIRPVASDF

SEQ ID NO: 15034 - protein, 20 aa, synthetic construct
  source 1..20: note = Seed: SATGFKQSSKALQRPVASDF
SATGIKQMSRALKRPVASDF

SEQ ID NO: 15035 - protein, 20 aa, synthetic construct
  source 1..20: note = Seed: SATGFKQSSKALQRPVASDF
SATGIKQMSRALLRPVASDF

SEQ ID NO: 15036 - protein, 20 aa, synthetic construct
  source 1..20: note = Seed: SATGFKQSSKALQRPVASDF
SATGIKQMSRALMRPVASDF

SEQ ID NO: 15037 - protein, 20 aa, synthetic construct
  source 1..20: note = Seed: SATGFKQSSKALQRPVASDF
SATGIKQMSRALNRPVASDF

SEQ ID NO: 15038 - protein, 20 aa, synthetic construct
  source 1..20: note = Seed: SATGFKQSSKALQRPVASDF
SATGIKQMSRALPRPVASDF

SEQ ID NO: 15039 - protein, 20 aa, synthetic construct
  source 1..20: note = Seed: SATGFKQSSKALQRPVASDF
SATGIKQMSRALQRPVASDF

SEQ ID NO: 15040 - protein, 20 aa, synthetic construct
  source 1..20: note = Seed: SATGFKQSSKALQRPVASDF
SATGIKQMSRALRRPVASDF

SEQ ID NO: 15041 - protein, 20 aa, synthetic construct
  source 1..20: note = Seed: SATGFKQSSKALQRPVASDF
SATGIKQMSRALSRPVASDF

SEQ ID NO: 15042 - protein, 20 aa, synthetic construct
  source 1..20: note = Seed: SATGFKQSSKALQRPVASDF
SATGIKQMSRALTRPVASDF

SEQ ID NO: 15043 - protein, 20 aa, synthetic construct
  source 1..20: note = Seed: SATGFKQSSKALQRPVASDF
SATGIKQMSRALVRPVASDF

SEQ ID NO: 15044 - protein, 20 aa, synthetic construct
  source 1..20: note = Seed: SATGFKQSSKALQRPVASDF
SATGIKQMSRALWRPVASDF

SEQ ID NO: 15045 - protein, 20 aa, synthetic construct
  source 1..20: note = Seed: SATGFKQSSKALQRPVASDF
SATGIKQMSRALYRPVASDF

SEQ ID NO: 15046 - protein, 20 aa, synthetic construct
  source 1..20: note = Seed: SATGFKQSSKALQRPVASDF
SATGIKQMSSALARPVASDF

SEQ ID NO: 15047 - protein, 20 aa, synthetic construct
  source 1..20: note = Seed: SATGFKQSSKALQRPVASDF
SATGIKQMSSALCRPVASDF

SEQ ID NO: 15048 - protein, 20 aa, synthetic construct
  source 1..20: note = Seed: SATGFKQSSKALQRPVASDF
SATGIKQMSSALDRPVASDF

SEQ ID NO: 15049 - protein, 20 aa, synthetic construct
  source 1..20: note = Seed: SATGFKQSSKALQRPVASDF
SATGIKQMSSALFRPVASDF

SEQ ID NO: 15050 - protein, 20 aa, synthetic construct
  source 1..20: note = Seed: SATGFKQSSKALQRPVASDF
SATGIKQMSSALGRPVASDF

SEQ ID NO: 15051 - protein, 20 aa, synthetic construct
  source 1..20: note = Seed: SATGFKQSSKALQRPVASDF
SATGIKQMSSALHRPVASDF

SEQ ID NO: 15052 - protein, 20 aa, synthetic construct
  source 1..20: note = Seed: SATGFKQSSKALQRPVASDF
SATGIKQMSSALIRPVASDF

SEQ ID NO: 15053 - protein, 20 aa, synthetic construct
  source 1..20: note = Seed: SATGFKQSSKALQRPVASDF
SATGIKQMSSALKRPVASDF

SEQ ID NO: 15054 - protein, 20 aa, synthetic construct
  source 1..20: note = Seed: SATGFKQSSKALQRPVASDF
SATGIKQMSSALLRPVASDF

SEQ ID NO: 15055 - protein, 20 aa, synthetic construct
  source 1..20: note = Seed: SATGFKQSSKALQRPVASDF
SATGIKQMSSALMRPVASDF

SEQ ID NO: 15056 - protein, 20 aa, synthetic construct
  source 1..20: note = Seed: SATGFKQSSKALQRPVASDF
SATGIKQMSSALNRPVASDF

SEQ ID NO: 15057 - protein, 20 aa, synthetic construct
  source 1..20: note = Seed: SATGFKQSSKALQRPVASDF
SATGIKQMSSALPRPVASDF

SEQ ID NO: 15058 - protein, 20 aa, synthetic construct
  source 1..20: note = Seed: SATGFKQSSKALQRPVASDF
SATGIKQMSSALQRPVASDF

SEQ ID NO: 15059 - protein, 20 aa, synthetic construct
  source 1..20: note = Seed: SATGFKQSSKALQRPVASDF
SATGIKQMSSALRRPVASDF

SEQ ID NO: 15060 - protein, 20 aa, synthetic construct
  source 1..20: note = Seed: SATGFKQSSKALQRPVASDF
SATGIKQMSSALSRPVASDF

SEQ ID NO: 15061 - protein, 20 aa, synthetic construct
  source 1..20: note = Seed: SATGFKQSSKALQRPVASDF
SATGIKQMSSALTRPVASDF

SEQ ID NO: 15062 - protein, 20 aa, synthetic construct
  source 1..20: note = Seed: SATGFKQSSKALQRPVASDF
SATGIKQMSSALVRPVASDF

SEQ ID NO: 15063 - protein, 20 aa, synthetic construct
  source 1..20: note = Seed: SATGFKQSSKALQRPVASDF
SATGIKQMSSALYRPVASDF

SEQ ID NO: 15064 - protein, 20 aa, synthetic construct
  source 1..20: note = Seed: SATGFKQSSKALQRPVASDF
SATGIKQMSTALARPVASDF

SEQ ID NO: 15065 - protein, 20 aa, synthetic construct
  source 1..20: note = Seed: SATGFKQSSKALQRPVASDF
SATGIKQMSTALCRPVASDF

SEQ ID NO: 15066 - protein, 20 aa, synthetic construct
  source 1..20: note = Seed: SATGFKQSSKALQRPVASDF
SATGIKQMSTALDRPVASDF

SEQ ID NO: 15067 - protein, 20 aa, synthetic construct
  source 1..20: note = Seed: SATGFKQSSKALQRPVASDF
SATGIKQMSTALFRPVASDF

SEQ ID NO: 15068 - protein, 20 aa, synthetic construct
  source 1..20: note = Seed: SATGFKQSSKALQRPVASDF
SATGIKQMSTALGRPVASDF

SEQ ID NO: 15069 - protein, 20 aa, synthetic construct
  source 1..20: note = Seed: SATGFKQSSKALQRPVASDF
SATGIKQMSTALHRPVASDF

SEQ ID NO: 15070 - protein, 20 aa, synthetic construct
  source 1..20: note = Seed: SATGFKQSSKALQRPVASDF
SATGIKQMSTALIRPVASDF

SEQ ID NO: 15071 - protein, 20 aa, synthetic construct
  source 1..20: note = Seed: SATGFKQSSKALQRPVASDF
SATGIKQMSTALKRPVASDF

SEQ ID NO: 15072 - protein, 20 aa, synthetic construct
  source 1..20: note = Seed: SATGFKQSSKALQRPVASDF
SATGIKQMSTALLRPVASDF

SEQ ID NO: 15073 - protein, 20 aa, synthetic construct
  source 1..20: note = Seed: SATGFKQSSKALQRPVASDF
SATGIKQMSTALMRPVASDF

SEQ ID NO: 15074 - protein, 20 aa, synthetic construct
  source 1..20: note = Seed: SATGFKQSSKALQRPVASDF
SATGIKQMSTALNRPVASDF

SEQ ID NO: 15075 - protein, 20 aa, synthetic construct
  source 1..20: note = Seed: SATGFKQSSKALQRPVASDF
SATGIKQMSTALPRPVASDF

SEQ ID NO: 15076 - protein, 20 aa, synthetic construct
  source 1..20: note = Seed: SATGFKQSSKALQRPVASDF
SATGIKQMSTALQRPVASDF

SEQ ID NO: 15077 - protein, 20 aa, synthetic construct
  source 1..20: note = Seed: SATGFKQSSKALQRPVASDF
SATGIKQMSTALRRPVASDF

SEQ ID NO: 15078 - protein, 20 aa, synthetic construct
  source 1..20: note = Seed: SATGFKQSSKALQRPVASDF
SATGIKQMSTALSRPVASDF

SEQ ID NO: 15079 - protein, 20 aa, synthetic construct
  source 1..20: note = Seed: SATGFKQSSKALQRPVASDF
SATGIKQMSTALTRPVASDF

SEQ ID NO: 15080 - protein, 20 aa, synthetic construct
  source 1..20: note = Seed: SATGFKQSSKALQRPVASDF
SATGIKQMSTALVRPVASDF

SEQ ID NO: 15081 - protein, 20 aa, synthetic construct
  source 1..20: note = Seed: SATGFKQSSKALQRPVASDF
SATGIKQMSTALYRPVASDF

SEQ ID NO: 15082 - protein, 20 aa, synthetic construct
  source 1..20: note = Seed: SATGFKQSSKALQRPVASDF
SATGIKQMSVALARPVASDF

SEQ ID NO: 15083 - protein, 20 aa, synthetic construct
  source 1..20: note = Seed: SATGFKQSSKALQRPVASDF
SATGIKQMSVALCRPVASDF

SEQ ID NO: 15084 - protein, 20 aa, synthetic construct
  source 1..20: note = Seed: SATGFKQSSKALQRPVASDF
SATGIKQMSVALDRPVASDF

SEQ ID NO: 15085 - protein, 20 aa, synthetic construct
  source 1..20: note = Seed: SATGFKQSSKALQRPVASDF
SATGIKQMSVALERPVASDF

SEQ ID NO: 15086 - protein, 20 aa, synthetic construct
  source 1..20: note = Seed: SATGFKQSSKALQRPVASDF
SATGIKQMSVALFRPVASDF

SEQ ID NO: 15087 - protein, 20 aa, synthetic construct
  source 1..20: note = Seed: SATGFKQSSKALQRPVASDF
SATGIKQMSVALGRPVASDF

SEQ ID NO: 15088 - protein, 20 aa, synthetic construct
  source 1..20: note = Seed: SATGFKQSSKALQRPVASDF
SATGIKQMSVALHRPVASDF

SEQ ID NO: 15089 - protein, 20 aa, synthetic construct
  source 1..20: note = Seed: SATGFKQSSKALQRPVASDF
SATGIKQMSVALIRPVASDF

SEQ ID NO: 15090 - protein, 20 aa, synthetic construct
  source 1..20: note = Seed: SATGFKQSSKALQRPVASDF
SATGIKQMSVALKRPVASDF

SEQ ID NO: 15091 - protein, 20 aa, synthetic construct
  source 1..20: note = Seed: SATGFKQSSKALQRPVASDF
SATGIKQMSVALLRPVASDF

SEQ ID NO: 15092 - protein, 20 aa, synthetic construct
  source 1..20: note = Seed: SATGFKQSSKALQRPVASDF
SATGIKQMSVALMRPVASDF

SEQ ID NO: 15093 - protein, 20 aa, synthetic construct
  source 1..20: note = Seed: SATGFKQSSKALQRPVASDF
SATGIKQMSVALNRPVASDF

SEQ ID NO: 15094 - protein, 20 aa, synthetic construct
  source 1..20: note = Seed: SATGFKQSSKALQRPVASDF
SATGIKQMSVALPRPVASDF

SEQ ID NO: 15095 - protein, 20 aa, synthetic construct
  source 1..20: note = Seed: SATGFKQSSKALQRPVASDF
SATGIKQMSVALQRPVASDF

SEQ ID NO: 15096 - protein, 20 aa, synthetic construct
  source 1..20: note = Seed: SATGFKQSSKALQRPVASDF
SATGIKQMSVALRRPVASDF

SEQ ID NO: 15097 - protein, 20 aa, synthetic construct
  source 1..20: note = Seed: SATGFKQSSKALQRPVASDF
SATGIKQMSVALSRPVASDF

SEQ ID NO: 15098 - protein, 20 aa, synthetic construct
  source 1..20: note = Seed: SATGFKQSSKALQRPVASDF
SATGIKQMSVALTRPVASDF

SEQ ID NO: 15099 - protein, 20 aa, synthetic construct
  source 1..20: note = Seed: SATGFKQSSKALQRPVASDF
SATGIKQMSVALVRPVASDF

SEQ ID NO: 15100 - protein, 20 aa, synthetic construct
  source 1..20: note = Seed: SATGFKQSSKALQRPVASDF
SATGIKQMSVALYRPVASDF

SEQ ID NO: 15101 - protein, 20 aa, synthetic construct
  source 1..20: note = Seed: SATGFKQSSKALQRPVASDF
SATGIKQNSAALARPVASDF

SEQ ID NO: 15102 - protein, 20 aa, synthetic construct
  source 1..20: note = Seed: SATGFKQSSKALQRPVASDF
SATGIKQNSAALIRPVASDF

SEQ ID NO: 15103 - protein, 20 aa, synthetic construct
  source 1..20: note = Seed: SATGFKQSSKALQRPVASDF
SATGIKQNSAALLRPVASDF

SEQ ID NO: 15104 - protein, 20 aa, synthetic construct
  source 1..20: note = Seed: SATGFKQSSKALQRPVASDF
SATGIKQNSAALVRPVASDF

SEQ ID NO: 15105 - protein, 20 aa, synthetic construct
  source 1..20: note = Seed: SATGFKQSSKALQRPVASDF
SATGIKQNSAALYRPVASDF

SEQ ID NO: 15106 - protein, 20 aa, synthetic construct
  source 1..20: note = Seed: SATGFKQSSKALQRPVASDF
SATGIKQNSFALIRPVASDF

SEQ ID NO: 15107 - protein, 20 aa, synthetic construct
  source 1..20: note = Seed: SATGFKQSSKALQRPVASDF
SATGIKQNSFALVRPVASDF

SEQ ID NO: 15108 - protein, 20 aa, synthetic construct
  source 1..20: note = Seed: SATGFKQSSKALQRPVASDF
SATGIKQNSGALIRPVASDF

SEQ ID NO: 15109 - protein, 20 aa, synthetic construct
  source 1..20: note = Seed: SATGFKQSSKALQRPVASDF
SATGIKQNSGALLRPVASDF

SEQ ID NO: 15110 - protein, 20 aa, synthetic construct
  source 1..20: note = Seed: SATGFKQSSKALQRPVASDF
SATGIKQNSGALVRPVASDF

SEQ ID NO: 15111 - protein, 20 aa, synthetic construct
  source 1..20: note = Seed: SATGFKQSSKALQRPVASDF
SATGIKQNSIALARPVASDF

SEQ ID NO: 15112 - protein, 20 aa, synthetic construct
  source 1..20: note = Seed: SATGFKQSSKALQRPVASDF
SATGIKQNSIALIRPVASDF

SEQ ID NO: 15113 - protein, 20 aa, synthetic construct
  source 1..20: note = Seed: SATGFKQSSKALQRPVASDF
SATGIKQNSIALRRPVASDF

SEQ ID NO: 15114 - protein, 20 aa, synthetic construct
  source 1..20: note = Seed: SATGFKQSSKALQRPVASDF
SATGIKQNSIALVRPVASDF

SEQ ID NO: 15115 - protein, 20 aa, synthetic construct
  source 1..20: note = Seed: SATGFKQSSKALQRPVASDF
SATGIKQNSIALYRPVASDF

SEQ ID NO: 15116 - protein, 20 aa, synthetic construct
  source 1..20: note = Seed: SATGFKQSSKALQRPVASDF
SATGIKQNSNALYRPVASDF

SEQ ID NO: 15117 - protein, 20 aa, synthetic construct
  source 1..20: note = Seed: SATGFKQSSKALQRPVASDF
SATGIKQNSRALRRPVASDF

SEQ ID NO: 15118 - protein, 20 aa, synthetic construct
  source 1..20: note = Seed: SATGFKQSSKALQRPVASDF
SATGIKQNSRALYRPVASDF

SEQ ID NO: 15119 - protein, 20 aa, synthetic construct
  source 1..20: note = Seed: SATGFKQSSKALQRPVASDF
SATGIKQNSSALIRPVASDF

SEQ ID NO: 15120 - protein, 20 aa, synthetic construct
  source 1..20: note = Seed: SATGFKQSSKALQRPVASDF
SATGIKQNSSALVRPVASDF

SEQ ID NO: 15121 - protein, 20 aa, synthetic construct
  source 1..20: note = Seed: SATGFKQSSKALQRPVASDF
SATGIKQNSVALARPVASDF

SEQ ID NO: 15122 - protein, 20 aa, synthetic construct
  source 1..20: note = Seed: SATGFKQSSKALQRPVASDF
SATGIKQQSAALARPVASDF

SEQ ID NO: 15123 - protein, 20 aa, synthetic construct
  source 1..20: note = Seed: SATGFKQSSKALQRPVASDF
SATGIKQQSAALCRPVASDF

SEQ ID NO: 15124 - protein, 20 aa, synthetic construct
  source 1..20: note = Seed: SATGFKQSSKALQRPVASDF
SATGIKQQSAALFRPVASDF

SEQ ID NO: 15125 - protein, 20 aa, synthetic construct
  source 1..20: note = Seed: SATGFKQSSKALQRPVASDF
SATGIKQQSAALGRPVASDF

SEQ ID NO: 15126 - protein, 20 aa, synthetic construct
  source 1..20: note = Seed: SATGFKQSSKALQRPVASDF
SATGIKQQSAALIRPVASDF

SEQ ID NO: 15127 - protein, 20 aa, synthetic construct
  source 1..20: note = Seed: SATGFKQSSKALQRPVASDF
SATGIKQQSAALLRPVASDF

SEQ ID NO: 15128 - protein, 20 aa, synthetic construct
  source 1..20: note = Seed: SATGFKQSSKALQRPVASDF
SATGIKQQSAALMRPVASDF

SEQ ID NO: 15129 - protein, 20 aa, synthetic construct
  source 1..20: note = Seed: SATGFKQSSKALQRPVASDF
SATGIKQQSAALNRPVASDF

SEQ ID NO: 15130 - protein, 20 aa, synthetic construct
  source 1..20: note = Seed: SATGFKQSSKALQRPVASDF
SATGIKQQSAALSRPVASDF

SEQ ID NO: 15131 - protein, 20 aa, synthetic construct
  source 1..20: note = Seed: SATGFKQSSKALQRPVASDF
SATGIKQQSAALTRPVASDF

SEQ ID NO: 15132 - protein, 20 aa, synthetic construct
  source 1..20: note = Seed: SATGFKQSSKALQRPVASDF
SATGIKQQSAALVRPVASDF

SEQ ID NO: 15133 - protein, 20 aa, synthetic construct
  source 1..20: note = Seed: SATGFKQSSKALQRPVASDF
SATGIKQQSFALFRPVASDF

SEQ ID NO: 15134 - protein, 20 aa, synthetic construct
  source 1..20: note = Seed: SATGFKQSSKALQRPVASDF
SATGIKQQSFALIRPVASDF

SEQ ID NO: 15135 - protein, 20 aa, synthetic construct
  source 1..20: note = Seed: SATGFKQSSKALQRPVASDF
SATGIKQQSFALLRPVASDF

SEQ ID NO: 15136 - protein, 20 aa, synthetic construct
  source 1..20: note = Seed: SATGFKQSSKALQRPVASDF
SATGIKQQSGALARPVASDF

SEQ ID NO: 15137 - protein, 20 aa, synthetic construct
  source 1..20: note = Seed: SATGFKQSSKALQRPVASDF
SATGIKQQSGALGRPVASDF

SEQ ID NO: 15138 - protein, 20 aa, synthetic construct
  source 1..20: note = Seed: SATGFKQSSKALQRPVASDF
SATGIKQQSGALIRPVASDF

SEQ ID NO: 15139 - protein, 20 aa, synthetic construct
  source 1..20: note = Seed: SATGFKQSSKALQRPVASDF
SATGIKQQSGALLRPVASDF

SEQ ID NO: 15140 - protein, 20 aa, synthetic construct
  source 1..20: note = Seed: SATGFKQSSKALQRPVASDF
SATGIKQQSGALMRPVASDF

SEQ ID NO: 15141 - protein, 20 aa, synthetic construct
  source 1..20: note = Seed: SATGFKQSSKALQRPVASDF
SATGIKQQSGALSRPVASDF

SEQ ID NO: 15142 - protein, 20 aa, synthetic construct
  source 1..20: note = Seed: SATGFKQSSKALQRPVASDF
SATGIKQQSGALTRPVASDF

SEQ ID NO: 15143 - protein, 20 aa, synthetic construct
  source 1..20: note = Seed: SATGFKQSSKALQRPVASDF
SATGIKQQSGALVRPVASDF

SEQ ID NO: 15144 - protein, 20 aa, synthetic construct
  source 1..20: note = Seed: SATGFKQSSKALQRPVASDF
SATGIKQQSIALARPVASDF

SEQ ID NO: 15145 - protein, 20 aa, synthetic construct
  source 1..20: note = Seed: SATGFKQSSKALQRPVASDF
SATGIKQQSIALGRPVASDF

SEQ ID NO: 15146 - protein, 20 aa, synthetic construct
  source 1..20: note = Seed: SATGFKQSSKALQRPVASDF
SATGIKQQSIALHRPVASDF

SEQ ID NO: 15147 - protein, 20 aa, synthetic construct
  source 1..20: note = Seed: SATGFKQSSKALQRPVASDF
SATGIKQQSIALNRPVASDF

SEQ ID NO: 15148 - protein, 20 aa, synthetic construct
  source 1..20: note = Seed: SATGFKQSSKALQRPVASDF
SATGIKQQSIALSRPVASDF

SEQ ID NO: 15149 - protein, 20 aa, synthetic construct
  source 1..20: note = Seed: SATGFKQSSKALQRPVASDF
SATGIKQQSIALTRPVASDF

SEQ ID NO: 15150 - protein, 20 aa, synthetic construct
  source 1..20: note = Seed: SATGFKQSSKALQRPVASDF
SATGIKQQSIALVRPVASDF

SEQ ID NO: 15151 - protein, 20 aa, synthetic construct
  source 1..20: note = Seed: SATGFKQSSKALQRPVASDF
SATGIKQQSKALARPVASDF

SEQ ID NO: 15152 - protein, 20 aa, synthetic construct
  source 1..20: note = Seed: SATGFKQSSKALQRPVASDF
SATGIKQQSKALGRPVASDF

SEQ ID NO: 15153 - protein, 20 aa, synthetic construct
  source 1..20: note = Seed: SATGFKQSSKALQRPVASDF
SATGIKQQSKALHRPVASDF

SEQ ID NO: 15154 - protein, 20 aa, synthetic construct
  source 1..20: note = Seed: SATGFKQSSKALQRPVASDF
SATGIKQQSKALKRPVASDF

SEQ ID NO: 15155 - protein, 20 aa, synthetic construct
  source 1..20: note = Seed: SATGFKQSSKALQRPVASDF
SATGIKQQSKALQRPVASDF

SEQ ID NO: 15156 - protein, 20 aa, synthetic construct
  source 1..20: note = Seed: SATGFKQSSKALQRPVASDF
SATGIKQQSKALRRPVASDF

SEQ ID NO: 15157 - protein, 20 aa, synthetic construct
  source 1..20: note = Seed: SATGFKQSSKALQRPVASDF
SATGIKQQSKALSRPVASDF

SEQ ID NO: 15158 - protein, 20 aa, synthetic construct
  source 1..20: note = Seed: SATGFKQSSKALQRPVASDF
SATGIKQQSKALTRPVASDF

SEQ ID NO: 15159 - protein, 20 aa, synthetic construct
  source 1..20: note = Seed: SATGFKQSSKALQRPVASDF
SATGIKQQSLALGRPVASDF

SEQ ID NO: 15160 - protein, 20 aa, synthetic construct
  source 1..20: note = Seed: SATGFKQSSKALQRPVASDF
SATGIKQQSLALHRPVASDF

SEQ ID NO: 15161 - protein, 20 aa, synthetic construct
  source 1..20: note = Seed: SATGFKQSSKALQRPVASDF
SATGIKQQSLALNRPVASDF

SEQ ID NO: 15162 - protein, 20 aa, synthetic construct
  source 1..20: note = Seed: SATGFKQSSKALQRPVASDF
SATGIKQQSLALSRPVASDF

SEQ ID NO: 15163 - protein, 20 aa, synthetic construct
  source 1..20: note = Seed: SATGFKQSSKALQRPVASDF
SATGIKQQSLALVRPVASDF

SEQ ID NO: 15164 - protein, 20 aa, synthetic construct
  source 1..20: note = Seed: SATGFKQSSKALQRPVASDF
SATGIKQQSMALSRPVASDF

SEQ ID NO: 15165 - protein, 20 aa, synthetic construct
  source 1..20: note = Seed: SATGFKQSSKALQRPVASDF
SATGIKQQSMALVRPVASDF

SEQ ID NO: 15166 - protein, 20 aa, synthetic construct
  source 1..20: note = Seed: SATGFKQSSKALQRPVASDF
SATGIKQQSNALARPVASDF

SEQ ID NO: 15167 - protein, 20 aa, synthetic construct
  source 1..20: note = Seed: SATGFKQSSKALQRPVASDF
SATGIKQQSNALIRPVASDF

SEQ ID NO: 15168 - protein, 20 aa, synthetic construct
  source 1..20: note = Seed: SATGFKQSSKALQRPVASDF
SATGIKQQSNALLRPVASDF

SEQ ID NO: 15169 - protein, 20 aa, synthetic construct
  source 1..20: note = Seed: SATGFKQSSKALQRPVASDF
SATGIKQQSNALMRPVASDF

SEQ ID NO: 15170 - protein, 20 aa, synthetic construct
  source 1..20: note = Seed: SATGFKQSSKALQRPVASDF
SATGIKQQSNALSRPVASDF

SEQ ID NO: 15171 - protein, 20 aa, synthetic construct
  source 1..20: note = Seed: SATGFKQSSKALQRPVASDF
SATGIKQQSNALVRPVASDF

SEQ ID NO: 15172 - protein, 20 aa, synthetic construct
  source 1..20: note = Seed: SATGFKQSSKALQRPVASDF
SATGIKQQSPALARPVASDF

SEQ ID NO: 15173 - protein, 20 aa, synthetic construct
  source 1..20: note = Seed: SATGFKQSSKALQRPVASDF
SATGIKQQSPALIRPVASDF

SEQ ID NO: 15174 - protein, 20 aa, synthetic construct
  source 1..20: note = Seed: SATGFKQSSKALQRPVASDF
SATGIKQQSPALLRPVASDF

SEQ ID NO: 15175 - protein, 20 aa, synthetic construct
  source 1..20: note = Seed: SATGFKQSSKALQRPVASDF
SATGIKQQSPALMRPVASDF

SEQ ID NO: 15176 - protein, 20 aa, synthetic construct
  source 1..20: note = Seed: SATGFKQSSKALQRPVASDF
SATGIKQQSPALNRPVASDF

SEQ ID NO: 15177 - protein, 20 aa, synthetic construct
  source 1..20: note = Seed: SATGFKQSSKALQRPVASDF
SATGIKQQSPALSRPVASDF

SEQ ID NO: 15178 - protein, 20 aa, synthetic construct
  source 1..20: note = Seed: SATGFKQSSKALQRPVASDF
SATGIKQQSPALTRPVASDF

SEQ ID NO: 15179 - protein, 20 aa, synthetic construct
  source 1..20: note = Seed: SATGFKQSSKALQRPVASDF
SATGIKQQSPALVRPVASDF

SEQ ID NO: 15180 - protein, 20 aa, synthetic construct
  source 1..20: note = Seed: SATGFKQSSKALQRPVASDF
SATGIKQQSRALARPVASDF

SEQ ID NO: 15181 - protein, 20 aa, synthetic construct
  source 1..20: note = Seed: SATGFKQSSKALQRPVASDF
SATGIKQQSRALFRPVASDF

SEQ ID NO: 15182 - protein, 20 aa, synthetic construct
  source 1..20: note = Seed: SATGFKQSSKALQRPVASDF
SATGIKQQSRALGRPVASDF

SEQ ID NO: 15183 - protein, 20 aa, synthetic construct
  source 1..20: note = Seed: SATGFKQSSKALQRPVASDF
SATGIKQQSRALHRPVASDF

SEQ ID NO: 15184 - protein, 20 aa, synthetic construct
  source 1..20: note = Seed: SATGFKQSSKALQRPVASDF
SATGIKQQSRALIRPVASDF

SEQ ID NO: 15185 - protein, 20 aa, synthetic construct
  source 1..20: note = Seed: SATGFKQSSKALQRPVASDF
SATGIKQQSRALKRPVASDF

SEQ ID NO: 15186 - protein, 20 aa, synthetic construct
  source 1..20: note = Seed: SATGFKQSSKALQRPVASDF
SATGIKQQSRALLRPVASDF

SEQ ID NO: 15187 - protein, 20 aa, synthetic construct
  source 1..20: note = Seed: SATGFKQSSKALQRPVASDF
SATGIKQQSRALMRPVASDF

SEQ ID NO: 15188 - protein, 20 aa, synthetic construct
  source 1..20: note = Seed: SATGFKQSSKALQRPVASDF
SATGIKQQSRALQRPVASDF

SEQ ID NO: 15189 - protein, 20 aa, synthetic construct
  source 1..20: note = Seed: SATGFKQSSKALQRPVASDF
SATGIKQQSRALRRPVASDF

SEQ ID NO: 15190 - protein, 20 aa, synthetic construct
  source 1..20: note = Seed: SATGFKQSSKALQRPVASDF
SATGIKQQSRALSRPVASDF

SEQ ID NO: 15191 - protein, 20 aa, synthetic construct
  source 1..20: note = Seed: SATGFKQSSKALQRPVASDF
SATGIKQQSRALTRPVASDF

SEQ ID NO: 15192 - protein, 20 aa, synthetic construct
  source 1..20: note = Seed: SATGFKQSSKALQRPVASDF
SATGIKQQSRALVRPVASDF

SEQ ID NO: 15193 - protein, 20 aa, synthetic construct
  source 1..20: note = Seed: SATGFKQSSKALQRPVASDF
SATGIKQQSRALYRPVASDF

SEQ ID NO: 15194 - protein, 20 aa, synthetic construct
  source 1..20: note = Seed: SATGFKQSSKALQRPVASDF
SATGIKQQSSALARPVASDF

SEQ ID NO: 15195 - protein, 20 aa, synthetic construct
  source 1..20: note = Seed: SATGFKQSSKALQRPVASDF
SATGIKQQSSALGRPVASDF

SEQ ID NO: 15196 - protein, 20 aa, synthetic construct
  source 1..20: note = Seed: SATGFKQSSKALQRPVASDF
SATGIKQQSSALIRPVASDF

SEQ ID NO: 15197 - protein, 20 aa, synthetic construct
  source 1..20: note = Seed: SATGFKQSSKALQRPVASDF
SATGIKQQSSALLRPVASDF

SEQ ID NO: 15198 - protein, 20 aa, synthetic construct
  source 1..20: note = Seed: SATGFKQSSKALQRPVASDF
SATGIKQQSSALMRPVASDF

SEQ ID NO: 15199 - protein, 20 aa, synthetic construct
  source 1..20: note = Seed: SATGFKQSSKALQRPVASDF
SATGIKQQSSALNRPVASDF

SEQ ID NO: 15200 - protein, 20 aa, synthetic construct
  source 1..20: note = Seed: SATGFKQSSKALQRPVASDF
SATGIKQQSSALSRPVASDF

SEQ ID NO: 15201 - protein, 20 aa, synthetic construct
  source 1..20: note = Seed: SATGFKQSSKALQRPVASDF
SATGIKQQSSALTRPVASDF

SEQ ID NO: 15202 - protein, 20 aa, synthetic construct
  source 1..20: note = Seed: SATGFKQSSKALQRPVASDF
SATGIKQQSSALVRPVASDF

SEQ ID NO: 15203 - protein, 20 aa, synthetic construct
  source 1..20: note = Seed: SATGFKQSSKALQRPVASDF
SATGIKQQSTALARPVASDF

SEQ ID NO: 15204 - protein, 20 aa, synthetic construct
  source 1..20: note = Seed: SATGFKQSSKALQRPVASDF
SATGIKQQSTALIRPVASDF

SEQ ID NO: 15205 - protein, 20 aa, synthetic construct
  source 1..20: note = Seed: SATGFKQSSKALQRPVASDF
SATGIKQQSTALLRPVASDF

SEQ ID NO: 15206 - protein, 20 aa, synthetic construct
  source 1..20: note = Seed: SATGFKQSSKALQRPVASDF
SATGIKQQSTALNRPVASDF

SEQ ID NO: 15207 - protein, 20 aa, synthetic construct
  source 1..20: note = Seed: SATGFKQSSKALQRPVASDF
SATGIKQQSTALSRPVASDF

SEQ ID NO: 15208 - protein, 20 aa, synthetic construct
  source 1..20: note = Seed: SATGFKQSSKALQRPVASDF
SATGIKQQSTALTRPVASDF

SEQ ID NO: 15209 - protein, 20 aa, synthetic construct
  source 1..20: note = Seed: SATGFKQSSKALQRPVASDF
SATGIKQQSTALVRPVASDF

SEQ ID NO: 15210 - protein, 20 aa, synthetic construct
  source 1..20: note = Seed: SATGFKQSSKALQRPVASDF
SATGIKQQSVALARPVASDF

SEQ ID NO: 15211 - protein, 20 aa, synthetic construct
  source 1..20: note = Seed: SATGFKQSSKALQRPVASDF
SATGIKQQSVALFRPVASDF

SEQ ID NO: 15212 - protein, 20 aa, synthetic construct
  source 1..20: note = Seed: SATGFKQSSKALQRPVASDF
SATGIKQQSVALHRPVASDF

SEQ ID NO: 15213 - protein, 20 aa, synthetic construct
  source 1..20: note = Seed: SATGFKQSSKALQRPVASDF
SATGIKQQSVALIRPVASDF

SEQ ID NO: 15214 - protein, 20 aa, synthetic construct
  source 1..20: note = Seed: SATGFKQSSKALQRPVASDF
SATGIKQQSVALLRPVASDF

SEQ ID NO: 15215 - protein, 20 aa, synthetic construct
  source 1..20: note = Seed: SATGFKQSSKALQRPVASDF
SATGIKQQSVALNRPVASDF

SEQ ID NO: 15216 - protein, 20 aa, synthetic construct
  source 1..20: note = Seed: SATGFKQSSKALQRPVASDF
SATGIKQQSVALQRPVASDF

SEQ ID NO: 15217 - protein, 20 aa, synthetic construct
  source 1..20: note = Seed: SATGFKQSSKALQRPVASDF
SATGIKQQSVALSRPVASDF

SEQ ID NO: 15218 - protein, 20 aa, synthetic construct
  source 1..20: note = Seed: SATGFKQSSKALQRPVASDF
SATGIKQQSVALTRPVASDF

SEQ ID NO: 15219 - protein, 20 aa, synthetic construct
  source 1..20: note = Seed: SATGFKQSSKALQRPVASDF
SATGIKQQSVALVRPVASDF

SEQ ID NO: 15220 - protein, 20 aa, synthetic construct
  source 1..20: note = Seed: SATGFKQSSKALQRPVASDF
SATGIKQRSIALARPVASDF

SEQ ID NO: 15221 - protein, 20 aa, synthetic construct
  source 1..20: note = Seed: SATGFKQSSKALQRPVASDF
SATGIKQRSIALRRPVASDF

SEQ ID NO: 15222 - protein, 20 aa, synthetic construct
  source 1..20: note = Seed: SATGFKQSSKALQRPVASDF
SATGIKQRSKALARPVASDF

SEQ ID NO: 15223 - protein, 20 aa, synthetic construct
  source 1..20: note = Seed: SATGFKQSSKALQRPVASDF
SATGIKQRSKALFRPVASDF

SEQ ID NO: 15224 - protein, 20 aa, synthetic construct
  source 1..20: note = Seed: SATGFKQSSKALQRPVASDF
SATGIKQRSKALMRPVASDF

SEQ ID NO: 15225 - protein, 20 aa, synthetic construct
  source 1..20: note = Seed: SATGFKQSSKALQRPVASDF
SATGIKQRSKALRRPVASDF

SEQ ID NO: 15226 - protein, 20 aa, synthetic construct
  source 1..20: note = Seed: SATGFKQSSKALQRPVASDF
SATGIKQRSKALYRPVASDF

SEQ ID NO: 15227 - protein, 20 aa, synthetic construct
  source 1..20: note = Seed: SATGFKQSSKALQRPVASDF
SATGIKQRSLALRRPVASDF

SEQ ID NO: 15228 - protein, 20 aa, synthetic construct
  source 1..20: note = Seed: SATGFKQSSKALQRPVASDF
SATGIKQRSRALARPVASDF

SEQ ID NO: 15229 - protein, 20 aa, synthetic construct
  source 1..20: note = Seed: SATGFKQSSKALQRPVASDF
SATGIKQRSRALFRPVASDF

SEQ ID NO: 15230 - protein, 20 aa, synthetic construct
  source 1..20: note = Seed: SATGFKQSSKALQRPVASDF
SATGIKQRSRALHRPVASDF

SEQ ID NO: 15231 - protein, 20 aa, synthetic construct
  source 1..20: note = Seed: SATGFKQSSKALQRPVASDF
SATGIKQRSRALIRPVASDF

SEQ ID NO: 15232 - protein, 20 aa, synthetic construct
  source 1..20: note = Seed: SATGFKQSSKALQRPVASDF
SATGIKQRSRALKRPVASDF

SEQ ID NO: 15233 - protein, 20 aa, synthetic construct
  source 1..20: note = Seed: SATGFKQSSKALQRPVASDF
SATGIKQRSRALLRPVASDF

SEQ ID NO: 15234 - protein, 20 aa, synthetic construct
  source 1..20: note = Seed: SATGFKQSSKALQRPVASDF
SATGIKQRSRALMRPVASDF

SEQ ID NO: 15235 - protein, 20 aa, synthetic construct
  source 1..20: note = Seed: SATGFKQSSKALQRPVASDF
SATGIKQRSRALRRPVASDF

SEQ ID NO: 15236 - protein, 20 aa, synthetic construct
  source 1..20: note = Seed: SATGFKQSSKALQRPVASDF
SATGIKQRSRALSRPVASDF

SEQ ID NO: 15237 - protein, 20 aa, synthetic construct
  source 1..20: note = Seed: SATGFKQSSKALQRPVASDF
SATGIKQRSRALVRPVASDF

SEQ ID NO: 15238 - protein, 20 aa, synthetic construct
  source 1..20: note = Seed: SATGFKQSSKALQRPVASDF
SATGIKQRSRALYRPVASDF

SEQ ID NO: 15239 - protein, 20 aa, synthetic construct
  source 1..20: note = Seed: SATGFKQSSKALQRPVASDF
SATGIKQRSVALRRPVASDF

SEQ ID NO: 15240 - protein, 20 aa, synthetic construct
  source 1..20: note = Seed: SATGFKQSSKALQRPVASDF
SATGIKQSSAALARPVASDF

SEQ ID NO: 15241 - protein, 20 aa, synthetic construct
  source 1..20: note = Seed: SATGFKQSSKALQRPVASDF
SATGIKQSSAALIRPVASDF

SEQ ID NO: 15242 - protein, 20 aa, synthetic construct
  source 1..20: note = Seed: SATGFKQSSKALQRPVASDF
SATGIKQSSAALLRPVASDF

SEQ ID NO: 15243 - protein, 20 aa, synthetic construct
  source 1..20: note = Seed: SATGFKQSSKALQRPVASDF
SATGIKQSSAALMRPVASDF

SEQ ID NO: 15244 - protein, 20 aa, synthetic construct
  source 1..20: note = Seed: SATGFKQSSKALQRPVASDF
SATGIKQSSAALNRPVASDF

SEQ ID NO: 15245 - protein, 20 aa, synthetic construct
  source 1..20: note = Seed: SATGFKQSSKALQRPVASDF
SATGIKQSSAALSRPVASDF

SEQ ID NO: 15246 - protein, 20 aa, synthetic construct
  source 1..20: note = Seed: SATGFKQSSKALQRPVASDF
SATGIKQSSAALTRPVASDF

SEQ ID NO: 15247 - protein, 20 aa, synthetic construct
  source 1..20: note = Seed: SATGFKQSSKALQRPVASDF
SATGIKQSSAALVRPVASDF

SEQ ID NO: 15248 - protein, 20 aa, synthetic construct
  source 1..20: note = Seed: SATGFKQSSKALQRPVASDF
SATGIKQSSFALARPVASDF

SEQ ID NO: 15249 - protein, 20 aa, synthetic construct
  source 1..20: note = Seed: SATGFKQSSKALQRPVASDF
SATGIKQSSFALDRPVASDF

SEQ ID NO: 15250 - protein, 20 aa, synthetic construct
  source 1..20: note = Seed: SATGFKQSSKALQRPVASDF
SATGIKQSSFALERPVASDF

SEQ ID NO: 15251 - protein, 20 aa, synthetic construct
  source 1..20: note = Seed: SATGFKQSSKALQRPVASDF
SATGIKQSSFALFRPVASDF

SEQ ID NO: 15252 - protein, 20 aa, synthetic construct
  source 1..20: note = Seed: SATGFKQSSKALQRPVASDF
SATGIKQSSFALIRPVASDF

SEQ ID NO: 15253 - protein, 20 aa, synthetic construct
  source 1..20: note = Seed: SATGFKQSSKALQRPVASDF
SATGIKQSSFALLRPVASDF

SEQ ID NO: 15254 - protein, 20 aa, synthetic construct
  source 1..20: note = Seed: SATGFKQSSKALQRPVASDF
SATGIKQSSFALMRPVASDF

SEQ ID NO: 15255 - protein, 20 aa, synthetic construct
  source 1..20: note = Seed: SATGFKQSSKALQRPVASDF
SATGIKQSSFALVRPVASDF

SEQ ID NO: 15256 - protein, 20 aa, synthetic construct
  source 1..20: note = Seed: SATGFKQSSKALQRPVASDF
SATGIKQSSGALARPVASDF

SEQ ID NO: 15257 - protein, 20 aa, synthetic construct
  source 1..20: note = Seed: SATGFKQSSKALQRPVASDF
SATGIKQSSGALIRPVASDF

SEQ ID NO: 15258 - protein, 20 aa, synthetic construct
  source 1..20: note = Seed: SATGFKQSSKALQRPVASDF
SATGIKQSSGALLRPVASDF

SEQ ID NO: 15259 - protein, 20 aa, synthetic construct
  source 1..20: note = Seed: SATGFKQSSKALQRPVASDF
SATGIKQSSGALMRPVASDF

SEQ ID NO: 15260 - protein, 20 aa, synthetic construct
  source 1..20: note = Seed: SATGFKQSSKALQRPVASDF
SATGIKQSSGALVRPVASDF

SEQ ID NO: 15261 - protein, 20 aa, synthetic construct
  source 1..20: note = Seed: SATGFKQSSKALQRPVASDF
SATGIKQSSIALNRPVASDF

SEQ ID NO: 15262 - protein, 20 aa, synthetic construct
  source 1..20: note = Seed: SATGFKQSSKALQRPVASDF
SATGIKQSSIALRRPVASDF

SEQ ID NO: 15263 - protein, 20 aa, synthetic construct
  source 1..20: note = Seed: SATGFKQSSKALQRPVASDF
SATGIKQSSIALSRPVASDF

SEQ ID NO: 15264 - protein, 20 aa, synthetic construct
  source 1..20: note = Seed: SATGFKQSSKALQRPVASDF
SATGIKQSSKALARPVASDF

SEQ ID NO: 15265 - protein, 20 aa, synthetic construct
  source 1..20: note = Seed: SATGFKQSSKALQRPVASDF
SATGIKQSSKALKRPVASDF

SEQ ID NO: 15266 - protein, 20 aa, synthetic construct
  source 1..20: note = Seed: SATGFKQSSKALQRPVASDF
SATGIKQSSKALRRPVASDF

SEQ ID NO: 15267 - protein, 20 aa, synthetic construct
  source 1..20: note = Seed: SATGFKQSSKALQRPVASDF
SATGIKQSSKALSRPVASDF

SEQ ID NO: 15268 - protein, 20 aa, synthetic construct
  source 1..20: note = Seed: SATGFKQSSKALQRPVASDF
SATGIKQSSKALYRPVASDF

SEQ ID NO: 15269 - protein, 20 aa, synthetic construct
  source 1..20: note = Seed: SATGFKQSSKALQRPVASDF
SATGIKQSSPALARPVASDF

SEQ ID NO: 15270 - protein, 20 aa, synthetic construct
  source 1..20: note = Seed: SATGFKQSSKALQRPVASDF
SATGIKQSSPALIRPVASDF

SEQ ID NO: 15271 - protein, 20 aa, synthetic construct
  source 1..20: note = Seed: SATGFKQSSKALQRPVASDF
SATGIKQSSPALLRPVASDF

SEQ ID NO: 15272 - protein, 20 aa, synthetic construct
  source 1..20: note = Seed: SATGFKQSSKALQRPVASDF
SATGIKQSSPALMRPVASDF

SEQ ID NO: 15273 - protein, 20 aa, synthetic construct
  source 1..20: note = Seed: SATGFKQSSKALQRPVASDF
SATGIKQSSPALNRPVASDF

SEQ ID NO: 15274 - protein, 20 aa, synthetic construct
  source 1..20: note = Seed: SATGFKQSSKALQRPVASDF
SATGIKQSSPALSRPVASDF

SEQ ID NO: 15275 - protein, 20 aa, synthetic construct
  source 1..20: note = Seed: SATGFKQSSKALQRPVASDF
SATGIKQSSPALVRPVASDF

SEQ ID NO: 15276 - protein, 20 aa, synthetic construct
  source 1..20: note = Seed: SATGFKQSSKALQRPVASDF
SATGIKQSSRALARPVASDF

SEQ ID NO: 15277 - protein, 20 aa, synthetic construct
  source 1..20: note = Seed: SATGFKQSSKALQRPVASDF
SATGIKQSSRALFRPVASDF

SEQ ID NO: 15278 - protein, 20 aa, synthetic construct
  source 1..20: note = Seed: SATGFKQSSKALQRPVASDF
SATGIKQSSRALGRPVASDF

SEQ ID NO: 15279 - protein, 20 aa, synthetic construct
  source 1..20: note = Seed: SATGFKQSSKALQRPVASDF
SATGIKQSSRALHRPVASDF

SEQ ID NO: 15280 - protein, 20 aa, synthetic construct
  source 1..20: note = Seed: SATGFKQSSKALQRPVASDF
SATGIKQSSRALKRPVASDF

SEQ ID NO: 15281 - protein, 20 aa, synthetic construct
  source 1..20: note = Seed: SATGFKQSSKALQRPVASDF
SATGIKQSSRALMRPVASDF

SEQ ID NO: 15282 - protein, 20 aa, synthetic construct
  source 1..20: note = Seed: SATGFKQSSKALQRPVASDF
SATGIKQSSRALQRPVASDF

SEQ ID NO: 15283 - protein, 20 aa, synthetic construct
  source 1..20: note = Seed: SATGFKQSSKALQRPVASDF
SATGIKQSSRALRRPVASDF

SEQ ID NO: 15284 - protein, 20 aa, synthetic construct
  source 1..20: note = Seed: SATGFKQSSKALQRPVASDF
SATGIKQSSRALSRPVASDF

SEQ ID NO: 15285 - protein, 20 aa, synthetic construct
  source 1..20: note = Seed: SATGFKQSSKALQRPVASDF
SATGIKQSSRALVRPVASDF

SEQ ID NO: 15286 - protein, 20 aa, synthetic construct
  source 1..20: note = Seed: SATGFKQSSKALQRPVASDF
SATGIKQSSRALYRPVASDF

SEQ ID NO: 15287 - protein, 20 aa, synthetic construct
  source 1..20: note = Seed: SATGFKQSSKALQRPVASDF
SATGIKQSSSALARPVASDF

SEQ ID NO: 15288 - protein, 20 aa, synthetic construct
  source 1..20: note = Seed: SATGFKQSSKALQRPVASDF
SATGIKQSSSALIRPVASDF

SEQ ID NO: 15289 - protein, 20 aa, synthetic construct
  source 1..20: note = Seed: SATGFKQSSKALQRPVASDF
SATGIKQSSSALLRPVASDF

SEQ ID NO: 15290 - protein, 20 aa, synthetic construct
  source 1..20: note = Seed: SATGFKQSSKALQRPVASDF
SATGIKQSSSALVRPVASDF

SEQ ID NO: 15291 - protein, 20 aa, synthetic construct
  source 1..20: note = Seed: SATGFKQSSKALQRPVASDF
SATGIKQSSTALARPVASDF

SEQ ID NO: 15292 - protein, 20 aa, synthetic construct
  source 1..20: note = Seed: SATGFKQSSKALQRPVASDF
SATGIKQSSVALARPVASDF

SEQ ID NO: 15293 - protein, 20 aa, synthetic construct
  source 1..20: note = Seed: SATGFKQSSKALQRPVASDF
SATGIKQSSVALIRPVASDF

SEQ ID NO: 15294 - protein, 20 aa, synthetic construct
  source 1..20: note = Seed: SATGFKQSSKALQRPVASDF
SATGIKQSSVALNRPVASDF

SEQ ID NO: 15295 - protein, 20 aa, synthetic construct
  source 1..20: note = Seed: SATGFKQSSKALQRPVASDF
SATGIKQSSVALSRPVASDF

SEQ ID NO: 15296 - protein, 20 aa, synthetic construct
  source 1..20: note = Seed: SATGFKQSSKALQRPVASDF
SATGIKQSSVALTRPVASDF

SEQ ID NO: 15297 - protein, 20 aa, synthetic construct
  source 1..20: note = Seed: SATGFKQSSKALQRPVASDF
SATGIKQSSVALVRPVASDF

SEQ ID NO: 15298 - protein, 20 aa, synthetic construct
  source 1..20: note = Seed: SATGFKQSSKALQRPVASDF
SATGIKQTSAALARPVASDF

SEQ ID NO: 15299 - protein, 20 aa, synthetic construct
  source 1..20: note = Seed: SATGFKQSSKALQRPVASDF
SATGIKQTSAALIRPVASDF

SEQ ID NO: 15300 - protein, 20 aa, synthetic construct
  source 1..20: note = Seed: SATGFKQSSKALQRPVASDF
SATGIKQTSAALLRPVASDF

SEQ ID NO: 15301 - protein, 20 aa, synthetic construct
  source 1..20: note = Seed: SATGFKQSSKALQRPVASDF
SATGIKQTSAALMRPVASDF

SEQ ID NO: 15302 - protein, 20 aa, synthetic construct
  source 1..20: note = Seed: SATGFKQSSKALQRPVASDF
SATGIKQTSAALNRPVASDF

SEQ ID NO: 15303 - protein, 20 aa, synthetic construct
  source 1..20: note = Seed: SATGFKQSSKALQRPVASDF
SATGIKQTSAALSRPVASDF

SEQ ID NO: 15304 - protein, 20 aa, synthetic construct
  source 1..20: note = Seed: SATGFKQSSKALQRPVASDF
SATGIKQTSAALTRPVASDF

SEQ ID NO: 15305 - protein, 20 aa, synthetic construct
  source 1..20: note = Seed: SATGFKQSSKALQRPVASDF
SATGIKQTSAALVRPVASDF

SEQ ID NO: 15306 - protein, 20 aa, synthetic construct
  source 1..20: note = Seed: SATGFKQSSKALQRPVASDF
SATGIKQTSFALARPVASDF

SEQ ID NO: 15307 - protein, 20 aa, synthetic construct
  source 1..20: note = Seed: SATGFKQSSKALQRPVASDF
SATGIKQTSFALDRPVASDF

SEQ ID NO: 15308 - protein, 20 aa, synthetic construct
  source 1..20: note = Seed: SATGFKQSSKALQRPVASDF
SATGIKQTSFALERPVASDF

SEQ ID NO: 15309 - protein, 20 aa, synthetic construct
  source 1..20: note = Seed: SATGFKQSSKALQRPVASDF
SATGIKQTSFALFRPVASDF

SEQ ID NO: 15310 - protein, 20 aa, synthetic construct
  source 1..20: note = Seed: SATGFKQSSKALQRPVASDF
SATGIKQTSFALIRPVASDF

SEQ ID NO: 15311 - protein, 20 aa, synthetic construct
  source 1..20: note = Seed: SATGFKQSSKALQRPVASDF
SATGIKQTSFALLRPVASDF

SEQ ID NO: 15312 - protein, 20 aa, synthetic construct
  source 1..20: note = Seed: SATGFKQSSKALQRPVASDF
SATGIKQTSFALMRPVASDF

SEQ ID NO: 15313 - protein, 20 aa, synthetic construct
  source 1..20: note = Seed: SATGFKQSSKALQRPVASDF
SATGIKQTSFALNRPVASDF

SEQ ID NO: 15314 - protein, 20 aa, synthetic construct
  source 1..20: note = Seed: SATGFKQSSKALQRPVASDF
SATGIKQTSFALSRPVASDF

SEQ ID NO: 15315 - protein, 20 aa, synthetic construct
  source 1..20: note = Seed: SATGFKQSSKALQRPVASDF
SATGIKQTSFALTRPVASDF

SEQ ID NO: 15316 - protein, 20 aa, synthetic construct
  source 1..20: note = Seed: SATGFKQSSKALQRPVASDF
SATGIKQTSFALVRPVASDF

SEQ ID NO: 15317 - protein, 20 aa, synthetic construct
  source 1..20: note = Seed: SATGFKQSSKALQRPVASDF
SATGIKQTSGALARPVASDF

SEQ ID NO: 15318 - protein, 20 aa, synthetic construct
  source 1..20: note = Seed: SATGFKQSSKALQRPVASDF
SATGIKQTSGALIRPVASDF

SEQ ID NO: 15319 - protein, 20 aa, synthetic construct
  source 1..20: note = Seed: SATGFKQSSKALQRPVASDF
SATGIKQTSGALLRPVASDF

SEQ ID NO: 15320 - protein, 20 aa, synthetic construct
  source 1..20: note = Seed: SATGFKQSSKALQRPVASDF
SATGIKQTSGALVRPVASDF

SEQ ID NO: 15321 - protein, 20 aa, synthetic construct
  source 1..20: note = Seed: SATGFKQSSKALQRPVASDF
SATGIKQTSIALNRPVASDF

SEQ ID NO: 15322 - protein, 20 aa, synthetic construct
  source 1..20: note = Seed: SATGFKQSSKALQRPVASDF
SATGIKQTSIALSRPVASDF

SEQ ID NO: 15323 - protein, 20 aa, synthetic construct
  source 1..20: note = Seed: SATGFKQSSKALQRPVASDF
SATGIKQTSKALARPVASDF

SEQ ID NO: 15324 - protein, 20 aa, synthetic construct
  source 1..20: note = Seed: SATGFKQSSKALQRPVASDF
SATGIKQTSKALKRPVASDF

SEQ ID NO: 15325 - protein, 20 aa, synthetic construct
  source 1..20: note = Seed: SATGFKQSSKALQRPVASDF
SATGIKQTSKALRRPVASDF

SEQ ID NO: 15326 - protein, 20 aa, synthetic construct
  source 1..20: note = Seed: SATGFKQSSKALQRPVASDF
SATGIKQTSKALSRPVASDF

SEQ ID NO: 15327 - protein, 20 aa, synthetic construct
  source 1..20: note = Seed: SATGFKQSSKALQRPVASDF
SATGIKQTSPALARPVASDF

SEQ ID NO: 15328 - protein, 20 aa, synthetic construct
  source 1..20: note = Seed: SATGFKQSSKALQRPVASDF
SATGIKQTSPALIRPVASDF

SEQ ID NO: 15329 - protein, 20 aa, synthetic construct
  source 1..20: note = Seed: SATGFKQSSKALQRPVASDF
SATGIKQTSPALLRPVASDF

SEQ ID NO: 15330 - protein, 20 aa, synthetic construct
  source 1..20: note = Seed: SATGFKQSSKALQRPVASDF
SATGIKQTSPALSRPVASDF

SEQ ID NO: 15331 - protein, 20 aa, synthetic construct
  source 1..20: note = Seed: SATGFKQSSKALQRPVASDF
SATGIKQTSPALVRPVASDF

SEQ ID NO: 15332 - protein, 20 aa, synthetic construct
  source 1..20: note = Seed: SATGFKQSSKALQRPVASDF
SATGIKQTSRALARPVASDF

SEQ ID NO: 15333 - protein, 20 aa, synthetic construct
  source 1..20: note = Seed: SATGFKQSSKALQRPVASDF
SATGIKQTSRALGRPVASDF

SEQ ID NO: 15334 - protein, 20 aa, synthetic construct
  source 1..20: note = Seed: SATGFKQSSKALQRPVASDF
SATGIKQTSRALHRPVASDF

SEQ ID NO: 15335 - protein, 20 aa, synthetic construct
  source 1..20: note = Seed: SATGFKQSSKALQRPVASDF
SATGIKQTSRALKRPVASDF

SEQ ID NO: 15336 - protein, 20 aa, synthetic construct
  source 1..20: note = Seed: SATGFKQSSKALQRPVASDF
SATGIKQTSRALQRPVASDF

SEQ ID NO: 15337 - protein, 20 aa, synthetic construct
  source 1..20: note = Seed: SATGFKQSSKALQRPVASDF
SATGIKQTSRALRRPVASDF

SEQ ID NO: 15338 - protein, 20 aa, synthetic construct
  source 1..20: note = Seed: SATGFKQSSKALQRPVASDF
SATGIKQTSRALSRPVASDF

SEQ ID NO: 15339 - protein, 20 aa, synthetic construct
  source 1..20: note = Seed: SATGFKQSSKALQRPVASDF
SATGIKQTSSALARPVASDF

SEQ ID NO: 15340 - protein, 20 aa, synthetic construct
  source 1..20: note = Seed: SATGFKQSSKALQRPVASDF
SATGIKQTSSALIRPVASDF

SEQ ID NO: 15341 - protein, 20 aa, synthetic construct
  source 1..20: note = Seed: SATGFKQSSKALQRPVASDF
SATGIKQTSSALLRPVASDF

SEQ ID NO: 15342 - protein, 20 aa, synthetic construct
  source 1..20: note = Seed: SATGFKQSSKALQRPVASDF
SATGIKQTSSALVRPVASDF

SEQ ID NO: 15343 - protein, 20 aa, synthetic construct
  source 1..20: note = Seed: SATGFKQSSKALQRPVASDF
SATGIKQTSVALARPVASDF

SEQ ID NO: 15344 - protein, 20 aa, synthetic construct
  source 1..20: note = Seed: SATGFKQSSKALQRPVASDF
SATGIKQTSVALIRPVASDF

SEQ ID NO: 15345 - protein, 20 aa, synthetic construct
  source 1..20: note = Seed: SATGFKQSSKALQRPVASDF
SATGIKQTSVALNRPVASDF

SEQ ID NO: 15346 - protein, 20 aa, synthetic construct
  source 1..20: note = Seed: SATGFKQSSKALQRPVASDF
SATGIKQTSVALSRPVASDF

SEQ ID NO: 15347 - protein, 20 aa, synthetic construct
  source 1..20: note = Seed: SATGFKQSSKALQRPVASDF
SATGIKQTSVALVRPVASDF

SEQ ID NO: 15348 - protein, 20 aa, synthetic construct
  source 1..20: note = Seed: SATGFKQSSKALQRPVASDF
SATGIKQVSAALARPVASDF

SEQ ID NO: 15349 - protein, 20 aa, synthetic construct
  source 1..20: note = Seed: SATGFKQSSKALQRPVASDF
SATGIKQVSAALCRPVASDF

SEQ ID NO: 15350 - protein, 20 aa, synthetic construct
  source 1..20: note = Seed: SATGFKQSSKALQRPVASDF
SATGIKQVSAALGRPVASDF

SEQ ID NO: 15351 - protein, 20 aa, synthetic construct
  source 1..20: note = Seed: SATGFKQSSKALQRPVASDF
SATGIKQVSAALHRPVASDF

SEQ ID NO: 15352 - protein, 20 aa, synthetic construct
  source 1..20: note = Seed: SATGFKQSSKALQRPVASDF
SATGIKQVSAALIRPVASDF

SEQ ID NO: 15353 - protein, 20 aa, synthetic construct
  source 1..20: note = Seed: SATGFKQSSKALQRPVASDF
SATGIKQVSAALLRPVASDF

SEQ ID NO: 15354 - protein, 20 aa, synthetic construct
  source 1..20: note = Seed: SATGFKQSSKALQRPVASDF
SATGIKQVSAALMRPVASDF

SEQ ID NO: 15355 - protein, 20 aa, synthetic construct
  source 1..20: note = Seed: SATGFKQSSKALQRPVASDF
SATGIKQVSAALNRPVASDF

SEQ ID NO: 15356 - protein, 20 aa, synthetic construct
  source 1..20: note = Seed: SATGFKQSSKALQRPVASDF
SATGIKQVSAALRRPVASDF

SEQ ID NO: 15357 - protein, 20 aa, synthetic construct
  source 1..20: note = Seed: SATGFKQSSKALQRPVASDF
SATGIKQVSAALSRPVASDF

SEQ ID NO: 15358 - protein, 20 aa, synthetic construct
  source 1..20: note = Seed: SATGFKQSSKALQRPVASDF
SATGIKQVSAALTRPVASDF

SEQ ID NO: 15359 - protein, 20 aa, synthetic construct
  source 1..20: note = Seed: SATGFKQSSKALQRPVASDF
SATGIKQVSAALVRPVASDF

SEQ ID NO: 15360 - protein, 20 aa, synthetic construct
  source 1..20: note = Seed: SATGFKQSSKALQRPVASDF
SATGIKQVSFALARPVASDF

SEQ ID NO: 15361 - protein, 20 aa, synthetic construct
  source 1..20: note = Seed: SATGFKQSSKALQRPVASDF
SATGIKQVSFALERPVASDF

SEQ ID NO: 15362 - protein, 20 aa, synthetic construct
  source 1..20: note = Seed: SATGFKQSSKALQRPVASDF
SATGIKQVSFALIRPVASDF

SEQ ID NO: 15363 - protein, 20 aa, synthetic construct
  source 1..20: note = Seed: SATGFKQSSKALQRPVASDF
SATGIKQVSFALLRPVASDF

SEQ ID NO: 15364 - protein, 20 aa, synthetic construct
  source 1..20: note = Seed: SATGFKQSSKALQRPVASDF
SATGIKQVSFALMRPVASDF

SEQ ID NO: 15365 - protein, 20 aa, synthetic construct
  source 1..20: note = Seed: SATGFKQSSKALQRPVASDF
SATGIKQVSFALSRPVASDF

SEQ ID NO: 15366 - protein, 20 aa, synthetic construct
  source 1..20: note = Seed: SATGFKQSSKALQRPVASDF
SATGIKQVSFALTRPVASDF

SEQ ID NO: 15367 - protein, 20 aa, synthetic construct
  source 1..20: note = Seed: SATGFKQSSKALQRPVASDF
SATGIKQVSFALVRPVASDF

SEQ ID NO: 15368 - protein, 20 aa, synthetic construct
  source 1..20: note = Seed: SATGFKQSSKALQRPVASDF
SATGIKQVSGALARPVASDF

SEQ ID NO: 15369 - protein, 20 aa, synthetic construct
  source 1..20: note = Seed: SATGFKQSSKALQRPVASDF
SATGIKQVSGALGRPVASDF

SEQ ID NO: 15370 - protein, 20 aa, synthetic construct
  source 1..20: note = Seed: SATGFKQSSKALQRPVASDF
SATGIKQVSGALIRPVASDF

SEQ ID NO: 15371 - protein, 20 aa, synthetic construct
  source 1..20: note = Seed: SATGFKQSSKALQRPVASDF
SATGIKQVSGALLRPVASDF

SEQ ID NO: 15372 - protein, 20 aa, synthetic construct
  source 1..20: note = Seed: SATGFKQSSKALQRPVASDF
SATGIKQVSGALMRPVASDF

SEQ ID NO: 15373 - protein, 20 aa, synthetic construct
  source 1..20: note = Seed: SATGFKQSSKALQRPVASDF
SATGIKQVSGALNRPVASDF

SEQ ID NO: 15374 - protein, 20 aa, synthetic construct
  source 1..20: note = Seed: SATGFKQSSKALQRPVASDF
SATGIKQVSGALRRPVASDF

SEQ ID NO: 15375 - protein, 20 aa, synthetic construct
  source 1..20: note = Seed: SATGFKQSSKALQRPVASDF
SATGIKQVSGALSRPVASDF

SEQ ID NO: 15376 - protein, 20 aa, synthetic construct
  source 1..20: note = Seed: SATGFKQSSKALQRPVASDF
SATGIKQVSGALTRPVASDF

SEQ ID NO: 15377 - protein, 20 aa, synthetic construct
  source 1..20: note = Seed: SATGFKQSSKALQRPVASDF
SATGIKQVSGALVRPVASDF

SEQ ID NO: 15378 - protein, 20 aa, synthetic construct
  source 1..20: note = Seed: SATGFKQSSKALQRPVASDF
SATGIKQVSHALIRPVASDF

SEQ ID NO: 15379 - protein, 20 aa, synthetic construct
  source 1..20: note = Seed: SATGFKQSSKALQRPVASDF
SATGIKQVSHALKRPVASDF

SEQ ID NO: 15380 - protein, 20 aa, synthetic construct
  source 1..20: note = Seed: SATGFKQSSKALQRPVASDF
SATGIKQVSHALRRPVASDF

SEQ ID NO: 15381 - protein, 20 aa, synthetic construct
  source 1..20: note = Seed: SATGFKQSSKALQRPVASDF
SATGIKQVSIALARPVASDF

SEQ ID NO: 15382 - protein, 20 aa, synthetic construct
  source 1..20: note = Seed: SATGFKQSSKALQRPVASDF
SATGIKQVSIALGRPVASDF

SEQ ID NO: 15383 - protein, 20 aa, synthetic construct
  source 1..20: note = Seed: SATGFKQSSKALQRPVASDF
SATGIKQVSIALHRPVASDF

SEQ ID NO: 15384 - protein, 20 aa, synthetic construct
  source 1..20: note = Seed: SATGFKQSSKALQRPVASDF
SATGIKQVSIALLRPVASDF

SEQ ID NO: 15385 - protein, 20 aa, synthetic construct
  source 1..20: note = Seed: SATGFKQSSKALQRPVASDF
SATGIKQVSIALNRPVASDF

SEQ ID NO: 15386 - protein, 20 aa, synthetic construct
  source 1..20: note = Seed: SATGFKQSSKALQRPVASDF
SATGIKQVSIALRRPVASDF

SEQ ID NO: 15387 - protein, 20 aa, synthetic construct
  source 1..20: note = Seed: SATGFKQSSKALQRPVASDF
SATGIKQVSIALSRPVASDF

SEQ ID NO: 15388 - protein, 20 aa, synthetic construct
  source 1..20: note = Seed: SATGFKQSSKALQRPVASDF
SATGIKQVSKALARPVASDF

SEQ ID NO: 15389 - protein, 20 aa, synthetic construct
  source 1..20: note = Seed: SATGFKQSSKALQRPVASDF
SATGIKQVSKALFRPVASDF

SEQ ID NO: 15390 - protein, 20 aa, synthetic construct
  source 1..20: note = Seed: SATGFKQSSKALQRPVASDF
SATGIKQVSKALGRPVASDF

SEQ ID NO: 15391 - protein, 20 aa, synthetic construct
  source 1..20: note = Seed: SATGFKQSSKALQRPVASDF
SATGIKQVSKALHRPVASDF

SEQ ID NO: 15392 - protein, 20 aa, synthetic construct
  source 1..20: note = Seed: SATGFKQSSKALQRPVASDF
SATGIKQVSKALIRPVASDF

SEQ ID NO: 15393 - protein, 20 aa, synthetic construct
  source 1..20: note = Seed: SATGFKQSSKALQRPVASDF
SATGIKQVSKALKRPVASDF

SEQ ID NO: 15394 - protein, 20 aa, synthetic construct
  source 1..20: note = Seed: SATGFKQSSKALQRPVASDF
SATGIKQVSKALLRPVASDF

SEQ ID NO: 15395 - protein, 20 aa, synthetic construct
  source 1..20: note = Seed: SATGFKQSSKALQRPVASDF
SATGIKQVSKALMRPVASDF

SEQ ID NO: 15396 - protein, 20 aa, synthetic construct
  source 1..20: note = Seed: SATGFKQSSKALQRPVASDF
SATGIKQVSKALNRPVASDF

SEQ ID NO: 15397 - protein, 20 aa, synthetic construct
  source 1..20: note = Seed: SATGFKQSSKALQRPVASDF
SATGIKQVSKALPRPVASDF

SEQ ID NO: 15398 - protein, 20 aa, synthetic construct
  source 1..20: note = Seed: SATGFKQSSKALQRPVASDF
SATGIKQVSKALQRPVASDF

SEQ ID NO: 15399 - protein, 20 aa, synthetic construct
  source 1..20: note = Seed: SATGFKQSSKALQRPVASDF
SATGIKQVSKALRRPVASDF

SEQ ID NO: 15400 - protein, 20 aa, synthetic construct
  source 1..20: note = Seed: SATGFKQSSKALQRPVASDF
SATGIKQVSKALSRPVASDF

SEQ ID NO: 15401 - protein, 20 aa, synthetic construct
  source 1..20: note = Seed: SATGFKQSSKALQRPVASDF
SATGIKQVSKALTRPVASDF

SEQ ID NO: 15402 - protein, 20 aa, synthetic construct
  source 1..20: note = Seed: SATGFKQSSKALQRPVASDF
SATGIKQVSKALVRPVASDF

SEQ ID NO: 15403 - protein, 20 aa, synthetic construct
  source 1..20: note = Seed: SATGFKQSSKALQRPVASDF
SATGIKQVSKALYRPVASDF

SEQ ID NO: 15404 - protein, 20 aa, synthetic construct
  source 1..20: note = Seed: SATGFKQSSKALQRPVASDF
SATGIKQVSLALGRPVASDF

SEQ ID NO: 15405 - protein, 20 aa, synthetic construct
  source 1..20: note = Seed: SATGFKQSSKALQRPVASDF
SATGIKQVSLALHRPVASDF

SEQ ID NO: 15406 - protein, 20 aa, synthetic construct
  source 1..20: note = Seed: SATGFKQSSKALQRPVASDF
SATGIKQVSLALIRPVASDF

SEQ ID NO: 15407 - protein, 20 aa, synthetic construct
  source 1..20: note = Seed: SATGFKQSSKALQRPVASDF
SATGIKQVSLALLRPVASDF

SEQ ID NO: 15408 - protein, 20 aa, synthetic construct
  source 1..20: note = Seed: SATGFKQSSKALQRPVASDF
SATGIKQVSLALMRPVASDF

SEQ ID NO: 15409 - protein, 20 aa, synthetic construct
  source 1..20: note = Seed: SATGFKQSSKALQRPVASDF
SATGIKQVSLALNRPVASDF

SEQ ID NO: 15410 - protein, 20 aa, synthetic construct
  source 1..20: note = Seed: SATGFKQSSKALQRPVASDF
SATGIKQVSLALYRPVASDF

SEQ ID NO: 15411 - protein, 20 aa, synthetic construct
  source 1..20: note = Seed: SATGFKQSSKALQRPVASDF
SATGIKQVSMALHRPVASDF

SEQ ID NO: 15412 - protein, 20 aa, synthetic construct
  source 1..20: note = Seed: SATGFKQSSKALQRPVASDF
SATGIKQVSMALIRPVASDF

SEQ ID NO: 15413 - protein, 20 aa, synthetic construct
  source 1..20: note = Seed: SATGFKQSSKALQRPVASDF
SATGIKQVSMALLRPVASDF

SEQ ID NO: 15414 - protein, 20 aa, synthetic construct
  source 1..20: note = Seed: SATGFKQSSKALQRPVASDF
SATGIKQVSMALNRPVASDF

SEQ ID NO: 15415 - protein, 20 aa, synthetic construct
  source 1..20: note = Seed: SATGFKQSSKALQRPVASDF
SATGIKQVSNALARPVASDF

SEQ ID NO: 15416 - protein, 20 aa, synthetic construct
  source 1..20: note = Seed: SATGFKQSSKALQRPVASDF
SATGIKQVSNALGRPVASDF

SEQ ID NO: 15417 - protein, 20 aa, synthetic construct
  source 1..20: note = Seed: SATGFKQSSKALQRPVASDF
SATGIKQVSNALIRPVASDF

SEQ ID NO: 15418 - protein, 20 aa, synthetic construct
  source 1..20: note = Seed: SATGFKQSSKALQRPVASDF
SATGIKQVSNALLRPVASDF

SEQ ID NO: 15419 - protein, 20 aa, synthetic construct
  source 1..20: note = Seed: SATGFKQSSKALQRPVASDF
SATGIKQVSNALRRPVASDF

SEQ ID NO: 15420 - protein, 20 aa, synthetic construct
  source 1..20: note = Seed: SATGFKQSSKALQRPVASDF
SATGIKQVSNALSRPVASDF

SEQ ID NO: 15421 - protein, 20 aa, synthetic construct
  source 1..20: note = Seed: SATGFKQSSKALQRPVASDF
SATGIKQVSNALTRPVASDF

SEQ ID NO: 15422 - protein, 20 aa, synthetic construct
  source 1..20: note = Seed: SATGFKQSSKALQRPVASDF
SATGIKQVSNALVRPVASDF

SEQ ID NO: 15423 - protein, 20 aa, synthetic construct
  source 1..20: note = Seed: SATGFKQSSKALQRPVASDF
SATGIKQVSPALARPVASDF

SEQ ID NO: 15424 - protein, 20 aa, synthetic construct
  source 1..20: note = Seed: SATGFKQSSKALQRPVASDF
SATGIKQVSPALGRPVASDF

SEQ ID NO: 15425 - protein, 20 aa, synthetic construct
  source 1..20: note = Seed: SATGFKQSSKALQRPVASDF
SATGIKQVSPALIRPVASDF

SEQ ID NO: 15426 - protein, 20 aa, synthetic construct
  source 1..20: note = Seed: SATGFKQSSKALQRPVASDF
SATGIKQVSPALLRPVASDF

SEQ ID NO: 15427 - protein, 20 aa, synthetic construct
  source 1..20: note = Seed: SATGFKQSSKALQRPVASDF
SATGIKQVSPALMRPVASDF

SEQ ID NO: 15428 - protein, 20 aa, synthetic construct
  source 1..20: note = Seed: SATGFKQSSKALQRPVASDF
SATGIKQVSPALNRPVASDF

SEQ ID NO: 15429 - protein, 20 aa, synthetic construct
  source 1..20: note = Seed: SATGFKQSSKALQRPVASDF
SATGIKQVSPALSRPVASDF

SEQ ID NO: 15430 - protein, 20 aa, synthetic construct
  source 1..20: note = Seed: SATGFKQSSKALQRPVASDF
SATGIKQVSPALTRPVASDF

SEQ ID NO: 15431 - protein, 20 aa, synthetic construct
  source 1..20: note = Seed: SATGFKQSSKALQRPVASDF
SATGIKQVSPALVRPVASDF

SEQ ID NO: 15432 - protein, 20 aa, synthetic construct
  source 1..20: note = Seed: SATGFKQSSKALQRPVASDF
SATGIKQVSRALARPVASDF

SEQ ID NO: 15433 - protein, 20 aa, synthetic construct
  source 1..20: note = Seed: SATGFKQSSKALQRPVASDF
SATGIKQVSRALFRPVASDF

SEQ ID NO: 15434 - protein, 20 aa, synthetic construct
  source 1..20: note = Seed: SATGFKQSSKALQRPVASDF
SATGIKQVSRALGRPVASDF

SEQ ID NO: 15435 - protein, 20 aa, synthetic construct
  source 1..20: note = Seed: SATGFKQSSKALQRPVASDF
SATGIKQVSRALHRPVASDF

SEQ ID NO: 15436 - protein, 20 aa, synthetic construct
  source 1..20: note = Seed: SATGFKQSSKALQRPVASDF
SATGIKQVSRALIRPVASDF

SEQ ID NO: 15437 - protein, 20 aa, synthetic construct
  source 1..20: note = Seed: SATGFKQSSKALQRPVASDF
SATGIKQVSRALKRPVASDF

SEQ ID NO: 15438 - protein, 20 aa, synthetic construct
  source 1..20: note = Seed: SATGFKQSSKALQRPVASDF
SATGIKQVSRALLRPVASDF

SEQ ID NO: 15439 - protein, 20 aa, synthetic construct
  source 1..20: note = Seed: SATGFKQSSKALQRPVASDF
SATGIKQVSRALMRPVASDF

SEQ ID NO: 15440 - protein, 20 aa, synthetic construct
  source 1..20: note = Seed: SATGFKQSSKALQRPVASDF
SATGIKQVSRALNRPVASDF

SEQ ID NO: 15441 - protein, 20 aa, synthetic construct
  source 1..20: note = Seed: SATGFKQSSKALQRPVASDF
SATGIKQVSRALPRPVASDF

SEQ ID NO: 15442 - protein, 20 aa, synthetic construct
  source 1..20: note = Seed: SATGFKQSSKALQRPVASDF
SATGIKQVSRALQRPVASDF

SEQ ID NO: 15443 - protein, 20 aa, synthetic construct
  source 1..20: note = Seed: SATGFKQSSKALQRPVASDF
SATGIKQVSRALRRPVASDF

SEQ ID NO: 15444 - protein, 20 aa, synthetic construct
  source 1..20: note = Seed: SATGFKQSSKALQRPVASDF
SATGIKQVSRALSRPVASDF

SEQ ID NO: 15445 - protein, 20 aa, synthetic construct
  source 1..20: note = Seed: SATGFKQSSKALQRPVASDF
SATGIKQVSRALTRPVASDF

SEQ ID NO: 15446 - protein, 20 aa, synthetic construct
  source 1..20: note = Seed: SATGFKQSSKALQRPVASDF
SATGIKQVSRALVRPVASDF

SEQ ID NO: 15447 - protein, 20 aa, synthetic construct
  source 1..20: note = Seed: SATGFKQSSKALQRPVASDF
SATGIKQVSRALYRPVASDF

SEQ ID NO: 15448 - protein, 20 aa, synthetic construct
  source 1..20: note = Seed: SATGFKQSSKALQRPVASDF
SATGIKQVSSALARPVASDF

SEQ ID NO: 15449 - protein, 20 aa, synthetic construct
  source 1..20: note = Seed: SATGFKQSSKALQRPVASDF
SATGIKQVSSALIRPVASDF

SEQ ID NO: 15450 - protein, 20 aa, synthetic construct
  source 1..20: note = Seed: SATGFKQSSKALQRPVASDF
SATGIKQVSSALLRPVASDF

SEQ ID NO: 15451 - protein, 20 aa, synthetic construct
  source 1..20: note = Seed: SATGFKQSSKALQRPVASDF
SATGIKQVSSALMRPVASDF

SEQ ID NO: 15452 - protein, 20 aa, synthetic construct
  source 1..20: note = Seed: SATGFKQSSKALQRPVASDF
SATGIKQVSSALNRPVASDF

SEQ ID NO: 15453 - protein, 20 aa, synthetic construct
  source 1..20: note = Seed: SATGFKQSSKALQRPVASDF
SATGIKQVSSALRRPVASDF

SEQ ID NO: 15454 - protein, 20 aa, synthetic construct
  source 1..20: note = Seed: SATGFKQSSKALQRPVASDF
SATGIKQVSSALSRPVASDF

SEQ ID NO: 15455 - protein, 20 aa, synthetic construct
  source 1..20: note = Seed: SATGFKQSSKALQRPVASDF
SATGIKQVSSALTRPVASDF

SEQ ID NO: 15456 - protein, 20 aa, synthetic construct
  source 1..20: note = Seed: SATGFKQSSKALQRPVASDF
SATGIKQVSSALVRPVASDF

SEQ ID NO: 15457 - protein, 20 aa, synthetic construct
  source 1..20: note = Seed: SATGFKQSSKALQRPVASDF
SATGIKQVSTALARPVASDF

SEQ ID NO: 15458 - protein, 20 aa, synthetic construct
  source 1..20: note = Seed: SATGFKQSSKALQRPVASDF
SATGIKQVSTALIRPVASDF

SEQ ID NO: 15459 - protein, 20 aa, synthetic construct
  source 1..20: note = Seed: SATGFKQSSKALQRPVASDF
SATGIKQVSTALKRPVASDF

SEQ ID NO: 15460 - protein, 20 aa, synthetic construct
  source 1..20: note = Seed: SATGFKQSSKALQRPVASDF
SATGIKQVSTALLRPVASDF

SEQ ID NO: 15461 - protein, 20 aa, synthetic construct
  source 1..20: note = Seed: SATGFKQSSKALQRPVASDF
SATGIKQVSTALMRPVASDF

SEQ ID NO: 15462 - protein, 20 aa, synthetic construct
  source 1..20: note = Seed: SATGFKQSSKALQRPVASDF
SATGIKQVSTALNRPVASDF

SEQ ID NO: 15463 - protein, 20 aa, synthetic construct
  source 1..20: note = Seed: SATGFKQSSKALQRPVASDF
SATGIKQVSTALRRPVASDF

SEQ ID NO: 15464 - protein, 20 aa, synthetic construct
  source 1..20: note = Seed: SATGFKQSSKALQRPVASDF
SATGIKQVSTALSRPVASDF

SEQ ID NO: 15465 - protein, 20 aa, synthetic construct
  source 1..20: note = Seed: SATGFKQSSKALQRPVASDF
SATGIKQVSTALTRPVASDF

SEQ ID NO: 15466 - protein, 20 aa, synthetic construct
  source 1..20: note = Seed: SATGFKQSSKALQRPVASDF
SATGIKQVSTALVRPVASDF

SEQ ID NO: 15467 - protein, 20 aa, synthetic construct
  source 1..20: note = Seed: SATGFKQSSKALQRPVASDF
SATGIKQVSVALARPVASDF

SEQ ID NO: 15468 - protein, 20 aa, synthetic construct
  source 1..20: note = Seed: SATGFKQSSKALQRPVASDF
SATGIKQVSVALGRPVASDF

SEQ ID NO: 15469 - protein, 20 aa, synthetic construct
  source 1..20: note = Seed: SATGFKQSSKALQRPVASDF
SATGIKQVSVALHRPVASDF

SEQ ID NO: 15470 - protein, 20 aa, synthetic construct
  source 1..20: note = Seed: SATGFKQSSKALQRPVASDF
SATGIKQVSVALIRPVASDF

SEQ ID NO: 15471 - protein, 20 aa, synthetic construct
  source 1..20: note = Seed: SATGFKQSSKALQRPVASDF
SATGIKQVSVALNRPVASDF

SEQ ID NO: 15472 - protein, 20 aa, synthetic construct
  source 1..20: note = Seed: SATGFKQSSKALQRPVASDF
SATGIKQVSVALQRPVASDF

SEQ ID NO: 15473 - protein, 20 aa, synthetic construct
  source 1..20: note = Seed: SATGFKQSSKALQRPVASDF
SATGIKQVSVALRRPVASDF

SEQ ID NO: 15474 - protein, 20 aa, synthetic construct
  source 1..20: note = Seed: SATGFKQSSKALQRPVASDF
SATGIKQVSVALSRPVASDF

SEQ ID NO: 15475 - protein, 20 aa, synthetic construct
  source 1..20: note = Seed: SATGFKQSSKALQRPVASDF
SATGIKQVSVALTRPVASDF

SEQ ID NO: 15476 - protein, 20 aa, synthetic construct
  source 1..20: note = Seed: SATGFKQSSKALQRPVASDF
SATGIKQVSVALVRPVASDF

SEQ ID NO: 15477 - protein, 20 aa, synthetic construct
  source 1..20: note = Seed: SATGFKQSSKALQRPVASDF
SATGIKQVSYALVRPVASDF

SEQ ID NO: 15478 - protein, 20 aa, synthetic construct
  source 1..20: note = Seed: SATGFKQSSKALQRPVASDF
SATGIKQWSAALARPVASDF

SEQ ID NO: 15479 - protein, 20 aa, synthetic construct
  source 1..20: note = Seed: SATGFKQSSKALQRPVASDF
SATGIKQWSAALIRPVASDF

SEQ ID NO: 15480 - protein, 20 aa, synthetic construct
  source 1..20: note = Seed: SATGFKQSSKALQRPVASDF
SATGIKQWSAALLRPVASDF

SEQ ID NO: 15481 - protein, 20 aa, synthetic construct
  source 1..20: note = Seed: SATGFKQSSKALQRPVASDF
SATGIKQWSAALMRPVASDF

SEQ ID NO: 15482 - protein, 20 aa, synthetic construct
  source 1..20: note = Seed: SATGFKQSSKALQRPVASDF
SATGIKQWSAALRRPVASDF

SEQ ID NO: 15483 - protein, 20 aa, synthetic construct
  source 1..20: note = Seed: SATGFKQSSKALQRPVASDF
SATGIKQWSAALVRPVASDF

SEQ ID NO: 15484 - protein, 20 aa, synthetic construct
  source 1..20: note = Seed: SATGFKQSSKALQRPVASDF
SATGIKQWSFALIRPVASDF

SEQ ID NO: 15485 - protein, 20 aa, synthetic construct
  source 1..20: note = Seed: SATGFKQSSKALQRPVASDF
SATGIKQWSFALMRPVASDF

SEQ ID NO: 15486 - protein, 20 aa, synthetic construct
  source 1..20: note = Seed: SATGFKQSSKALQRPVASDF
SATGIKQWSFALVRPVASDF

SEQ ID NO: 15487 - protein, 20 aa, synthetic construct
  source 1..20: note = Seed: SATGFKQSSKALQRPVASDF
SATGIKQWSGALIRPVASDF

SEQ ID NO: 15488 - protein, 20 aa, synthetic construct
  source 1..20: note = Seed: SATGFKQSSKALQRPVASDF
SATGIKQWSGALLRPVASDF

SEQ ID NO: 15489 - protein, 20 aa, synthetic construct
  source 1..20: note = Seed: SATGFKQSSKALQRPVASDF
SATGIKQWSGALVRPVASDF

SEQ ID NO: 15490 - protein, 20 aa, synthetic construct
  source 1..20: note = Seed: SATGFKQSSKALQRPVASDF
SATGIKQWSHALRRPVASDF

SEQ ID NO: 15491 - protein, 20 aa, synthetic construct
  source 1..20: note = Seed: SATGFKQSSKALQRPVASDF
SATGIKQWSIALARPVASDF

SEQ ID NO: 15492 - protein, 20 aa, synthetic construct
  source 1..20: note = Seed: SATGFKQSSKALQRPVASDF
SATGIKQWSIALHRPVASDF

SEQ ID NO: 15493 - protein, 20 aa, synthetic construct
  source 1..20: note = Seed: SATGFKQSSKALQRPVASDF
SATGIKQWSIALIRPVASDF

SEQ ID NO: 15494 - protein, 20 aa, synthetic construct
  source 1..20: note = Seed: SATGFKQSSKALQRPVASDF
SATGIKQWSIALKRPVASDF

SEQ ID NO: 15495 - protein, 20 aa, synthetic construct
  source 1..20: note = Seed: SATGFKQSSKALQRPVASDF
SATGIKQWSIALMRPVASDF

SEQ ID NO: 15496 - protein, 20 aa, synthetic construct
  source 1..20: note = Seed: SATGFKQSSKALQRPVASDF
SATGIKQWSIALRRPVASDF

SEQ ID NO: 15497 - protein, 20 aa, synthetic construct
  source 1..20: note = Seed: SATGFKQSSKALQRPVASDF
SATGIKQWSKALARPVASDF

SEQ ID NO: 15498 - protein, 20 aa, synthetic construct
  source 1..20: note = Seed: SATGFKQSSKALQRPVASDF
SATGIKQWSKALFRPVASDF

SEQ ID NO: 15499 - protein, 20 aa, synthetic construct
  source 1..20: note = Seed: SATGFKQSSKALQRPVASDF
SATGIKQWSKALHRPVASDF

SEQ ID NO: 15500 - protein, 20 aa, synthetic construct
  source 1..20: note = Seed: SATGFKQSSKALQRPVASDF
SATGIKQWSKALIRPVASDF

SEQ ID NO: 15501 - protein, 20 aa, synthetic construct
  source 1..20: note = Seed: SATGFKQSSKALQRPVASDF
SATGIKQWSKALKRPVASDF

SEQ ID NO: 15502 - protein, 20 aa, synthetic construct
  source 1..20: note = Seed: SATGFKQSSKALQRPVASDF
SATGIKQWSKALLRPVASDF

SEQ ID NO: 15503 - protein, 20 aa, synthetic construct
  source 1..20: note = Seed: SATGFKQSSKALQRPVASDF
SATGIKQWSKALMRPVASDF

SEQ ID NO: 15504 - protein, 20 aa, synthetic construct
  source 1..20: note = Seed: SATGFKQSSKALQRPVASDF
SATGIKQWSKALRRPVASDF

SEQ ID NO: 15505 - protein, 20 aa, synthetic construct
  source 1..20: note = Seed: SATGFKQSSKALQRPVASDF
SATGIKQWSKALSRPVASDF

SEQ ID NO: 15506 - protein, 20 aa, synthetic construct
  source 1..20: note = Seed: SATGFKQSSKALQRPVASDF
SATGIKQWSKALVRPVASDF

SEQ ID NO: 15507 - protein, 20 aa, synthetic construct
  source 1..20: note = Seed: SATGFKQSSKALQRPVASDF
SATGIKQWSKALYRPVASDF

SEQ ID NO: 15508 - protein, 20 aa, synthetic construct
  source 1..20: note = Seed: SATGFKQSSKALQRPVASDF
SATGIKQWSLALARPVASDF

SEQ ID NO: 15509 - protein, 20 aa, synthetic construct
  source 1..20: note = Seed: SATGFKQSSKALQRPVASDF
SATGIKQWSLALIRPVASDF

SEQ ID NO: 15510 - protein, 20 aa, synthetic construct
  source 1..20: note = Seed: SATGFKQSSKALQRPVASDF
SATGIKQWSLALLRPVASDF

SEQ ID NO: 15511 - protein, 20 aa, synthetic construct
  source 1..20: note = Seed: SATGFKQSSKALQRPVASDF
SATGIKQWSLALMRPVASDF

SEQ ID NO: 15512 - protein, 20 aa, synthetic construct
  source 1..20: note = Seed: SATGFKQSSKALQRPVASDF
SATGIKQWSLALRRPVASDF

SEQ ID NO: 15513 - protein, 20 aa, synthetic construct
  source 1..20: note = Seed: SATGFKQSSKALQRPVASDF
SATGIKQWSLALVRPVASDF

SEQ ID NO: 15514 - protein, 20 aa, synthetic construct
  source 1..20: note = Seed: SATGFKQSSKALQRPVASDF
SATGIKQWSMALARPVASDF

SEQ ID NO: 15515 - protein, 20 aa, synthetic construct
  source 1..20: note = Seed: SATGFKQSSKALQRPVASDF
SATGIKQWSMALIRPVASDF

SEQ ID NO: 15516 - protein, 20 aa, synthetic construct
  source 1..20: note = Seed: SATGFKQSSKALQRPVASDF
SATGIKQWSMALMRPVASDF

SEQ ID NO: 15517 - protein, 20 aa, synthetic construct
  source 1..20: note = Seed: SATGFKQSSKALQRPVASDF
SATGIKQWSMALRRPVASDF

SEQ ID NO: 15518 - protein, 20 aa, synthetic construct
  source 1..20: note = Seed: SATGFKQSSKALQRPVASDF
SATGIKQWSNALIRPVASDF

SEQ ID NO: 15519 - protein, 20 aa, synthetic construct
  source 1..20: note = Seed: SATGFKQSSKALQRPVASDF
SATGIKQWSNALVRPVASDF

SEQ ID NO: 15520 - protein, 20 aa, synthetic construct
  source 1..20: note = Seed: SATGFKQSSKALQRPVASDF
SATGIKQWSPALIRPVASDF

SEQ ID NO: 15521 - protein, 20 aa, synthetic construct
  source 1..20: note = Seed: SATGFKQSSKALQRPVASDF
SATGIKQWSPALLRPVASDF

SEQ ID NO: 15522 - protein, 20 aa, synthetic construct
  source 1..20: note = Seed: SATGFKQSSKALQRPVASDF
SATGIKQWSPALMRPVASDF

SEQ ID NO: 15523 - protein, 20 aa, synthetic construct
  source 1..20: note = Seed: SATGFKQSSKALQRPVASDF
SATGIKQWSPALNRPVASDF

SEQ ID NO: 15524 - protein, 20 aa, synthetic construct
  source 1..20: note = Seed: SATGFKQSSKALQRPVASDF
SATGIKQWSPALRRPVASDF

SEQ ID NO: 15525 - protein, 20 aa, synthetic construct
  source 1..20: note = Seed: SATGFKQSSKALQRPVASDF
SATGIKQWSPALVRPVASDF

SEQ ID NO: 15526 - protein, 20 aa, synthetic construct
  source 1..20: note = Seed: SATGFKQSSKALQRPVASDF
SATGIKQWSRALARPVASDF

SEQ ID NO: 15527 - protein, 20 aa, synthetic construct
  source 1..20: note = Seed: SATGFKQSSKALQRPVASDF
SATGIKQWSRALFRPVASDF

SEQ ID NO: 15528 - protein, 20 aa, synthetic construct
  source 1..20: note = Seed: SATGFKQSSKALQRPVASDF
SATGIKQWSRALHRPVASDF

SEQ ID NO: 15529 - protein, 20 aa, synthetic construct
  source 1..20: note = Seed: SATGFKQSSKALQRPVASDF
SATGIKQWSRALIRPVASDF

SEQ ID NO: 15530 - protein, 20 aa, synthetic construct
  source 1..20: note = Seed: SATGFKQSSKALQRPVASDF
SATGIKQWSRALKRPVASDF

SEQ ID NO: 15531 - protein, 20 aa, synthetic construct
  source 1..20: note = Seed: SATGFKQSSKALQRPVASDF
SATGIKQWSRALLRPVASDF

SEQ ID NO: 15532 - protein, 20 aa, synthetic construct
  source 1..20: note = Seed: SATGFKQSSKALQRPVASDF
SATGIKQWSRALMRPVASDF

SEQ ID NO: 15533 - protein, 20 aa, synthetic construct
  source 1..20: note = Seed: SATGFKQSSKALQRPVASDF
SATGIKQWSRALQRPVASDF

SEQ ID NO: 15534 - protein, 20 aa, synthetic construct
  source 1..20: note = Seed: SATGFKQSSKALQRPVASDF
SATGIKQWSRALRRPVASDF

SEQ ID NO: 15535 - protein, 20 aa, synthetic construct
  source 1..20: note = Seed: SATGFKQSSKALQRPVASDF
SATGIKQWSRALSRPVASDF

SEQ ID NO: 15536 - protein, 20 aa, synthetic construct
  source 1..20: note = Seed: SATGFKQSSKALQRPVASDF
SATGIKQWSRALTRPVASDF

SEQ ID NO: 15537 - protein, 20 aa, synthetic construct
  source 1..20: note = Seed: SATGFKQSSKALQRPVASDF
SATGIKQWSRALVRPVASDF

SEQ ID NO: 15538 - protein, 20 aa, synthetic construct
  source 1..20: note = Seed: SATGFKQSSKALQRPVASDF
SATGIKQWSRALYRPVASDF

SEQ ID NO: 15539 - protein, 20 aa, synthetic construct
  source 1..20: note = Seed: SATGFKQSSKALQRPVASDF
SATGIKQWSSALARPVASDF

SEQ ID NO: 15540 - protein, 20 aa, synthetic construct
  source 1..20: note = Seed: SATGFKQSSKALQRPVASDF
SATGIKQWSSALIRPVASDF

SEQ ID NO: 15541 - protein, 20 aa, synthetic construct
  source 1..20: note = Seed: SATGFKQSSKALQRPVASDF
SATGIKQWSSALLRPVASDF

SEQ ID NO: 15542 - protein, 20 aa, synthetic construct
  source 1..20: note = Seed: SATGFKQSSKALQRPVASDF
SATGIKQWSSALMRPVASDF

SEQ ID NO: 15543 - protein, 20 aa, synthetic construct
  source 1..20: note = Seed: SATGFKQSSKALQRPVASDF
SATGIKQWSSALRRPVASDF

SEQ ID NO: 15544 - protein, 20 aa, synthetic construct
  source 1..20: note = Seed: SATGFKQSSKALQRPVASDF
SATGIKQWSTALIRPVASDF

SEQ ID NO: 15545 - protein, 20 aa, synthetic construct
  source 1..20: note = Seed: SATGFKQSSKALQRPVASDF
SATGIKQWSTALLRPVASDF

SEQ ID NO: 15546 - protein, 20 aa, synthetic construct
  source 1..20: note = Seed: SATGFKQSSKALQRPVASDF
SATGIKQWSTALMRPVASDF

SEQ ID NO: 15547 - protein, 20 aa, synthetic construct
  source 1..20: note = Seed: SATGFKQSSKALQRPVASDF
SATGIKQWSTALRRPVASDF

SEQ ID NO: 15548 - protein, 20 aa, synthetic construct
  source 1..20: note = Seed: SATGFKQSSKALQRPVASDF
SATGIKQWSVALHRPVASDF

SEQ ID NO: 15549 - protein, 20 aa, synthetic construct
  source 1..20: note = Seed: SATGFKQSSKALQRPVASDF
SATGIKQWSVALRRPVASDF

SEQ ID NO: 15550 - protein, 20 aa, synthetic construct
  source 1..20: note = Seed: SATGFKQSSKALQRPVASDF
SATGIKQYSAALARPVASDF

SEQ ID NO: 15551 - protein, 20 aa, synthetic construct
  source 1..20: note = Seed: SATGFKQSSKALQRPVASDF
SATGIKQYSAALGRPVASDF

SEQ ID NO: 15552 - protein, 20 aa, synthetic construct
  source 1..20: note = Seed: SATGFKQSSKALQRPVASDF
SATGIKQYSAALIRPVASDF

SEQ ID NO: 15553 - protein, 20 aa, synthetic construct
  source 1..20: note = Seed: SATGFKQSSKALQRPVASDF
SATGIKQYSAALKRPVASDF

SEQ ID NO: 15554 - protein, 20 aa, synthetic construct
  source 1..20: note = Seed: SATGFKQSSKALQRPVASDF
SATGIKQYSAALLRPVASDF

SEQ ID NO: 15555 - protein, 20 aa, synthetic construct
  source 1..20: note = Seed: SATGFKQSSKALQRPVASDF
SATGIKQYSAALRRPVASDF

SEQ ID NO: 15556 - protein, 20 aa, synthetic construct
  source 1..20: note = Seed: SATGFKQSSKALQRPVASDF
SATGIKQYSAALVRPVASDF

SEQ ID NO: 15557 - protein, 20 aa, synthetic construct
  source 1..20: note = Seed: SATGFKQSSKALQRPVASDF
SATGIKQYSGALARPVASDF

SEQ ID NO: 15558 - protein, 20 aa, synthetic construct
  source 1..20: note = Seed: SATGFKQSSKALQRPVASDF
SATGIKQYSGALIRPVASDF

SEQ ID NO: 15559 - protein, 20 aa, synthetic construct
  source 1..20: note = Seed: SATGFKQSSKALQRPVASDF
SATGIKQYSGALLRPVASDF

SEQ ID NO: 15560 - protein, 20 aa, synthetic construct
  source 1..20: note = Seed: SATGFKQSSKALQRPVASDF
SATGIKQYSGALMRPVASDF

SEQ ID NO: 15561 - protein, 20 aa, synthetic construct
  source 1..20: note = Seed: SATGFKQSSKALQRPVASDF
SATGIKQYSGALSRPVASDF

SEQ ID NO: 15562 - protein, 20 aa, synthetic construct
  source 1..20: note = Seed: SATGFKQSSKALQRPVASDF
SATGIKQYSHALRRPVASDF

SEQ ID NO: 15563 - protein, 20 aa, synthetic construct
  source 1..20: note = Seed: SATGFKQSSKALQRPVASDF
SATGIKQYSIALHRPVASDF

SEQ ID NO: 15564 - protein, 20 aa, synthetic construct
  source 1..20: note = Seed: SATGFKQSSKALQRPVASDF
SATGIKQYSIALKRPVASDF

SEQ ID NO: 15565 - protein, 20 aa, synthetic construct
  source 1..20: note = Seed: SATGFKQSSKALQRPVASDF
SATGIKQYSIALRRPVASDF

SEQ ID NO: 15566 - protein, 20 aa, synthetic construct
  source 1..20: note = Seed: SATGFKQSSKALQRPVASDF
SATGIKQYSKALARPVASDF

SEQ ID NO: 15567 - protein, 20 aa, synthetic construct
  source 1..20: note = Seed: SATGFKQSSKALQRPVASDF
SATGIKQYSKALHRPVASDF

SEQ ID NO: 15568 - protein, 20 aa, synthetic construct
  source 1..20: note = Seed: SATGFKQSSKALQRPVASDF
SATGIKQYSKALKRPVASDF

SEQ ID NO: 15569 - protein, 20 aa, synthetic construct
  source 1..20: note = Seed: SATGFKQSSKALQRPVASDF
SATGIKQYSKALRRPVASDF

SEQ ID NO: 15570 - protein, 20 aa, synthetic construct
  source 1..20: note = Seed: SATGFKQSSKALQRPVASDF
SATGIKQYSKALSRPVASDF

SEQ ID NO: 15571 - protein, 20 aa, synthetic construct
  source 1..20: note = Seed: SATGFKQSSKALQRPVASDF
SATGIKQYSLALARPVASDF

SEQ ID NO: 15572 - protein, 20 aa, synthetic construct
  source 1..20: note = Seed: SATGFKQSSKALQRPVASDF
SATGIKQYSLALMRPVASDF

SEQ ID NO: 15573 - protein, 20 aa, synthetic construct
  source 1..20: note = Seed: SATGFKQSSKALQRPVASDF
SATGIKQYSLALRRPVASDF

SEQ ID NO: 15574 - protein, 20 aa, synthetic construct
  source 1..20: note = Seed: SATGFKQSSKALQRPVASDF
SATGIKQYSLALYRPVASDF

SEQ ID NO: 15575 - protein, 20 aa, synthetic construct
  source 1..20: note = Seed: SATGFKQSSKALQRPVASDF
SATGIKQYSMALRRPVASDF

SEQ ID NO: 15576 - protein, 20 aa, synthetic construct
  source 1..20: note = Seed: SATGFKQSSKALQRPVASDF
SATGIKQYSNALARPVASDF

SEQ ID NO: 15577 - protein, 20 aa, synthetic construct
  source 1..20: note = Seed: SATGFKQSSKALQRPVASDF
SATGIKQYSNALLRPVASDF

SEQ ID NO: 15578 - protein, 20 aa, synthetic construct
  source 1..20: note = Seed: SATGFKQSSKALQRPVASDF
SATGIKQYSNALMRPVASDF

SEQ ID NO: 15579 - protein, 20 aa, synthetic construct
  source 1..20: note = Seed: SATGFKQSSKALQRPVASDF
SATGIKQYSPALLRPVASDF

SEQ ID NO: 15580 - protein, 20 aa, synthetic construct
  source 1..20: note = Seed: SATGFKQSSKALQRPVASDF
SATGIKQYSRALARPVASDF

SEQ ID NO: 15581 - protein, 20 aa, synthetic construct
  source 1..20: note = Seed: SATGFKQSSKALQRPVASDF
SATGIKQYSRALHRPVASDF

SEQ ID NO: 15582 - protein, 20 aa, synthetic construct
  source 1..20: note = Seed: SATGFKQSSKALQRPVASDF
SATGIKQYSRALKRPVASDF

SEQ ID NO: 15583 - protein, 20 aa, synthetic construct
  source 1..20: note = Seed: SATGFKQSSKALQRPVASDF
SATGIKQYSRALRRPVASDF

SEQ ID NO: 15584 - protein, 20 aa, synthetic construct
  source 1..20: note = Seed: SATGFKQSSKALQRPVASDF
SATGIKQYSRALSRPVASDF

SEQ ID NO: 15585 - protein, 20 aa, synthetic construct
  source 1..20: note = Seed: SATGFKQSSKALQRPVASDF
SATGIKQYSRALYRPVASDF

SEQ ID NO: 15586 - protein, 20 aa, synthetic construct
  source 1..20: note = Seed: SATGFKQSSKALQRPVASDF
SATGIKQYSSALARPVASDF

SEQ ID NO: 15587 - protein, 20 aa, synthetic construct
  source 1..20: note = Seed: SATGFKQSSKALQRPVASDF
SATGIKQYSSALGRPVASDF

SEQ ID NO: 15588 - protein, 20 aa, synthetic construct
  source 1..20: note = Seed: SATGFKQSSKALQRPVASDF
SATGIKQYSSALLRPVASDF

SEQ ID NO: 15589 - protein, 20 aa, synthetic construct
  source 1..20: note = Seed: SATGFKQSSKALQRPVASDF
SATGIKQYSSALRRPVASDF

SEQ ID NO: 15590 - protein, 20 aa, synthetic construct
  source 1..20: note = Seed: SATGFKQSSKALQRPVASDF
SATGIKQYSSALTRPVASDF

SEQ ID NO: 15591 - protein, 20 aa, synthetic construct
  source 1..20: note = Seed: SATGFKQSSKALQRPVASDF
SATGIKQYSSALVRPVASDF

SEQ ID NO: 15592 - protein, 20 aa, synthetic construct
  source 1..20: note = Seed: SATGFKQSSKALQRPVASDF
SATGIKQYSTALARPVASDF

SEQ ID NO: 15593 - protein, 20 aa, synthetic construct
  source 1..20: note = Seed: SATGFKQSSKALQRPVASDF
SATGIKQYSTALGRPVASDF

SEQ ID NO: 15594 - protein, 20 aa, synthetic construct
  source 1..20: note = Seed: SATGFKQSSKALQRPVASDF
SATGIKQYSTALRRPVASDF

SEQ ID NO: 15595 - protein, 20 aa, synthetic construct
  source 1..20: note = Seed: SATGFKQSSKALQRPVASDF
SATGIKQYSVALRRPVASDF

SEQ ID NO: 15596 - protein, 20 aa, synthetic construct
  source 1..20: note = Seed: SATGFKQSSKALQRPVASDF
SATGKKQASFALARPVASDF

SEQ ID NO: 15597 - protein, 20 aa, synthetic construct
  source 1..20: note = Seed: SATGFKQSSKALQRPVASDF
SATGKKQFSIALARPVASDF

SEQ ID NO: 15598 - protein, 20 aa, synthetic construct
  source 1..20: note = Seed: SATGFKQSSKALQRPVASDF
SATGKKQFSIALSRPVASDF

SEQ ID NO: 15599 - protein, 20 aa, synthetic construct
  source 1..20: note = Seed: SATGFKQSSKALQRPVASDF
SATGKKQFSIALVRPVASDF

SEQ ID NO: 15600 - protein, 20 aa, synthetic construct
  source 1..20: note = Seed: SATGFKQSSKALQRPVASDF
SATGKKQFSLALARPVASDF

SEQ ID NO: 15601 - protein, 20 aa, synthetic construct
  source 1..20: note = Seed: SATGFKQSSKALQRPVASDF
SATGKKQFSLALMRPVASDF

SEQ ID NO: 15602 - protein, 20 aa, synthetic construct
  source 1..20: note = Seed: SATGFKQSSKALQRPVASDF
SATGKKQFSLALSRPVASDF

SEQ ID NO: 15603 - protein, 20 aa, synthetic construct
  source 1..20: note = Seed: SATGFKQSSKALQRPVASDF
SATGKKQFSLALVRPVASDF

SEQ ID NO: 15604 - protein, 20 aa, synthetic construct
  source 1..20: note = Seed: SATGFKQSSKALQRPVASDF
SATGKKQFSMALARPVASDF

SEQ ID NO: 15605 - protein, 20 aa, synthetic construct
  source 1..20: note = Seed: SATGFKQSSKALQRPVASDF
SATGKKQFSVALARPVASDF

SEQ ID NO: 15606 - protein, 20 aa, synthetic construct
  source 1..20: note = Seed: SATGFKQSSKALQRPVASDF
SATGKKQISMALARPVASDF

SEQ ID NO: 15607 - protein, 20 aa, synthetic construct
  source 1..20: note = Seed: SATGFKQSSKALQRPVASDF
SATGKKQLSAALLRPVASDF

SEQ ID NO: 15608 - protein, 20 aa, synthetic construct
  source 1..20: note = Seed: SATGFKQSSKALQRPVASDF
SATGKKQLSGALIRPVASDF

SEQ ID NO: 15609 - protein, 20 aa, synthetic construct
  source 1..20: note = Seed: SATGFKQSSKALQRPVASDF
SATGKKQLSGALVRPVASDF

SEQ ID NO: 15610 - protein, 20 aa, synthetic construct
  source 1..20: note = Seed: SATGFKQSSKALQRPVASDF
SATGKKQLSIALARPVASDF

SEQ ID NO: 15611 - protein, 20 aa, synthetic construct
  source 1..20: note = Seed: SATGFKQSSKALQRPVASDF
SATGKKQLSLALARPVASDF

SEQ ID NO: 15612 - protein, 20 aa, synthetic construct
  source 1..20: note = Seed: SATGFKQSSKALQRPVASDF
SATGKKQMSAALLRPVASDF

SEQ ID NO: 15613 - protein, 20 aa, synthetic construct
  source 1..20: note = Seed: SATGFKQSSKALQRPVASDF
SATGKKQMSAALMRPVASDF

SEQ ID NO: 15614 - protein, 20 aa, synthetic construct
  source 1..20: note = Seed: SATGFKQSSKALQRPVASDF
SATGKKQMSGALIRPVASDF

SEQ ID NO: 15615 - protein, 20 aa, synthetic construct
  source 1..20: note = Seed: SATGFKQSSKALQRPVASDF
SATGKKQMSGALVRPVASDF

SEQ ID NO: 15616 - protein, 20 aa, synthetic construct
  source 1..20: note = Seed: SATGFKQSSKALQRPVASDF
SATGKKQWSIALARPVASDF

SEQ ID NO: 15617 - protein, 20 aa, synthetic construct
  source 1..20: note = Seed: SATGFKQSSKALQRPVASDF
SATGKKQWSLALARPVASDF

SEQ ID NO: 15618 - protein, 20 aa, synthetic construct
  source 1..20: note = Seed: SATGFKQSSKALQRPVASDF
SATGKKQYSIALARPVASDF

SEQ ID NO: 15619 - protein, 20 aa, synthetic construct
  source 1..20: note = Seed: SATGFKQSSKALQRPVASDF
SATGKKQYSLALARPVASDF

SEQ ID NO: 15620 - protein, 20 aa, synthetic construct
  source 1..20: note = Seed: SATGFKQSSKALQRPVASDF
SATGKKQYSVALARPVASDF

SEQ ID NO: 15621 - protein, 20 aa, synthetic construct
  source 1..20: note = Seed: SATGFKQSSKALQRPVASDF
SATGLKQASAALARPVASDF

SEQ ID NO: 15622 - protein, 20 aa, synthetic construct
  source 1..20: note = Seed: SATGFKQSSKALQRPVASDF
SATGLKQASAALCRPVASDF

SEQ ID NO: 15623 - protein, 20 aa, synthetic construct
  source 1..20: note = Seed: SATGFKQSSKALQRPVASDF
SATGLKQASAALFRPVASDF

SEQ ID NO: 15624 - protein, 20 aa, synthetic construct
  source 1..20: note = Seed: SATGFKQSSKALQRPVASDF
SATGLKQASAALGRPVASDF

SEQ ID NO: 15625 - protein, 20 aa, synthetic construct
  source 1..20: note = Seed: SATGFKQSSKALQRPVASDF
SATGLKQASAALHRPVASDF

SEQ ID NO: 15626 - protein, 20 aa, synthetic construct
  source 1..20: note = Seed: SATGFKQSSKALQRPVASDF
SATGLKQASAALIRPVASDF

SEQ ID NO: 15627 - protein, 20 aa, synthetic construct
  source 1..20: note = Seed: SATGFKQSSKALQRPVASDF
SATGLKQASAALLRPVASDF

SEQ ID NO: 15628 - protein, 20 aa, synthetic construct
  source 1..20: note = Seed: SATGFKQSSKALQRPVASDF
SATGLKQASAALMRPVASDF

SEQ ID NO: 15629 - protein, 20 aa, synthetic construct
  source 1..20: note = Seed: SATGFKQSSKALQRPVASDF
SATGLKQASAALNRPVASDF

SEQ ID NO: 15630 - protein, 20 aa, synthetic construct
  source 1..20: note = Seed: SATGFKQSSKALQRPVASDF
SATGLKQASAALQRPVASDF

SEQ ID NO: 15631 - protein, 20 aa, synthetic construct
  source 1..20: note = Seed: SATGFKQSSKALQRPVASDF
SATGLKQASAALSRPVASDF

SEQ ID NO: 15632 - protein, 20 aa, synthetic construct
  source 1..20: note = Seed: SATGFKQSSKALQRPVASDF
SATGLKQASAALTRPVASDF

SEQ ID NO: 15633 - protein, 20 aa, synthetic construct
  source 1..20: note = Seed: SATGFKQSSKALQRPVASDF
SATGLKQASAALVRPVASDF

SEQ ID NO: 15634 - protein, 20 aa, synthetic construct
  source 1..20: note = Seed: SATGFKQSSKALQRPVASDF
SATGLKQASFALARPVASDF

SEQ ID NO: 15635 - protein, 20 aa, synthetic construct
  source 1..20: note = Seed: SATGFKQSSKALQRPVASDF
SATGLKQASFALDRPVASDF

SEQ ID NO: 15636 - protein, 20 aa, synthetic construct
  source 1..20: note = Seed: SATGFKQSSKALQRPVASDF
SATGLKQASFALERPVASDF

SEQ ID NO: 15637 - protein, 20 aa, synthetic construct
  source 1..20: note = Seed: SATGFKQSSKALQRPVASDF
SATGLKQASFALFRPVASDF

SEQ ID NO: 15638 - protein, 20 aa, synthetic construct
  source 1..20: note = Seed: SATGFKQSSKALQRPVASDF
SATGLKQASFALIRPVASDF

SEQ ID NO: 15639 - protein, 20 aa, synthetic construct
  source 1..20: note = Seed: SATGFKQSSKALQRPVASDF
SATGLKQASFALLRPVASDF

SEQ ID NO: 15640 - protein, 20 aa, synthetic construct
  source 1..20: note = Seed: SATGFKQSSKALQRPVASDF
SATGLKQASFALMRPVASDF

SEQ ID NO: 15641 - protein, 20 aa, synthetic construct
  source 1..20: note = Seed: SATGFKQSSKALQRPVASDF
SATGLKQASFALVRPVASDF

SEQ ID NO: 15642 - protein, 20 aa, synthetic construct
  source 1..20: note = Seed: SATGFKQSSKALQRPVASDF
SATGLKQASGALARPVASDF

SEQ ID NO: 15643 - protein, 20 aa, synthetic construct
  source 1..20: note = Seed: SATGFKQSSKALQRPVASDF
SATGLKQASGALGRPVASDF

SEQ ID NO: 15644 - protein, 20 aa, synthetic construct
  source 1..20: note = Seed: SATGFKQSSKALQRPVASDF
SATGLKQASGALIRPVASDF

SEQ ID NO: 15645 - protein, 20 aa, synthetic construct
  source 1..20: note = Seed: SATGFKQSSKALQRPVASDF
SATGLKQASGALLRPVASDF

SEQ ID NO: 15646 - protein, 20 aa, synthetic construct
  source 1..20: note = Seed: SATGFKQSSKALQRPVASDF
SATGLKQASGALMRPVASDF

SEQ ID NO: 15647 - protein, 20 aa, synthetic construct
  source 1..20: note = Seed: SATGFKQSSKALQRPVASDF
SATGLKQASGALNRPVASDF

SEQ ID NO: 15648 - protein, 20 aa, synthetic construct
  source 1..20: note = Seed: SATGFKQSSKALQRPVASDF
SATGLKQASGALSRPVASDF

SEQ ID NO: 15649 - protein, 20 aa, synthetic construct
  source 1..20: note = Seed: SATGFKQSSKALQRPVASDF
SATGLKQASGALTRPVASDF

SEQ ID NO: 15650 - protein, 20 aa, synthetic construct
  source 1..20: note = Seed: SATGFKQSSKALQRPVASDF
SATGLKQASGALVRPVASDF

SEQ ID NO: 15651 - protein, 20 aa, synthetic construct
  source 1..20: note = Seed: SATGFKQSSKALQRPVASDF
SATGLKQASIALARPVASDF

SEQ ID NO: 15652 - protein, 20 aa, synthetic construct
  source 1..20: note = Seed: SATGFKQSSKALQRPVASDF
SATGLKQASIALGRPVASDF

SEQ ID NO: 15653 - protein, 20 aa, synthetic construct
  source 1..20: note = Seed: SATGFKQSSKALQRPVASDF
SATGLKQASIALHRPVASDF

SEQ ID NO: 15654 - protein, 20 aa, synthetic construct
  source 1..20: note = Seed: SATGFKQSSKALQRPVASDF
SATGLKQASIALNRPVASDF

SEQ ID NO: 15655 - protein, 20 aa, synthetic construct
  source 1..20: note = Seed: SATGFKQSSKALQRPVASDF
SATGLKQASIALSRPVASDF

SEQ ID NO: 15656 - protein, 20 aa, synthetic construct
  source 1..20: note = Seed: SATGFKQSSKALQRPVASDF
SATGLKQASIALTRPVASDF

SEQ ID NO: 15657 - protein, 20 aa, synthetic construct
  source 1..20: note = Seed: SATGFKQSSKALQRPVASDF
SATGLKQASKALARPVASDF

SEQ ID NO: 15658 - protein, 20 aa, synthetic construct
  source 1..20: note = Seed: SATGFKQSSKALQRPVASDF
SATGLKQASKALGRPVASDF

SEQ ID NO: 15659 - protein, 20 aa, synthetic construct
  source 1..20: note = Seed: SATGFKQSSKALQRPVASDF
SATGLKQASKALHRPVASDF

SEQ ID NO: 15660 - protein, 20 aa, synthetic construct
  source 1..20: note = Seed: SATGFKQSSKALQRPVASDF
SATGLKQASKALKRPVASDF

SEQ ID NO: 15661 - protein, 20 aa, synthetic construct
  source 1..20: note = Seed: SATGFKQSSKALQRPVASDF
SATGLKQASKALQRPVASDF

SEQ ID NO: 15662 - protein, 20 aa, synthetic construct
  source 1..20: note = Seed: SATGFKQSSKALQRPVASDF
SATGLKQASKALRRPVASDF

SEQ ID NO: 15663 - protein, 20 aa, synthetic construct
  source 1..20: note = Seed: SATGFKQSSKALQRPVASDF
SATGLKQASKALSRPVASDF

SEQ ID NO: 15664 - protein, 20 aa, synthetic construct
  source 1..20: note = Seed: SATGFKQSSKALQRPVASDF
SATGLKQASKALTRPVASDF

SEQ ID NO: 15665 - protein, 20 aa, synthetic construct
  source 1..20: note = Seed: SATGFKQSSKALQRPVASDF
SATGLKQASKALVRPVASDF

SEQ ID NO: 15666 - protein, 20 aa, synthetic construct
  source 1..20: note = Seed: SATGFKQSSKALQRPVASDF
SATGLKQASLALARPVASDF

SEQ ID NO: 15667 - protein, 20 aa, synthetic construct
  source 1..20: note = Seed: SATGFKQSSKALQRPVASDF
SATGLKQASLALNRPVASDF

SEQ ID NO: 15668 - protein, 20 aa, synthetic construct
  source 1..20: note = Seed: SATGFKQSSKALQRPVASDF
SATGLKQASMALNRPVASDF

SEQ ID NO: 15669 - protein, 20 aa, synthetic construct
  source 1..20: note = Seed: SATGFKQSSKALQRPVASDF
SATGLKQASMALSRPVASDF

SEQ ID NO: 15670 - protein, 20 aa, synthetic construct
  source 1..20: note = Seed: SATGFKQSSKALQRPVASDF
SATGLKQASMALVRPVASDF

SEQ ID NO: 15671 - protein, 20 aa, synthetic construct
  source 1..20: note = Seed: SATGFKQSSKALQRPVASDF
SATGLKQASNALARPVASDF

SEQ ID NO: 15672 - protein, 20 aa, synthetic construct
  source 1..20: note = Seed: SATGFKQSSKALQRPVASDF
SATGLKQASNALIRPVASDF

SEQ ID NO: 15673 - protein, 20 aa, synthetic construct
  source 1..20: note = Seed: SATGFKQSSKALQRPVASDF
SATGLKQASNALLRPVASDF

SEQ ID NO: 15674 - protein, 20 aa, synthetic construct
  source 1..20: note = Seed: SATGFKQSSKALQRPVASDF
SATGLKQASNALNRPVASDF

SEQ ID NO: 15675 - protein, 20 aa, synthetic construct
  source 1..20: note = Seed: SATGFKQSSKALQRPVASDF
SATGLKQASNALSRPVASDF

SEQ ID NO: 15676 - protein, 20 aa, synthetic construct
  source 1..20: note = Seed: SATGFKQSSKALQRPVASDF
SATGLKQASNALVRPVASDF

SEQ ID NO: 15677 - protein, 20 aa, synthetic construct
  source 1..20: note = Seed: SATGFKQSSKALQRPVASDF
SATGLKQASPALARPVASDF

SEQ ID NO: 15678 - protein, 20 aa, synthetic construct
  source 1..20: note = Seed: SATGFKQSSKALQRPVASDF
SATGLKQASPALIRPVASDF

SEQ ID NO: 15679 - protein, 20 aa, synthetic construct
  source 1..20: note = Seed: SATGFKQSSKALQRPVASDF
SATGLKQASPALLRPVASDF

SEQ ID NO: 15680 - protein, 20 aa, synthetic construct
  source 1..20: note = Seed: SATGFKQSSKALQRPVASDF
SATGLKQASPALMRPVASDF

SEQ ID NO: 15681 - protein, 20 aa, synthetic construct
  source 1..20: note = Seed: SATGFKQSSKALQRPVASDF
SATGLKQASPALNRPVASDF

SEQ ID NO: 15682 - protein, 20 aa, synthetic construct
  source 1..20: note = Seed: SATGFKQSSKALQRPVASDF
SATGLKQASPALQRPVASDF

SEQ ID NO: 15683 - protein, 20 aa, synthetic construct
  source 1..20: note = Seed: SATGFKQSSKALQRPVASDF
SATGLKQASPALSRPVASDF

SEQ ID NO: 15684 - protein, 20 aa, synthetic construct
  source 1..20: note = Seed: SATGFKQSSKALQRPVASDF
SATGLKQASPALTRPVASDF

SEQ ID NO: 15685 - protein, 20 aa, synthetic construct
  source 1..20: note = Seed: SATGFKQSSKALQRPVASDF
SATGLKQASPALVRPVASDF

SEQ ID NO: 15686 - protein, 20 aa, synthetic construct
  source 1..20: note = Seed: SATGFKQSSKALQRPVASDF
SATGLKQASRALARPVASDF

SEQ ID NO: 15687 - protein, 20 aa, synthetic construct
  source 1..20: note = Seed: SATGFKQSSKALQRPVASDF
SATGLKQASRALGRPVASDF

SEQ ID NO: 15688 - protein, 20 aa, synthetic construct
  source 1..20: note = Seed: SATGFKQSSKALQRPVASDF
SATGLKQASRALHRPVASDF

SEQ ID NO: 15689 - protein, 20 aa, synthetic construct
  source 1..20: note = Seed: SATGFKQSSKALQRPVASDF
SATGLKQASRALIRPVASDF

SEQ ID NO: 15690 - protein, 20 aa, synthetic construct
  source 1..20: note = Seed: SATGFKQSSKALQRPVASDF
SATGLKQASRALKRPVASDF

SEQ ID NO: 15691 - protein, 20 aa, synthetic construct
  source 1..20: note = Seed: SATGFKQSSKALQRPVASDF
SATGLKQASRALLRPVASDF

SEQ ID NO: 15692 - protein, 20 aa, synthetic construct
  source 1..20: note = Seed: SATGFKQSSKALQRPVASDF
SATGLKQASRALMRPVASDF

SEQ ID NO: 15693 - protein, 20 aa, synthetic construct
  source 1..20: note = Seed: SATGFKQSSKALQRPVASDF
SATGLKQASRALQRPVASDF

SEQ ID NO: 15694 - protein, 20 aa, synthetic construct
  source 1..20: note = Seed: SATGFKQSSKALQRPVASDF
SATGLKQASRALRRPVASDF

SEQ ID NO: 15695 - protein, 20 aa, synthetic construct
  source 1..20: note = Seed: SATGFKQSSKALQRPVASDF
SATGLKQASRALSRPVASDF

SEQ ID NO: 15696 - protein, 20 aa, synthetic construct
  source 1..20: note = Seed: SATGFKQSSKALQRPVASDF
SATGLKQASRALTRPVASDF

SEQ ID NO: 15697 - protein, 20 aa, synthetic construct
  source 1..20: note = Seed: SATGFKQSSKALQRPVASDF
SATGLKQASRALVRPVASDF

SEQ ID NO: 15698 - protein, 20 aa, synthetic construct
  source 1..20: note = Seed: SATGFKQSSKALQRPVASDF
SATGLKQASRALYRPVASDF

SEQ ID NO: 15699 - protein, 20 aa, synthetic construct
  source 1..20: note = Seed: SATGFKQSSKALQRPVASDF
SATGLKQASSALARPVASDF

SEQ ID NO: 15700 - protein, 20 aa, synthetic construct
  source 1..20: note = Seed: SATGFKQSSKALQRPVASDF
SATGLKQASSALIRPVASDF

SEQ ID NO: 15701 - protein, 20 aa, synthetic construct
  source 1..20: note = Seed: SATGFKQSSKALQRPVASDF
SATGLKQASSALLRPVASDF

SEQ ID NO: 15702 - protein, 20 aa, synthetic construct
  source 1..20: note = Seed: SATGFKQSSKALQRPVASDF
SATGLKQASSALMRPVASDF

SEQ ID NO: 15703 - protein, 20 aa, synthetic construct
  source 1..20: note = Seed: SATGFKQSSKALQRPVASDF
SATGLKQASSALNRPVASDF

SEQ ID NO: 15704 - protein, 20 aa, synthetic construct
  source 1..20: note = Seed: SATGFKQSSKALQRPVASDF
SATGLKQASSALSRPVASDF

SEQ ID NO: 15705 - protein, 20 aa, synthetic construct
  source 1..20: note = Seed: SATGFKQSSKALQRPVASDF
SATGLKQASSALTRPVASDF

SEQ ID NO: 15706 - protein, 20 aa, synthetic construct
  source 1..20: note = Seed: SATGFKQSSKALQRPVASDF
SATGLKQASSALVRPVASDF

SEQ ID NO: 15707 - protein, 20 aa, synthetic construct
  source 1..20: note = Seed: SATGFKQSSKALQRPVASDF
SATGLKQASTALARPVASDF

SEQ ID NO: 15708 - protein, 20 aa, synthetic construct
  source 1..20: note = Seed: SATGFKQSSKALQRPVASDF
SATGLKQASTALIRPVASDF

SEQ ID NO: 15709 - protein, 20 aa, synthetic construct
  source 1..20: note = Seed: SATGFKQSSKALQRPVASDF
SATGLKQASTALLRPVASDF

SEQ ID NO: 15710 - protein, 20 aa, synthetic construct
  source 1..20: note = Seed: SATGFKQSSKALQRPVASDF
SATGLKQASTALMRPVASDF

SEQ ID NO: 15711 - protein, 20 aa, synthetic construct
  source 1..20: note = Seed: SATGFKQSSKALQRPVASDF
SATGLKQASTALNRPVASDF

SEQ ID NO: 15712 - protein, 20 aa, synthetic construct
  source 1..20: note = Seed: SATGFKQSSKALQRPVASDF
SATGLKQASTALSRPVASDF

SEQ ID NO: 15713 - protein, 20 aa, synthetic construct
  source 1..20: note = Seed: SATGFKQSSKALQRPVASDF
SATGLKQASTALTRPVASDF

SEQ ID NO: 15714 - protein, 20 aa, synthetic construct
  source 1..20: note = Seed: SATGFKQSSKALQRPVASDF
SATGLKQASTALVRPVASDF

SEQ ID NO: 15715 - protein, 20 aa, synthetic construct
  source 1..20: note = Seed: SATGFKQSSKALQRPVASDF
SATGLKQASVALARPVASDF

SEQ ID NO: 15716 - protein, 20 aa, synthetic construct
  source 1..20: note = Seed: SATGFKQSSKALQRPVASDF
SATGLKQASVALGRPVASDF

SEQ ID NO: 15717 - protein, 20 aa, synthetic construct
  source 1..20: note = Seed: SATGFKQSSKALQRPVASDF
SATGLKQASVALHRPVASDF

SEQ ID NO: 15718 - protein, 20 aa, synthetic construct
  source 1..20: note = Seed: SATGFKQSSKALQRPVASDF
SATGLKQASVALIRPVASDF

SEQ ID NO: 15719 - protein, 20 aa, synthetic construct
  source 1..20: note = Seed: SATGFKQSSKALQRPVASDF
SATGLKQASVALNRPVASDF

SEQ ID NO: 15720 - protein, 20 aa, synthetic construct
  source 1..20: note = Seed: SATGFKQSSKALQRPVASDF
SATGLKQASVALQRPVASDF

SEQ ID NO: 15721 - protein, 20 aa, synthetic construct
  source 1..20: note = Seed: SATGFKQSSKALQRPVASDF
SATGLKQASVALSRPVASDF

SEQ ID NO: 15722 - protein, 20 aa, synthetic construct
  source 1..20: note = Seed: SATGFKQSSKALQRPVASDF
SATGLKQASVALTRPVASDF

SEQ ID NO: 15723 - protein, 20 aa, synthetic construct
  source 1..20: note = Seed: SATGFKQSSKALQRPVASDF
SATGLKQASVALVRPVASDF

SEQ ID NO: 15724 - protein, 20 aa, synthetic construct
  source 1..20: note = Seed: SATGFKQSSKALQRPVASDF
SATGLKQCSAALARPVASDF

SEQ ID NO: 15725 - protein, 20 aa, synthetic construct
  source 1..20: note = Seed: SATGFKQSSKALQRPVASDF
SATGLKQCSAALIRPVASDF

SEQ ID NO: 15726 - protein, 20 aa, synthetic construct
  source 1..20: note = Seed: SATGFKQSSKALQRPVASDF
SATGLKQCSAALLRPVASDF

SEQ ID NO: 15727 - protein, 20 aa, synthetic construct
  source 1..20: note = Seed: SATGFKQSSKALQRPVASDF
SATGLKQCSAALSRPVASDF

SEQ ID NO: 15728 - protein, 20 aa, synthetic construct
  source 1..20: note = Seed: SATGFKQSSKALQRPVASDF
SATGLKQCSAALVRPVASDF

SEQ ID NO: 15729 - protein, 20 aa, synthetic construct
  source 1..20: note = Seed: SATGFKQSSKALQRPVASDF
SATGLKQCSIALSRPVASDF

SEQ ID NO: 15730 - protein, 20 aa, synthetic construct
  source 1..20: note = Seed: SATGFKQSSKALQRPVASDF
SATGLKQCSIALVRPVASDF

SEQ ID NO: 15731 - protein, 20 aa, synthetic construct
  source 1..20: note = Seed: SATGFKQSSKALQRPVASDF
SATGLKQCSRALARPVASDF

SEQ ID NO: 15732 - protein, 20 aa, synthetic construct
  source 1..20: note = Seed: SATGFKQSSKALQRPVASDF
SATGLKQCSRALRRPVASDF

SEQ ID NO: 15733 - protein, 20 aa, synthetic construct
  source 1..20: note = Seed: SATGFKQSSKALQRPVASDF
SATGLKQCSRALSRPVASDF

SEQ ID NO: 15734 - protein, 20 aa, synthetic construct
  source 1..20: note = Seed: SATGFKQSSKALQRPVASDF
SATGLKQCSSALARPVASDF

SEQ ID NO: 15735 - protein, 20 aa, synthetic construct
  source 1..20: note = Seed: SATGFKQSSKALQRPVASDF
SATGLKQCSVALARPVASDF

SEQ ID NO: 15736 - protein, 20 aa, synthetic construct
  source 1..20: note = Seed: SATGFKQSSKALQRPVASDF
SATGLKQCSVALSRPVASDF

SEQ ID NO: 15737 - protein, 20 aa, synthetic construct
  source 1..20: note = Seed: SATGFKQSSKALQRPVASDF
SATGLKQDSFALIRPVASDF

SEQ ID NO: 15738 - protein, 20 aa, synthetic construct
  source 1..20: note = Seed: SATGFKQSSKALQRPVASDF
SATGLKQDSFALVRPVASDF

SEQ ID NO: 15739 - protein, 20 aa, synthetic construct
  source 1..20: note = Seed: SATGFKQSSKALQRPVASDF
SATGLKQESAALARPVASDF

SEQ ID NO: 15740 - protein, 20 aa, synthetic construct
  source 1..20: note = Seed: SATGFKQSSKALQRPVASDF
SATGLKQESAALIRPVASDF

SEQ ID NO: 15741 - protein, 20 aa, synthetic construct
  source 1..20: note = Seed: SATGFKQSSKALQRPVASDF
SATGLKQESAALLRPVASDF

SEQ ID NO: 15742 - protein, 20 aa, synthetic construct
  source 1..20: note = Seed: SATGFKQSSKALQRPVASDF
SATGLKQESAALMRPVASDF

SEQ ID NO: 15743 - protein, 20 aa, synthetic construct
  source 1..20: note = Seed: SATGFKQSSKALQRPVASDF
SATGLKQESAALSRPVASDF

SEQ ID NO: 15744 - protein, 20 aa, synthetic construct
  source 1..20: note = Seed: SATGFKQSSKALQRPVASDF
SATGLKQESAALTRPVASDF

SEQ ID NO: 15745 - protein, 20 aa, synthetic construct
  source 1..20: note = Seed: SATGFKQSSKALQRPVASDF
SATGLKQESAALVRPVASDF

SEQ ID NO: 15746 - protein, 20 aa, synthetic construct
  source 1..20: note = Seed: SATGFKQSSKALQRPVASDF
SATGLKQESFALARPVASDF

SEQ ID NO: 15747 - protein, 20 aa, synthetic construct
  source 1..20: note = Seed: SATGFKQSSKALQRPVASDF
SATGLKQESFALFRPVASDF

SEQ ID NO: 15748 - protein, 20 aa, synthetic construct
  source 1..20: note = Seed: SATGFKQSSKALQRPVASDF
SATGLKQESFALIRPVASDF

SEQ ID NO: 15749 - protein, 20 aa, synthetic construct
  source 1..20: note = Seed: SATGFKQSSKALQRPVASDF
SATGLKQESFALLRPVASDF

SEQ ID NO: 15750 - protein, 20 aa, synthetic construct
  source 1..20: note = Seed: SATGFKQSSKALQRPVASDF
SATGLKQESFALSRPVASDF

SEQ ID NO: 15751 - protein, 20 aa, synthetic construct
  source 1..20: note = Seed: SATGFKQSSKALQRPVASDF
SATGLKQESFALVRPVASDF

SEQ ID NO: 15752 - protein, 20 aa, synthetic construct
  source 1..20: note = Seed: SATGFKQSSKALQRPVASDF
SATGLKQESGALARPVASDF

SEQ ID NO: 15753 - protein, 20 aa, synthetic construct
  source 1..20: note = Seed: SATGFKQSSKALQRPVASDF
SATGLKQESGALIRPVASDF

SEQ ID NO: 15754 - protein, 20 aa, synthetic construct
  source 1..20: note = Seed: SATGFKQSSKALQRPVASDF
SATGLKQESGALLRPVASDF

SEQ ID NO: 15755 - protein, 20 aa, synthetic construct
  source 1..20: note = Seed: SATGFKQSSKALQRPVASDF
SATGLKQESGALVRPVASDF

SEQ ID NO: 15756 - protein, 20 aa, synthetic construct
  source 1..20: note = Seed: SATGFKQSSKALQRPVASDF
SATGLKQESIALNRPVASDF

SEQ ID NO: 15757 - protein, 20 aa, synthetic construct
  source 1..20: note = Seed: SATGFKQSSKALQRPVASDF
SATGLKQESIALSRPVASDF

SEQ ID NO: 15758 - protein, 20 aa, synthetic construct
  source 1..20: note = Seed: SATGFKQSSKALQRPVASDF
SATGLKQESLALSRPVASDF

SEQ ID NO: 15759 - protein, 20 aa, synthetic construct
  source 1..20: note = Seed: SATGFKQSSKALQRPVASDF
SATGLKQESMALSRPVASDF

SEQ ID NO: 15760 - protein, 20 aa, synthetic construct
  source 1..20: note = Seed: SATGFKQSSKALQRPVASDF
SATGLKQESPALARPVASDF

SEQ ID NO: 15761 - protein, 20 aa, synthetic construct
  source 1..20: note = Seed: SATGFKQSSKALQRPVASDF
SATGLKQESSALARPVASDF

SEQ ID NO: 15762 - protein, 20 aa, synthetic construct
  source 1..20: note = Seed: SATGFKQSSKALQRPVASDF
SATGLKQESSALIRPVASDF

SEQ ID NO: 15763 - protein, 20 aa, synthetic construct
  source 1..20: note = Seed: SATGFKQSSKALQRPVASDF
SATGLKQESSALLRPVASDF

SEQ ID NO: 15764 - protein, 20 aa, synthetic construct
  source 1..20: note = Seed: SATGFKQSSKALQRPVASDF
SATGLKQESSALVRPVASDF

SEQ ID NO: 15765 - protein, 20 aa, synthetic construct
  source 1..20: note = Seed: SATGFKQSSKALQRPVASDF
SATGLKQESVALARPVASDF

SEQ ID NO: 15766 - protein, 20 aa, synthetic construct
  source 1..20: note = Seed: SATGFKQSSKALQRPVASDF
SATGLKQESVALQRPVASDF

SEQ ID NO: 15767 - protein, 20 aa, synthetic construct
  source 1..20: note = Seed: SATGFKQSSKALQRPVASDF
SATGLKQESVALSRPVASDF

SEQ ID NO: 15768 - protein, 20 aa, synthetic construct
  source 1..20: note = Seed: SATGFKQSSKALQRPVASDF
SATGLKQESVALVRPVASDF

SEQ ID NO: 15769 - protein, 20 aa, synthetic construct
  source 1..20: note = Seed: SATGFKQSSKALQRPVASDF
SATGLKQFSAALIRPVASDF

SEQ ID NO: 15770 - protein, 20 aa, synthetic construct
  source 1..20: note = Seed: SATGFKQSSKALQRPVASDF
SATGLKQFSAALKRPVASDF

SEQ ID NO: 15771 - protein, 20 aa, synthetic construct
  source 1..20: note = Seed: SATGFKQSSKALQRPVASDF
SATGLKQFSAALLRPVASDF

SEQ ID NO: 15772 - protein, 20 aa, synthetic construct
  source 1..20: note = Seed: SATGFKQSSKALQRPVASDF
SATGLKQFSAALMRPVASDF

SEQ ID NO: 15773 - protein, 20 aa, synthetic construct
  source 1..20: note = Seed: SATGFKQSSKALQRPVASDF
SATGLKQFSAALRRPVASDF

SEQ ID NO: 15774 - protein, 20 aa, synthetic construct
  source 1..20: note = Seed: SATGFKQSSKALQRPVASDF
SATGLKQFSAALVRPVASDF

SEQ ID NO: 15775 - protein, 20 aa, synthetic construct
  source 1..20: note = Seed: SATGFKQSSKALQRPVASDF
SATGLKQFSFALERPVASDF

SEQ ID NO: 15776 - protein, 20 aa, synthetic construct
  source 1..20: note = Seed: SATGFKQSSKALQRPVASDF
SATGLKQFSFALNRPVASDF

SEQ ID NO: 15777 - protein, 20 aa, synthetic construct
  source 1..20: note = Seed: SATGFKQSSKALQRPVASDF
SATGLKQFSFALSRPVASDF

SEQ ID NO: 15778 - protein, 20 aa, synthetic construct
  source 1..20: note = Seed: SATGFKQSSKALQRPVASDF
SATGLKQFSGALARPVASDF

SEQ ID NO: 15779 - protein, 20 aa, synthetic construct
  source 1..20: note = Seed: SATGFKQSSKALQRPVASDF
SATGLKQFSGALIRPVASDF

SEQ ID NO: 15780 - protein, 20 aa, synthetic construct
  source 1..20: note = Seed: SATGFKQSSKALQRPVASDF
SATGLKQFSGALLRPVASDF

SEQ ID NO: 15781 - protein, 20 aa, synthetic construct
  source 1..20: note = Seed: SATGFKQSSKALQRPVASDF
SATGLKQFSGALMRPVASDF

SEQ ID NO: 15782 - protein, 20 aa, synthetic construct
  source 1..20: note = Seed: SATGFKQSSKALQRPVASDF
SATGLKQFSGALVRPVASDF

SEQ ID NO: 15783 - protein, 20 aa, synthetic construct
  source 1..20: note = Seed: SATGFKQSSKALQRPVASDF
SATGLKQFSHALKRPVASDF

SEQ ID NO: 15784 - protein, 20 aa, synthetic construct
  source 1..20: note = Seed: SATGFKQSSKALQRPVASDF
SATGLKQFSHALRRPVASDF

SEQ ID NO: 15785 - protein, 20 aa, synthetic construct
  source 1..20: note = Seed: SATGFKQSSKALQRPVASDF
SATGLKQFSIALARPVASDF

SEQ ID NO: 15786 - protein, 20 aa, synthetic construct
  source 1..20: note = Seed: SATGFKQSSKALQRPVASDF
SATGLKQFSIALSRPVASDF

SEQ ID NO: 15787 - protein, 20 aa, synthetic construct
  source 1..20: note = Seed: SATGFKQSSKALQRPVASDF
SATGLKQFSKALARPVASDF

SEQ ID NO: 15788 - protein, 20 aa, synthetic construct
  source 1..20: note = Seed: SATGFKQSSKALQRPVASDF
SATGLKQFSKALFRPVASDF

SEQ ID NO: 15789 - protein, 20 aa, synthetic construct
  source 1..20: note = Seed: SATGFKQSSKALQRPVASDF
SATGLKQFSKALGRPVASDF

SEQ ID NO: 15790 - protein, 20 aa, synthetic construct
  source 1..20: note = Seed: SATGFKQSSKALQRPVASDF
SATGLKQFSKALHRPVASDF

SEQ ID NO: 15791 - protein, 20 aa, synthetic construct
  source 1..20: note = Seed: SATGFKQSSKALQRPVASDF
SATGLKQFSKALIRPVASDF

SEQ ID NO: 15792 - protein, 20 aa, synthetic construct
  source 1..20: note = Seed: SATGFKQSSKALQRPVASDF
SATGLKQFSKALKRPVASDF

SEQ ID NO: 15793 - protein, 20 aa, synthetic construct
  source 1..20: note = Seed: SATGFKQSSKALQRPVASDF
SATGLKQFSKALLRPVASDF

SEQ ID NO: 15794 - protein, 20 aa, synthetic construct
  source 1..20: note = Seed: SATGFKQSSKALQRPVASDF
SATGLKQFSKALMRPVASDF

SEQ ID NO: 15795 - protein, 20 aa, synthetic construct
  source 1..20: note = Seed: SATGFKQSSKALQRPVASDF
SATGLKQFSKALQRPVASDF

SEQ ID NO: 15796 - protein, 20 aa, synthetic construct
  source 1..20: note = Seed: SATGFKQSSKALQRPVASDF
SATGLKQFSKALRRPVASDF

SEQ ID NO: 15797 - protein, 20 aa, synthetic construct
  source 1..20: note = Seed: SATGFKQSSKALQRPVASDF
SATGLKQFSKALSRPVASDF

SEQ ID NO: 15798 - protein, 20 aa, synthetic construct
  source 1..20: note = Seed: SATGFKQSSKALQRPVASDF
SATGLKQFSKALTRPVASDF

SEQ ID NO: 15799 - protein, 20 aa, synthetic construct
  source 1..20: note = Seed: SATGFKQSSKALQRPVASDF
SATGLKQFSKALVRPVASDF

SEQ ID NO: 15800 - protein, 20 aa, synthetic construct
  source 1..20: note = Seed: SATGFKQSSKALQRPVASDF
SATGLKQFSKALYRPVASDF

SEQ ID NO: 15801 - protein, 20 aa, synthetic construct
  source 1..20: note = Seed: SATGFKQSSKALQRPVASDF
SATGLKQFSLALARPVASDF

SEQ ID NO: 15802 - protein, 20 aa, synthetic construct
  source 1..20: note = Seed: SATGFKQSSKALQRPVASDF
SATGLKQFSLALSRPVASDF

SEQ ID NO: 15803 - protein, 20 aa, synthetic construct
  source 1..20: note = Seed: SATGFKQSSKALQRPVASDF
SATGLKQFSLALVRPVASDF

SEQ ID NO: 15804 - protein, 20 aa, synthetic construct
  source 1..20: note = Seed: SATGFKQSSKALQRPVASDF
SATGLKQFSNALARPVASDF

SEQ ID NO: 15805 - protein, 20 aa, synthetic construct
  source 1..20: note = Seed: SATGFKQSSKALQRPVASDF
SATGLKQFSNALLRPVASDF

SEQ ID NO: 15806 - protein, 20 aa, synthetic construct
  source 1..20: note = Seed: SATGFKQSSKALQRPVASDF
SATGLKQFSNALMRPVASDF

SEQ ID NO: 15807 - protein, 20 aa, synthetic construct
  source 1..20: note = Seed: SATGFKQSSKALQRPVASDF
SATGLKQFSNALRRPVASDF

SEQ ID NO: 15808 - protein, 20 aa, synthetic construct
  source 1..20: note = Seed: SATGFKQSSKALQRPVASDF
SATGLKQFSPALHRPVASDF

SEQ ID NO: 15809 - protein, 20 aa, synthetic construct
  source 1..20: note = Seed: SATGFKQSSKALQRPVASDF
SATGLKQFSPALIRPVASDF

SEQ ID NO: 15810 - protein, 20 aa, synthetic construct
  source 1..20: note = Seed: SATGFKQSSKALQRPVASDF
SATGLKQFSPALLRPVASDF

SEQ ID NO: 15811 - protein, 20 aa, synthetic construct
  source 1..20: note = Seed: SATGFKQSSKALQRPVASDF
SATGLKQFSPALMRPVASDF

SEQ ID NO: 15812 - protein, 20 aa, synthetic construct
  source 1..20: note = Seed: SATGFKQSSKALQRPVASDF
SATGLKQFSPALNRPVASDF

SEQ ID NO: 15813 - protein, 20 aa, synthetic construct
  source 1..20: note = Seed: SATGFKQSSKALQRPVASDF
SATGLKQFSPALQRPVASDF

SEQ ID NO: 15814 - protein, 20 aa, synthetic construct
  source 1..20: note = Seed: SATGFKQSSKALQRPVASDF
SATGLKQFSPALRRPVASDF

SEQ ID NO: 15815 - protein, 20 aa, synthetic construct
  source 1..20: note = Seed: SATGFKQSSKALQRPVASDF
SATGLKQFSQALRRPVASDF

SEQ ID NO: 15816 - protein, 20 aa, synthetic construct
  source 1..20: note = Seed: SATGFKQSSKALQRPVASDF
SATGLKQFSRALARPVASDF

SEQ ID NO: 15817 - protein, 20 aa, synthetic construct
  source 1..20: note = Seed: SATGFKQSSKALQRPVASDF
SATGLKQFSRALGRPVASDF

SEQ ID NO: 15818 - protein, 20 aa, synthetic construct
  source 1..20: note = Seed: SATGFKQSSKALQRPVASDF
SATGLKQFSRALHRPVASDF

SEQ ID NO: 15819 - protein, 20 aa, synthetic construct
  source 1..20: note = Seed: SATGFKQSSKALQRPVASDF
SATGLKQFSRALIRPVASDF

SEQ ID NO: 15820 - protein, 20 aa, synthetic construct
  source 1..20: note = Seed: SATGFKQSSKALQRPVASDF
SATGLKQFSRALKRPVASDF

SEQ ID NO: 15821 - protein, 20 aa, synthetic construct
  source 1..20: note = Seed: SATGFKQSSKALQRPVASDF
SATGLKQFSRALLRPVASDF

SEQ ID NO: 15822 - protein, 20 aa, synthetic construct
  source 1..20: note = Seed: SATGFKQSSKALQRPVASDF
SATGLKQFSRALMRPVASDF

SEQ ID NO: 15823 - protein, 20 aa, synthetic construct
  source 1..20: note = Seed: SATGFKQSSKALQRPVASDF
SATGLKQFSRALNRPVASDF

SEQ ID NO: 15824 - protein, 20 aa, synthetic construct
  source 1..20: note = Seed: SATGFKQSSKALQRPVASDF
SATGLKQFSRALQRPVASDF

SEQ ID NO: 15825 - protein, 20 aa, synthetic construct
  source 1..20: note = Seed: SATGFKQSSKALQRPVASDF
SATGLKQFSRALRRPVASDF

SEQ ID NO: 15826 - protein, 20 aa, synthetic construct
  source 1..20: note = Seed: SATGFKQSSKALQRPVASDF
SATGLKQFSRALSRPVASDF

SEQ ID NO: 15827 - protein, 20 aa, synthetic construct
  source 1..20: note = Seed: SATGFKQSSKALQRPVASDF
SATGLKQFSRALTRPVASDF

SEQ ID NO: 15828 - protein, 20 aa, synthetic construct
  source 1..20: note = Seed: SATGFKQSSKALQRPVASDF
SATGLKQFSRALVRPVASDF

SEQ ID NO: 15829 - protein, 20 aa, synthetic construct
  source 1..20: note = Seed: SATGFKQSSKALQRPVASDF
SATGLKQFSRALYRPVASDF

SEQ ID NO: 15830 - protein, 20 aa, synthetic construct
  source 1..20: note = Seed: SATGFKQSSKALQRPVASDF
SATGLKQFSSALARPVASDF

SEQ ID NO: 15831 - protein, 20 aa, synthetic construct
  source 1..20: note = Seed: SATGFKQSSKALQRPVASDF
SATGLKQFSSALIRPVASDF

SEQ ID NO: 15832 - protein, 20 aa, synthetic construct
  source 1..20: note = Seed: SATGFKQSSKALQRPVASDF
SATGLKQFSSALLRPVASDF

SEQ ID NO: 15833 - protein, 20 aa, synthetic construct
  source 1..20: note = Seed: SATGFKQSSKALQRPVASDF
SATGLKQFSSALRRPVASDF

SEQ ID NO: 15834 - protein, 20 aa, synthetic construct
  source 1..20: note = Seed: SATGFKQSSKALQRPVASDF
SATGLKQFSSALVRPVASDF

SEQ ID NO: 15835 - protein, 20 aa, synthetic construct
  source 1..20: note = Seed: SATGFKQSSKALQRPVASDF
SATGLKQFSTALLRPVASDF

SEQ ID NO: 15836 - protein, 20 aa, synthetic construct
  source 1..20: note = Seed: SATGFKQSSKALQRPVASDF
SATGLKQFSTALQRPVASDF

SEQ ID NO: 15837 - protein, 20 aa, synthetic construct
  source 1..20: note = Seed: SATGFKQSSKALQRPVASDF
SATGLKQFSTALRRPVASDF

SEQ ID NO: 15838 - protein, 20 aa, synthetic construct
  source 1..20: note = Seed: SATGFKQSSKALQRPVASDF
SATGLKQFSVALRRPVASDF

SEQ ID NO: 15839 - protein, 20 aa, synthetic construct
  source 1..20: note = Seed: SATGFKQSSKALQRPVASDF
SATGLKQGSAALARPVASDF

SEQ ID NO: 15840 - protein, 20 aa, synthetic construct
  source 1..20: note = Seed: SATGFKQSSKALQRPVASDF
SATGLKQGSAALIRPVASDF

SEQ ID NO: 15841 - protein, 20 aa, synthetic construct
  source 1..20: note = Seed: SATGFKQSSKALQRPVASDF
SATGLKQGSAALLRPVASDF

SEQ ID NO: 15842 - protein, 20 aa, synthetic construct
  source 1..20: note = Seed: SATGFKQSSKALQRPVASDF
SATGLKQGSAALMRPVASDF

SEQ ID NO: 15843 - protein, 20 aa, synthetic construct
  source 1..20: note = Seed: SATGFKQSSKALQRPVASDF
SATGLKQGSAALVRPVASDF

SEQ ID NO: 15844 - protein, 20 aa, synthetic construct
  source 1..20: note = Seed: SATGFKQSSKALQRPVASDF
SATGLKQGSGALIRPVASDF

SEQ ID NO: 15845 - protein, 20 aa, synthetic construct
  source 1..20: note = Seed: SATGFKQSSKALQRPVASDF
SATGLKQGSGALLRPVASDF

SEQ ID NO: 15846 - protein, 20 aa, synthetic construct
  source 1..20: note = Seed: SATGFKQSSKALQRPVASDF
SATGLKQGSGALVRPVASDF

SEQ ID NO: 15847 - protein, 20 aa, synthetic construct
  source 1..20: note = Seed: SATGFKQSSKALQRPVASDF
SATGLKQGSPALIRPVASDF

SEQ ID NO: 15848 - protein, 20 aa, synthetic construct
  source 1..20: note = Seed: SATGFKQSSKALQRPVASDF
SATGLKQGSPALLRPVASDF

SEQ ID NO: 15849 - protein, 20 aa, synthetic construct
  source 1..20: note = Seed: SATGFKQSSKALQRPVASDF
SATGLKQGSPALVRPVASDF

SEQ ID NO: 15850 - protein, 20 aa, synthetic construct
  source 1..20: note = Seed: SATGFKQSSKALQRPVASDF
SATGLKQGSSALARPVASDF

SEQ ID NO: 15851 - protein, 20 aa, synthetic construct
  source 1..20: note = Seed: SATGFKQSSKALQRPVASDF
SATGLKQGSSALIRPVASDF

SEQ ID NO: 15852 - protein, 20 aa, synthetic construct
  source 1..20: note = Seed: SATGFKQSSKALQRPVASDF
SATGLKQGSSALLRPVASDF

SEQ ID NO: 15853 - protein, 20 aa, synthetic construct
  source 1..20: note = Seed: SATGFKQSSKALQRPVASDF
SATGLKQGSSALVRPVASDF

SEQ ID NO: 15854 - protein, 20 aa, synthetic construct
  source 1..20: note = Seed: SATGFKQSSKALQRPVASDF
SATGLKQGSVALARPVASDF

SEQ ID NO: 15855 - protein, 20 aa, synthetic construct
  source 1..20: note = Seed: SATGFKQSSKALQRPVASDF
SATGLKQGSVALIRPVASDF

SEQ ID NO: 15856 - protein, 20 aa, synthetic construct
  source 1..20: note = Seed: SATGFKQSSKALQRPVASDF
SATGLKQHSAALARPVASDF

SEQ ID NO: 15857 - protein, 20 aa, synthetic construct
  source 1..20: note = Seed: SATGFKQSSKALQRPVASDF
SATGLKQHSAALIRPVASDF

SEQ ID NO: 15858 - protein, 20 aa, synthetic construct
  source 1..20: note = Seed: SATGFKQSSKALQRPVASDF
SATGLKQHSAALLRPVASDF

SEQ ID NO: 15859 - protein, 20 aa, synthetic construct
  source 1..20: note = Seed: SATGFKQSSKALQRPVASDF
SATGLKQHSAALRRPVASDF

SEQ ID NO: 15860 - protein, 20 aa, synthetic construct
  source 1..20: note = Seed: SATGFKQSSKALQRPVASDF
SATGLKQHSAALVRPVASDF

SEQ ID NO: 15861 - protein, 20 aa, synthetic construct
  source 1..20: note = Seed: SATGFKQSSKALQRPVASDF
SATGLKQHSFALFRPVASDF

SEQ ID NO: 15862 - protein, 20 aa, synthetic construct
  source 1..20: note = Seed: SATGFKQSSKALQRPVASDF
SATGLKQHSFALIRPVASDF

SEQ ID NO: 15863 - protein, 20 aa, synthetic construct
  source 1..20: note = Seed: SATGFKQSSKALQRPVASDF
SATGLKQHSIALRRPVASDF

SEQ ID NO: 15864 - protein, 20 aa, synthetic construct
  source 1..20: note = Seed: SATGFKQSSKALQRPVASDF
SATGLKQHSKALRRPVASDF

SEQ ID NO: 15865 - protein, 20 aa, synthetic construct
  source 1..20: note = Seed: SATGFKQSSKALQRPVASDF
SATGLKQHSRALFRPVASDF

SEQ ID NO: 15866 - protein, 20 aa, synthetic construct
  source 1..20: note = Seed: SATGFKQSSKALQRPVASDF
SATGLKQHSRALKRPVASDF

SEQ ID NO: 15867 - protein, 20 aa, synthetic construct
  source 1..20: note = Seed: SATGFKQSSKALQRPVASDF
SATGLKQHSRALRRPVASDF

SEQ ID NO: 15868 - protein, 20 aa, synthetic construct
  source 1..20: note = Seed: SATGFKQSSKALQRPVASDF
SATGLKQHSRALYRPVASDF

SEQ ID NO: 15869 - protein, 20 aa, synthetic construct
  source 1..20: note = Seed: SATGFKQSSKALQRPVASDF
SATGLKQHSSALRRPVASDF

SEQ ID NO: 15870 - protein, 20 aa, synthetic construct
  source 1..20: note = Seed: SATGFKQSSKALQRPVASDF
SATGLKQHSTALRRPVASDF

SEQ ID NO: 15871 - protein, 20 aa, synthetic construct
  source 1..20: note = Seed: SATGFKQSSKALQRPVASDF
SATGLKQHSVALRRPVASDF

SEQ ID NO: 15872 - protein, 20 aa, synthetic construct
  source 1..20: note = Seed: SATGFKQSSKALQRPVASDF
SATGLKQHSVALSRPVASDF

SEQ ID NO: 15873 - protein, 20 aa, synthetic construct
  source 1..20: note = Seed: SATGFKQSSKALQRPVASDF
SATGLKQISAALARPVASDF

SEQ ID NO: 15874 - protein, 20 aa, synthetic construct
  source 1..20: note = Seed: SATGFKQSSKALQRPVASDF
SATGLKQISAALCRPVASDF

SEQ ID NO: 15875 - protein, 20 aa, synthetic construct
  source 1..20: note = Seed: SATGFKQSSKALQRPVASDF
SATGLKQISAALFRPVASDF

SEQ ID NO: 15876 - protein, 20 aa, synthetic construct
  source 1..20: note = Seed: SATGFKQSSKALQRPVASDF
SATGLKQISAALGRPVASDF

SEQ ID NO: 15877 - protein, 20 aa, synthetic construct
  source 1..20: note = Seed: SATGFKQSSKALQRPVASDF
SATGLKQISAALHRPVASDF

SEQ ID NO: 15878 - protein, 20 aa, synthetic construct
  source 1..20: note = Seed: SATGFKQSSKALQRPVASDF
SATGLKQISAALIRPVASDF

SEQ ID NO: 15879 - protein, 20 aa, synthetic construct
  source 1..20: note = Seed: SATGFKQSSKALQRPVASDF
SATGLKQISAALLRPVASDF

SEQ ID NO: 15880 - protein, 20 aa, synthetic construct
  source 1..20: note = Seed: SATGFKQSSKALQRPVASDF
SATGLKQISAALMRPVASDF

SEQ ID NO: 15881 - protein, 20 aa, synthetic construct
  source 1..20: note = Seed: SATGFKQSSKALQRPVASDF
SATGLKQISAALNRPVASDF

SEQ ID NO: 15882 - protein, 20 aa, synthetic construct
  source 1..20: note = Seed: SATGFKQSSKALQRPVASDF
SATGLKQISAALQRPVASDF

SEQ ID NO: 15883 - protein, 20 aa, synthetic construct
  source 1..20: note = Seed: SATGFKQSSKALQRPVASDF
SATGLKQISAALRRPVASDF

SEQ ID NO: 15884 - protein, 20 aa, synthetic construct
  source 1..20: note = Seed: SATGFKQSSKALQRPVASDF
SATGLKQISAALSRPVASDF

SEQ ID NO: 15885 - protein, 20 aa, synthetic construct
  source 1..20: note = Seed: SATGFKQSSKALQRPVASDF
SATGLKQISAALTRPVASDF

SEQ ID NO: 15886 - protein, 20 aa, synthetic construct
  source 1..20: note = Seed: SATGFKQSSKALQRPVASDF
SATGLKQISAALVRPVASDF

SEQ ID NO: 15887 - protein, 20 aa, synthetic construct
  source 1..20: note = Seed: SATGFKQSSKALQRPVASDF
SATGLKQISCALARPVASDF

SEQ ID NO: 15888 - protein, 20 aa, synthetic construct
  source 1..20: note = Seed: SATGFKQSSKALQRPVASDF
SATGLKQISFALARPVASDF

SEQ ID NO: 15889 - protein, 20 aa, synthetic construct
  source 1..20: note = Seed: SATGFKQSSKALQRPVASDF
SATGLKQISFALDRPVASDF

SEQ ID NO: 15890 - protein, 20 aa, synthetic construct
  source 1..20: note = Seed: SATGFKQSSKALQRPVASDF
SATGLKQISFALERPVASDF

SEQ ID NO: 15891 - protein, 20 aa, synthetic construct
  source 1..20: note = Seed: SATGFKQSSKALQRPVASDF
SATGLKQISFALIRPVASDF

SEQ ID NO: 15892 - protein, 20 aa, synthetic construct
  source 1..20: note = Seed: SATGFKQSSKALQRPVASDF
SATGLKQISFALMRPVASDF

SEQ ID NO: 15893 - protein, 20 aa, synthetic construct
  source 1..20: note = Seed: SATGFKQSSKALQRPVASDF
SATGLKQISFALSRPVASDF

SEQ ID NO: 15894 - protein, 20 aa, synthetic construct
  source 1..20: note = Seed: SATGFKQSSKALQRPVASDF
SATGLKQISFALTRPVASDF

SEQ ID NO: 15895 - protein, 20 aa, synthetic construct
  source 1..20: note = Seed: SATGFKQSSKALQRPVASDF
SATGLKQISFALVRPVASDF

SEQ ID NO: 15896 - protein, 20 aa, synthetic construct
  source 1..20: note = Seed: SATGFKQSSKALQRPVASDF
SATGLKQISGALARPVASDF

SEQ ID NO: 15897 - protein, 20 aa, synthetic construct
  source 1..20: note = Seed: SATGFKQSSKALQRPVASDF
SATGLKQISGALCRPVASDF

SEQ ID NO: 15898 - protein, 20 aa, synthetic construct
  source 1..20: note = Seed: SATGFKQSSKALQRPVASDF
SATGLKQISGALGRPVASDF

SEQ ID NO: 15899 - protein, 20 aa, synthetic construct
  source 1..20: note = Seed: SATGFKQSSKALQRPVASDF
SATGLKQISGALIRPVASDF

SEQ ID NO: 15900 - protein, 20 aa, synthetic construct
  source 1..20: note = Seed: SATGFKQSSKALQRPVASDF
SATGLKQISGALLRPVASDF

SEQ ID NO: 15901 - protein, 20 aa, synthetic construct
  source 1..20: note = Seed: SATGFKQSSKALQRPVASDF
SATGLKQISGALMRPVASDF

SEQ ID NO: 15902 - protein, 20 aa, synthetic construct
  source 1..20: note = Seed: SATGFKQSSKALQRPVASDF
SATGLKQISGALNRPVASDF

SEQ ID NO: 15903 - protein, 20 aa, synthetic construct
  source 1..20: note = Seed: SATGFKQSSKALQRPVASDF
SATGLKQISGALSRPVASDF

SEQ ID NO: 15904 - protein, 20 aa, synthetic construct
  source 1..20: note = Seed: SATGFKQSSKALQRPVASDF
SATGLKQISGALTRPVASDF

SEQ ID NO: 15905 - protein, 20 aa, synthetic construct
  source 1..20: note = Seed: SATGFKQSSKALQRPVASDF
SATGLKQISGALVRPVASDF

SEQ ID NO: 15906 - protein, 20 aa, synthetic construct
  source 1..20: note = Seed: SATGFKQSSKALQRPVASDF
SATGLKQISHALARPVASDF

SEQ ID NO: 15907 - protein, 20 aa, synthetic construct
  source 1..20: note = Seed: SATGFKQSSKALQRPVASDF
SATGLKQISHALLRPVASDF

SEQ ID NO: 15908 - protein, 20 aa, synthetic construct
  source 1..20: note = Seed: SATGFKQSSKALQRPVASDF
SATGLKQISHALRRPVASDF

SEQ ID NO: 15909 - protein, 20 aa, synthetic construct
  source 1..20: note = Seed: SATGFKQSSKALQRPVASDF
SATGLKQISHALSRPVASDF

SEQ ID NO: 15910 - protein, 20 aa, synthetic construct
  source 1..20: note = Seed: SATGFKQSSKALQRPVASDF
SATGLKQISIALARPVASDF

SEQ ID NO: 15911 - protein, 20 aa, synthetic construct
  source 1..20: note = Seed: SATGFKQSSKALQRPVASDF
SATGLKQISIALCRPVASDF

SEQ ID NO: 15912 - protein, 20 aa, synthetic construct
  source 1..20: note = Seed: SATGFKQSSKALQRPVASDF
SATGLKQISIALGRPVASDF

SEQ ID NO: 15913 - protein, 20 aa, synthetic construct
  source 1..20: note = Seed: SATGFKQSSKALQRPVASDF
SATGLKQISIALHRPVASDF

SEQ ID NO: 15914 - protein, 20 aa, synthetic construct
  source 1..20: note = Seed: SATGFKQSSKALQRPVASDF
SATGLKQISIALNRPVASDF

SEQ ID NO: 15915 - protein, 20 aa, synthetic construct
  source 1..20: note = Seed: SATGFKQSSKALQRPVASDF
SATGLKQISIALSRPVASDF

SEQ ID NO: 15916 - protein, 20 aa, synthetic construct
  source 1..20: note = Seed: SATGFKQSSKALQRPVASDF
SATGLKQISIALVRPVASDF

SEQ ID NO: 15917 - protein, 20 aa, synthetic construct
  source 1..20: note = Seed: SATGFKQSSKALQRPVASDF
SATGLKQISKALARPVASDF

SEQ ID NO: 15918 - protein, 20 aa, synthetic construct
  source 1..20: note = Seed: SATGFKQSSKALQRPVASDF
SATGLKQISKALFRPVASDF

SEQ ID NO: 15919 - protein, 20 aa, synthetic construct
  source 1..20: note = Seed: SATGFKQSSKALQRPVASDF
SATGLKQISKALGRPVASDF

SEQ ID NO: 15920 - protein, 20 aa, synthetic construct
  source 1..20: note = Seed: SATGFKQSSKALQRPVASDF
SATGLKQISKALHRPVASDF

SEQ ID NO: 15921 - protein, 20 aa, synthetic construct
  source 1..20: note = Seed: SATGFKQSSKALQRPVASDF
SATGLKQISKALIRPVASDF

SEQ ID NO: 15922 - protein, 20 aa, synthetic construct
  source 1..20: note = Seed: SATGFKQSSKALQRPVASDF
SATGLKQISKALKRPVASDF

SEQ ID NO: 15923 - protein, 20 aa, synthetic construct
  source 1..20: note = Seed: SATGFKQSSKALQRPVASDF
SATGLKQISKALLRPVASDF

SEQ ID NO: 15924 - protein, 20 aa, synthetic construct
  source 1..20: note = Seed: SATGFKQSSKALQRPVASDF
SATGLKQISKALMRPVASDF

SEQ ID NO: 15925 - protein, 20 aa, synthetic construct
  source 1..20: note = Seed: SATGFKQSSKALQRPVASDF
SATGLKQISKALNRPVASDF

SEQ ID NO: 15926 - protein, 20 aa, synthetic construct
  source 1..20: note = Seed: SATGFKQSSKALQRPVASDF
SATGLKQISKALPRPVASDF

SEQ ID NO: 15927 - protein, 20 aa, synthetic construct
  source 1..20: note = Seed: SATGFKQSSKALQRPVASDF
SATGLKQISKALQRPVASDF

SEQ ID NO: 15928 - protein, 20 aa, synthetic construct
  source 1..20: note = Seed: SATGFKQSSKALQRPVASDF
SATGLKQISKALRRPVASDF

SEQ ID NO: 15929 - protein, 20 aa, synthetic construct
  source 1..20: note = Seed: SATGFKQSSKALQRPVASDF
SATGLKQISKALSRPVASDF

SEQ ID NO: 15930 - protein, 20 aa, synthetic construct
  source 1..20: note = Seed: SATGFKQSSKALQRPVASDF
SATGLKQISKALTRPVASDF

SEQ ID NO: 15931 - protein, 20 aa, synthetic construct
  source 1..20: note = Seed: SATGFKQSSKALQRPVASDF
SATGLKQISKALVRPVASDF

SEQ ID NO: 15932 - protein, 20 aa, synthetic construct
  source 1..20: note = Seed: SATGFKQSSKALQRPVASDF
SATGLKQISKALYRPVASDF

SEQ ID NO: 15933 - protein, 20 aa, synthetic construct
  source 1..20: note = Seed: SATGFKQSSKALQRPVASDF
SATGLKQISLALGRPVASDF

SEQ ID NO: 15934 - protein, 20 aa, synthetic construct
  source 1..20: note = Seed: SATGFKQSSKALQRPVASDF
SATGLKQISLALHRPVASDF

SEQ ID NO: 15935 - protein, 20 aa, synthetic construct
  source 1..20: note = Seed: SATGFKQSSKALQRPVASDF
SATGLKQISLALMRPVASDF

SEQ ID NO: 15936 - protein, 20 aa, synthetic construct
  source 1..20: note = Seed: SATGFKQSSKALQRPVASDF
SATGLKQISLALNRPVASDF

SEQ ID NO: 15937 - protein, 20 aa, synthetic construct
  source 1..20: note = Seed: SATGFKQSSKALQRPVASDF
SATGLKQISLALVRPVASDF

SEQ ID NO: 15938 - protein, 20 aa, synthetic construct
  source 1..20: note = Seed: SATGFKQSSKALQRPVASDF
SATGLKQISMALNRPVASDF

SEQ ID NO: 15939 - protein, 20 aa, synthetic construct
  source 1..20: note = Seed: SATGFKQSSKALQRPVASDF
SATGLKQISNALARPVASDF

SEQ ID NO: 15940 - protein, 20 aa, synthetic construct
  source 1..20: note = Seed: SATGFKQSSKALQRPVASDF
SATGLKQISNALIRPVASDF

SEQ ID NO: 15941 - protein, 20 aa, synthetic construct
  source 1..20: note = Seed: SATGFKQSSKALQRPVASDF
SATGLKQISNALLRPVASDF

SEQ ID NO: 15942 - protein, 20 aa, synthetic construct
  source 1..20: note = Seed: SATGFKQSSKALQRPVASDF
SATGLKQISNALMRPVASDF

SEQ ID NO: 15943 - protein, 20 aa, synthetic construct
  source 1..20: note = Seed: SATGFKQSSKALQRPVASDF
SATGLKQISNALNRPVASDF

SEQ ID NO: 15944 - protein, 20 aa, synthetic construct
  source 1..20: note = Seed: SATGFKQSSKALQRPVASDF
SATGLKQISNALSRPVASDF

SEQ ID NO: 15945 - protein, 20 aa, synthetic construct
  source 1..20: note = Seed: SATGFKQSSKALQRPVASDF
SATGLKQISNALTRPVASDF

SEQ ID NO: 15946 - protein, 20 aa, synthetic construct
  source 1..20: note = Seed: SATGFKQSSKALQRPVASDF
SATGLKQISNALVRPVASDF

SEQ ID NO: 15947 - protein, 20 aa, synthetic construct
  source 1..20: note = Seed: SATGFKQSSKALQRPVASDF
SATGLKQISPALARPVASDF

SEQ ID NO: 15948 - protein, 20 aa, synthetic construct
  source 1..20: note = Seed: SATGFKQSSKALQRPVASDF
SATGLKQISPALGRPVASDF

SEQ ID NO: 15949 - protein, 20 aa, synthetic construct
  source 1..20: note = Seed: SATGFKQSSKALQRPVASDF
SATGLKQISPALHRPVASDF

SEQ ID NO: 15950 - protein, 20 aa, synthetic construct
  source 1..20: note = Seed: SATGFKQSSKALQRPVASDF
SATGLKQISPALIRPVASDF

SEQ ID NO: 15951 - protein, 20 aa, synthetic construct
  source 1..20: note = Seed: SATGFKQSSKALQRPVASDF
SATGLKQISPALLRPVASDF

SEQ ID NO: 15952 - protein, 20 aa, synthetic construct
  source 1..20: note = Seed: SATGFKQSSKALQRPVASDF
SATGLKQISPALMRPVASDF

SEQ ID NO: 15953 - protein, 20 aa, synthetic construct
  source 1..20: note = Seed: SATGFKQSSKALQRPVASDF
SATGLKQISPALNRPVASDF

SEQ ID NO: 15954 - protein, 20 aa, synthetic construct
  source 1..20: note = Seed: SATGFKQSSKALQRPVASDF
SATGLKQISPALPRPVASDF

SEQ ID NO: 15955 - protein, 20 aa, synthetic construct
  source 1..20: note = Seed: SATGFKQSSKALQRPVASDF
SATGLKQISPALQRPVASDF

SEQ ID NO: 15956 - protein, 20 aa, synthetic construct
  source 1..20: note = Seed: SATGFKQSSKALQRPVASDF
SATGLKQISPALSRPVASDF

SEQ ID NO: 15957 - protein, 20 aa, synthetic construct
  source 1..20: note = Seed: SATGFKQSSKALQRPVASDF
SATGLKQISPALTRPVASDF

SEQ ID NO: 15958 - protein, 20 aa, synthetic construct
  source 1..20: note = Seed: SATGFKQSSKALQRPVASDF
SATGLKQISPALVRPVASDF

SEQ ID NO: 15959 - protein, 20 aa, synthetic construct
  source 1..20: note = Seed: SATGFKQSSKALQRPVASDF
SATGLKQISRALARPVASDF

SEQ ID NO: 15960 - protein, 20 aa, synthetic construct
  source 1..20: note = Seed: SATGFKQSSKALQRPVASDF
SATGLKQISRALCRPVASDF

SEQ ID NO: 15961 - protein, 20 aa, synthetic construct
  source 1..20: note = Seed: SATGFKQSSKALQRPVASDF
SATGLKQISRALFRPVASDF

SEQ ID NO: 15962 - protein, 20 aa, synthetic construct
  source 1..20: note = Seed: SATGFKQSSKALQRPVASDF
SATGLKQISRALGRPVASDF

SEQ ID NO: 15963 - protein, 20 aa, synthetic construct
  source 1..20: note = Seed: SATGFKQSSKALQRPVASDF
SATGLKQISRALHRPVASDF

SEQ ID NO: 15964 - protein, 20 aa, synthetic construct
  source 1..20: note = Seed: SATGFKQSSKALQRPVASDF
SATGLKQISRALIRPVASDF

SEQ ID NO: 15965 - protein, 20 aa, synthetic construct
  source 1..20: note = Seed: SATGFKQSSKALQRPVASDF
SATGLKQISRALKRPVASDF

SEQ ID NO: 15966 - protein, 20 aa, synthetic construct
  source 1..20: note = Seed: SATGFKQSSKALQRPVASDF
SATGLKQISRALLRPVASDF

SEQ ID NO: 15967 - protein, 20 aa, synthetic construct
  source 1..20: note = Seed: SATGFKQSSKALQRPVASDF
SATGLKQISRALMRPVASDF

SEQ ID NO: 15968 - protein, 20 aa, synthetic construct
  source 1..20: note = Seed: SATGFKQSSKALQRPVASDF
SATGLKQISRALNRPVASDF

SEQ ID NO: 15969 - protein, 20 aa, synthetic construct
  source 1..20: note = Seed: SATGFKQSSKALQRPVASDF
SATGLKQISRALPRPVASDF

SEQ ID NO: 15970 - protein, 20 aa, synthetic construct
  source 1..20: note = Seed: SATGFKQSSKALQRPVASDF
SATGLKQISRALQRPVASDF

SEQ ID NO: 15971 - protein, 20 aa, synthetic construct
  source 1..20: note = Seed: SATGFKQSSKALQRPVASDF
SATGLKQISRALRRPVASDF

SEQ ID NO: 15972 - protein, 20 aa, synthetic construct
  source 1..20: note = Seed: SATGFKQSSKALQRPVASDF
SATGLKQISRALSRPVASDF

SEQ ID NO: 15973 - protein, 20 aa, synthetic construct
  source 1..20: note = Seed: SATGFKQSSKALQRPVASDF
SATGLKQISRALTRPVASDF

SEQ ID NO: 15974 - protein, 20 aa, synthetic construct
  source 1..20: note = Seed: SATGFKQSSKALQRPVASDF
SATGLKQISRALVRPVASDF

SEQ ID NO: 15975 - protein, 20 aa, synthetic construct
  source 1..20: note = Seed: SATGFKQSSKALQRPVASDF
SATGLKQISRALWRPVASDF

SEQ ID NO: 15976 - protein, 20 aa, synthetic construct
  source 1..20: note = Seed: SATGFKQSSKALQRPVASDF
SATGLKQISRALYRPVASDF

SEQ ID NO: 15977 - protein, 20 aa, synthetic construct
  source 1..20: note = Seed: SATGFKQSSKALQRPVASDF
SATGLKQISSALARPVASDF

SEQ ID NO: 15978 - protein, 20 aa, synthetic construct
  source 1..20: note = Seed: SATGFKQSSKALQRPVASDF
SATGLKQISSALCRPVASDF

SEQ ID NO: 15979 - protein, 20 aa, synthetic construct
  source 1..20: note = Seed: SATGFKQSSKALQRPVASDF
SATGLKQISSALGRPVASDF

SEQ ID NO: 15980 - protein, 20 aa, synthetic construct
  source 1..20: note = Seed: SATGFKQSSKALQRPVASDF
SATGLKQISSALHRPVASDF

SEQ ID NO: 15981 - protein, 20 aa, synthetic construct
  source 1..20: note = Seed: SATGFKQSSKALQRPVASDF
SATGLKQISSALIRPVASDF

SEQ ID NO: 15982 - protein, 20 aa, synthetic construct
  source 1..20: note = Seed: SATGFKQSSKALQRPVASDF
SATGLKQISSALLRPVASDF

SEQ ID NO: 15983 - protein, 20 aa, synthetic construct
  source 1..20: note = Seed: SATGFKQSSKALQRPVASDF
SATGLKQISSALMRPVASDF

SEQ ID NO: 15984 - protein, 20 aa, synthetic construct
  source 1..20: note = Seed: SATGFKQSSKALQRPVASDF
SATGLKQISSALNRPVASDF

SEQ ID NO: 15985 - protein, 20 aa, synthetic construct
  source 1..20: note = Seed: SATGFKQSSKALQRPVASDF
SATGLKQISSALSRPVASDF

SEQ ID NO: 15986 - protein, 20 aa, synthetic construct
  source 1..20: note = Seed: SATGFKQSSKALQRPVASDF
SATGLKQISSALTRPVASDF

SEQ ID NO: 15987 - protein, 20 aa, synthetic construct
  source 1..20: note = Seed: SATGFKQSSKALQRPVASDF
SATGLKQISSALVRPVASDF

SEQ ID NO: 15988 - protein, 20 aa, synthetic construct
  source 1..20: note = Seed: SATGFKQSSKALQRPVASDF
SATGLKQISTALARPVASDF

SEQ ID NO: 15989 - protein, 20 aa, synthetic construct
  source 1..20: note = Seed: SATGFKQSSKALQRPVASDF
SATGLKQISTALGRPVASDF

SEQ ID NO: 15990 - protein, 20 aa, synthetic construct
  source 1..20: note = Seed: SATGFKQSSKALQRPVASDF
SATGLKQISTALHRPVASDF

SEQ ID NO: 15991 - protein, 20 aa, synthetic construct
  source 1..20: note = Seed: SATGFKQSSKALQRPVASDF
SATGLKQISTALIRPVASDF

SEQ ID NO: 15992 - protein, 20 aa, synthetic construct
  source 1..20: note = Seed: SATGFKQSSKALQRPVASDF
SATGLKQISTALLRPVASDF

SEQ ID NO: 15993 - protein, 20 aa, synthetic construct
  source 1..20: note = Seed: SATGFKQSSKALQRPVASDF
SATGLKQISTALMRPVASDF

SEQ ID NO: 15994 - protein, 20 aa, synthetic construct
  source 1..20: note = Seed: SATGFKQSSKALQRPVASDF
SATGLKQISTALNRPVASDF

SEQ ID NO: 15995 - protein, 20 aa, synthetic construct
  source 1..20: note = Seed: SATGFKQSSKALQRPVASDF
SATGLKQISTALRRPVASDF

SEQ ID NO: 15996 - protein, 20 aa, synthetic construct
  source 1..20: note = Seed: SATGFKQSSKALQRPVASDF
SATGLKQISTALSRPVASDF

SEQ ID NO: 15997 - protein, 20 aa, synthetic construct
  source 1..20: note = Seed: SATGFKQSSKALQRPVASDF
SATGLKQISTALTRPVASDF

SEQ ID NO: 15998 - protein, 20 aa, synthetic construct
  source 1..20: note = Seed: SATGFKQSSKALQRPVASDF
SATGLKQISTALVRPVASDF

SEQ ID NO: 15999 - protein, 20 aa, synthetic construct
  source 1..20: note = Seed: SATGFKQSSKALQRPVASDF
SATGLKQISVALARPVASDF

SEQ ID NO: 16000 - protein, 20 aa, synthetic construct
  source 1..20: note = Seed: SATGFKQSSKALQRPVASDF
SATGLKQISVALERPVASDF

SEQ ID NO: 16001 - protein, 20 aa, synthetic construct
  source 1..20: note = Seed: SATGFKQSSKALQRPVASDF
SATGLKQISVALGRPVASDF

SEQ ID NO: 16002 - protein, 20 aa, synthetic construct
  source 1..20: note = Seed: SATGFKQSSKALQRPVASDF
SATGLKQISVALHRPVASDF

SEQ ID NO: 16003 - protein, 20 aa, synthetic construct
  source 1..20: note = Seed: SATGFKQSSKALQRPVASDF
SATGLKQISVALIRPVASDF

SEQ ID NO: 16004 - protein, 20 aa, synthetic construct
  source 1..20: note = Seed: SATGFKQSSKALQRPVASDF
SATGLKQISVALNRPVASDF

SEQ ID NO: 16005 - protein, 20 aa, synthetic construct
  source 1..20: note = Seed: SATGFKQSSKALQRPVASDF
SATGLKQISVALQRPVASDF

SEQ ID NO: 16006 - protein, 20 aa, synthetic construct
  source 1..20: note = Seed: SATGFKQSSKALQRPVASDF
SATGLKQISVALSRPVASDF

SEQ ID NO: 16007 - protein, 20 aa, synthetic construct
  source 1..20: note = Seed: SATGFKQSSKALQRPVASDF
SATGLKQISVALTRPVASDF

SEQ ID NO: 16008 - protein, 20 aa, synthetic construct
  source 1..20: note = Seed: SATGFKQSSKALQRPVASDF
SATGLKQISVALVRPVASDF

SEQ ID NO: 16009 - protein, 20 aa, synthetic construct
  source 1..20: note = Seed: SATGFKQSSKALQRPVASDF
SATGLKQKSIALARPVASDF

SEQ ID NO: 16010 - protein, 20 aa, synthetic construct
  source 1..20: note = Seed: SATGFKQSSKALQRPVASDF
SATGLKQKSKALRRPVASDF

SEQ ID NO: 16011 - protein, 20 aa, synthetic construct
  source 1..20: note = Seed: SATGFKQSSKALQRPVASDF
SATGLKQKSRALARPVASDF

SEQ ID NO: 16012 - protein, 20 aa, synthetic construct
  source 1..20: note = Seed: SATGFKQSSKALQRPVASDF
SATGLKQKSRALKRPVASDF

SEQ ID NO: 16013 - protein, 20 aa, synthetic construct
  source 1..20: note = Seed: SATGFKQSSKALQRPVASDF
SATGLKQKSRALRRPVASDF

SEQ ID NO: 16014 - protein, 20 aa, synthetic construct
  source 1..20: note = Seed: SATGFKQSSKALQRPVASDF
SATGLKQLSAALARPVASDF

SEQ ID NO: 16015 - protein, 20 aa, synthetic construct
  source 1..20: note = Seed: SATGFKQSSKALQRPVASDF
SATGLKQLSAALCRPVASDF

SEQ ID NO: 16016 - protein, 20 aa, synthetic construct
  source 1..20: note = Seed: SATGFKQSSKALQRPVASDF
SATGLKQLSAALDRPVASDF

SEQ ID NO: 16017 - protein, 20 aa, synthetic construct
  source 1..20: note = Seed: SATGFKQSSKALQRPVASDF
SATGLKQLSAALERPVASDF

SEQ ID NO: 16018 - protein, 20 aa, synthetic construct
  source 1..20: note = Seed: SATGFKQSSKALQRPVASDF
SATGLKQLSAALFRPVASDF

SEQ ID NO: 16019 - protein, 20 aa, synthetic construct
  source 1..20: note = Seed: SATGFKQSSKALQRPVASDF
SATGLKQLSAALGRPVASDF

SEQ ID NO: 16020 - protein, 20 aa, synthetic construct
  source 1..20: note = Seed: SATGFKQSSKALQRPVASDF
SATGLKQLSAALHRPVASDF

SEQ ID NO: 16021 - protein, 20 aa, synthetic construct
  source 1..20: note = Seed: SATGFKQSSKALQRPVASDF
SATGLKQLSAALIRPVASDF

SEQ ID NO: 16022 - protein, 20 aa, synthetic construct
  source 1..20: note = Seed: SATGFKQSSKALQRPVASDF
SATGLKQLSAALLRPVASDF

SEQ ID NO: 16023 - protein, 20 aa, synthetic construct
  source 1..20: note = Seed: SATGFKQSSKALQRPVASDF
SATGLKQLSAALMRPVASDF

SEQ ID NO: 16024 - protein, 20 aa, synthetic construct
  source 1..20: note = Seed: SATGFKQSSKALQRPVASDF
SATGLKQLSAALNRPVASDF

SEQ ID NO: 16025 - protein, 20 aa, synthetic construct
  source 1..20: note = Seed: SATGFKQSSKALQRPVASDF
SATGLKQLSAALPRPVASDF

SEQ ID NO: 16026 - protein, 20 aa, synthetic construct
  source 1..20: note = Seed: SATGFKQSSKALQRPVASDF
SATGLKQLSAALQRPVASDF

SEQ ID NO: 16027 - protein, 20 aa, synthetic construct
  source 1..20: note = Seed: SATGFKQSSKALQRPVASDF
SATGLKQLSAALRRPVASDF

SEQ ID NO: 16028 - protein, 20 aa, synthetic construct
  source 1..20: note = Seed: SATGFKQSSKALQRPVASDF
SATGLKQLSAALSRPVASDF

SEQ ID NO: 16029 - protein, 20 aa, synthetic construct
  source 1..20: note = Seed: SATGFKQSSKALQRPVASDF
SATGLKQLSAALTRPVASDF

SEQ ID NO: 16030 - protein, 20 aa, synthetic construct
  source 1..20: note = Seed: SATGFKQSSKALQRPVASDF
SATGLKQLSAALVRPVASDF

SEQ ID NO: 16031 - protein, 20 aa, synthetic construct
  source 1..20: note = Seed: SATGFKQSSKALQRPVASDF
SATGLKQLSAALYRPVASDF

SEQ ID NO: 16032 - protein, 20 aa, synthetic construct
  source 1..20: note = Seed: SATGFKQSSKALQRPVASDF
SATGLKQLSCALARPVASDF

SEQ ID NO: 16033 - protein, 20 aa, synthetic construct
  source 1..20: note = Seed: SATGFKQSSKALQRPVASDF
SATGLKQLSCALIRPVASDF

SEQ ID NO: 16034 - protein, 20 aa, synthetic construct
  source 1..20: note = Seed: SATGFKQSSKALQRPVASDF
SATGLKQLSCALSRPVASDF

SEQ ID NO: 16035 - protein, 20 aa, synthetic construct
  source 1..20: note = Seed: SATGFKQSSKALQRPVASDF
SATGLKQLSCALVRPVASDF

SEQ ID NO: 16036 - protein, 20 aa, synthetic construct
  source 1..20: note = Seed: SATGFKQSSKALQRPVASDF
SATGLKQLSFALARPVASDF

SEQ ID NO: 16037 - protein, 20 aa, synthetic construct
  source 1..20: note = Seed: SATGFKQSSKALQRPVASDF
SATGLKQLSFALERPVASDF

SEQ ID NO: 16038 - protein, 20 aa, synthetic construct
  source 1..20: note = Seed: SATGFKQSSKALQRPVASDF
SATGLKQLSFALSRPVASDF

SEQ ID NO: 16039 - protein, 20 aa, synthetic construct
  source 1..20: note = Seed: SATGFKQSSKALQRPVASDF
SATGLKQLSFALTRPVASDF

SEQ ID NO: 16040 - protein, 20 aa, synthetic construct
  source 1..20: note = Seed: SATGFKQSSKALQRPVASDF
SATGLKQLSFALVRPVASDF

SEQ ID NO: 16041 - protein, 20 aa, synthetic construct
  source 1..20: note = Seed: SATGFKQSSKALQRPVASDF
SATGLKQLSGALARPVASDF

SEQ ID NO: 16042 - protein, 20 aa, synthetic construct
  source 1..20: note = Seed: SATGFKQSSKALQRPVASDF
SATGLKQLSGALCRPVASDF

SEQ ID NO: 16043 - protein, 20 aa, synthetic construct
  source 1..20: note = Seed: SATGFKQSSKALQRPVASDF
SATGLKQLSGALFRPVASDF

SEQ ID NO: 16044 - protein, 20 aa, synthetic construct
  source 1..20: note = Seed: SATGFKQSSKALQRPVASDF
SATGLKQLSGALGRPVASDF

SEQ ID NO: 16045 - protein, 20 aa, synthetic construct
  source 1..20: note = Seed: SATGFKQSSKALQRPVASDF
SATGLKQLSGALHRPVASDF

SEQ ID NO: 16046 - protein, 20 aa, synthetic construct
  source 1..20: note = Seed: SATGFKQSSKALQRPVASDF
SATGLKQLSGALIRPVASDF

SEQ ID NO: 16047 - protein, 20 aa, synthetic construct
  source 1..20: note = Seed: SATGFKQSSKALQRPVASDF
SATGLKQLSGALLRPVASDF

SEQ ID NO: 16048 - protein, 20 aa, synthetic construct
  source 1..20: note = Seed: SATGFKQSSKALQRPVASDF
SATGLKQLSGALMRPVASDF

SEQ ID NO: 16049 - protein, 20 aa, synthetic construct
  source 1..20: note = Seed: SATGFKQSSKALQRPVASDF
SATGLKQLSGALNRPVASDF

SEQ ID NO: 16050 - protein, 20 aa, synthetic construct
  source 1..20: note = Seed: SATGFKQSSKALQRPVASDF
SATGLKQLSGALPRPVASDF

SEQ ID NO: 16051 - protein, 20 aa, synthetic construct
  source 1..20: note = Seed: SATGFKQSSKALQRPVASDF
SATGLKQLSGALSRPVASDF

SEQ ID NO: 16052 - protein, 20 aa, synthetic construct
  source 1..20: note = Seed: SATGFKQSSKALQRPVASDF
SATGLKQLSGALTRPVASDF

SEQ ID NO: 16053 - protein, 20 aa, synthetic construct
  source 1..20: note = Seed: SATGFKQSSKALQRPVASDF
SATGLKQLSGALVRPVASDF

SEQ ID NO: 16054 - protein, 20 aa, synthetic construct
  source 1..20: note = Seed: SATGFKQSSKALQRPVASDF
SATGLKQLSHALARPVASDF

SEQ ID NO: 16055 - protein, 20 aa, synthetic construct
  source 1..20: note = Seed: SATGFKQSSKALQRPVASDF
SATGLKQLSHALIRPVASDF

SEQ ID NO: 16056 - protein, 20 aa, synthetic construct
  source 1..20: note = Seed: SATGFKQSSKALQRPVASDF
SATGLKQLSHALKRPVASDF

SEQ ID NO: 16057 - protein, 20 aa, synthetic construct
  source 1..20: note = Seed: SATGFKQSSKALQRPVASDF
SATGLKQLSHALLRPVASDF

SEQ ID NO: 16058 - protein, 20 aa, synthetic construct
  source 1..20: note = Seed: SATGFKQSSKALQRPVASDF
SATGLKQLSHALMRPVASDF

SEQ ID NO: 16059 - protein, 20 aa, synthetic construct
  source 1..20: note = Seed: SATGFKQSSKALQRPVASDF
SATGLKQLSHALRRPVASDF

SEQ ID NO: 16060 - protein, 20 aa, synthetic construct
  source 1..20: note = Seed: SATGFKQSSKALQRPVASDF
SATGLKQLSHALSRPVASDF

SEQ ID NO: 16061 - protein, 20 aa, synthetic construct
  source 1..20: note = Seed: SATGFKQSSKALQRPVASDF
SATGLKQLSHALVRPVASDF

SEQ ID NO: 16062 - protein, 20 aa, synthetic construct
  source 1..20: note = Seed: SATGFKQSSKALQRPVASDF
SATGLKQLSIALARPVASDF

SEQ ID NO: 16063 - protein, 20 aa, synthetic construct
  source 1..20: note = Seed: SATGFKQSSKALQRPVASDF
SATGLKQLSIALCRPVASDF

SEQ ID NO: 16064 - protein, 20 aa, synthetic construct
  source 1..20: note = Seed: SATGFKQSSKALQRPVASDF
SATGLKQLSIALDRPVASDF

SEQ ID NO: 16065 - protein, 20 aa, synthetic construct
  source 1..20: note = Seed: SATGFKQSSKALQRPVASDF
SATGLKQLSIALGRPVASDF

SEQ ID NO: 16066 - protein, 20 aa, synthetic construct
  source 1..20: note = Seed: SATGFKQSSKALQRPVASDF
SATGLKQLSIALHRPVASDF

SEQ ID NO: 16067 - protein, 20 aa, synthetic construct
  source 1..20: note = Seed: SATGFKQSSKALQRPVASDF
SATGLKQLSIALIRPVASDF

SEQ ID NO: 16068 - protein, 20 aa, synthetic construct
  source 1..20: note = Seed: SATGFKQSSKALQRPVASDF
SATGLKQLSIALNRPVASDF

SEQ ID NO: 16069 - protein, 20 aa, synthetic construct
  source 1..20: note = Seed: SATGFKQSSKALQRPVASDF
SATGLKQLSIALRRPVASDF

SEQ ID NO: 16070 - protein, 20 aa, synthetic construct
  source 1..20: note = Seed: SATGFKQSSKALQRPVASDF
SATGLKQLSIALSRPVASDF

SEQ ID NO: 16071 - protein, 20 aa, synthetic construct
  source 1..20: note = Seed: SATGFKQSSKALQRPVASDF
SATGLKQLSIALTRPVASDF

SEQ ID NO: 16072 - protein, 20 aa, synthetic construct
  source 1..20: note = Seed: SATGFKQSSKALQRPVASDF
SATGLKQLSIALVRPVASDF

SEQ ID NO: 16073 - protein, 20 aa, synthetic construct
  source 1..20: note = Seed: SATGFKQSSKALQRPVASDF
SATGLKQLSIALYRPVASDF

SEQ ID NO: 16074 - protein, 20 aa, synthetic construct
  source 1..20: note = Seed: SATGFKQSSKALQRPVASDF
SATGLKQLSKALARPVASDF

SEQ ID NO: 16075 - protein, 20 aa, synthetic construct
  source 1..20: note = Seed: SATGFKQSSKALQRPVASDF
SATGLKQLSKALFRPVASDF

SEQ ID NO: 16076 - protein, 20 aa, synthetic construct
  source 1..20: note = Seed: SATGFKQSSKALQRPVASDF
SATGLKQLSKALGRPVASDF

SEQ ID NO: 16077 - protein, 20 aa, synthetic construct
  source 1..20: note = Seed: SATGFKQSSKALQRPVASDF
SATGLKQLSKALHRPVASDF

SEQ ID NO: 16078 - protein, 20 aa, synthetic construct
  source 1..20: note = Seed: SATGFKQSSKALQRPVASDF
SATGLKQLSKALIRPVASDF

SEQ ID NO: 16079 - protein, 20 aa, synthetic construct
  source 1..20: note = Seed: SATGFKQSSKALQRPVASDF
SATGLKQLSKALKRPVASDF

SEQ ID NO: 16080 - protein, 20 aa, synthetic construct
  source 1..20: note = Seed: SATGFKQSSKALQRPVASDF
SATGLKQLSKALLRPVASDF

SEQ ID NO: 16081 - protein, 20 aa, synthetic construct
  source 1..20: note = Seed: SATGFKQSSKALQRPVASDF
SATGLKQLSKALMRPVASDF

SEQ ID NO: 16082 - protein, 20 aa, synthetic construct
  source 1..20: note = Seed: SATGFKQSSKALQRPVASDF
SATGLKQLSKALNRPVASDF

SEQ ID NO: 16083 - protein, 20 aa, synthetic construct
  source 1..20: note = Seed: SATGFKQSSKALQRPVASDF
SATGLKQLSKALPRPVASDF

SEQ ID NO: 16084 - protein, 20 aa, synthetic construct
  source 1..20: note = Seed: SATGFKQSSKALQRPVASDF
SATGLKQLSKALQRPVASDF

SEQ ID NO: 16085 - protein, 20 aa, synthetic construct
  source 1..20: note = Seed: SATGFKQSSKALQRPVASDF
SATGLKQLSKALRRPVASDF

SEQ ID NO: 16086 - protein, 20 aa, synthetic construct
  source 1..20: note = Seed: SATGFKQSSKALQRPVASDF
SATGLKQLSKALSRPVASDF

SEQ ID NO: 16087 - protein, 20 aa, synthetic construct
  source 1..20: note = Seed: SATGFKQSSKALQRPVASDF
SATGLKQLSKALTRPVASDF

SEQ ID NO: 16088 - protein, 20 aa, synthetic construct
  source 1..20: note = Seed: SATGFKQSSKALQRPVASDF
SATGLKQLSKALVRPVASDF

SEQ ID NO: 16089 - protein, 20 aa, synthetic construct
  source 1..20: note = Seed: SATGFKQSSKALQRPVASDF
SATGLKQLSKALYRPVASDF

SEQ ID NO: 16090 - protein, 20 aa, synthetic construct
  source 1..20: note = Seed: SATGFKQSSKALQRPVASDF
SATGLKQLSLALCRPVASDF

SEQ ID NO: 16091 - protein, 20 aa, synthetic construct
  source 1..20: note = Seed: SATGFKQSSKALQRPVASDF
SATGLKQLSLALGRPVASDF

SEQ ID NO: 16092 - protein, 20 aa, synthetic construct
  source 1..20: note = Seed: SATGFKQSSKALQRPVASDF
SATGLKQLSLALHRPVASDF

SEQ ID NO: 16093 - protein, 20 aa, synthetic construct
  source 1..20: note = Seed: SATGFKQSSKALQRPVASDF
SATGLKQLSLALMRPVASDF

SEQ ID NO: 16094 - protein, 20 aa, synthetic construct
  source 1..20: note = Seed: SATGFKQSSKALQRPVASDF
SATGLKQLSLALNRPVASDF

SEQ ID NO: 16095 - protein, 20 aa, synthetic construct
  source 1..20: note = Seed: SATGFKQSSKALQRPVASDF
SATGLKQLSLALSRPVASDF

SEQ ID NO: 16096 - protein, 20 aa, synthetic construct
  source 1..20: note = Seed: SATGFKQSSKALQRPVASDF
SATGLKQLSLALTRPVASDF

SEQ ID NO: 16097 - protein, 20 aa, synthetic construct
  source 1..20: note = Seed: SATGFKQSSKALQRPVASDF
SATGLKQLSLALVRPVASDF

SEQ ID NO: 16098 - protein, 20 aa, synthetic construct
  source 1..20: note = Seed: SATGFKQSSKALQRPVASDF
SATGLKQLSMALCRPVASDF

SEQ ID NO: 16099 - protein, 20 aa, synthetic construct
  source 1..20: note = Seed: SATGFKQSSKALQRPVASDF
SATGLKQLSMALGRPVASDF

SEQ ID NO: 16100 - protein, 20 aa, synthetic construct
  source 1..20: note = Seed: SATGFKQSSKALQRPVASDF
SATGLKQLSMALHRPVASDF

SEQ ID NO: 16101 - protein, 20 aa, synthetic construct
  source 1..20: note = Seed: SATGFKQSSKALQRPVASDF
SATGLKQLSMALNRPVASDF

SEQ ID NO: 16102 - protein, 20 aa, synthetic construct
  source 1..20: note = Seed: SATGFKQSSKALQRPVASDF
SATGLKQLSMALSRPVASDF

SEQ ID NO: 16103 - protein, 20 aa, synthetic construct
  source 1..20: note = Seed: SATGFKQSSKALQRPVASDF
SATGLKQLSNALARPVASDF

SEQ ID NO: 16104 - protein, 20 aa, synthetic construct
  source 1..20: note = Seed: SATGFKQSSKALQRPVASDF
SATGLKQLSNALCRPVASDF

SEQ ID NO: 16105 - protein, 20 aa, synthetic construct
  source 1..20: note = Seed: SATGFKQSSKALQRPVASDF
SATGLKQLSNALGRPVASDF

SEQ ID NO: 16106 - protein, 20 aa, synthetic construct
  source 1..20: note = Seed: SATGFKQSSKALQRPVASDF
SATGLKQLSNALIRPVASDF

SEQ ID NO: 16107 - protein, 20 aa, synthetic construct
  source 1..20: note = Seed: SATGFKQSSKALQRPVASDF
SATGLKQLSNALLRPVASDF

SEQ ID NO: 16108 - protein, 20 aa, synthetic construct
  source 1..20: note = Seed: SATGFKQSSKALQRPVASDF
SATGLKQLSNALMRPVASDF

SEQ ID NO: 16109 - protein, 20 aa, synthetic construct
  source 1..20: note = Seed: SATGFKQSSKALQRPVASDF
SATGLKQLSNALNRPVASDF

SEQ ID NO: 16110 - protein, 20 aa, synthetic construct
  source 1..20: note = Seed: SATGFKQSSKALQRPVASDF
SATGLKQLSNALRRPVASDF

SEQ ID NO: 16111 - protein, 20 aa, synthetic construct
  source 1..20: note = Seed: SATGFKQSSKALQRPVASDF
SATGLKQLSNALSRPVASDF

SEQ ID NO: 16112 - protein, 20 aa, synthetic construct
  source 1..20: note = Seed: SATGFKQSSKALQRPVASDF
SATGLKQLSNALTRPVASDF

SEQ ID NO: 16113 - protein, 20 aa, synthetic construct
  source 1..20: note = Seed: SATGFKQSSKALQRPVASDF
SATGLKQLSNALVRPVASDF

SEQ ID NO: 16114 - protein, 20 aa, synthetic construct
  source 1..20: note = Seed: SATGFKQSSKALQRPVASDF
SATGLKQLSPALARPVASDF

SEQ ID NO: 16115 - protein, 20 aa, synthetic construct
  source 1..20: note = Seed: SATGFKQSSKALQRPVASDF
SATGLKQLSPALCRPVASDF

SEQ ID NO: 16116 - protein, 20 aa, synthetic construct
  source 1..20: note = Seed: SATGFKQSSKALQRPVASDF
SATGLKQLSPALDRPVASDF

SEQ ID NO: 16117 - protein, 20 aa, synthetic construct
  source 1..20: note = Seed: SATGFKQSSKALQRPVASDF
SATGLKQLSPALFRPVASDF

SEQ ID NO: 16118 - protein, 20 aa, synthetic construct
  source 1..20: note = Seed: SATGFKQSSKALQRPVASDF
SATGLKQLSPALGRPVASDF

SEQ ID NO: 16119 - protein, 20 aa, synthetic construct
  source 1..20: note = Seed: SATGFKQSSKALQRPVASDF
SATGLKQLSPALHRPVASDF

SEQ ID NO: 16120 - protein, 20 aa, synthetic construct
  source 1..20: note = Seed: SATGFKQSSKALQRPVASDF
SATGLKQLSPALIRPVASDF

SEQ ID NO: 16121 - protein, 20 aa, synthetic construct
  source 1..20: note = Seed: SATGFKQSSKALQRPVASDF
SATGLKQLSPALLRPVASDF

SEQ ID NO: 16122 - protein, 20 aa, synthetic construct
  source 1..20: note = Seed: SATGFKQSSKALQRPVASDF
SATGLKQLSPALMRPVASDF

SEQ ID NO: 16123 - protein, 20 aa, synthetic construct
  source 1..20: note = Seed: SATGFKQSSKALQRPVASDF
SATGLKQLSPALNRPVASDF

SEQ ID NO: 16124 - protein, 20 aa, synthetic construct
  source 1..20: note = Seed: SATGFKQSSKALQRPVASDF
SATGLKQLSPALPRPVASDF

SEQ ID NO: 16125 - protein, 20 aa, synthetic construct
  source 1..20: note = Seed: SATGFKQSSKALQRPVASDF
SATGLKQLSPALQRPVASDF

SEQ ID NO: 16126 - protein, 20 aa, synthetic construct
  source 1..20: note = Seed: SATGFKQSSKALQRPVASDF
SATGLKQLSPALSRPVASDF

SEQ ID NO: 16127 - protein, 20 aa, synthetic construct
  source 1..20: note = Seed: SATGFKQSSKALQRPVASDF
SATGLKQLSPALTRPVASDF

SEQ ID NO: 16128 - protein, 20 aa, synthetic construct
  source 1..20: note = Seed: SATGFKQSSKALQRPVASDF
SATGLKQLSPALVRPVASDF

SEQ ID NO: 16129 - protein, 20 aa, synthetic construct
  source 1..20: note = Seed: SATGFKQSSKALQRPVASDF
SATGLKQLSQALARPVASDF

SEQ ID NO: 16130 - protein, 20 aa, synthetic construct
  source 1..20: note = Seed: SATGFKQSSKALQRPVASDF
SATGLKQLSQALIRPVASDF

SEQ ID NO: 16131 - protein, 20 aa, synthetic construct
  source 1..20: note = Seed: SATGFKQSSKALQRPVASDF
SATGLKQLSQALSRPVASDF

SEQ ID NO: 16132 - protein, 20 aa, synthetic construct
  source 1..20: note = Seed: SATGFKQSSKALQRPVASDF
SATGLKQLSQALVRPVASDF

SEQ ID NO: 16133 - protein, 20 aa, synthetic construct
  source 1..20: note = Seed: SATGFKQSSKALQRPVASDF
SATGLKQLSRALARPVASDF

SEQ ID NO: 16134 - protein, 20 aa, synthetic construct
  source 1..20: note = Seed: SATGFKQSSKALQRPVASDF
SATGLKQLSRALCRPVASDF

SEQ ID NO: 16135 - protein, 20 aa, synthetic construct
  source 1..20: note = Seed: SATGFKQSSKALQRPVASDF
SATGLKQLSRALERPVASDF

SEQ ID NO: 16136 - protein, 20 aa, synthetic construct
  source 1..20: note = Seed: SATGFKQSSKALQRPVASDF
SATGLKQLSRALFRPVASDF

SEQ ID NO: 16137 - protein, 20 aa, synthetic construct
  source 1..20: note = Seed: SATGFKQSSKALQRPVASDF
SATGLKQLSRALGRPVASDF

SEQ ID NO: 16138 - protein, 20 aa, synthetic construct
  source 1..20: note = Seed: SATGFKQSSKALQRPVASDF
SATGLKQLSRALHRPVASDF

SEQ ID NO: 16139 - protein, 20 aa, synthetic construct
  source 1..20: note = Seed: SATGFKQSSKALQRPVASDF
SATGLKQLSRALIRPVASDF

SEQ ID NO: 16140 - protein, 20 aa, synthetic construct
  source 1..20: note = Seed: SATGFKQSSKALQRPVASDF
SATGLKQLSRALKRPVASDF

SEQ ID NO: 16141 - protein, 20 aa, synthetic construct
  source 1..20: note = Seed: SATGFKQSSKALQRPVASDF
SATGLKQLSRALLRPVASDF

SEQ ID NO: 16142 - protein, 20 aa, synthetic construct
  source 1..20: note = Seed: SATGFKQSSKALQRPVASDF
SATGLKQLSRALMRPVASDF

SEQ ID NO: 16143 - protein, 20 aa, synthetic construct
  source 1..20: note = Seed: SATGFKQSSKALQRPVASDF
SATGLKQLSRALNRPVASDF

SEQ ID NO: 16144 - protein, 20 aa, synthetic construct
  source 1..20: note = Seed: SATGFKQSSKALQRPVASDF
SATGLKQLSRALPRPVASDF

SEQ ID NO: 16145 - protein, 20 aa, synthetic construct
  source 1..20: note = Seed: SATGFKQSSKALQRPVASDF
SATGLKQLSRALQRPVASDF

SEQ ID NO: 16146 - protein, 20 aa, synthetic construct
  source 1..20: note = Seed: SATGFKQSSKALQRPVASDF
SATGLKQLSRALRRPVASDF

SEQ ID NO: 16147 - protein, 20 aa, synthetic construct
  source 1..20: note = Seed: SATGFKQSSKALQRPVASDF
SATGLKQLSRALSRPVASDF

SEQ ID NO: 16148 - protein, 20 aa, synthetic construct
  source 1..20: note = Seed: SATGFKQSSKALQRPVASDF
SATGLKQLSRALTRPVASDF

SEQ ID NO: 16149 - protein, 20 aa, synthetic construct
  source 1..20: note = Seed: SATGFKQSSKALQRPVASDF
SATGLKQLSRALVRPVASDF

SEQ ID NO: 16150 - protein, 20 aa, synthetic construct
  source 1..20: note = Seed: SATGFKQSSKALQRPVASDF
SATGLKQLSRALWRPVASDF

SEQ ID NO: 16151 - protein, 20 aa, synthetic construct
  source 1..20: note = Seed: SATGFKQSSKALQRPVASDF
SATGLKQLSRALYRPVASDF

SEQ ID NO: 16152 - protein, 20 aa, synthetic construct
  source 1..20: note = Seed: SATGFKQSSKALQRPVASDF
SATGLKQLSSALARPVASDF

SEQ ID NO: 16153 - protein, 20 aa, synthetic construct
  source 1..20: note = Seed: SATGFKQSSKALQRPVASDF
SATGLKQLSSALCRPVASDF

SEQ ID NO: 16154 - protein, 20 aa, synthetic construct
  source 1..20: note = Seed: SATGFKQSSKALQRPVASDF
SATGLKQLSSALFRPVASDF

SEQ ID NO: 16155 - protein, 20 aa, synthetic construct
  source 1..20: note = Seed: SATGFKQSSKALQRPVASDF
SATGLKQLSSALGRPVASDF

SEQ ID NO: 16156 - protein, 20 aa, synthetic construct
  source 1..20: note = Seed: SATGFKQSSKALQRPVASDF
SATGLKQLSSALHRPVASDF

SEQ ID NO: 16157 - protein, 20 aa, synthetic construct
  source 1..20: note = Seed: SATGFKQSSKALQRPVASDF
SATGLKQLSSALIRPVASDF

SEQ ID NO: 16158 - protein, 20 aa, synthetic construct
  source 1..20: note = Seed: SATGFKQSSKALQRPVASDF
SATGLKQLSSALLRPVASDF

SEQ ID NO: 16159 - protein, 20 aa, synthetic construct
  source 1..20: note = Seed: SATGFKQSSKALQRPVASDF
SATGLKQLSSALMRPVASDF

SEQ ID NO: 16160 - protein, 20 aa, synthetic construct
  source 1..20: note = Seed: SATGFKQSSKALQRPVASDF
SATGLKQLSSALNRPVASDF

SEQ ID NO: 16161 - protein, 20 aa, synthetic construct
  source 1..20: note = Seed: SATGFKQSSKALQRPVASDF
SATGLKQLSSALQRPVASDF

SEQ ID NO: 16162 - protein, 20 aa, synthetic construct
  source 1..20: note = Seed: SATGFKQSSKALQRPVASDF
SATGLKQLSSALSRPVASDF

SEQ ID NO: 16163 - protein, 20 aa, synthetic construct
  source 1..20: note = Seed: SATGFKQSSKALQRPVASDF
SATGLKQLSSALTRPVASDF

SEQ ID NO: 16164 - protein, 20 aa, synthetic construct
  source 1..20: note = Seed: SATGFKQSSKALQRPVASDF
SATGLKQLSSALVRPVASDF

SEQ ID NO: 16165 - protein, 20 aa, synthetic construct
  source 1..20: note = Seed: SATGFKQSSKALQRPVASDF
SATGLKQLSSALYRPVASDF

SEQ ID NO: 16166 - protein, 20 aa, synthetic construct
  source 1..20: note = Seed: SATGFKQSSKALQRPVASDF
SATGLKQLSTALARPVASDF

SEQ ID NO: 16167 - protein, 20 aa, synthetic construct
  source 1..20: note = Seed: SATGFKQSSKALQRPVASDF
SATGLKQLSTALCRPVASDF

SEQ ID NO: 16168 - protein, 20 aa, synthetic construct
  source 1..20: note = Seed: SATGFKQSSKALQRPVASDF
SATGLKQLSTALGRPVASDF

SEQ ID NO: 16169 - protein, 20 aa, synthetic construct
  source 1..20: note = Seed: SATGFKQSSKALQRPVASDF
SATGLKQLSTALHRPVASDF

SEQ ID NO: 16170 - protein, 20 aa, synthetic construct
  source 1..20: note = Seed: SATGFKQSSKALQRPVASDF
SATGLKQLSTALIRPVASDF

SEQ ID NO: 16171 - protein, 20 aa, synthetic construct
  source 1..20: note = Seed: SATGFKQSSKALQRPVASDF
SATGLKQLSTALLRPVASDF

SEQ ID NO: 16172 - protein, 20 aa, synthetic construct
  source 1..20: note = Seed: SATGFKQSSKALQRPVASDF
SATGLKQLSTALMRPVASDF

SEQ ID NO: 16173 - protein, 20 aa, synthetic construct
  source 1..20: note = Seed: SATGFKQSSKALQRPVASDF
SATGLKQLSTALNRPVASDF

SEQ ID NO: 16174 - protein, 20 aa, synthetic construct
  source 1..20: note = Seed: SATGFKQSSKALQRPVASDF
SATGLKQLSTALPRPVASDF

SEQ ID NO: 16175 - protein, 20 aa, synthetic construct
  source 1..20: note = Seed: SATGFKQSSKALQRPVASDF
SATGLKQLSTALQRPVASDF

SEQ ID NO: 16176 - protein, 20 aa, synthetic construct
  source 1..20: note = Seed: SATGFKQSSKALQRPVASDF
SATGLKQLSTALRRPVASDF

SEQ ID NO: 16177 - protein, 20 aa, synthetic construct
  source 1..20: note = Seed: SATGFKQSSKALQRPVASDF
SATGLKQLSTALSRPVASDF

SEQ ID NO: 16178 - protein, 20 aa, synthetic construct
  source 1..20: note = Seed: SATGFKQSSKALQRPVASDF
SATGLKQLSTALTRPVASDF

SEQ ID NO: 16179 - protein, 20 aa, synthetic construct
  source 1..20: note = Seed: SATGFKQSSKALQRPVASDF
SATGLKQLSTALVRPVASDF

SEQ ID NO: 16180 - protein, 20 aa, synthetic construct
  source 1..20: note = Seed: SATGFKQSSKALQRPVASDF
SATGLKQLSVALARPVASDF

SEQ ID NO: 16181 - protein, 20 aa, synthetic construct
  source 1..20: note = Seed: SATGFKQSSKALQRPVASDF
SATGLKQLSVALCRPVASDF

SEQ ID NO: 16182 - protein, 20 aa, synthetic construct
  source 1..20: note = Seed: SATGFKQSSKALQRPVASDF
SATGLKQLSVALDRPVASDF

SEQ ID NO: 16183 - protein, 20 aa, synthetic construct
  source 1..20: note = Seed: SATGFKQSSKALQRPVASDF
SATGLKQLSVALERPVASDF

SEQ ID NO: 16184 - protein, 20 aa, synthetic construct
  source 1..20: note = Seed: SATGFKQSSKALQRPVASDF
SATGLKQLSVALFRPVASDF

SEQ ID NO: 16185 - protein, 20 aa, synthetic construct
  source 1..20: note = Seed: SATGFKQSSKALQRPVASDF
SATGLKQLSVALGRPVASDF

SEQ ID NO: 16186 - protein, 20 aa, synthetic construct
  source 1..20: note = Seed: SATGFKQSSKALQRPVASDF
SATGLKQLSVALHRPVASDF

SEQ ID NO: 16187 - protein, 20 aa, synthetic construct
  source 1..20: note = Seed: SATGFKQSSKALQRPVASDF
SATGLKQLSVALIRPVASDF

SEQ ID NO: 16188 - protein, 20 aa, synthetic construct
  source 1..20: note = Seed: SATGFKQSSKALQRPVASDF
SATGLKQLSVALLRPVASDF

SEQ ID NO: 16189 - protein, 20 aa, synthetic construct
  source 1..20: note = Seed: SATGFKQSSKALQRPVASDF
SATGLKQLSVALMRPVASDF

SEQ ID NO: 16190 - protein, 20 aa, synthetic construct
  source 1..20: note = Seed: SATGFKQSSKALQRPVASDF
SATGLKQLSVALNRPVASDF

SEQ ID NO: 16191 - protein, 20 aa, synthetic construct
  source 1..20: note = Seed: SATGFKQSSKALQRPVASDF
SATGLKQLSVALPRPVASDF

SEQ ID NO: 16192 - protein, 20 aa, synthetic construct
  source 1..20: note = Seed: SATGFKQSSKALQRPVASDF
SATGLKQLSVALQRPVASDF

SEQ ID NO: 16193 - protein, 20 aa, synthetic construct
  source 1..20: note = Seed: SATGFKQSSKALQRPVASDF
SATGLKQLSVALRRPVASDF

SEQ ID NO: 16194 - protein, 20 aa, synthetic construct
  source 1..20: note = Seed: SATGFKQSSKALQRPVASDF
SATGLKQLSVALSRPVASDF

SEQ ID NO: 16195 - protein, 20 aa, synthetic construct
  source 1..20: note = Seed: SATGFKQSSKALQRPVASDF
SATGLKQLSVALTRPVASDF

SEQ ID NO: 16196 - protein, 20 aa, synthetic construct
  source 1..20: note = Seed: SATGFKQSSKALQRPVASDF
SATGLKQLSVALVRPVASDF

SEQ ID NO: 16197 - protein, 20 aa, synthetic construct
  source 1..20: note = Seed: SATGFKQSSKALQRPVASDF
SATGLKQMSAALARPVASDF

SEQ ID NO: 16198 - protein, 20 aa, synthetic construct
  source 1..20: note = Seed: SATGFKQSSKALQRPVASDF
SATGLKQMSAALCRPVASDF

SEQ ID NO: 16199 - protein, 20 aa, synthetic construct
  source 1..20: note = Seed: SATGFKQSSKALQRPVASDF
SATGLKQMSAALDRPVASDF

SEQ ID NO: 16200 - protein, 20 aa, synthetic construct
  source 1..20: note = Seed: SATGFKQSSKALQRPVASDF
SATGLKQMSAALERPVASDF

SEQ ID NO: 16201 - protein, 20 aa, synthetic construct
  source 1..20: note = Seed: SATGFKQSSKALQRPVASDF
SATGLKQMSAALFRPVASDF

SEQ ID NO: 16202 - protein, 20 aa, synthetic construct
  source 1..20: note = Seed: SATGFKQSSKALQRPVASDF
SATGLKQMSAALGRPVASDF

SEQ ID NO: 16203 - protein, 20 aa, synthetic construct
  source 1..20: note = Seed: SATGFKQSSKALQRPVASDF
SATGLKQMSAALHRPVASDF

SEQ ID NO: 16204 - protein, 20 aa, synthetic construct
  source 1..20: note = Seed: SATGFKQSSKALQRPVASDF
SATGLKQMSAALIRPVASDF

SEQ ID NO: 16205 - protein, 20 aa, synthetic construct
  source 1..20: note = Seed: SATGFKQSSKALQRPVASDF
SATGLKQMSAALKRPVASDF

SEQ ID NO: 16206 - protein, 20 aa, synthetic construct
  source 1..20: note = Seed: SATGFKQSSKALQRPVASDF
SATGLKQMSAALLRPVASDF

SEQ ID NO: 16207 - protein, 20 aa, synthetic construct
  source 1..20: note = Seed: SATGFKQSSKALQRPVASDF
SATGLKQMSAALMRPVASDF

SEQ ID NO: 16208 - protein, 20 aa, synthetic construct
  source 1..20: note = Seed: SATGFKQSSKALQRPVASDF
SATGLKQMSAALNRPVASDF

SEQ ID NO: 16209 - protein, 20 aa, synthetic construct
  source 1..20: note = Seed: SATGFKQSSKALQRPVASDF
SATGLKQMSAALPRPVASDF

SEQ ID NO: 16210 - protein, 20 aa, synthetic construct
  source 1..20: note = Seed: SATGFKQSSKALQRPVASDF
SATGLKQMSAALQRPVASDF

SEQ ID NO: 16211 - protein, 20 aa, synthetic construct
  source 1..20: note = Seed: SATGFKQSSKALQRPVASDF
SATGLKQMSAALRRPVASDF

SEQ ID NO: 16212 - protein, 20 aa, synthetic construct
  source 1..20: note = Seed: SATGFKQSSKALQRPVASDF
SATGLKQMSAALSRPVASDF

SEQ ID NO: 16213 - protein, 20 aa, synthetic construct
  source 1..20: note = Seed: SATGFKQSSKALQRPVASDF
SATGLKQMSAALTRPVASDF

SEQ ID NO: 16214 - protein, 20 aa, synthetic construct
  source 1..20: note = Seed: SATGFKQSSKALQRPVASDF
SATGLKQMSAALVRPVASDF

SEQ ID NO: 16215 - protein, 20 aa, synthetic construct
  source 1..20: note = Seed: SATGFKQSSKALQRPVASDF
SATGLKQMSAALYRPVASDF

SEQ ID NO: 16216 - protein, 20 aa, synthetic construct
  source 1..20: note = Seed: SATGFKQSSKALQRPVASDF
SATGLKQMSCALARPVASDF

SEQ ID NO: 16217 - protein, 20 aa, synthetic construct
  source 1..20: note = Seed: SATGFKQSSKALQRPVASDF
SATGLKQMSCALIRPVASDF

SEQ ID NO: 16218 - protein, 20 aa, synthetic construct
  source 1..20: note = Seed: SATGFKQSSKALQRPVASDF
SATGLKQMSCALSRPVASDF

SEQ ID NO: 16219 - protein, 20 aa, synthetic construct
  source 1..20: note = Seed: SATGFKQSSKALQRPVASDF
SATGLKQMSCALVRPVASDF

SEQ ID NO: 16220 - protein, 20 aa, synthetic construct
  source 1..20: note = Seed: SATGFKQSSKALQRPVASDF
SATGLKQMSEALARPVASDF

SEQ ID NO: 16221 - protein, 20 aa, synthetic construct
  source 1..20: note = Seed: SATGFKQSSKALQRPVASDF
SATGLKQMSFALMRPVASDF

SEQ ID NO: 16222 - protein, 20 aa, synthetic construct
  source 1..20: note = Seed: SATGFKQSSKALQRPVASDF
SATGLKQMSFALVRPVASDF

SEQ ID NO: 16223 - protein, 20 aa, synthetic construct
  source 1..20: note = Seed: SATGFKQSSKALQRPVASDF
SATGLKQMSGALARPVASDF

SEQ ID NO: 16224 - protein, 20 aa, synthetic construct
  source 1..20: note = Seed: SATGFKQSSKALQRPVASDF
SATGLKQMSGALCRPVASDF

SEQ ID NO: 16225 - protein, 20 aa, synthetic construct
  source 1..20: note = Seed: SATGFKQSSKALQRPVASDF
SATGLKQMSGALFRPVASDF

SEQ ID NO: 16226 - protein, 20 aa, synthetic construct
  source 1..20: note = Seed: SATGFKQSSKALQRPVASDF
SATGLKQMSGALGRPVASDF

SEQ ID NO: 16227 - protein, 20 aa, synthetic construct
  source 1..20: note = Seed: SATGFKQSSKALQRPVASDF
SATGLKQMSGALHRPVASDF

SEQ ID NO: 16228 - protein, 20 aa, synthetic construct
  source 1..20: note = Seed: SATGFKQSSKALQRPVASDF
SATGLKQMSGALIRPVASDF

SEQ ID NO: 16229 - protein, 20 aa, synthetic construct
  source 1..20: note = Seed: SATGFKQSSKALQRPVASDF
SATGLKQMSGALLRPVASDF

SEQ ID NO: 16230 - protein, 20 aa, synthetic construct
  source 1..20: note = Seed: SATGFKQSSKALQRPVASDF
SATGLKQMSGALMRPVASDF

SEQ ID NO: 16231 - protein, 20 aa, synthetic construct
  source 1..20: note = Seed: SATGFKQSSKALQRPVASDF
SATGLKQMSGALNRPVASDF

SEQ ID NO: 16232 - protein, 20 aa, synthetic construct
  source 1..20: note = Seed: SATGFKQSSKALQRPVASDF
SATGLKQMSGALPRPVASDF

SEQ ID NO: 16233 - protein, 20 aa, synthetic construct
  source 1..20: note = Seed: SATGFKQSSKALQRPVASDF
SATGLKQMSGALQRPVASDF

SEQ ID NO: 16234 - protein, 20 aa, synthetic construct
  source 1..20: note = Seed: SATGFKQSSKALQRPVASDF
SATGLKQMSGALSRPVASDF

SEQ ID NO: 16235 - protein, 20 aa, synthetic construct
  source 1..20: note = Seed: SATGFKQSSKALQRPVASDF
SATGLKQMSGALTRPVASDF

SEQ ID NO: 16236 - protein, 20 aa, synthetic construct
  source 1..20: note = Seed: SATGFKQSSKALQRPVASDF
SATGLKQMSGALVRPVASDF

SEQ ID NO: 16237 - protein, 20 aa, synthetic construct
  source 1..20: note = Seed: SATGFKQSSKALQRPVASDF
SATGLKQMSHALARPVASDF

SEQ ID NO: 16238 - protein, 20 aa, synthetic construct
  source 1..20: note = Seed: SATGFKQSSKALQRPVASDF
SATGLKQMSHALIRPVASDF

SEQ ID NO: 16239 - protein, 20 aa, synthetic construct
  source 1..20: note = Seed: SATGFKQSSKALQRPVASDF
SATGLKQMSHALKRPVASDF

SEQ ID NO: 16240 - protein, 20 aa, synthetic construct
  source 1..20: note = Seed: SATGFKQSSKALQRPVASDF
SATGLKQMSHALLRPVASDF

SEQ ID NO: 16241 - protein, 20 aa, synthetic construct
  source 1..20: note = Seed: SATGFKQSSKALQRPVASDF
SATGLKQMSHALMRPVASDF

SEQ ID NO: 16242 - protein, 20 aa, synthetic construct
  source 1..20: note = Seed: SATGFKQSSKALQRPVASDF
SATGLKQMSHALRRPVASDF

SEQ ID NO: 16243 - protein, 20 aa, synthetic construct
  source 1..20: note = Seed: SATGFKQSSKALQRPVASDF
SATGLKQMSHALSRPVASDF

SEQ ID NO: 16244 - protein, 20 aa, synthetic construct
  source 1..20: note = Seed: SATGFKQSSKALQRPVASDF
SATGLKQMSHALVRPVASDF

SEQ ID NO: 16245 - protein, 20 aa, synthetic construct
  source 1..20: note = Seed: SATGFKQSSKALQRPVASDF
SATGLKQMSIALARPVASDF

SEQ ID NO: 16246 - protein, 20 aa, synthetic construct
  source 1..20: note = Seed: SATGFKQSSKALQRPVASDF
SATGLKQMSIALCRPVASDF

SEQ ID NO: 16247 - protein, 20 aa, synthetic construct
  source 1..20: note = Seed: SATGFKQSSKALQRPVASDF
SATGLKQMSIALDRPVASDF

SEQ ID NO: 16248 - protein, 20 aa, synthetic construct
  source 1..20: note = Seed: SATGFKQSSKALQRPVASDF
SATGLKQMSIALGRPVASDF

SEQ ID NO: 16249 - protein, 20 aa, synthetic construct
  source 1..20: note = Seed: SATGFKQSSKALQRPVASDF
SATGLKQMSIALHRPVASDF

SEQ ID NO: 16250 - protein, 20 aa, synthetic construct
  source 1..20: note = Seed: SATGFKQSSKALQRPVASDF
SATGLKQMSIALKRPVASDF

SEQ ID NO: 16251 - protein, 20 aa, synthetic construct
  source 1..20: note = Seed: SATGFKQSSKALQRPVASDF
SATGLKQMSIALNRPVASDF

SEQ ID NO: 16252 - protein, 20 aa, synthetic construct
  source 1..20: note = Seed: SATGFKQSSKALQRPVASDF
SATGLKQMSIALRRPVASDF

SEQ ID NO: 16253 - protein, 20 aa, synthetic construct
  source 1..20: note = Seed: SATGFKQSSKALQRPVASDF
SATGLKQMSIALSRPVASDF

SEQ ID NO: 16254 - protein, 20 aa, synthetic construct
  source 1..20: note = Seed: SATGFKQSSKALQRPVASDF
SATGLKQMSIALTRPVASDF

SEQ ID NO: 16255 - protein, 20 aa, synthetic construct
  source 1..20: note = Seed: SATGFKQSSKALQRPVASDF
SATGLKQMSIALVRPVASDF

SEQ ID NO: 16256 - protein, 20 aa, synthetic construct
  source 1..20: note = Seed: SATGFKQSSKALQRPVASDF
SATGLKQMSIALYRPVASDF

SEQ ID NO: 16257 - protein, 20 aa, synthetic construct
  source 1..20: note = Seed: SATGFKQSSKALQRPVASDF
SATGLKQMSKALARPVASDF

SEQ ID NO: 16258 - protein, 20 aa, synthetic construct
  source 1..20: note = Seed: SATGFKQSSKALQRPVASDF
SATGLKQMSKALCRPVASDF

SEQ ID NO: 16259 - protein, 20 aa, synthetic construct
  source 1..20: note = Seed: SATGFKQSSKALQRPVASDF
SATGLKQMSKALFRPVASDF

SEQ ID NO: 16260 - protein, 20 aa, synthetic construct
  source 1..20: note = Seed: SATGFKQSSKALQRPVASDF
SATGLKQMSKALGRPVASDF

SEQ ID NO: 16261 - protein, 20 aa, synthetic construct
  source 1..20: note = Seed: SATGFKQSSKALQRPVASDF
SATGLKQMSKALHRPVASDF

SEQ ID NO: 16262 - protein, 20 aa, synthetic construct
  source 1..20: note = Seed: SATGFKQSSKALQRPVASDF
SATGLKQMSKALIRPVASDF

SEQ ID NO: 16263 - protein, 20 aa, synthetic construct
  source 1..20: note = Seed: SATGFKQSSKALQRPVASDF
SATGLKQMSKALKRPVASDF

SEQ ID NO: 16264 - protein, 20 aa, synthetic construct
  source 1..20: note = Seed: SATGFKQSSKALQRPVASDF
SATGLKQMSKALLRPVASDF

SEQ ID NO: 16265 - protein, 20 aa, synthetic construct
  source 1..20: note = Seed: SATGFKQSSKALQRPVASDF
SATGLKQMSKALMRPVASDF

SEQ ID NO: 16266 - protein, 20 aa, synthetic construct
  source 1..20: note = Seed: SATGFKQSSKALQRPVASDF
SATGLKQMSKALNRPVASDF

SEQ ID NO: 16267 - protein, 20 aa, synthetic construct
  source 1..20: note = Seed: SATGFKQSSKALQRPVASDF
SATGLKQMSKALPRPVASDF

SEQ ID NO: 16268 - protein, 20 aa, synthetic construct
  source 1..20: note = Seed: SATGFKQSSKALQRPVASDF
SATGLKQMSKALQRPVASDF

SEQ ID NO: 16269 - protein, 20 aa, synthetic construct
  source 1..20: note = Seed: SATGFKQSSKALQRPVASDF
SATGLKQMSKALRRPVASDF

SEQ ID NO: 16270 - protein, 20 aa, synthetic construct
  source 1..20: note = Seed: SATGFKQSSKALQRPVASDF
SATGLKQMSKALSRPVASDF

SEQ ID NO: 16271 - protein, 20 aa, synthetic construct
  source 1..20: note = Seed: SATGFKQSSKALQRPVASDF
SATGLKQMSKALTRPVASDF

SEQ ID NO: 16272 - protein, 20 aa, synthetic construct
  source 1..20: note = Seed: SATGFKQSSKALQRPVASDF
SATGLKQMSKALVRPVASDF

SEQ ID NO: 16273 - protein, 20 aa, synthetic construct
  source 1..20: note = Seed: SATGFKQSSKALQRPVASDF
SATGLKQMSKALWRPVASDF

SEQ ID NO: 16274 - protein, 20 aa, synthetic construct
  source 1..20: note = Seed: SATGFKQSSKALQRPVASDF
SATGLKQMSKALYRPVASDF

SEQ ID NO: 16275 - protein, 20 aa, synthetic construct
  source 1..20: note = Seed: SATGFKQSSKALQRPVASDF
SATGLKQMSLALARPVASDF

SEQ ID NO: 16276 - protein, 20 aa, synthetic construct
  source 1..20: note = Seed: SATGFKQSSKALQRPVASDF
SATGLKQMSLALCRPVASDF

SEQ ID NO: 16277 - protein, 20 aa, synthetic construct
  source 1..20: note = Seed: SATGFKQSSKALQRPVASDF
SATGLKQMSLALGRPVASDF

SEQ ID NO: 16278 - protein, 20 aa, synthetic construct
  source 1..20: note = Seed: SATGFKQSSKALQRPVASDF
SATGLKQMSLALHRPVASDF

SEQ ID NO: 16279 - protein, 20 aa, synthetic construct
  source 1..20: note = Seed: SATGFKQSSKALQRPVASDF
SATGLKQMSLALIRPVASDF

SEQ ID NO: 16280 - protein, 20 aa, synthetic construct
  source 1..20: note = Seed: SATGFKQSSKALQRPVASDF
SATGLKQMSLALMRPVASDF

SEQ ID NO: 16281 - protein, 20 aa, synthetic construct
  source 1..20: note = Seed: SATGFKQSSKALQRPVASDF
SATGLKQMSLALNRPVASDF

SEQ ID NO: 16282 - protein, 20 aa, synthetic construct
  source 1..20: note = Seed: SATGFKQSSKALQRPVASDF
SATGLKQMSLALRRPVASDF

SEQ ID NO: 16283 - protein, 20 aa, synthetic construct
  source 1..20: note = Seed: SATGFKQSSKALQRPVASDF
SATGLKQMSLALSRPVASDF

SEQ ID NO: 16284 - protein, 20 aa, synthetic construct
  source 1..20: note = Seed: SATGFKQSSKALQRPVASDF
SATGLKQMSLALTRPVASDF

SEQ ID NO: 16285 - protein, 20 aa, synthetic construct
  source 1..20: note = Seed: SATGFKQSSKALQRPVASDF
SATGLKQMSLALVRPVASDF

SEQ ID NO: 16286 - protein, 20 aa, synthetic construct
  source 1..20: note = Seed: SATGFKQSSKALQRPVASDF
SATGLKQMSMALCRPVASDF

SEQ ID NO: 16287 - protein, 20 aa, synthetic construct
  source 1..20: note = Seed: SATGFKQSSKALQRPVASDF
SATGLKQMSMALGRPVASDF

SEQ ID NO: 16288 - protein, 20 aa, synthetic construct
  source 1..20: note = Seed: SATGFKQSSKALQRPVASDF
SATGLKQMSMALHRPVASDF

SEQ ID NO: 16289 - protein, 20 aa, synthetic construct
  source 1..20: note = Seed: SATGFKQSSKALQRPVASDF
SATGLKQMSMALNRPVASDF

SEQ ID NO: 16290 - protein, 20 aa, synthetic construct
  source 1..20: note = Seed: SATGFKQSSKALQRPVASDF
SATGLKQMSMALSRPVASDF

SEQ ID NO: 16291 - protein, 20 aa, synthetic construct
  source 1..20: note = Seed: SATGFKQSSKALQRPVASDF
SATGLKQMSNALARPVASDF

SEQ ID NO: 16292 - protein, 20 aa, synthetic construct
  source 1..20: note = Seed: SATGFKQSSKALQRPVASDF
SATGLKQMSNALCRPVASDF

SEQ ID NO: 16293 - protein, 20 aa, synthetic construct
  source 1..20: note = Seed: SATGFKQSSKALQRPVASDF
SATGLKQMSNALGRPVASDF

SEQ ID NO: 16294 - protein, 20 aa, synthetic construct
  source 1..20: note = Seed: SATGFKQSSKALQRPVASDF
SATGLKQMSNALIRPVASDF

SEQ ID NO: 16295 - protein, 20 aa, synthetic construct
  source 1..20: note = Seed: SATGFKQSSKALQRPVASDF
SATGLKQMSNALLRPVASDF

SEQ ID NO: 16296 - protein, 20 aa, synthetic construct
  source 1..20: note = Seed: SATGFKQSSKALQRPVASDF
SATGLKQMSNALMRPVASDF

SEQ ID NO: 16297 - protein, 20 aa, synthetic construct
  source 1..20: note = Seed: SATGFKQSSKALQRPVASDF
SATGLKQMSNALNRPVASDF

SEQ ID NO: 16298 - protein, 20 aa, synthetic construct
  source 1..20: note = Seed: SATGFKQSSKALQRPVASDF
SATGLKQMSNALRRPVASDF

SEQ ID NO: 16299 - protein, 20 aa, synthetic construct
  source 1..20: note = Seed: SATGFKQSSKALQRPVASDF
SATGLKQMSNALSRPVASDF

SEQ ID NO: 16300 - protein, 20 aa, synthetic construct
  source 1..20: note = Seed: SATGFKQSSKALQRPVASDF
SATGLKQMSNALTRPVASDF

SEQ ID NO: 16301 - protein, 20 aa, synthetic construct
  source 1..20: note = Seed: SATGFKQSSKALQRPVASDF
SATGLKQMSNALVRPVASDF

SEQ ID NO: 16302 - protein, 20 aa, synthetic construct
  source 1..20: note = Seed: SATGFKQSSKALQRPVASDF
SATGLKQMSPALARPVASDF

SEQ ID NO: 16303 - protein, 20 aa, synthetic construct
  source 1..20: note = Seed: SATGFKQSSKALQRPVASDF
SATGLKQMSPALCRPVASDF

SEQ ID NO: 16304 - protein, 20 aa, synthetic construct
  source 1..20: note = Seed: SATGFKQSSKALQRPVASDF
SATGLKQMSPALDRPVASDF

SEQ ID NO: 16305 - protein, 20 aa, synthetic construct
  source 1..20: note = Seed: SATGFKQSSKALQRPVASDF
SATGLKQMSPALERPVASDF

SEQ ID NO: 16306 - protein, 20 aa, synthetic construct
  source 1..20: note = Seed: SATGFKQSSKALQRPVASDF
SATGLKQMSPALFRPVASDF

SEQ ID NO: 16307 - protein, 20 aa, synthetic construct
  source 1..20: note = Seed: SATGFKQSSKALQRPVASDF
SATGLKQMSPALGRPVASDF

SEQ ID NO: 16308 - protein, 20 aa, synthetic construct
  source 1..20: note = Seed: SATGFKQSSKALQRPVASDF
SATGLKQMSPALHRPVASDF

SEQ ID NO: 16309 - protein, 20 aa, synthetic construct
  source 1..20: note = Seed: SATGFKQSSKALQRPVASDF
SATGLKQMSPALIRPVASDF

SEQ ID NO: 16310 - protein, 20 aa, synthetic construct
  source 1..20: note = Seed: SATGFKQSSKALQRPVASDF
SATGLKQMSPALLRPVASDF

SEQ ID NO: 16311 - protein, 20 aa, synthetic construct
  source 1..20: note = Seed: SATGFKQSSKALQRPVASDF
SATGLKQMSPALMRPVASDF

SEQ ID NO: 16312 - protein, 20 aa, synthetic construct
  source 1..20: note = Seed: SATGFKQSSKALQRPVASDF
SATGLKQMSPALNRPVASDF

SEQ ID NO: 16313 - protein, 20 aa, synthetic construct
  source 1..20: note = Seed: SATGFKQSSKALQRPVASDF
SATGLKQMSPALPRPVASDF

SEQ ID NO: 16314 - protein, 20 aa, synthetic construct
  source 1..20: note = Seed: SATGFKQSSKALQRPVASDF
SATGLKQMSPALQRPVASDF

SEQ ID NO: 16315 - protein, 20 aa, synthetic construct
  source 1..20: note = Seed: SATGFKQSSKALQRPVASDF
SATGLKQMSPALSRPVASDF

SEQ ID NO: 16316 - protein, 20 aa, synthetic construct
  source 1..20: note = Seed: SATGFKQSSKALQRPVASDF
SATGLKQMSPALTRPVASDF

SEQ ID NO: 16317 - protein, 20 aa, synthetic construct
  source 1..20: note = Seed: SATGFKQSSKALQRPVASDF
SATGLKQMSPALVRPVASDF

SEQ ID NO: 16318 - protein, 20 aa, synthetic construct
  source 1..20: note = Seed: SATGFKQSSKALQRPVASDF
SATGLKQMSQALARPVASDF

SEQ ID NO: 16319 - protein, 20 aa, synthetic construct
  source 1..20: note = Seed: SATGFKQSSKALQRPVASDF
SATGLKQMSQALIRPVASDF

SEQ ID NO: 16320 - protein, 20 aa, synthetic construct
  source 1..20: note = Seed: SATGFKQSSKALQRPVASDF
SATGLKQMSQALRRPVASDF

SEQ ID NO: 16321 - protein, 20 aa, synthetic construct
  source 1..20: note = Seed: SATGFKQSSKALQRPVASDF
SATGLKQMSQALSRPVASDF

SEQ ID NO: 16322 - protein, 20 aa, synthetic construct
  source 1..20: note = Seed: SATGFKQSSKALQRPVASDF
SATGLKQMSQALVRPVASDF

SEQ ID NO: 16323 - protein, 20 aa, synthetic construct
  source 1..20: note = Seed: SATGFKQSSKALQRPVASDF
SATGLKQMSRALARPVASDF

SEQ ID NO: 16324 - protein, 20 aa, synthetic construct
  source 1..20: note = Seed: SATGFKQSSKALQRPVASDF
SATGLKQMSRALCRPVASDF

SEQ ID NO: 16325 - protein, 20 aa, synthetic construct
  source 1..20: note = Seed: SATGFKQSSKALQRPVASDF
SATGLKQMSRALERPVASDF

SEQ ID NO: 16326 - protein, 20 aa, synthetic construct
  source 1..20: note = Seed: SATGFKQSSKALQRPVASDF
SATGLKQMSRALFRPVASDF

SEQ ID NO: 16327 - protein, 20 aa, synthetic construct
  source 1..20: note = Seed: SATGFKQSSKALQRPVASDF
SATGLKQMSRALGRPVASDF

SEQ ID NO: 16328 - protein, 20 aa, synthetic construct
  source 1..20: note = Seed: SATGFKQSSKALQRPVASDF
SATGLKQMSRALHRPVASDF

SEQ ID NO: 16329 - protein, 20 aa, synthetic construct
  source 1..20: note = Seed: SATGFKQSSKALQRPVASDF
SATGLKQMSRALIRPVASDF

SEQ ID NO: 16330 - protein, 20 aa, synthetic construct
  source 1..20: note = Seed: SATGFKQSSKALQRPVASDF
SATGLKQMSRALKRPVASDF

SEQ ID NO: 16331 - protein, 20 aa, synthetic construct
  source 1..20: note = Seed: SATGFKQSSKALQRPVASDF
SATGLKQMSRALLRPVASDF

SEQ ID NO: 16332 - protein, 20 aa, synthetic construct
  source 1..20: note = Seed: SATGFKQSSKALQRPVASDF
SATGLKQMSRALMRPVASDF

SEQ ID NO: 16333 - protein, 20 aa, synthetic construct
  source 1..20: note = Seed: SATGFKQSSKALQRPVASDF
SATGLKQMSRALNRPVASDF

SEQ ID NO: 16334 - protein, 20 aa, synthetic construct
  source 1..20: note = Seed: SATGFKQSSKALQRPVASDF
SATGLKQMSRALPRPVASDF

SEQ ID NO: 16335 - protein, 20 aa, synthetic construct
  source 1..20: note = Seed: SATGFKQSSKALQRPVASDF
SATGLKQMSRALQRPVASDF

SEQ ID NO: 16336 - protein, 20 aa, synthetic construct
  source 1..20: note = Seed: SATGFKQSSKALQRPVASDF
SATGLKQMSRALRRPVASDF

SEQ ID NO: 16337 - protein, 20 aa, synthetic construct
  source 1..20: note = Seed: SATGFKQSSKALQRPVASDF
SATGLKQMSRALSRPVASDF

SEQ ID NO: 16338 - protein, 20 aa, synthetic construct
  source 1..20: note = Seed: SATGFKQSSKALQRPVASDF
SATGLKQMSRALTRPVASDF

SEQ ID NO: 16339 - protein, 20 aa, synthetic construct
  source 1..20: note = Seed: SATGFKQSSKALQRPVASDF
SATGLKQMSRALVRPVASDF

SEQ ID NO: 16340 - protein, 20 aa, synthetic construct
  source 1..20: note = Seed: SATGFKQSSKALQRPVASDF
SATGLKQMSRALWRPVASDF

SEQ ID NO: 16341 - protein, 20 aa, synthetic construct
  source 1..20: note = Seed: SATGFKQSSKALQRPVASDF
SATGLKQMSRALYRPVASDF

SEQ ID NO: 16342 - protein, 20 aa, synthetic construct
  source 1..20: note = Seed: SATGFKQSSKALQRPVASDF
SATGLKQMSSALARPVASDF

SEQ ID NO: 16343 - protein, 20 aa, synthetic construct
  source 1..20: note = Seed: SATGFKQSSKALQRPVASDF
SATGLKQMSSALCRPVASDF

SEQ ID NO: 16344 - protein, 20 aa, synthetic construct
  source 1..20: note = Seed: SATGFKQSSKALQRPVASDF
SATGLKQMSSALFRPVASDF

SEQ ID NO: 16345 - protein, 20 aa, synthetic construct
  source 1..20: note = Seed: SATGFKQSSKALQRPVASDF
SATGLKQMSSALGRPVASDF

SEQ ID NO: 16346 - protein, 20 aa, synthetic construct
  source 1..20: note = Seed: SATGFKQSSKALQRPVASDF
SATGLKQMSSALHRPVASDF

SEQ ID NO: 16347 - protein, 20 aa, synthetic construct
  source 1..20: note = Seed: SATGFKQSSKALQRPVASDF
SATGLKQMSSALIRPVASDF

SEQ ID NO: 16348 - protein, 20 aa, synthetic construct
  source 1..20: note = Seed: SATGFKQSSKALQRPVASDF
SATGLKQMSSALLRPVASDF

SEQ ID NO: 16349 - protein, 20 aa, synthetic construct
  source 1..20: note = Seed: SATGFKQSSKALQRPVASDF
SATGLKQMSSALMRPVASDF

SEQ ID NO: 16350 - protein, 20 aa, synthetic construct
  source 1..20: note = Seed: SATGFKQSSKALQRPVASDF
SATGLKQMSSALNRPVASDF

SEQ ID NO: 16351 - protein, 20 aa, synthetic construct
  source 1..20: note = Seed: SATGFKQSSKALQRPVASDF
SATGLKQMSSALPRPVASDF

SEQ ID NO: 16352 - protein, 20 aa, synthetic construct
  source 1..20: note = Seed: SATGFKQSSKALQRPVASDF
SATGLKQMSSALQRPVASDF

SEQ ID NO: 16353 - protein, 20 aa, synthetic construct
  source 1..20: note = Seed: SATGFKQSSKALQRPVASDF
SATGLKQMSSALRRPVASDF

SEQ ID NO: 16354 - protein, 20 aa, synthetic construct
  source 1..20: note = Seed: SATGFKQSSKALQRPVASDF
SATGLKQMSSALSRPVASDF

SEQ ID NO: 16355 - protein, 20 aa, synthetic construct
  source 1..20: note = Seed: SATGFKQSSKALQRPVASDF
SATGLKQMSSALTRPVASDF

SEQ ID NO: 16356 - protein, 20 aa, synthetic construct
  source 1..20: note = Seed: SATGFKQSSKALQRPVASDF
SATGLKQMSSALVRPVASDF

SEQ ID NO: 16357 - protein, 20 aa, synthetic construct
  source 1..20: note = Seed: SATGFKQSSKALQRPVASDF
SATGLKQMSSALYRPVASDF

SEQ ID NO: 16358 - protein, 20 aa, synthetic construct
  source 1..20: note = Seed: SATGFKQSSKALQRPVASDF
SATGLKQMSTALARPVASDF

SEQ ID NO: 16359 - protein, 20 aa, synthetic construct
  source 1..20: note = Seed: SATGFKQSSKALQRPVASDF
SATGLKQMSTALCRPVASDF

SEQ ID NO: 16360 - protein, 20 aa, synthetic construct
  source 1..20: note = Seed: SATGFKQSSKALQRPVASDF
SATGLKQMSTALGRPVASDF

SEQ ID NO: 16361 - protein, 20 aa, synthetic construct
  source 1..20: note = Seed: SATGFKQSSKALQRPVASDF
SATGLKQMSTALHRPVASDF

SEQ ID NO: 16362 - protein, 20 aa, synthetic construct
  source 1..20: note = Seed: SATGFKQSSKALQRPVASDF
SATGLKQMSTALIRPVASDF

SEQ ID NO: 16363 - protein, 20 aa, synthetic construct
  source 1..20: note = Seed: SATGFKQSSKALQRPVASDF
SATGLKQMSTALKRPVASDF

SEQ ID NO: 16364 - protein, 20 aa, synthetic construct
  source 1..20: note = Seed: SATGFKQSSKALQRPVASDF
SATGLKQMSTALLRPVASDF

SEQ ID NO: 16365 - protein, 20 aa, synthetic construct
  source 1..20: note = Seed: SATGFKQSSKALQRPVASDF
SATGLKQMSTALMRPVASDF

SEQ ID NO: 16366 - protein, 20 aa, synthetic construct
  source 1..20: note = Seed: SATGFKQSSKALQRPVASDF
SATGLKQMSTALNRPVASDF

SEQ ID NO: 16367 - protein, 20 aa, synthetic construct
  source 1..20: note = Seed: SATGFKQSSKALQRPVASDF
SATGLKQMSTALPRPVASDF

SEQ ID NO: 16368 - protein, 20 aa, synthetic construct
  source 1..20: note = Seed: SATGFKQSSKALQRPVASDF
SATGLKQMSTALQRPVASDF

SEQ ID NO: 16369 - protein, 20 aa, synthetic construct
  source 1..20: note = Seed: SATGFKQSSKALQRPVASDF
SATGLKQMSTALRRPVASDF

SEQ ID NO: 16370 - protein, 20 aa, synthetic construct
  source 1..20: note = Seed: SATGFKQSSKALQRPVASDF
SATGLKQMSTALSRPVASDF

SEQ ID NO: 16371 - protein, 20 aa, synthetic construct
  source 1..20: note = Seed: SATGFKQSSKALQRPVASDF
SATGLKQMSTALTRPVASDF

SEQ ID NO: 16372 - protein, 20 aa, synthetic construct
  source 1..20: note = Seed: SATGFKQSSKALQRPVASDF
SATGLKQMSTALVRPVASDF

SEQ ID NO: 16373 - protein, 20 aa, synthetic construct
  source 1..20: note = Seed: SATGFKQSSKALQRPVASDF
SATGLKQMSVALARPVASDF

SEQ ID NO: 16374 - protein, 20 aa, synthetic construct
  source 1..20: note = Seed: SATGFKQSSKALQRPVASDF
SATGLKQMSVALCRPVASDF

SEQ ID NO: 16375 - protein, 20 aa, synthetic construct
  source 1..20: note = Seed: SATGFKQSSKALQRPVASDF
SATGLKQMSVALDRPVASDF

SEQ ID NO: 16376 - protein, 20 aa, synthetic construct
  source 1..20: note = Seed: SATGFKQSSKALQRPVASDF
SATGLKQMSVALERPVASDF

SEQ ID NO: 16377 - protein, 20 aa, synthetic construct
  source 1..20: note = Seed: SATGFKQSSKALQRPVASDF
SATGLKQMSVALFRPVASDF

SEQ ID NO: 16378 - protein, 20 aa, synthetic construct
  source 1..20: note = Seed: SATGFKQSSKALQRPVASDF
SATGLKQMSVALGRPVASDF

SEQ ID NO: 16379 - protein, 20 aa, synthetic construct
  source 1..20: note = Seed: SATGFKQSSKALQRPVASDF
SATGLKQMSVALHRPVASDF

SEQ ID NO: 16380 - protein, 20 aa, synthetic construct
  source 1..20: note = Seed: SATGFKQSSKALQRPVASDF
SATGLKQMSVALIRPVASDF

SEQ ID NO: 16381 - protein, 20 aa, synthetic construct
  source 1..20: note = Seed: SATGFKQSSKALQRPVASDF
SATGLKQMSVALLRPVASDF

SEQ ID NO: 16382 - protein, 20 aa, synthetic construct
  source 1..20: note = Seed: SATGFKQSSKALQRPVASDF
SATGLKQMSVALMRPVASDF

SEQ ID NO: 16383 - protein, 20 aa, synthetic construct
  source 1..20: note = Seed: SATGFKQSSKALQRPVASDF
SATGLKQMSVALNRPVASDF

SEQ ID NO: 16384 - protein, 20 aa, synthetic construct
  source 1..20: note = Seed: SATGFKQSSKALQRPVASDF
SATGLKQMSVALPRPVASDF

SEQ ID NO: 16385 - protein, 20 aa, synthetic construct
  source 1..20: note = Seed: SATGFKQSSKALQRPVASDF
SATGLKQMSVALQRPVASDF

SEQ ID NO: 16386 - protein, 20 aa, synthetic construct
  source 1..20: note = Seed: SATGFKQSSKALQRPVASDF
SATGLKQMSVALRRPVASDF

SEQ ID NO: 16387 - protein, 20 aa, synthetic construct
  source 1..20: note = Seed: SATGFKQSSKALQRPVASDF
SATGLKQMSVALSRPVASDF

SEQ ID NO: 16388 - protein, 20 aa, synthetic construct
  source 1..20: note = Seed: SATGFKQSSKALQRPVASDF
SATGLKQMSVALTRPVASDF

SEQ ID NO: 16389 - protein, 20 aa, synthetic construct
  source 1..20: note = Seed: SATGFKQSSKALQRPVASDF
SATGLKQMSVALVRPVASDF

SEQ ID NO: 16390 - protein, 20 aa, synthetic construct
  source 1..20: note = Seed: SATGFKQSSKALQRPVASDF
SATGLKQMSVALYRPVASDF

SEQ ID NO: 16391 - protein, 20 aa, synthetic construct
  source 1..20: note = Seed: SATGFKQSSKALQRPVASDF
SATGLKQNSAALARPVASDF

SEQ ID NO: 16392 - protein, 20 aa, synthetic construct
  source 1..20: note = Seed: SATGFKQSSKALQRPVASDF
SATGLKQNSAALIRPVASDF

SEQ ID NO: 16393 - protein, 20 aa, synthetic construct
  source 1..20: note = Seed: SATGFKQSSKALQRPVASDF
SATGLKQNSAALLRPVASDF

SEQ ID NO: 16394 - protein, 20 aa, synthetic construct
  source 1..20: note = Seed: SATGFKQSSKALQRPVASDF
SATGLKQNSAALVRPVASDF

SEQ ID NO: 16395 - protein, 20 aa, synthetic construct
  source 1..20: note = Seed: SATGFKQSSKALQRPVASDF
SATGLKQNSFALIRPVASDF

SEQ ID NO: 16396 - protein, 20 aa, synthetic construct
  source 1..20: note = Seed: SATGFKQSSKALQRPVASDF
SATGLKQNSFALVRPVASDF

SEQ ID NO: 16397 - protein, 20 aa, synthetic construct
  source 1..20: note = Seed: SATGFKQSSKALQRPVASDF
SATGLKQQSAALARPVASDF

SEQ ID NO: 16398 - protein, 20 aa, synthetic construct
  source 1..20: note = Seed: SATGFKQSSKALQRPVASDF
SATGLKQQSAALGRPVASDF

SEQ ID NO: 16399 - protein, 20 aa, synthetic construct
  source 1..20: note = Seed: SATGFKQSSKALQRPVASDF
SATGLKQQSAALIRPVASDF

SEQ ID NO: 16400 - protein, 20 aa, synthetic construct
  source 1..20: note = Seed: SATGFKQSSKALQRPVASDF
SATGLKQQSAALLRPVASDF

SEQ ID NO: 16401 - protein, 20 aa, synthetic construct
  source 1..20: note = Seed: SATGFKQSSKALQRPVASDF
SATGLKQQSAALMRPVASDF

SEQ ID NO: 16402 - protein, 20 aa, synthetic construct
  source 1..20: note = Seed: SATGFKQSSKALQRPVASDF
SATGLKQQSAALNRPVASDF

SEQ ID NO: 16403 - protein, 20 aa, synthetic construct
  source 1..20: note = Seed: SATGFKQSSKALQRPVASDF
SATGLKQQSAALSRPVASDF

SEQ ID NO: 16404 - protein, 20 aa, synthetic construct
  source 1..20: note = Seed: SATGFKQSSKALQRPVASDF
SATGLKQQSAALTRPVASDF

SEQ ID NO: 16405 - protein, 20 aa, synthetic construct
  source 1..20: note = Seed: SATGFKQSSKALQRPVASDF
SATGLKQQSAALVRPVASDF

SEQ ID NO: 16406 - protein, 20 aa, synthetic construct
  source 1..20: note = Seed: SATGFKQSSKALQRPVASDF
SATGLKQQSFALFRPVASDF

SEQ ID NO: 16407 - protein, 20 aa, synthetic construct
  source 1..20: note = Seed: SATGFKQSSKALQRPVASDF
SATGLKQQSFALIRPVASDF

SEQ ID NO: 16408 - protein, 20 aa, synthetic construct
  source 1..20: note = Seed: SATGFKQSSKALQRPVASDF
SATGLKQQSFALLRPVASDF

SEQ ID NO: 16409 - protein, 20 aa, synthetic construct
  source 1..20: note = Seed: SATGFKQSSKALQRPVASDF
SATGLKQQSFALVRPVASDF

SEQ ID NO: 16410 - protein, 20 aa, synthetic construct
  source 1..20: note = Seed: SATGFKQSSKALQRPVASDF
SATGLKQQSGALARPVASDF

SEQ ID NO: 16411 - protein, 20 aa, synthetic construct
  source 1..20: note = Seed: SATGFKQSSKALQRPVASDF
SATGLKQQSGALIRPVASDF

SEQ ID NO: 16412 - protein, 20 aa, synthetic construct
  source 1..20: note = Seed: SATGFKQSSKALQRPVASDF
SATGLKQQSGALLRPVASDF

SEQ ID NO: 16413 - protein, 20 aa, synthetic construct
  source 1..20: note = Seed: SATGFKQSSKALQRPVASDF
SATGLKQQSGALMRPVASDF

SEQ ID NO: 16414 - protein, 20 aa, synthetic construct
  source 1..20: note = Seed: SATGFKQSSKALQRPVASDF
SATGLKQQSGALSRPVASDF

SEQ ID NO: 16415 - protein, 20 aa, synthetic construct
  source 1..20: note = Seed: SATGFKQSSKALQRPVASDF
SATGLKQQSGALTRPVASDF

SEQ ID NO: 16416 - protein, 20 aa, synthetic construct
  source 1..20: note = Seed: SATGFKQSSKALQRPVASDF
SATGLKQQSGALVRPVASDF

SEQ ID NO: 16417 - protein, 20 aa, synthetic construct
  source 1..20: note = Seed: SATGFKQSSKALQRPVASDF
SATGLKQQSIALGRPVASDF

SEQ ID NO: 16418 - protein, 20 aa, synthetic construct
  source 1..20: note = Seed: SATGFKQSSKALQRPVASDF
SATGLKQQSIALHRPVASDF

SEQ ID NO: 16419 - protein, 20 aa, synthetic construct
  source 1..20: note = Seed: SATGFKQSSKALQRPVASDF
SATGLKQQSIALNRPVASDF

SEQ ID NO: 16420 - protein, 20 aa, synthetic construct
  source 1..20: note = Seed: SATGFKQSSKALQRPVASDF
SATGLKQQSIALSRPVASDF

SEQ ID NO: 16421 - protein, 20 aa, synthetic construct
  source 1..20: note = Seed: SATGFKQSSKALQRPVASDF
SATGLKQQSIALTRPVASDF

SEQ ID NO: 16422 - protein, 20 aa, synthetic construct
  source 1..20: note = Seed: SATGFKQSSKALQRPVASDF
SATGLKQQSKALARPVASDF

SEQ ID NO: 16423 - protein, 20 aa, synthetic construct
  source 1..20: note = Seed: SATGFKQSSKALQRPVASDF
SATGLKQQSKALSRPVASDF

SEQ ID NO: 16424 - protein, 20 aa, synthetic construct
  source 1..20: note = Seed: SATGFKQSSKALQRPVASDF
SATGLKQQSLALNRPVASDF

SEQ ID NO: 16425 - protein, 20 aa, synthetic construct
  source 1..20: note = Seed: SATGFKQSSKALQRPVASDF
SATGLKQQSLALSRPVASDF

SEQ ID NO: 16426 - protein, 20 aa, synthetic construct
  source 1..20: note = Seed: SATGFKQSSKALQRPVASDF
SATGLKQQSMALSRPVASDF

SEQ ID NO: 16427 - protein, 20 aa, synthetic construct
  source 1..20: note = Seed: SATGFKQSSKALQRPVASDF
SATGLKQQSMALVRPVASDF

SEQ ID NO: 16428 - protein, 20 aa, synthetic construct
  source 1..20: note = Seed: SATGFKQSSKALQRPVASDF
SATGLKQQSNALARPVASDF

SEQ ID NO: 16429 - protein, 20 aa, synthetic construct
  source 1..20: note = Seed: SATGFKQSSKALQRPVASDF
SATGLKQQSNALIRPVASDF

SEQ ID NO: 16430 - protein, 20 aa, synthetic construct
  source 1..20: note = Seed: SATGFKQSSKALQRPVASDF
SATGLKQQSNALLRPVASDF

SEQ ID NO: 16431 - protein, 20 aa, synthetic construct
  source 1..20: note = Seed: SATGFKQSSKALQRPVASDF
SATGLKQQSNALVRPVASDF

SEQ ID NO: 16432 - protein, 20 aa, synthetic construct
  source 1..20: note = Seed: SATGFKQSSKALQRPVASDF
SATGLKQQSPALARPVASDF

SEQ ID NO: 16433 - protein, 20 aa, synthetic construct
  source 1..20: note = Seed: SATGFKQSSKALQRPVASDF
SATGLKQQSPALIRPVASDF

SEQ ID NO: 16434 - protein, 20 aa, synthetic construct
  source 1..20: note = Seed: SATGFKQSSKALQRPVASDF
SATGLKQQSPALLRPVASDF

SEQ ID NO: 16435 - protein, 20 aa, synthetic construct
  source 1..20: note = Seed: SATGFKQSSKALQRPVASDF
SATGLKQQSPALMRPVASDF

SEQ ID NO: 16436 - protein, 20 aa, synthetic construct
  source 1..20: note = Seed: SATGFKQSSKALQRPVASDF
SATGLKQQSPALNRPVASDF

SEQ ID NO: 16437 - protein, 20 aa, synthetic construct
  source 1..20: note = Seed: SATGFKQSSKALQRPVASDF
SATGLKQQSPALSRPVASDF

SEQ ID NO: 16438 - protein, 20 aa, synthetic construct
  source 1..20: note = Seed: SATGFKQSSKALQRPVASDF
SATGLKQQSPALVRPVASDF

SEQ ID NO: 16439 - protein, 20 aa, synthetic construct
  source 1..20: note = Seed: SATGFKQSSKALQRPVASDF
SATGLKQQSRALARPVASDF

SEQ ID NO: 16440 - protein, 20 aa, synthetic construct
  source 1..20: note = Seed: SATGFKQSSKALQRPVASDF
SATGLKQQSRALGRPVASDF

SEQ ID NO: 16441 - protein, 20 aa, synthetic construct
  source 1..20: note = Seed: SATGFKQSSKALQRPVASDF
SATGLKQQSRALHRPVASDF

SEQ ID NO: 16442 - protein, 20 aa, synthetic construct
  source 1..20: note = Seed: SATGFKQSSKALQRPVASDF
SATGLKQQSRALKRPVASDF

SEQ ID NO: 16443 - protein, 20 aa, synthetic construct
  source 1..20: note = Seed: SATGFKQSSKALQRPVASDF
SATGLKQQSRALQRPVASDF

SEQ ID NO: 16444 - protein, 20 aa, synthetic construct
  source 1..20: note = Seed: SATGFKQSSKALQRPVASDF
SATGLKQQSRALRRPVASDF

SEQ ID NO: 16445 - protein, 20 aa, synthetic construct
  source 1..20: note = Seed: SATGFKQSSKALQRPVASDF
SATGLKQQSRALSRPVASDF

SEQ ID NO: 16446 - protein, 20 aa, synthetic construct
  source 1..20: note = Seed: SATGFKQSSKALQRPVASDF
SATGLKQQSSALARPVASDF

SEQ ID NO: 16447 - protein, 20 aa, synthetic construct
  source 1..20: note = Seed: SATGFKQSSKALQRPVASDF
SATGLKQQSSALIRPVASDF

SEQ ID NO: 16448 - protein, 20 aa, synthetic construct
  source 1..20: note = Seed: SATGFKQSSKALQRPVASDF
SATGLKQQSSALLRPVASDF

SEQ ID NO: 16449 - protein, 20 aa, synthetic construct
  source 1..20: note = Seed: SATGFKQSSKALQRPVASDF
SATGLKQQSSALMRPVASDF

SEQ ID NO: 16450 - protein, 20 aa, synthetic construct
  source 1..20: note = Seed: SATGFKQSSKALQRPVASDF
SATGLKQQSSALNRPVASDF

SEQ ID NO: 16451 - protein, 20 aa, synthetic construct
  source 1..20: note = Seed: SATGFKQSSKALQRPVASDF
SATGLKQQSSALSRPVASDF

SEQ ID NO: 16452 - protein, 20 aa, synthetic construct
  source 1..20: note = Seed: SATGFKQSSKALQRPVASDF
SATGLKQQSSALTRPVASDF

SEQ ID NO: 16453 - protein, 20 aa, synthetic construct
  source 1..20: note = Seed: SATGFKQSSKALQRPVASDF
SATGLKQQSSALVRPVASDF

SEQ ID NO: 16454 - protein, 20 aa, synthetic construct
  source 1..20: note = Seed: SATGFKQSSKALQRPVASDF
SATGLKQQSTALARPVASDF

SEQ ID NO: 16455 - protein, 20 aa, synthetic construct
  source 1..20: note = Seed: SATGFKQSSKALQRPVASDF
SATGLKQQSTALIRPVASDF

SEQ ID NO: 16456 - protein, 20 aa, synthetic construct
  source 1..20: note = Seed: SATGFKQSSKALQRPVASDF
SATGLKQQSTALLRPVASDF

SEQ ID NO: 16457 - protein, 20 aa, synthetic construct
  source 1..20: note = Seed: SATGFKQSSKALQRPVASDF
SATGLKQQSTALNRPVASDF

SEQ ID NO: 16458 - protein, 20 aa, synthetic construct
  source 1..20: note = Seed: SATGFKQSSKALQRPVASDF
SATGLKQQSTALSRPVASDF

SEQ ID NO: 16459 - protein, 20 aa, synthetic construct
  source 1..20: note = Seed: SATGFKQSSKALQRPVASDF
SATGLKQQSTALVRPVASDF

SEQ ID NO: 16460 - protein, 20 aa, synthetic construct
  source 1..20: note = Seed: SATGFKQSSKALQRPVASDF
SATGLKQQSVALARPVASDF

SEQ ID NO: 16461 - protein, 20 aa, synthetic construct
  source 1..20: note = Seed: SATGFKQSSKALQRPVASDF
SATGLKQQSVALIRPVASDF

SEQ ID NO: 16462 - protein, 20 aa, synthetic construct
  source 1..20: note = Seed: SATGFKQSSKALQRPVASDF
SATGLKQQSVALNRPVASDF

SEQ ID NO: 16463 - protein, 20 aa, synthetic construct
  source 1..20: note = Seed: SATGFKQSSKALQRPVASDF
SATGLKQQSVALQRPVASDF

SEQ ID NO: 16464 - protein, 20 aa, synthetic construct
  source 1..20: note = Seed: SATGFKQSSKALQRPVASDF
SATGLKQQSVALSRPVASDF

SEQ ID NO: 16465 - protein, 20 aa, synthetic construct
  source 1..20: note = Seed: SATGFKQSSKALQRPVASDF
SATGLKQQSVALTRPVASDF

SEQ ID NO: 16466 - protein, 20 aa, synthetic construct
  source 1..20: note = Seed: SATGFKQSSKALQRPVASDF
SATGLKQQSVALVRPVASDF

SEQ ID NO: 16467 - protein, 20 aa, synthetic construct
  source 1..20: note = Seed: SATGFKQSSKALQRPVASDF
SATGLKQRSIALARPVASDF

SEQ ID NO: 16468 - protein, 20 aa, synthetic construct
  source 1..20: note = Seed: SATGFKQSSKALQRPVASDF
SATGLKQRSIALRRPVASDF

SEQ ID NO: 16469 - protein, 20 aa, synthetic construct
  source 1..20: note = Seed: SATGFKQSSKALQRPVASDF
SATGLKQRSKALRRPVASDF

SEQ ID NO: 16470 - protein, 20 aa, synthetic construct
  source 1..20: note = Seed: SATGFKQSSKALQRPVASDF
SATGLKQRSRALRRPVASDF

SEQ ID NO: 16471 - protein, 20 aa, synthetic construct
  source 1..20: note = Seed: SATGFKQSSKALQRPVASDF
SATGLKQRSRALYRPVASDF

SEQ ID NO: 16472 - protein, 20 aa, synthetic construct
  source 1..20: note = Seed: SATGFKQSSKALQRPVASDF
SATGLKQSSAALARPVASDF

SEQ ID NO: 16473 - protein, 20 aa, synthetic construct
  source 1..20: note = Seed: SATGFKQSSKALQRPVASDF
SATGLKQSSAALIRPVASDF

SEQ ID NO: 16474 - protein, 20 aa, synthetic construct
  source 1..20: note = Seed: SATGFKQSSKALQRPVASDF
SATGLKQSSAALLRPVASDF

SEQ ID NO: 16475 - protein, 20 aa, synthetic construct
  source 1..20: note = Seed: SATGFKQSSKALQRPVASDF
SATGLKQSSAALMRPVASDF

SEQ ID NO: 16476 - protein, 20 aa, synthetic construct
  source 1..20: note = Seed: SATGFKQSSKALQRPVASDF
SATGLKQSSAALNRPVASDF

SEQ ID NO: 16477 - protein, 20 aa, synthetic construct
  source 1..20: note = Seed: SATGFKQSSKALQRPVASDF
SATGLKQSSAALSRPVASDF

SEQ ID NO: 16478 - protein, 20 aa, synthetic construct
  source 1..20: note = Seed: SATGFKQSSKALQRPVASDF
SATGLKQSSAALTRPVASDF

SEQ ID NO: 16479 - protein, 20 aa, synthetic construct
  source 1..20: note = Seed: SATGFKQSSKALQRPVASDF
SATGLKQSSAALVRPVASDF

SEQ ID NO: 16480 - protein, 20 aa, synthetic construct
  source 1..20: note = Seed: SATGFKQSSKALQRPVASDF
SATGLKQSSFALARPVASDF

SEQ ID NO: 16481 - protein, 20 aa, synthetic construct
  source 1..20: note = Seed: SATGFKQSSKALQRPVASDF
SATGLKQSSFALDRPVASDF

SEQ ID NO: 16482 - protein, 20 aa, synthetic construct
  source 1..20: note = Seed: SATGFKQSSKALQRPVASDF
SATGLKQSSFALERPVASDF

SEQ ID NO: 16483 - protein, 20 aa, synthetic construct
  source 1..20: note = Seed: SATGFKQSSKALQRPVASDF
SATGLKQSSFALFRPVASDF

SEQ ID NO: 16484 - protein, 20 aa, synthetic construct
  source 1..20: note = Seed: SATGFKQSSKALQRPVASDF
SATGLKQSSFALIRPVASDF

SEQ ID NO: 16485 - protein, 20 aa, synthetic construct
  source 1..20: note = Seed: SATGFKQSSKALQRPVASDF
SATGLKQSSFALLRPVASDF

SEQ ID NO: 16486 - protein, 20 aa, synthetic construct
  source 1..20: note = Seed: SATGFKQSSKALQRPVASDF
SATGLKQSSFALMRPVASDF

SEQ ID NO: 16487 - protein, 20 aa, synthetic construct
  source 1..20: note = Seed: SATGFKQSSKALQRPVASDF
SATGLKQSSFALNRPVASDF

SEQ ID NO: 16488 - protein, 20 aa, synthetic construct
  source 1..20: note = Seed: SATGFKQSSKALQRPVASDF
SATGLKQSSFALSRPVASDF

SEQ ID NO: 16489 - protein, 20 aa, synthetic construct
  source 1..20: note = Seed: SATGFKQSSKALQRPVASDF
SATGLKQSSFALTRPVASDF

SEQ ID NO: 16490 - protein, 20 aa, synthetic construct
  source 1..20: note = Seed: SATGFKQSSKALQRPVASDF
SATGLKQSSFALVRPVASDF

SEQ ID NO: 16491 - protein, 20 aa, synthetic construct
  source 1..20: note = Seed: SATGFKQSSKALQRPVASDF
SATGLKQSSGALARPVASDF

SEQ ID NO: 16492 - protein, 20 aa, synthetic construct
  source 1..20: note = Seed: SATGFKQSSKALQRPVASDF
SATGLKQSSGALIRPVASDF

SEQ ID NO: 16493 - protein, 20 aa, synthetic construct
  source 1..20: note = Seed: SATGFKQSSKALQRPVASDF
SATGLKQSSGALLRPVASDF

SEQ ID NO: 16494 - protein, 20 aa, synthetic construct
  source 1..20: note = Seed: SATGFKQSSKALQRPVASDF
SATGLKQSSGALVRPVASDF

SEQ ID NO: 16495 - protein, 20 aa, synthetic construct
  source 1..20: note = Seed: SATGFKQSSKALQRPVASDF
SATGLKQSSIALNRPVASDF

SEQ ID NO: 16496 - protein, 20 aa, synthetic construct
  source 1..20: note = Seed: SATGFKQSSKALQRPVASDF
SATGLKQSSKALARPVASDF

SEQ ID NO: 16497 - protein, 20 aa, synthetic construct
  source 1..20: note = Seed: SATGFKQSSKALQRPVASDF
SATGLKQSSKALRRPVASDF

SEQ ID NO: 16498 - protein, 20 aa, synthetic construct
  source 1..20: note = Seed: SATGFKQSSKALQRPVASDF
SATGLKQSSKALSRPVASDF

SEQ ID NO: 16499 - protein, 20 aa, synthetic construct
  source 1..20: note = Seed: SATGFKQSSKALQRPVASDF
SATGLKQSSPALARPVASDF

SEQ ID NO: 16500 - protein, 20 aa, synthetic construct
  source 1..20: note = Seed: SATGFKQSSKALQRPVASDF
SATGLKQSSPALIRPVASDF

SEQ ID NO: 16501 - protein, 20 aa, synthetic construct
  source 1..20: note = Seed: SATGFKQSSKALQRPVASDF
SATGLKQSSPALLRPVASDF

SEQ ID NO: 16502 - protein, 20 aa, synthetic construct
  source 1..20: note = Seed: SATGFKQSSKALQRPVASDF
SATGLKQSSPALSRPVASDF

SEQ ID NO: 16503 - protein, 20 aa, synthetic construct
  source 1..20: note = Seed: SATGFKQSSKALQRPVASDF
SATGLKQSSPALVRPVASDF

SEQ ID NO: 16504 - protein, 20 aa, synthetic construct
  source 1..20: note = Seed: SATGFKQSSKALQRPVASDF
SATGLKQSSRALARPVASDF

SEQ ID NO: 16505 - protein, 20 aa, synthetic construct
  source 1..20: note = Seed: SATGFKQSSKALQRPVASDF
SATGLKQSSRALKRPVASDF

SEQ ID NO: 16506 - protein, 20 aa, synthetic construct
  source 1..20: note = Seed: SATGFKQSSKALQRPVASDF
SATGLKQSSRALRRPVASDF

SEQ ID NO: 16507 - protein, 20 aa, synthetic construct
  source 1..20: note = Seed: SATGFKQSSKALQRPVASDF
SATGLKQSSRALSRPVASDF

SEQ ID NO: 16508 - protein, 20 aa, synthetic construct
  source 1..20: note = Seed: SATGFKQSSKALQRPVASDF
SATGLKQSSSALARPVASDF

SEQ ID NO: 16509 - protein, 20 aa, synthetic construct
  source 1..20: note = Seed: SATGFKQSSKALQRPVASDF
SATGLKQSSSALIRPVASDF

SEQ ID NO: 16510 - protein, 20 aa, synthetic construct
  source 1..20: note = Seed: SATGFKQSSKALQRPVASDF
SATGLKQSSSALLRPVASDF

SEQ ID NO: 16511 - protein, 20 aa, synthetic construct
  source 1..20: note = Seed: SATGFKQSSKALQRPVASDF
SATGLKQSSSALVRPVASDF

SEQ ID NO: 16512 - protein, 20 aa, synthetic construct
  source 1..20: note = Seed: SATGFKQSSKALQRPVASDF
SATGLKQSSVALARPVASDF

SEQ ID NO: 16513 - protein, 20 aa, synthetic construct
  source 1..20: note = Seed: SATGFKQSSKALQRPVASDF
SATGLKQSSVALNRPVASDF

SEQ ID NO: 16514 - protein, 20 aa, synthetic construct
  source 1..20: note = Seed: SATGFKQSSKALQRPVASDF
SATGLKQSSVALSRPVASDF

SEQ ID NO: 16515 - protein, 20 aa, synthetic construct
  source 1..20: note = Seed: SATGFKQSSKALQRPVASDF
SATGLKQSSVALVRPVASDF

SEQ ID NO: 16516 - protein, 20 aa, synthetic construct
  source 1..20: note = Seed: SATGFKQSSKALQRPVASDF
SATGLKQTSAALARPVASDF

SEQ ID NO: 16517 - protein, 20 aa, synthetic construct
  source 1..20: note = Seed: SATGFKQSSKALQRPVASDF
SATGLKQTSAALIRPVASDF

SEQ ID NO: 16518 - protein, 20 aa, synthetic construct
  source 1..20: note = Seed: SATGFKQSSKALQRPVASDF
SATGLKQTSAALLRPVASDF

SEQ ID NO: 16519 - protein, 20 aa, synthetic construct
  source 1..20: note = Seed: SATGFKQSSKALQRPVASDF
SATGLKQTSAALMRPVASDF

SEQ ID NO: 16520 - protein, 20 aa, synthetic construct
  source 1..20: note = Seed: SATGFKQSSKALQRPVASDF
SATGLKQTSAALNRPVASDF

SEQ ID NO: 16521 - protein, 20 aa, synthetic construct
  source 1..20: note = Seed: SATGFKQSSKALQRPVASDF
SATGLKQTSAALSRPVASDF

SEQ ID NO: 16522 - protein, 20 aa, synthetic construct
  source 1..20: note = Seed: SATGFKQSSKALQRPVASDF
SATGLKQTSAALVRPVASDF

SEQ ID NO: 16523 - protein, 20 aa, synthetic construct
  source 1..20: note = Seed: SATGFKQSSKALQRPVASDF
SATGLKQTSFALARPVASDF

SEQ ID NO: 16524 - protein, 20 aa, synthetic construct
  source 1..20: note = Seed: SATGFKQSSKALQRPVASDF
SATGLKQTSFALDRPVASDF

SEQ ID NO: 16525 - protein, 20 aa, synthetic construct
  source 1..20: note = Seed: SATGFKQSSKALQRPVASDF
SATGLKQTSFALERPVASDF

SEQ ID NO: 16526 - protein, 20 aa, synthetic construct
  source 1..20: note = Seed: SATGFKQSSKALQRPVASDF
SATGLKQTSFALFRPVASDF

SEQ ID NO: 16527 - protein, 20 aa, synthetic construct
  source 1..20: note = Seed: SATGFKQSSKALQRPVASDF
SATGLKQTSFALIRPVASDF

SEQ ID NO: 16528 - protein, 20 aa, synthetic construct
  source 1..20: note = Seed: SATGFKQSSKALQRPVASDF
SATGLKQTSFALLRPVASDF

SEQ ID NO: 16529 - protein, 20 aa, synthetic construct
  source 1..20: note = Seed: SATGFKQSSKALQRPVASDF
SATGLKQTSFALMRPVASDF

SEQ ID NO: 16530 - protein, 20 aa, synthetic construct
  source 1..20: note = Seed: SATGFKQSSKALQRPVASDF
SATGLKQTSFALNRPVASDF

SEQ ID NO: 16531 - protein, 20 aa, synthetic construct
  source 1..20: note = Seed: SATGFKQSSKALQRPVASDF
SATGLKQTSFALSRPVASDF

SEQ ID NO: 16532 - protein, 20 aa, synthetic construct
  source 1..20: note = Seed: SATGFKQSSKALQRPVASDF
SATGLKQTSFALTRPVASDF

SEQ ID NO: 16533 - protein, 20 aa, synthetic construct
  source 1..20: note = Seed: SATGFKQSSKALQRPVASDF
SATGLKQTSFALVRPVASDF

SEQ ID NO: 16534 - protein, 20 aa, synthetic construct
  source 1..20: note = Seed: SATGFKQSSKALQRPVASDF
SATGLKQTSGALARPVASDF

SEQ ID NO: 16535 - protein, 20 aa, synthetic construct
  source 1..20: note = Seed: SATGFKQSSKALQRPVASDF
SATGLKQTSGALIRPVASDF

SEQ ID NO: 16536 - protein, 20 aa, synthetic construct
  source 1..20: note = Seed: SATGFKQSSKALQRPVASDF
SATGLKQTSGALLRPVASDF

SEQ ID NO: 16537 - protein, 20 aa, synthetic construct
  source 1..20: note = Seed: SATGFKQSSKALQRPVASDF
SATGLKQTSGALVRPVASDF

SEQ ID NO: 16538 - protein, 20 aa, synthetic construct
  source 1..20: note = Seed: SATGFKQSSKALQRPVASDF
SATGLKQTSIALNRPVASDF

SEQ ID NO: 16539 - protein, 20 aa, synthetic construct
  source 1..20: note = Seed: SATGFKQSSKALQRPVASDF
SATGLKQTSKALRRPVASDF

SEQ ID NO: 16540 - protein, 20 aa, synthetic construct
  source 1..20: note = Seed: SATGFKQSSKALQRPVASDF
SATGLKQTSLALLRPVASDF

SEQ ID NO: 16541 - protein, 20 aa, synthetic construct
  source 1..20: note = Seed: SATGFKQSSKALQRPVASDF
SATGLKQTSPALARPVASDF

SEQ ID NO: 16542 - protein, 20 aa, synthetic construct
  source 1..20: note = Seed: SATGFKQSSKALQRPVASDF
SATGLKQTSPALVRPVASDF

SEQ ID NO: 16543 - protein, 20 aa, synthetic construct
  source 1..20: note = Seed: SATGFKQSSKALQRPVASDF
SATGLKQTSRALARPVASDF

SEQ ID NO: 16544 - protein, 20 aa, synthetic construct
  source 1..20: note = Seed: SATGFKQSSKALQRPVASDF
SATGLKQTSRALKRPVASDF

SEQ ID NO: 16545 - protein, 20 aa, synthetic construct
  source 1..20: note = Seed: SATGFKQSSKALQRPVASDF
SATGLKQTSRALRRPVASDF

SEQ ID NO: 16546 - protein, 20 aa, synthetic construct
  source 1..20: note = Seed: SATGFKQSSKALQRPVASDF
SATGLKQTSRALSRPVASDF

SEQ ID NO: 16547 - protein, 20 aa, synthetic construct
  source 1..20: note = Seed: SATGFKQSSKALQRPVASDF
SATGLKQTSSALARPVASDF

SEQ ID NO: 16548 - protein, 20 aa, synthetic construct
  source 1..20: note = Seed: SATGFKQSSKALQRPVASDF
SATGLKQTSSALIRPVASDF

SEQ ID NO: 16549 - protein, 20 aa, synthetic construct
  source 1..20: note = Seed: SATGFKQSSKALQRPVASDF
SATGLKQTSSALVRPVASDF

SEQ ID NO: 16550 - protein, 20 aa, synthetic construct
  source 1..20: note = Seed: SATGFKQSSKALQRPVASDF
SATGLKQTSVALARPVASDF

SEQ ID NO: 16551 - protein, 20 aa, synthetic construct
  source 1..20: note = Seed: SATGFKQSSKALQRPVASDF
SATGLKQTSVALSRPVASDF

SEQ ID NO: 16552 - protein, 20 aa, synthetic construct
  source 1..20: note = Seed: SATGFKQSSKALQRPVASDF
SATGLKQVSAALARPVASDF

SEQ ID NO: 16553 - protein, 20 aa, synthetic construct
  source 1..20: note = Seed: SATGFKQSSKALQRPVASDF
SATGLKQVSAALGRPVASDF

SEQ ID NO: 16554 - protein, 20 aa, synthetic construct
  source 1..20: note = Seed: SATGFKQSSKALQRPVASDF
SATGLKQVSAALIRPVASDF

SEQ ID NO: 16555 - protein, 20 aa, synthetic construct
  source 1..20: note = Seed: SATGFKQSSKALQRPVASDF
SATGLKQVSAALLRPVASDF

SEQ ID NO: 16556 - protein, 20 aa, synthetic construct
  source 1..20: note = Seed: SATGFKQSSKALQRPVASDF
SATGLKQVSAALMRPVASDF

SEQ ID NO: 16557 - protein, 20 aa, synthetic construct
  source 1..20: note = Seed: SATGFKQSSKALQRPVASDF
SATGLKQVSAALNRPVASDF

SEQ ID NO: 16558 - protein, 20 aa, synthetic construct
  source 1..20: note = Seed: SATGFKQSSKALQRPVASDF
SATGLKQVSAALSRPVASDF

SEQ ID NO: 16559 - protein, 20 aa, synthetic construct
  source 1..20: note = Seed: SATGFKQSSKALQRPVASDF
SATGLKQVSAALTRPVASDF

SEQ ID NO: 16560 - protein, 20 aa, synthetic construct
  source 1..20: note = Seed: SATGFKQSSKALQRPVASDF
SATGLKQVSAALVRPVASDF

SEQ ID NO: 16561 - protein, 20 aa, synthetic construct
  source 1..20: note = Seed: SATGFKQSSKALQRPVASDF
SATGLKQVSFALARPVASDF

SEQ ID NO: 16562 - protein, 20 aa, synthetic construct
  source 1..20: note = Seed: SATGFKQSSKALQRPVASDF
SATGLKQVSFALDRPVASDF

SEQ ID NO: 16563 - protein, 20 aa, synthetic construct
  source 1..20: note = Seed: SATGFKQSSKALQRPVASDF
SATGLKQVSFALERPVASDF

SEQ ID NO: 16564 - protein, 20 aa, synthetic construct
  source 1..20: note = Seed: SATGFKQSSKALQRPVASDF
SATGLKQVSFALIRPVASDF

SEQ ID NO: 16565 - protein, 20 aa, synthetic construct
  source 1..20: note = Seed: SATGFKQSSKALQRPVASDF
SATGLKQVSFALLRPVASDF

SEQ ID NO: 16566 - protein, 20 aa, synthetic construct
  source 1..20: note = Seed: SATGFKQSSKALQRPVASDF
SATGLKQVSFALMRPVASDF

SEQ ID NO: 16567 - protein, 20 aa, synthetic construct
  source 1..20: note = Seed: SATGFKQSSKALQRPVASDF
SATGLKQVSFALSRPVASDF

SEQ ID NO: 16568 - protein, 20 aa, synthetic construct
  source 1..20: note = Seed: SATGFKQSSKALQRPVASDF
SATGLKQVSFALTRPVASDF

SEQ ID NO: 16569 - protein, 20 aa, synthetic construct
  source 1..20: note = Seed: SATGFKQSSKALQRPVASDF
SATGLKQVSFALVRPVASDF

SEQ ID NO: 16570 - protein, 20 aa, synthetic construct
  source 1..20: note = Seed: SATGFKQSSKALQRPVASDF
SATGLKQVSGALARPVASDF

SEQ ID NO: 16571 - protein, 20 aa, synthetic construct
  source 1..20: note = Seed: SATGFKQSSKALQRPVASDF
SATGLKQVSGALGRPVASDF

SEQ ID NO: 16572 - protein, 20 aa, synthetic construct
  source 1..20: note = Seed: SATGFKQSSKALQRPVASDF
SATGLKQVSGALIRPVASDF

SEQ ID NO: 16573 - protein, 20 aa, synthetic construct
  source 1..20: note = Seed: SATGFKQSSKALQRPVASDF
SATGLKQVSGALLRPVASDF

SEQ ID NO: 16574 - protein, 20 aa, synthetic construct
  source 1..20: note = Seed: SATGFKQSSKALQRPVASDF
SATGLKQVSGALMRPVASDF

SEQ ID NO: 16575 - protein, 20 aa, synthetic construct
  source 1..20: note = Seed: SATGFKQSSKALQRPVASDF
SATGLKQVSGALNRPVASDF

SEQ ID NO: 16576 - protein, 20 aa, synthetic construct
  source 1..20: note = Seed: SATGFKQSSKALQRPVASDF
SATGLKQVSGALSRPVASDF

SEQ ID NO: 16577 - protein, 20 aa, synthetic construct
  source 1..20: note = Seed: SATGFKQSSKALQRPVASDF
SATGLKQVSGALTRPVASDF

SEQ ID NO: 16578 - protein, 20 aa, synthetic construct
  source 1..20: note = Seed: SATGFKQSSKALQRPVASDF
SATGLKQVSGALVRPVASDF

SEQ ID NO: 16579 - protein, 20 aa, synthetic construct
  source 1..20: note = Seed: SATGFKQSSKALQRPVASDF
SATGLKQVSHALRRPVASDF

SEQ ID NO: 16580 - protein, 20 aa, synthetic construct
  source 1..20: note = Seed: SATGFKQSSKALQRPVASDF
SATGLKQVSIALARPVASDF

SEQ ID NO: 16581 - protein, 20 aa, synthetic construct
  source 1..20: note = Seed: SATGFKQSSKALQRPVASDF
SATGLKQVSIALGRPVASDF

SEQ ID NO: 16582 - protein, 20 aa, synthetic construct
  source 1..20: note = Seed: SATGFKQSSKALQRPVASDF
SATGLKQVSIALHRPVASDF

SEQ ID NO: 16583 - protein, 20 aa, synthetic construct
  source 1..20: note = Seed: SATGFKQSSKALQRPVASDF
SATGLKQVSIALLRPVASDF

SEQ ID NO: 16584 - protein, 20 aa, synthetic construct
  source 1..20: note = Seed: SATGFKQSSKALQRPVASDF
SATGLKQVSIALNRPVASDF

SEQ ID NO: 16585 - protein, 20 aa, synthetic construct
  source 1..20: note = Seed: SATGFKQSSKALQRPVASDF
SATGLKQVSIALSRPVASDF

SEQ ID NO: 16586 - protein, 20 aa, synthetic construct
  source 1..20: note = Seed: SATGFKQSSKALQRPVASDF
SATGLKQVSKALARPVASDF

SEQ ID NO: 16587 - protein, 20 aa, synthetic construct
  source 1..20: note = Seed: SATGFKQSSKALQRPVASDF
SATGLKQVSKALGRPVASDF

SEQ ID NO: 16588 - protein, 20 aa, synthetic construct
  source 1..20: note = Seed: SATGFKQSSKALQRPVASDF
SATGLKQVSKALHRPVASDF

SEQ ID NO: 16589 - protein, 20 aa, synthetic construct
  source 1..20: note = Seed: SATGFKQSSKALQRPVASDF
SATGLKQVSKALIRPVASDF

SEQ ID NO: 16590 - protein, 20 aa, synthetic construct
  source 1..20: note = Seed: SATGFKQSSKALQRPVASDF
SATGLKQVSKALKRPVASDF

SEQ ID NO: 16591 - protein, 20 aa, synthetic construct
  source 1..20: note = Seed: SATGFKQSSKALQRPVASDF
SATGLKQVSKALLRPVASDF

SEQ ID NO: 16592 - protein, 20 aa, synthetic construct
  source 1..20: note = Seed: SATGFKQSSKALQRPVASDF
SATGLKQVSKALMRPVASDF

SEQ ID NO: 16593 - protein, 20 aa, synthetic construct
  source 1..20: note = Seed: SATGFKQSSKALQRPVASDF
SATGLKQVSKALQRPVASDF

SEQ ID NO: 16594 - protein, 20 aa, synthetic construct
  source 1..20: note = Seed: SATGFKQSSKALQRPVASDF
SATGLKQVSKALRRPVASDF

SEQ ID NO: 16595 - protein, 20 aa, synthetic construct
  source 1..20: note = Seed: SATGFKQSSKALQRPVASDF
SATGLKQVSKALSRPVASDF

SEQ ID NO: 16596 - protein, 20 aa, synthetic construct
  source 1..20: note = Seed: SATGFKQSSKALQRPVASDF
SATGLKQVSKALTRPVASDF

SEQ ID NO: 16597 - protein, 20 aa, synthetic construct
  source 1..20: note = Seed: SATGFKQSSKALQRPVASDF
SATGLKQVSKALVRPVASDF

SEQ ID NO: 16598 - protein, 20 aa, synthetic construct
  source 1..20: note = Seed: SATGFKQSSKALQRPVASDF
SATGLKQVSKALYRPVASDF

SEQ ID NO: 16599 - protein, 20 aa, synthetic construct
  source 1..20: note = Seed: SATGFKQSSKALQRPVASDF
SATGLKQVSLALGRPVASDF

SEQ ID NO: 16600 - protein, 20 aa, synthetic construct
  source 1..20: note = Seed: SATGFKQSSKALQRPVASDF
SATGLKQVSLALIRPVASDF

SEQ ID NO: 16601 - protein, 20 aa, synthetic construct
  source 1..20: note = Seed: SATGFKQSSKALQRPVASDF
SATGLKQVSLALLRPVASDF

SEQ ID NO: 16602 - protein, 20 aa, synthetic construct
  source 1..20: note = Seed: SATGFKQSSKALQRPVASDF
SATGLKQVSLALMRPVASDF

SEQ ID NO: 16603 - protein, 20 aa, synthetic construct
  source 1..20: note = Seed: SATGFKQSSKALQRPVASDF
SATGLKQVSLALNRPVASDF

SEQ ID NO: 16604 - protein, 20 aa, synthetic construct
  source 1..20: note = Seed: SATGFKQSSKALQRPVASDF
SATGLKQVSLALVRPVASDF

SEQ ID NO: 16605 - protein, 20 aa, synthetic construct
  source 1..20: note = Seed: SATGFKQSSKALQRPVASDF
SATGLKQVSMALIRPVASDF

SEQ ID NO: 16606 - protein, 20 aa, synthetic construct
  source 1..20: note = Seed: SATGFKQSSKALQRPVASDF
SATGLKQVSMALLRPVASDF

SEQ ID NO: 16607 - protein, 20 aa, synthetic construct
  source 1..20: note = Seed: SATGFKQSSKALQRPVASDF
SATGLKQVSMALNRPVASDF

SEQ ID NO: 16608 - protein, 20 aa, synthetic construct
  source 1..20: note = Seed: SATGFKQSSKALQRPVASDF
SATGLKQVSNALARPVASDF

SEQ ID NO: 16609 - protein, 20 aa, synthetic construct
  source 1..20: note = Seed: SATGFKQSSKALQRPVASDF
SATGLKQVSNALIRPVASDF

SEQ ID NO: 16610 - protein, 20 aa, synthetic construct
  source 1..20: note = Seed: SATGFKQSSKALQRPVASDF
SATGLKQVSNALLRPVASDF

SEQ ID NO: 16611 - protein, 20 aa, synthetic construct
  source 1..20: note = Seed: SATGFKQSSKALQRPVASDF
SATGLKQVSNALRRPVASDF

SEQ ID NO: 16612 - protein, 20 aa, synthetic construct
  source 1..20: note = Seed: SATGFKQSSKALQRPVASDF
SATGLKQVSNALVRPVASDF

SEQ ID NO: 16613 - protein, 20 aa, synthetic construct
  source 1..20: note = Seed: SATGFKQSSKALQRPVASDF
SATGLKQVSPALARPVASDF

SEQ ID NO: 16614 - protein, 20 aa, synthetic construct
  source 1..20: note = Seed: SATGFKQSSKALQRPVASDF
SATGLKQVSPALIRPVASDF

SEQ ID NO: 16615 - protein, 20 aa, synthetic construct
  source 1..20: note = Seed: SATGFKQSSKALQRPVASDF
SATGLKQVSPALLRPVASDF

SEQ ID NO: 16616 - protein, 20 aa, synthetic construct
  source 1..20: note = Seed: SATGFKQSSKALQRPVASDF
SATGLKQVSPALMRPVASDF

SEQ ID NO: 16617 - protein, 20 aa, synthetic construct
  source 1..20: note = Seed: SATGFKQSSKALQRPVASDF
SATGLKQVSPALNRPVASDF

SEQ ID NO: 16618 - protein, 20 aa, synthetic construct
  source 1..20: note = Seed: SATGFKQSSKALQRPVASDF
SATGLKQVSPALSRPVASDF

SEQ ID NO: 16619 - protein, 20 aa, synthetic construct
  source 1..20: note = Seed: SATGFKQSSKALQRPVASDF
SATGLKQVSPALTRPVASDF

SEQ ID NO: 16620 - protein, 20 aa, synthetic construct
  source 1..20: note = Seed: SATGFKQSSKALQRPVASDF
SATGLKQVSPALVRPVASDF

SEQ ID NO: 16621 - protein, 20 aa, synthetic construct
  source 1..20: note = Seed: SATGFKQSSKALQRPVASDF
SATGLKQVSRALARPVASDF

SEQ ID NO: 16622 - protein, 20 aa, synthetic construct
  source 1..20: note = Seed: SATGFKQSSKALQRPVASDF
SATGLKQVSRALGRPVASDF

SEQ ID NO: 16623 - protein, 20 aa, synthetic construct
  source 1..20: note = Seed: SATGFKQSSKALQRPVASDF
SATGLKQVSRALHRPVASDF

SEQ ID NO: 16624 - protein, 20 aa, synthetic construct
  source 1..20: note = Seed: SATGFKQSSKALQRPVASDF
SATGLKQVSRALIRPVASDF

SEQ ID NO: 16625 - protein, 20 aa, synthetic construct
  source 1..20: note = Seed: SATGFKQSSKALQRPVASDF
SATGLKQVSRALKRPVASDF

SEQ ID NO: 16626 - protein, 20 aa, synthetic construct
  source 1..20: note = Seed: SATGFKQSSKALQRPVASDF
SATGLKQVSRALLRPVASDF

SEQ ID NO: 16627 - protein, 20 aa, synthetic construct
  source 1..20: note = Seed: SATGFKQSSKALQRPVASDF
SATGLKQVSRALMRPVASDF

SEQ ID NO: 16628 - protein, 20 aa, synthetic construct
  source 1..20: note = Seed: SATGFKQSSKALQRPVASDF
SATGLKQVSRALNRPVASDF

SEQ ID NO: 16629 - protein, 20 aa, synthetic construct
  source 1..20: note = Seed: SATGFKQSSKALQRPVASDF
SATGLKQVSRALPRPVASDF

SEQ ID NO: 16630 - protein, 20 aa, synthetic construct
  source 1..20: note = Seed: SATGFKQSSKALQRPVASDF
SATGLKQVSRALQRPVASDF

SEQ ID NO: 16631 - protein, 20 aa, synthetic construct
  source 1..20: note = Seed: SATGFKQSSKALQRPVASDF
SATGLKQVSRALRRPVASDF

SEQ ID NO: 16632 - protein, 20 aa, synthetic construct
  source 1..20: note = Seed: SATGFKQSSKALQRPVASDF
SATGLKQVSRALSRPVASDF

SEQ ID NO: 16633 - protein, 20 aa, synthetic construct
  source 1..20: note = Seed: SATGFKQSSKALQRPVASDF
SATGLKQVSRALTRPVASDF

SEQ ID NO: 16634 - protein, 20 aa, synthetic construct
  source 1..20: note = Seed: SATGFKQSSKALQRPVASDF
SATGLKQVSRALVRPVASDF

SEQ ID NO: 16635 - protein, 20 aa, synthetic construct
  source 1..20: note = Seed: SATGFKQSSKALQRPVASDF
SATGLKQVSRALYRPVASDF

SEQ ID NO: 16636 - protein, 20 aa, synthetic construct
  source 1..20: note = Seed: SATGFKQSSKALQRPVASDF
SATGLKQVSSALARPVASDF

SEQ ID NO: 16637 - protein, 20 aa, synthetic construct
  source 1..20: note = Seed: SATGFKQSSKALQRPVASDF
SATGLKQVSSALIRPVASDF

SEQ ID NO: 16638 - protein, 20 aa, synthetic construct
  source 1..20: note = Seed: SATGFKQSSKALQRPVASDF
SATGLKQVSSALLRPVASDF

SEQ ID NO: 16639 - protein, 20 aa, synthetic construct
  source 1..20: note = Seed: SATGFKQSSKALQRPVASDF
SATGLKQVSSALMRPVASDF

SEQ ID NO: 16640 - protein, 20 aa, synthetic construct
  source 1..20: note = Seed: SATGFKQSSKALQRPVASDF
SATGLKQVSSALNRPVASDF

SEQ ID NO: 16641 - protein, 20 aa, synthetic construct
  source 1..20: note = Seed: SATGFKQSSKALQRPVASDF
SATGLKQVSSALSRPVASDF

SEQ ID NO: 16642 - protein, 20 aa, synthetic construct
  source 1..20: note = Seed: SATGFKQSSKALQRPVASDF
SATGLKQVSSALTRPVASDF

SEQ ID NO: 16643 - protein, 20 aa, synthetic construct
  source 1..20: note = Seed: SATGFKQSSKALQRPVASDF
SATGLKQVSSALVRPVASDF

SEQ ID NO: 16644 - protein, 20 aa, synthetic construct
  source 1..20: note = Seed: SATGFKQSSKALQRPVASDF
SATGLKQVSTALARPVASDF

SEQ ID NO: 16645 - protein, 20 aa, synthetic construct
  source 1..20: note = Seed: SATGFKQSSKALQRPVASDF
SATGLKQVSTALIRPVASDF

SEQ ID NO: 16646 - protein, 20 aa, synthetic construct
  source 1..20: note = Seed: SATGFKQSSKALQRPVASDF
SATGLKQVSTALMRPVASDF

SEQ ID NO: 16647 - protein, 20 aa, synthetic construct
  source 1..20: note = Seed: SATGFKQSSKALQRPVASDF
SATGLKQVSTALNRPVASDF

SEQ ID NO: 16648 - protein, 20 aa, synthetic construct
  source 1..20: note = Seed: SATGFKQSSKALQRPVASDF
SATGLKQVSTALRRPVASDF

SEQ ID NO: 16649 - protein, 20 aa, synthetic construct
  source 1..20: note = Seed: SATGFKQSSKALQRPVASDF
SATGLKQVSTALSRPVASDF

SEQ ID NO: 16650 - protein, 20 aa, synthetic construct
  source 1..20: note = Seed: SATGFKQSSKALQRPVASDF
SATGLKQVSTALTRPVASDF

SEQ ID NO: 16651 - protein, 20 aa, synthetic construct
  source 1..20: note = Seed: SATGFKQSSKALQRPVASDF
SATGLKQVSTALVRPVASDF

SEQ ID NO: 16652 - protein, 20 aa, synthetic construct
  source 1..20: note = Seed: SATGFKQSSKALQRPVASDF
SATGLKQVSVALARPVASDF

SEQ ID NO: 16653 - protein, 20 aa, synthetic construct
  source 1..20: note = Seed: SATGFKQSSKALQRPVASDF
SATGLKQVSVALGRPVASDF

SEQ ID NO: 16654 - protein, 20 aa, synthetic construct
  source 1..20: note = Seed: SATGFKQSSKALQRPVASDF
SATGLKQVSVALHRPVASDF

SEQ ID NO: 16655 - protein, 20 aa, synthetic construct
  source 1..20: note = Seed: SATGFKQSSKALQRPVASDF
SATGLKQVSVALIRPVASDF

SEQ ID NO: 16656 - protein, 20 aa, synthetic construct
  source 1..20: note = Seed: SATGFKQSSKALQRPVASDF
SATGLKQVSVALNRPVASDF

SEQ ID NO: 16657 - protein, 20 aa, synthetic construct
  source 1..20: note = Seed: SATGFKQSSKALQRPVASDF
SATGLKQVSVALSRPVASDF

SEQ ID NO: 16658 - protein, 20 aa, synthetic construct
  source 1..20: note = Seed: SATGFKQSSKALQRPVASDF
SATGLKQVSVALTRPVASDF

SEQ ID NO: 16659 - protein, 20 aa, synthetic construct
  source 1..20: note = Seed: SATGFKQSSKALQRPVASDF
SATGLKQVSVALVRPVASDF

SEQ ID NO: 16660 - protein, 20 aa, synthetic construct
  source 1..20: note = Seed: SATGFKQSSKALQRPVASDF
SATGLKQVSYALVRPVASDF

SEQ ID NO: 16661 - protein, 20 aa, synthetic construct
  source 1..20: note = Seed: SATGFKQSSKALQRPVASDF
SATGLKQWSAALIRPVASDF

SEQ ID NO: 16662 - protein, 20 aa, synthetic construct
  source 1..20: note = Seed: SATGFKQSSKALQRPVASDF
SATGLKQWSAALLRPVASDF

SEQ ID NO: 16663 - protein, 20 aa, synthetic construct
  source 1..20: note = Seed: SATGFKQSSKALQRPVASDF
SATGLKQWSAALMRPVASDF

SEQ ID NO: 16664 - protein, 20 aa, synthetic construct
  source 1..20: note = Seed: SATGFKQSSKALQRPVASDF
SATGLKQWSAALRRPVASDF

SEQ ID NO: 16665 - protein, 20 aa, synthetic construct
  source 1..20: note = Seed: SATGFKQSSKALQRPVASDF
SATGLKQWSFALMRPVASDF

SEQ ID NO: 16666 - protein, 20 aa, synthetic construct
  source 1..20: note = Seed: SATGFKQSSKALQRPVASDF
SATGLKQWSFALSRPVASDF

SEQ ID NO: 16667 - protein, 20 aa, synthetic construct
  source 1..20: note = Seed: SATGFKQSSKALQRPVASDF
SATGLKQWSFALVRPVASDF

SEQ ID NO: 16668 - protein, 20 aa, synthetic construct
  source 1..20: note = Seed: SATGFKQSSKALQRPVASDF
SATGLKQWSGALIRPVASDF

SEQ ID NO: 16669 - protein, 20 aa, synthetic construct
  source 1..20: note = Seed: SATGFKQSSKALQRPVASDF
SATGLKQWSGALVRPVASDF

SEQ ID NO: 16670 - protein, 20 aa, synthetic construct
  source 1..20: note = Seed: SATGFKQSSKALQRPVASDF
SATGLKQWSHALRRPVASDF

SEQ ID NO: 16671 - protein, 20 aa, synthetic construct
  source 1..20: note = Seed: SATGFKQSSKALQRPVASDF
SATGLKQWSIALARPVASDF

SEQ ID NO: 16672 - protein, 20 aa, synthetic construct
  source 1..20: note = Seed: SATGFKQSSKALQRPVASDF
SATGLKQWSIALIRPVASDF

SEQ ID NO: 16673 - protein, 20 aa, synthetic construct
  source 1..20: note = Seed: SATGFKQSSKALQRPVASDF
SATGLKQWSIALMRPVASDF

SEQ ID NO: 16674 - protein, 20 aa, synthetic construct
  source 1..20: note = Seed: SATGFKQSSKALQRPVASDF
SATGLKQWSIALRRPVASDF

SEQ ID NO: 16675 - protein, 20 aa, synthetic construct
  source 1..20: note = Seed: SATGFKQSSKALQRPVASDF
SATGLKQWSKALARPVASDF

SEQ ID NO: 16676 - protein, 20 aa, synthetic construct
  source 1..20: note = Seed: SATGFKQSSKALQRPVASDF
SATGLKQWSKALFRPVASDF

SEQ ID NO: 16677 - protein, 20 aa, synthetic construct
  source 1..20: note = Seed: SATGFKQSSKALQRPVASDF
SATGLKQWSKALKRPVASDF

SEQ ID NO: 16678 - protein, 20 aa, synthetic construct
  source 1..20: note = Seed: SATGFKQSSKALQRPVASDF
SATGLKQWSKALRRPVASDF

SEQ ID NO: 16679 - protein, 20 aa, synthetic construct
  source 1..20: note = Seed: SATGFKQSSKALQRPVASDF
SATGLKQWSKALSRPVASDF

SEQ ID NO: 16680 - protein, 20 aa, synthetic construct
  source 1..20: note = Seed: SATGFKQSSKALQRPVASDF
SATGLKQWSKALYRPVASDF

SEQ ID NO: 16681 - protein, 20 aa, synthetic construct
  source 1..20: note = Seed: SATGFKQSSKALQRPVASDF
SATGLKQWSLALARPVASDF

SEQ ID NO: 16682 - protein, 20 aa, synthetic construct
  source 1..20: note = Seed: SATGFKQSSKALQRPVASDF
SATGLKQWSLALIRPVASDF

SEQ ID NO: 16683 - protein, 20 aa, synthetic construct
  source 1..20: note = Seed: SATGFKQSSKALQRPVASDF
SATGLKQWSLALLRPVASDF

SEQ ID NO: 16684 - protein, 20 aa, synthetic construct
  source 1..20: note = Seed: SATGFKQSSKALQRPVASDF
SATGLKQWSLALMRPVASDF

SEQ ID NO: 16685 - protein, 20 aa, synthetic construct
  source 1..20: note = Seed: SATGFKQSSKALQRPVASDF
SATGLKQWSLALRRPVASDF

SEQ ID NO: 16686 - protein, 20 aa, synthetic construct
  source 1..20: note = Seed: SATGFKQSSKALQRPVASDF
SATGLKQWSLALVRPVASDF

SEQ ID NO: 16687 - protein, 20 aa, synthetic construct
  source 1..20: note = Seed: SATGFKQSSKALQRPVASDF
SATGLKQWSMALARPVASDF

SEQ ID NO: 16688 - protein, 20 aa, synthetic construct
  source 1..20: note = Seed: SATGFKQSSKALQRPVASDF
SATGLKQWSMALRRPVASDF

SEQ ID NO: 16689 - protein, 20 aa, synthetic construct
  source 1..20: note = Seed: SATGFKQSSKALQRPVASDF
SATGLKQWSPALIRPVASDF

SEQ ID NO: 16690 - protein, 20 aa, synthetic construct
  source 1..20: note = Seed: SATGFKQSSKALQRPVASDF
SATGLKQWSPALMRPVASDF

SEQ ID NO: 16691 - protein, 20 aa, synthetic construct
  source 1..20: note = Seed: SATGFKQSSKALQRPVASDF
SATGLKQWSPALNRPVASDF

SEQ ID NO: 16692 - protein, 20 aa, synthetic construct
  source 1..20: note = Seed: SATGFKQSSKALQRPVASDF
SATGLKQWSRALARPVASDF

SEQ ID NO: 16693 - protein, 20 aa, synthetic construct
  source 1..20: note = Seed: SATGFKQSSKALQRPVASDF
SATGLKQWSRALFRPVASDF

SEQ ID NO: 16694 - protein, 20 aa, synthetic construct
  source 1..20: note = Seed: SATGFKQSSKALQRPVASDF
SATGLKQWSRALHRPVASDF

SEQ ID NO: 16695 - protein, 20 aa, synthetic construct
  source 1..20: note = Seed: SATGFKQSSKALQRPVASDF
SATGLKQWSRALKRPVASDF

SEQ ID NO: 16696 - protein, 20 aa, synthetic construct
  source 1..20: note = Seed: SATGFKQSSKALQRPVASDF
SATGLKQWSRALMRPVASDF

SEQ ID NO: 16697 - protein, 20 aa, synthetic construct
  source 1..20: note = Seed: SATGFKQSSKALQRPVASDF
SATGLKQWSRALRRPVASDF

SEQ ID NO: 16698 - protein, 20 aa, synthetic construct
  source 1..20: note = Seed: SATGFKQSSKALQRPVASDF
SATGLKQWSRALSRPVASDF

SEQ ID NO: 16699 - protein, 20 aa, synthetic construct
  source 1..20: note = Seed: SATGFKQSSKALQRPVASDF
SATGLKQWSRALYRPVASDF

SEQ ID NO: 16700 - protein, 20 aa, synthetic construct
  source 1..20: note = Seed: SATGFKQSSKALQRPVASDF
SATGLKQWSSALLRPVASDF

SEQ ID NO: 16701 - protein, 20 aa, synthetic construct
  source 1..20: note = Seed: SATGFKQSSKALQRPVASDF
SATGLKQWSTALMRPVASDF

SEQ ID NO: 16702 - protein, 20 aa, synthetic construct
  source 1..20: note = Seed: SATGFKQSSKALQRPVASDF
SATGLKQWSTALRRPVASDF

SEQ ID NO: 16703 - protein, 20 aa, synthetic construct
  source 1..20: note = Seed: SATGFKQSSKALQRPVASDF
SATGLKQWSVALHRPVASDF

SEQ ID NO: 16704 - protein, 20 aa, synthetic construct
  source 1..20: note = Seed: SATGFKQSSKALQRPVASDF
SATGLKQWSVALRRPVASDF

SEQ ID NO: 16705 - protein, 20 aa, synthetic construct
  source 1..20: note = Seed: SATGFKQSSKALQRPVASDF
SATGLKQYSAALVRPVASDF

SEQ ID NO: 16706 - protein, 20 aa, synthetic construct
  source 1..20: note = Seed: SATGFKQSSKALQRPVASDF
SATGLKQYSGALARPVASDF

SEQ ID NO: 16707 - protein, 20 aa, synthetic construct
  source 1..20: note = Seed: SATGFKQSSKALQRPVASDF
SATGLKQYSGALLRPVASDF

SEQ ID NO: 16708 - protein, 20 aa, synthetic construct
  source 1..20: note = Seed: SATGFKQSSKALQRPVASDF
SATGLKQYSHALRRPVASDF

SEQ ID NO: 16709 - protein, 20 aa, synthetic construct
  source 1..20: note = Seed: SATGFKQSSKALQRPVASDF
SATGLKQYSIALRRPVASDF

SEQ ID NO: 16710 - protein, 20 aa, synthetic construct
  source 1..20: note = Seed: SATGFKQSSKALQRPVASDF
SATGLKQYSKALARPVASDF

SEQ ID NO: 16711 - protein, 20 aa, synthetic construct
  source 1..20: note = Seed: SATGFKQSSKALQRPVASDF
SATGLKQYSKALHRPVASDF

SEQ ID NO: 16712 - protein, 20 aa, synthetic construct
  source 1..20: note = Seed: SATGFKQSSKALQRPVASDF
SATGLKQYSKALKRPVASDF

SEQ ID NO: 16713 - protein, 20 aa, synthetic construct
  source 1..20: note = Seed: SATGFKQSSKALQRPVASDF
SATGLKQYSKALRRPVASDF

SEQ ID NO: 16714 - protein, 20 aa, synthetic construct
  source 1..20: note = Seed: SATGFKQSSKALQRPVASDF
SATGLKQYSLALARPVASDF

SEQ ID NO: 16715 - protein, 20 aa, synthetic construct
  source 1..20: note = Seed: SATGFKQSSKALQRPVASDF
SATGLKQYSLALRRPVASDF

SEQ ID NO: 16716 - protein, 20 aa, synthetic construct
  source 1..20: note = Seed: SATGFKQSSKALQRPVASDF
SATGLKQYSMALRRPVASDF

SEQ ID NO: 16717 - protein, 20 aa, synthetic construct
  source 1..20: note = Seed: SATGFKQSSKALQRPVASDF
SATGLKQYSNALARPVASDF

SEQ ID NO: 16718 - protein, 20 aa, synthetic construct
  source 1..20: note = Seed: SATGFKQSSKALQRPVASDF
SATGLKQYSRALARPVASDF

SEQ ID NO: 16719 - protein, 20 aa, synthetic construct
  source 1..20: note = Seed: SATGFKQSSKALQRPVASDF
SATGLKQYSRALHRPVASDF

SEQ ID NO: 16720 - protein, 20 aa, synthetic construct
  source 1..20: note = Seed: SATGFKQSSKALQRPVASDF
SATGLKQYSRALKRPVASDF

SEQ ID NO: 16721 - protein, 20 aa, synthetic construct
  source 1..20: note = Seed: SATGFKQSSKALQRPVASDF
SATGLKQYSRALRRPVASDF

SEQ ID NO: 16722 - protein, 20 aa, synthetic construct
  source 1..20: note = Seed: SATGFKQSSKALQRPVASDF
SATGLKQYSRALSRPVASDF

SEQ ID NO: 16723 - protein, 20 aa, synthetic construct
  source 1..20: note = Seed: SATGFKQSSKALQRPVASDF
SATGLKQYSSALARPVASDF

SEQ ID NO: 16724 - protein, 20 aa, synthetic construct
  source 1..20: note = Seed: SATGFKQSSKALQRPVASDF
SATGLKQYSSALGRPVASDF

SEQ ID NO: 16725 - protein, 20 aa, synthetic construct
  source 1..20: note = Seed: SATGFKQSSKALQRPVASDF
SATGLKQYSTALRRPVASDF

SEQ ID NO: 16726 - protein, 20 aa, synthetic construct
  source 1..20: note = Seed: SATGFKQSSKALQRPVASDF
SATGLKQYSVALRRPVASDF

SEQ ID NO: 16727 - protein, 20 aa, synthetic construct
  source 1..20: note = Seed: SATGFKQSSKALQRPVASDF
SATGMKQASAALARPVASDF

SEQ ID NO: 16728 - protein, 20 aa, synthetic construct
  source 1..20: note = Seed: SATGFKQSSKALQRPVASDF
SATGMKQASAALIRPVASDF

SEQ ID NO: 16729 - protein, 20 aa, synthetic construct
  source 1..20: note = Seed: SATGFKQSSKALQRPVASDF
SATGMKQASAALLRPVASDF

SEQ ID NO: 16730 - protein, 20 aa, synthetic construct
  source 1..20: note = Seed: SATGFKQSSKALQRPVASDF
SATGMKQASAALMRPVASDF

SEQ ID NO: 16731 - protein, 20 aa, synthetic construct
  source 1..20: note = Seed: SATGFKQSSKALQRPVASDF
SATGMKQASAALNRPVASDF

SEQ ID NO: 16732 - protein, 20 aa, synthetic construct
  source 1..20: note = Seed: SATGFKQSSKALQRPVASDF
SATGMKQASAALSRPVASDF

SEQ ID NO: 16733 - protein, 20 aa, synthetic construct
  source 1..20: note = Seed: SATGFKQSSKALQRPVASDF
SATGMKQASAALTRPVASDF

SEQ ID NO: 16734 - protein, 20 aa, synthetic construct
  source 1..20: note = Seed: SATGFKQSSKALQRPVASDF
SATGMKQASAALVRPVASDF

SEQ ID NO: 16735 - protein, 20 aa, synthetic construct
  source 1..20: note = Seed: SATGFKQSSKALQRPVASDF
SATGMKQASFALARPVASDF

SEQ ID NO: 16736 - protein, 20 aa, synthetic construct
  source 1..20: note = Seed: SATGFKQSSKALQRPVASDF
SATGMKQASFALERPVASDF

SEQ ID NO: 16737 - protein, 20 aa, synthetic construct
  source 1..20: note = Seed: SATGFKQSSKALQRPVASDF
SATGMKQASFALIRPVASDF

SEQ ID NO: 16738 - protein, 20 aa, synthetic construct
  source 1..20: note = Seed: SATGFKQSSKALQRPVASDF
SATGMKQASFALLRPVASDF

SEQ ID NO: 16739 - protein, 20 aa, synthetic construct
  source 1..20: note = Seed: SATGFKQSSKALQRPVASDF
SATGMKQASFALVRPVASDF

SEQ ID NO: 16740 - protein, 20 aa, synthetic construct
  source 1..20: note = Seed: SATGFKQSSKALQRPVASDF
SATGMKQASGALARPVASDF

SEQ ID NO: 16741 - protein, 20 aa, synthetic construct
  source 1..20: note = Seed: SATGFKQSSKALQRPVASDF
SATGMKQASGALIRPVASDF

SEQ ID NO: 16742 - protein, 20 aa, synthetic construct
  source 1..20: note = Seed: SATGFKQSSKALQRPVASDF
SATGMKQASGALLRPVASDF

SEQ ID NO: 16743 - protein, 20 aa, synthetic construct
  source 1..20: note = Seed: SATGFKQSSKALQRPVASDF
SATGMKQASGALMRPVASDF

SEQ ID NO: 16744 - protein, 20 aa, synthetic construct
  source 1..20: note = Seed: SATGFKQSSKALQRPVASDF
SATGMKQASGALSRPVASDF

SEQ ID NO: 16745 - protein, 20 aa, synthetic construct
  source 1..20: note = Seed: SATGFKQSSKALQRPVASDF
SATGMKQASGALVRPVASDF

SEQ ID NO: 16746 - protein, 20 aa, synthetic construct
  source 1..20: note = Seed: SATGFKQSSKALQRPVASDF
SATGMKQASIALHRPVASDF

SEQ ID NO: 16747 - protein, 20 aa, synthetic construct
  source 1..20: note = Seed: SATGFKQSSKALQRPVASDF
SATGMKQASIALNRPVASDF

SEQ ID NO: 16748 - protein, 20 aa, synthetic construct
  source 1..20: note = Seed: SATGFKQSSKALQRPVASDF
SATGMKQASIALSRPVASDF

SEQ ID NO: 16749 - protein, 20 aa, synthetic construct
  source 1..20: note = Seed: SATGFKQSSKALQRPVASDF
SATGMKQASKALARPVASDF

SEQ ID NO: 16750 - protein, 20 aa, synthetic construct
  source 1..20: note = Seed: SATGFKQSSKALQRPVASDF
SATGMKQASKALKRPVASDF

SEQ ID NO: 16751 - protein, 20 aa, synthetic construct
  source 1..20: note = Seed: SATGFKQSSKALQRPVASDF
SATGMKQASKALRRPVASDF

SEQ ID NO: 16752 - protein, 20 aa, synthetic construct
  source 1..20: note = Seed: SATGFKQSSKALQRPVASDF
SATGMKQASKALSRPVASDF

SEQ ID NO: 16753 - protein, 20 aa, synthetic construct
  source 1..20: note = Seed: SATGFKQSSKALQRPVASDF
SATGMKQASLALNRPVASDF

SEQ ID NO: 16754 - protein, 20 aa, synthetic construct
  source 1..20: note = Seed: SATGFKQSSKALQRPVASDF
SATGMKQASMALNRPVASDF

SEQ ID NO: 16755 - protein, 20 aa, synthetic construct
  source 1..20: note = Seed: SATGFKQSSKALQRPVASDF
SATGMKQASMALVRPVASDF

SEQ ID NO: 16756 - protein, 20 aa, synthetic construct
  source 1..20: note = Seed: SATGFKQSSKALQRPVASDF
SATGMKQASNALARPVASDF

SEQ ID NO: 16757 - protein, 20 aa, synthetic construct
  source 1..20: note = Seed: SATGFKQSSKALQRPVASDF
SATGMKQASPALARPVASDF

SEQ ID NO: 16758 - protein, 20 aa, synthetic construct
  source 1..20: note = Seed: SATGFKQSSKALQRPVASDF
SATGMKQASPALIRPVASDF

SEQ ID NO: 16759 - protein, 20 aa, synthetic construct
  source 1..20: note = Seed: SATGFKQSSKALQRPVASDF
SATGMKQASPALLRPVASDF

SEQ ID NO: 16760 - protein, 20 aa, synthetic construct
  source 1..20: note = Seed: SATGFKQSSKALQRPVASDF
SATGMKQASPALMRPVASDF

SEQ ID NO: 16761 - protein, 20 aa, synthetic construct
  source 1..20: note = Seed: SATGFKQSSKALQRPVASDF
SATGMKQASPALNRPVASDF

SEQ ID NO: 16762 - protein, 20 aa, synthetic construct
  source 1..20: note = Seed: SATGFKQSSKALQRPVASDF
SATGMKQASPALSRPVASDF

SEQ ID NO: 16763 - protein, 20 aa, synthetic construct
  source 1..20: note = Seed: SATGFKQSSKALQRPVASDF
SATGMKQASPALVRPVASDF

SEQ ID NO: 16764 - protein, 20 aa, synthetic construct
  source 1..20: note = Seed: SATGFKQSSKALQRPVASDF
SATGMKQASRALARPVASDF

SEQ ID NO: 16765 - protein, 20 aa, synthetic construct
  source 1..20: note = Seed: SATGFKQSSKALQRPVASDF
SATGMKQASRALHRPVASDF

SEQ ID NO: 16766 - protein, 20 aa, synthetic construct
  source 1..20: note = Seed: SATGFKQSSKALQRPVASDF
SATGMKQASRALKRPVASDF

SEQ ID NO: 16767 - protein, 20 aa, synthetic construct
  source 1..20: note = Seed: SATGFKQSSKALQRPVASDF
SATGMKQASRALQRPVASDF

SEQ ID NO: 16768 - protein, 20 aa, synthetic construct
  source 1..20: note = Seed: SATGFKQSSKALQRPVASDF
SATGMKQASRALRRPVASDF

SEQ ID NO: 16769 - protein, 20 aa, synthetic construct
  source 1..20: note = Seed: SATGFKQSSKALQRPVASDF
SATGMKQASRALSRPVASDF

SEQ ID NO: 16770 - protein, 20 aa, synthetic construct
  source 1..20: note = Seed: SATGFKQSSKALQRPVASDF
SATGMKQASSALARPVASDF

SEQ ID NO: 16771 - protein, 20 aa, synthetic construct
  source 1..20: note = Seed: SATGFKQSSKALQRPVASDF
SATGMKQASSALIRPVASDF

SEQ ID NO: 16772 - protein, 20 aa, synthetic construct
  source 1..20: note = Seed: SATGFKQSSKALQRPVASDF
SATGMKQASSALLRPVASDF

SEQ ID NO: 16773 - protein, 20 aa, synthetic construct
  source 1..20: note = Seed: SATGFKQSSKALQRPVASDF
SATGMKQASSALMRPVASDF

SEQ ID NO: 16774 - protein, 20 aa, synthetic construct
  source 1..20: note = Seed: SATGFKQSSKALQRPVASDF
SATGMKQASSALNRPVASDF

SEQ ID NO: 16775 - protein, 20 aa, synthetic construct
  source 1..20: note = Seed: SATGFKQSSKALQRPVASDF
SATGMKQASSALSRPVASDF

SEQ ID NO: 16776 - protein, 20 aa, synthetic construct
  source 1..20: note = Seed: SATGFKQSSKALQRPVASDF
SATGMKQASSALTRPVASDF

SEQ ID NO: 16777 - protein, 20 aa, synthetic construct
  source 1..20: note = Seed: SATGFKQSSKALQRPVASDF
SATGMKQASSALVRPVASDF

SEQ ID NO: 16778 - protein, 20 aa, synthetic construct
  source 1..20: note = Seed: SATGFKQSSKALQRPVASDF
SATGMKQASTALARPVASDF

SEQ ID NO: 16779 - protein, 20 aa, synthetic construct
  source 1..20: note = Seed: SATGFKQSSKALQRPVASDF
SATGMKQASTALIRPVASDF

SEQ ID NO: 16780 - protein, 20 aa, synthetic construct
  source 1..20: note = Seed: SATGFKQSSKALQRPVASDF
SATGMKQASTALLRPVASDF

SEQ ID NO: 16781 - protein, 20 aa, synthetic construct
  source 1..20: note = Seed: SATGFKQSSKALQRPVASDF
SATGMKQASTALMRPVASDF

SEQ ID NO: 16782 - protein, 20 aa, synthetic construct
  source 1..20: note = Seed: SATGFKQSSKALQRPVASDF
SATGMKQASTALNRPVASDF

SEQ ID NO: 16783 - protein, 20 aa, synthetic construct
  source 1..20: note = Seed: SATGFKQSSKALQRPVASDF
SATGMKQASTALSRPVASDF

SEQ ID NO: 16784 - protein, 20 aa, synthetic construct
  source 1..20: note = Seed: SATGFKQSSKALQRPVASDF
SATGMKQASTALVRPVASDF

SEQ ID NO: 16785 - protein, 20 aa, synthetic construct
  source 1..20: note = Seed: SATGFKQSSKALQRPVASDF
SATGMKQASVALARPVASDF

SEQ ID NO: 16786 - protein, 20 aa, synthetic construct
  source 1..20: note = Seed: SATGFKQSSKALQRPVASDF
SATGMKQASVALHRPVASDF

SEQ ID NO: 16787 - protein, 20 aa, synthetic construct
  source 1..20: note = Seed: SATGFKQSSKALQRPVASDF
SATGMKQASVALIRPVASDF

SEQ ID NO: 16788 - protein, 20 aa, synthetic construct
  source 1..20: note = Seed: SATGFKQSSKALQRPVASDF
SATGMKQASVALNRPVASDF

SEQ ID NO: 16789 - protein, 20 aa, synthetic construct
  source 1..20: note = Seed: SATGFKQSSKALQRPVASDF
SATGMKQASVALQRPVASDF

SEQ ID NO: 16790 - protein, 20 aa, synthetic construct
  source 1..20: note = Seed: SATGFKQSSKALQRPVASDF
SATGMKQASVALSRPVASDF

SEQ ID NO: 16791 - protein, 20 aa, synthetic construct
  source 1..20: note = Seed: SATGFKQSSKALQRPVASDF
SATGMKQASVALTRPVASDF

SEQ ID NO: 16792 - protein, 20 aa, synthetic construct
  source 1..20: note = Seed: SATGFKQSSKALQRPVASDF
SATGMKQASVALVRPVASDF

SEQ ID NO: 16793 - protein, 20 aa, synthetic construct
  source 1..20: note = Seed: SATGFKQSSKALQRPVASDF
SATGMKQCSAALARPVASDF

SEQ ID NO: 16794 - protein, 20 aa, synthetic construct
  source 1..20: note = Seed: SATGFKQSSKALQRPVASDF
SATGMKQCSIALSRPVASDF

SEQ ID NO: 16795 - protein, 20 aa, synthetic construct
  source 1..20: note = Seed: SATGFKQSSKALQRPVASDF
SATGMKQCSSALARPVASDF

SEQ ID NO: 16796 - protein, 20 aa, synthetic construct
  source 1..20: note = Seed: SATGFKQSSKALQRPVASDF
SATGMKQCSVALARPVASDF

SEQ ID NO: 16797 - protein, 20 aa, synthetic construct
  source 1..20: note = Seed: SATGFKQSSKALQRPVASDF
SATGMKQESAALARPVASDF

SEQ ID NO: 16798 - protein, 20 aa, synthetic construct
  source 1..20: note = Seed: SATGFKQSSKALQRPVASDF
SATGMKQESAALIRPVASDF

SEQ ID NO: 16799 - protein, 20 aa, synthetic construct
  source 1..20: note = Seed: SATGFKQSSKALQRPVASDF
SATGMKQESAALLRPVASDF

SEQ ID NO: 16800 - protein, 20 aa, synthetic construct
  source 1..20: note = Seed: SATGFKQSSKALQRPVASDF
SATGMKQESAALVRPVASDF

SEQ ID NO: 16801 - protein, 20 aa, synthetic construct
  source 1..20: note = Seed: SATGFKQSSKALQRPVASDF
SATGMKQESFALFRPVASDF

SEQ ID NO: 16802 - protein, 20 aa, synthetic construct
  source 1..20: note = Seed: SATGFKQSSKALQRPVASDF
SATGMKQESFALIRPVASDF

SEQ ID NO: 16803 - protein, 20 aa, synthetic construct
  source 1..20: note = Seed: SATGFKQSSKALQRPVASDF
SATGMKQESFALLRPVASDF

SEQ ID NO: 16804 - protein, 20 aa, synthetic construct
  source 1..20: note = Seed: SATGFKQSSKALQRPVASDF
SATGMKQESFALVRPVASDF

SEQ ID NO: 16805 - protein, 20 aa, synthetic construct
  source 1..20: note = Seed: SATGFKQSSKALQRPVASDF
SATGMKQESGALLRPVASDF

SEQ ID NO: 16806 - protein, 20 aa, synthetic construct
  source 1..20: note = Seed: SATGFKQSSKALQRPVASDF
SATGMKQESGALVRPVASDF

SEQ ID NO: 16807 - protein, 20 aa, synthetic construct
  source 1..20: note = Seed: SATGFKQSSKALQRPVASDF
SATGMKQESIALNRPVASDF

SEQ ID NO: 16808 - protein, 20 aa, synthetic construct
  source 1..20: note = Seed: SATGFKQSSKALQRPVASDF
SATGMKQESIALSRPVASDF

SEQ ID NO: 16809 - protein, 20 aa, synthetic construct
  source 1..20: note = Seed: SATGFKQSSKALQRPVASDF
SATGMKQESVALARPVASDF

SEQ ID NO: 16810 - protein, 20 aa, synthetic construct
  source 1..20: note = Seed: SATGFKQSSKALQRPVASDF
SATGMKQESVALSRPVASDF

SEQ ID NO: 16811 - protein, 20 aa, synthetic construct
  source 1..20: note = Seed: SATGFKQSSKALQRPVASDF
SATGMKQESVALVRPVASDF

SEQ ID NO: 16812 - protein, 20 aa, synthetic construct
  source 1..20: note = Seed: SATGFKQSSKALQRPVASDF
SATGMKQFSAALLRPVASDF

SEQ ID NO: 16813 - protein, 20 aa, synthetic construct
  source 1..20: note = Seed: SATGFKQSSKALQRPVASDF
SATGMKQFSAALRRPVASDF

SEQ ID NO: 16814 - protein, 20 aa, synthetic construct
  source 1..20: note = Seed: SATGFKQSSKALQRPVASDF
SATGMKQFSAALVRPVASDF

SEQ ID NO: 16815 - protein, 20 aa, synthetic construct
  source 1..20: note = Seed: SATGFKQSSKALQRPVASDF
SATGMKQFSFALMRPVASDF

SEQ ID NO: 16816 - protein, 20 aa, synthetic construct
  source 1..20: note = Seed: SATGFKQSSKALQRPVASDF
SATGMKQFSGALARPVASDF

SEQ ID NO: 16817 - protein, 20 aa, synthetic construct
  source 1..20: note = Seed: SATGFKQSSKALQRPVASDF
SATGMKQFSGALIRPVASDF

SEQ ID NO: 16818 - protein, 20 aa, synthetic construct
  source 1..20: note = Seed: SATGFKQSSKALQRPVASDF
SATGMKQFSGALLRPVASDF

SEQ ID NO: 16819 - protein, 20 aa, synthetic construct
  source 1..20: note = Seed: SATGFKQSSKALQRPVASDF
SATGMKQFSGALMRPVASDF

SEQ ID NO: 16820 - protein, 20 aa, synthetic construct
  source 1..20: note = Seed: SATGFKQSSKALQRPVASDF
SATGMKQFSHALKRPVASDF

SEQ ID NO: 16821 - protein, 20 aa, synthetic construct
  source 1..20: note = Seed: SATGFKQSSKALQRPVASDF
SATGMKQFSHALRRPVASDF

SEQ ID NO: 16822 - protein, 20 aa, synthetic construct
  source 1..20: note = Seed: SATGFKQSSKALQRPVASDF
SATGMKQFSIALARPVASDF

SEQ ID NO: 16823 - protein, 20 aa, synthetic construct
  source 1..20: note = Seed: SATGFKQSSKALQRPVASDF
SATGMKQFSIALSRPVASDF

SEQ ID NO: 16824 - protein, 20 aa, synthetic construct
  source 1..20: note = Seed: SATGFKQSSKALQRPVASDF
SATGMKQFSKALARPVASDF

SEQ ID NO: 16825 - protein, 20 aa, synthetic construct
  source 1..20: note = Seed: SATGFKQSSKALQRPVASDF
SATGMKQFSKALGRPVASDF

SEQ ID NO: 16826 - protein, 20 aa, synthetic construct
  source 1..20: note = Seed: SATGFKQSSKALQRPVASDF
SATGMKQFSKALHRPVASDF

SEQ ID NO: 16827 - protein, 20 aa, synthetic construct
  source 1..20: note = Seed: SATGFKQSSKALQRPVASDF
SATGMKQFSKALIRPVASDF

SEQ ID NO: 16828 - protein, 20 aa, synthetic construct
  source 1..20: note = Seed: SATGFKQSSKALQRPVASDF
SATGMKQFSKALKRPVASDF

SEQ ID NO: 16829 - protein, 20 aa, synthetic construct
  source 1..20: note = Seed: SATGFKQSSKALQRPVASDF
SATGMKQFSKALLRPVASDF

SEQ ID NO: 16830 - protein, 20 aa, synthetic construct
  source 1..20: note = Seed: SATGFKQSSKALQRPVASDF
SATGMKQFSKALMRPVASDF

SEQ ID NO: 16831 - protein, 20 aa, synthetic construct
  source 1..20: note = Seed: SATGFKQSSKALQRPVASDF
SATGMKQFSKALQRPVASDF

SEQ ID NO: 16832 - protein, 20 aa, synthetic construct
  source 1..20: note = Seed: SATGFKQSSKALQRPVASDF
SATGMKQFSKALRRPVASDF

SEQ ID NO: 16833 - protein, 20 aa, synthetic construct
  source 1..20: note = Seed: SATGFKQSSKALQRPVASDF
SATGMKQFSKALSRPVASDF

SEQ ID NO: 16834 - protein, 20 aa, synthetic construct
  source 1..20: note = Seed: SATGFKQSSKALQRPVASDF
SATGMKQFSKALTRPVASDF

SEQ ID NO: 16835 - protein, 20 aa, synthetic construct
  source 1..20: note = Seed: SATGFKQSSKALQRPVASDF
SATGMKQFSKALVRPVASDF

SEQ ID NO: 16836 - protein, 20 aa, synthetic construct
  source 1..20: note = Seed: SATGFKQSSKALQRPVASDF
SATGMKQFSLALARPVASDF

SEQ ID NO: 16837 - protein, 20 aa, synthetic construct
  source 1..20: note = Seed: SATGFKQSSKALQRPVASDF
SATGMKQFSLALSRPVASDF

SEQ ID NO: 16838 - protein, 20 aa, synthetic construct
  source 1..20: note = Seed: SATGFKQSSKALQRPVASDF
SATGMKQFSNALLRPVASDF

SEQ ID NO: 16839 - protein, 20 aa, synthetic construct
  source 1..20: note = Seed: SATGFKQSSKALQRPVASDF
SATGMKQFSPALLRPVASDF

SEQ ID NO: 16840 - protein, 20 aa, synthetic construct
  source 1..20: note = Seed: SATGFKQSSKALQRPVASDF
SATGMKQFSRALARPVASDF

SEQ ID NO: 16841 - protein, 20 aa, synthetic construct
  source 1..20: note = Seed: SATGFKQSSKALQRPVASDF
SATGMKQFSRALGRPVASDF

SEQ ID NO: 16842 - protein, 20 aa, synthetic construct
  source 1..20: note = Seed: SATGFKQSSKALQRPVASDF
SATGMKQFSRALHRPVASDF

SEQ ID NO: 16843 - protein, 20 aa, synthetic construct
  source 1..20: note = Seed: SATGFKQSSKALQRPVASDF
SATGMKQFSRALIRPVASDF

SEQ ID NO: 16844 - protein, 20 aa, synthetic construct
  source 1..20: note = Seed: SATGFKQSSKALQRPVASDF
SATGMKQFSRALKRPVASDF

SEQ ID NO: 16845 - protein, 20 aa, synthetic construct
  source 1..20: note = Seed: SATGFKQSSKALQRPVASDF
SATGMKQFSRALLRPVASDF

SEQ ID NO: 16846 - protein, 20 aa, synthetic construct
  source 1..20: note = Seed: SATGFKQSSKALQRPVASDF
SATGMKQFSRALMRPVASDF

SEQ ID NO: 16847 - protein, 20 aa, synthetic construct
  source 1..20: note = Seed: SATGFKQSSKALQRPVASDF
SATGMKQFSRALQRPVASDF

SEQ ID NO: 16848 - protein, 20 aa, synthetic construct
  source 1..20: note = Seed: SATGFKQSSKALQRPVASDF
SATGMKQFSRALRRPVASDF

SEQ ID NO: 16849 - protein, 20 aa, synthetic construct
  source 1..20: note = Seed: SATGFKQSSKALQRPVASDF
SATGMKQFSRALSRPVASDF

SEQ ID NO: 16850 - protein, 20 aa, synthetic construct
  source 1..20: note = Seed: SATGFKQSSKALQRPVASDF
SATGMKQFSRALTRPVASDF

SEQ ID NO: 16851 - protein, 20 aa, synthetic construct
  source 1..20: note = Seed: SATGFKQSSKALQRPVASDF
SATGMKQFSRALVRPVASDF

SEQ ID NO: 16852 - protein, 20 aa, synthetic construct
  source 1..20: note = Seed: SATGFKQSSKALQRPVASDF
SATGMKQFSRALYRPVASDF

SEQ ID NO: 16853 - protein, 20 aa, synthetic construct
  source 1..20: note = Seed: SATGFKQSSKALQRPVASDF
SATGMKQFSSALVRPVASDF

SEQ ID NO: 16854 - protein, 20 aa, synthetic construct
  source 1..20: note = Seed: SATGFKQSSKALQRPVASDF
SATGMKQFSTALQRPVASDF

SEQ ID NO: 16855 - protein, 20 aa, synthetic construct
  source 1..20: note = Seed: SATGFKQSSKALQRPVASDF
SATGMKQFSTALRRPVASDF

SEQ ID NO: 16856 - protein, 20 aa, synthetic construct
  source 1..20: note = Seed: SATGFKQSSKALQRPVASDF
SATGMKQGSAALIRPVASDF

SEQ ID NO: 16857 - protein, 20 aa, synthetic construct
  source 1..20: note = Seed: SATGFKQSSKALQRPVASDF
SATGMKQGSAALLRPVASDF

SEQ ID NO: 16858 - protein, 20 aa, synthetic construct
  source 1..20: note = Seed: SATGFKQSSKALQRPVASDF
SATGMKQGSAALVRPVASDF

SEQ ID NO: 16859 - protein, 20 aa, synthetic construct
  source 1..20: note = Seed: SATGFKQSSKALQRPVASDF
SATGMKQHSIALRRPVASDF

SEQ ID NO: 16860 - protein, 20 aa, synthetic construct
  source 1..20: note = Seed: SATGFKQSSKALQRPVASDF
SATGMKQHSRALRRPVASDF

SEQ ID NO: 16861 - protein, 20 aa, synthetic construct
  source 1..20: note = Seed: SATGFKQSSKALQRPVASDF
SATGMKQHSVALRRPVASDF

SEQ ID NO: 16862 - protein, 20 aa, synthetic construct
  source 1..20: note = Seed: SATGFKQSSKALQRPVASDF
SATGMKQHSVALSRPVASDF

SEQ ID NO: 16863 - protein, 20 aa, synthetic construct
  source 1..20: note = Seed: SATGFKQSSKALQRPVASDF
SATGMKQISAALARPVASDF

SEQ ID NO: 16864 - protein, 20 aa, synthetic construct
  source 1..20: note = Seed: SATGFKQSSKALQRPVASDF
SATGMKQISAALCRPVASDF

SEQ ID NO: 16865 - protein, 20 aa, synthetic construct
  source 1..20: note = Seed: SATGFKQSSKALQRPVASDF
SATGMKQISAALGRPVASDF

SEQ ID NO: 16866 - protein, 20 aa, synthetic construct
  source 1..20: note = Seed: SATGFKQSSKALQRPVASDF
SATGMKQISAALHRPVASDF

SEQ ID NO: 16867 - protein, 20 aa, synthetic construct
  source 1..20: note = Seed: SATGFKQSSKALQRPVASDF
SATGMKQISAALIRPVASDF

SEQ ID NO: 16868 - protein, 20 aa, synthetic construct
  source 1..20: note = Seed: SATGFKQSSKALQRPVASDF
SATGMKQISAALLRPVASDF

SEQ ID NO: 16869 - protein, 20 aa, synthetic construct
  source 1..20: note = Seed: SATGFKQSSKALQRPVASDF
SATGMKQISAALMRPVASDF

SEQ ID NO: 16870 - protein, 20 aa, synthetic construct
  source 1..20: note = Seed: SATGFKQSSKALQRPVASDF
SATGMKQISAALNRPVASDF

SEQ ID NO: 16871 - protein, 20 aa, synthetic construct
  source 1..20: note = Seed: SATGFKQSSKALQRPVASDF
SATGMKQISAALQRPVASDF

SEQ ID NO: 16872 - protein, 20 aa, synthetic construct
  source 1..20: note = Seed: SATGFKQSSKALQRPVASDF
SATGMKQISAALSRPVASDF

SEQ ID NO: 16873 - protein, 20 aa, synthetic construct
  source 1..20: note = Seed: SATGFKQSSKALQRPVASDF
SATGMKQISAALTRPVASDF

SEQ ID NO: 16874 - protein, 20 aa, synthetic construct
  source 1..20: note = Seed: SATGFKQSSKALQRPVASDF
SATGMKQISAALVRPVASDF

SEQ ID NO: 16875 - protein, 20 aa, synthetic construct
  source 1..20: note = Seed: SATGFKQSSKALQRPVASDF
SATGMKQISFALARPVASDF

SEQ ID NO: 16876 - protein, 20 aa, synthetic construct
  source 1..20: note = Seed: SATGFKQSSKALQRPVASDF
SATGMKQISFALERPVASDF

SEQ ID NO: 16877 - protein, 20 aa, synthetic construct
  source 1..20: note = Seed: SATGFKQSSKALQRPVASDF
SATGMKQISFALSRPVASDF

SEQ ID NO: 16878 - protein, 20 aa, synthetic construct
  source 1..20: note = Seed: SATGFKQSSKALQRPVASDF
SATGMKQISFALTRPVASDF

SEQ ID NO: 16879 - protein, 20 aa, synthetic construct
  source 1..20: note = Seed: SATGFKQSSKALQRPVASDF
SATGMKQISFALVRPVASDF

SEQ ID NO: 16880 - protein, 20 aa, synthetic construct
  source 1..20: note = Seed: SATGFKQSSKALQRPVASDF
SATGMKQISGALARPVASDF

SEQ ID NO: 16881 - protein, 20 aa, synthetic construct
  source 1..20: note = Seed: SATGFKQSSKALQRPVASDF
SATGMKQISGALIRPVASDF

SEQ ID NO: 16882 - protein, 20 aa, synthetic construct
  source 1..20: note = Seed: SATGFKQSSKALQRPVASDF
SATGMKQISGALLRPVASDF

SEQ ID NO: 16883 - protein, 20 aa, synthetic construct
  source 1..20: note = Seed: SATGFKQSSKALQRPVASDF
SATGMKQISGALMRPVASDF

SEQ ID NO: 16884 - protein, 20 aa, synthetic construct
  source 1..20: note = Seed: SATGFKQSSKALQRPVASDF
SATGMKQISGALNRPVASDF

SEQ ID NO: 16885 - protein, 20 aa, synthetic construct
  source 1..20: note = Seed: SATGFKQSSKALQRPVASDF
SATGMKQISGALSRPVASDF

SEQ ID NO: 16886 - protein, 20 aa, synthetic construct
  source 1..20: note = Seed: SATGFKQSSKALQRPVASDF
SATGMKQISGALTRPVASDF

SEQ ID NO: 16887 - protein, 20 aa, synthetic construct
  source 1..20: note = Seed: SATGFKQSSKALQRPVASDF
SATGMKQISGALVRPVASDF

SEQ ID NO: 16888 - protein, 20 aa, synthetic construct
  source 1..20: note = Seed: SATGFKQSSKALQRPVASDF
SATGMKQISHALLRPVASDF

SEQ ID NO: 16889 - protein, 20 aa, synthetic construct
  source 1..20: note = Seed: SATGFKQSSKALQRPVASDF
SATGMKQISIALARPVASDF

SEQ ID NO: 16890 - protein, 20 aa, synthetic construct
  source 1..20: note = Seed: SATGFKQSSKALQRPVASDF
SATGMKQISIALCRPVASDF

SEQ ID NO: 16891 - protein, 20 aa, synthetic construct
  source 1..20: note = Seed: SATGFKQSSKALQRPVASDF
SATGMKQISIALGRPVASDF

SEQ ID NO: 16892 - protein, 20 aa, synthetic construct
  source 1..20: note = Seed: SATGFKQSSKALQRPVASDF
SATGMKQISIALHRPVASDF

SEQ ID NO: 16893 - protein, 20 aa, synthetic construct
  source 1..20: note = Seed: SATGFKQSSKALQRPVASDF
SATGMKQISIALNRPVASDF

SEQ ID NO: 16894 - protein, 20 aa, synthetic construct
  source 1..20: note = Seed: SATGFKQSSKALQRPVASDF
SATGMKQISIALSRPVASDF

SEQ ID NO: 16895 - protein, 20 aa, synthetic construct
  source 1..20: note = Seed: SATGFKQSSKALQRPVASDF
SATGMKQISKALARPVASDF

SEQ ID NO: 16896 - protein, 20 aa, synthetic construct
  source 1..20: note = Seed: SATGFKQSSKALQRPVASDF
SATGMKQISKALGRPVASDF

SEQ ID NO: 16897 - protein, 20 aa, synthetic construct
  source 1..20: note = Seed: SATGFKQSSKALQRPVASDF
SATGMKQISKALHRPVASDF

SEQ ID NO: 16898 - protein, 20 aa, synthetic construct
  source 1..20: note = Seed: SATGFKQSSKALQRPVASDF
SATGMKQISKALIRPVASDF

SEQ ID NO: 16899 - protein, 20 aa, synthetic construct
  source 1..20: note = Seed: SATGFKQSSKALQRPVASDF
SATGMKQISKALKRPVASDF

SEQ ID NO: 16900 - protein, 20 aa, synthetic construct
  source 1..20: note = Seed: SATGFKQSSKALQRPVASDF
SATGMKQISKALLRPVASDF

SEQ ID NO: 16901 - protein, 20 aa, synthetic construct
  source 1..20: note = Seed: SATGFKQSSKALQRPVASDF
SATGMKQISKALMRPVASDF

SEQ ID NO: 16902 - protein, 20 aa, synthetic construct
  source 1..20: note = Seed: SATGFKQSSKALQRPVASDF
SATGMKQISKALNRPVASDF

SEQ ID NO: 16903 - protein, 20 aa, synthetic construct
  source 1..20: note = Seed: SATGFKQSSKALQRPVASDF
SATGMKQISKALQRPVASDF

SEQ ID NO: 16904 - protein, 20 aa, synthetic construct
  source 1..20: note = Seed: SATGFKQSSKALQRPVASDF
SATGMKQISKALRRPVASDF

SEQ ID NO: 16905 - protein, 20 aa, synthetic construct
  source 1..20: note = Seed: SATGFKQSSKALQRPVASDF
SATGMKQISKALSRPVASDF

SEQ ID NO: 16906 - protein, 20 aa, synthetic construct
  source 1..20: note = Seed: SATGFKQSSKALQRPVASDF
SATGMKQISKALTRPVASDF

SEQ ID NO: 16907 - protein, 20 aa, synthetic construct
  source 1..20: note = Seed: SATGFKQSSKALQRPVASDF
SATGMKQISKALVRPVASDF

SEQ ID NO: 16908 - protein, 20 aa, synthetic construct
  source 1..20: note = Seed: SATGFKQSSKALQRPVASDF
SATGMKQISKALYRPVASDF

SEQ ID NO: 16909 - protein, 20 aa, synthetic construct
  source 1..20: note = Seed: SATGFKQSSKALQRPVASDF
SATGMKQISLALMRPVASDF

SEQ ID NO: 16910 - protein, 20 aa, synthetic construct
  source 1..20: note = Seed: SATGFKQSSKALQRPVASDF
SATGMKQISLALNRPVASDF

SEQ ID NO: 16911 - protein, 20 aa, synthetic construct
  source 1..20: note = Seed: SATGFKQSSKALQRPVASDF
SATGMKQISLALVRPVASDF

SEQ ID NO: 16912 - protein, 20 aa, synthetic construct
  source 1..20: note = Seed: SATGFKQSSKALQRPVASDF
SATGMKQISNALARPVASDF

SEQ ID NO: 16913 - protein, 20 aa, synthetic construct
  source 1..20: note = Seed: SATGFKQSSKALQRPVASDF
SATGMKQISNALIRPVASDF

SEQ ID NO: 16914 - protein, 20 aa, synthetic construct
  source 1..20: note = Seed: SATGFKQSSKALQRPVASDF
SATGMKQISNALLRPVASDF

SEQ ID NO: 16915 - protein, 20 aa, synthetic construct
  source 1..20: note = Seed: SATGFKQSSKALQRPVASDF
SATGMKQISNALNRPVASDF

SEQ ID NO: 16916 - protein, 20 aa, synthetic construct
  source 1..20: note = Seed: SATGFKQSSKALQRPVASDF
SATGMKQISNALSRPVASDF

SEQ ID NO: 16917 - protein, 20 aa, synthetic construct
  source 1..20: note = Seed: SATGFKQSSKALQRPVASDF
SATGMKQISNALTRPVASDF

SEQ ID NO: 16918 - protein, 20 aa, synthetic construct
  source 1..20: note = Seed: SATGFKQSSKALQRPVASDF
SATGMKQISNALVRPVASDF

SEQ ID NO: 16919 - protein, 20 aa, synthetic construct
  source 1..20: note = Seed: SATGFKQSSKALQRPVASDF
SATGMKQISPALARPVASDF

SEQ ID NO: 16920 - protein, 20 aa, synthetic construct
  source 1..20: note = Seed: SATGFKQSSKALQRPVASDF
SATGMKQISPALGRPVASDF

SEQ ID NO: 16921 - protein, 20 aa, synthetic construct
  source 1..20: note = Seed: SATGFKQSSKALQRPVASDF
SATGMKQISPALIRPVASDF

SEQ ID NO: 16922 - protein, 20 aa, synthetic construct
  source 1..20: note = Seed: SATGFKQSSKALQRPVASDF
SATGMKQISPALLRPVASDF

SEQ ID NO: 16923 - protein, 20 aa, synthetic construct
  source 1..20: note = Seed: SATGFKQSSKALQRPVASDF
SATGMKQISPALMRPVASDF

SEQ ID NO: 16924 - protein, 20 aa, synthetic construct
  source 1..20: note = Seed: SATGFKQSSKALQRPVASDF
SATGMKQISPALNRPVASDF

SEQ ID NO: 16925 - protein, 20 aa, synthetic construct
  source 1..20: note = Seed: SATGFKQSSKALQRPVASDF
SATGMKQISPALSRPVASDF

SEQ ID NO: 16926 - protein, 20 aa, synthetic construct
  source 1..20: note = Seed: SATGFKQSSKALQRPVASDF
SATGMKQISPALTRPVASDF

SEQ ID NO: 16927 - protein, 20 aa, synthetic construct
  source 1..20: note = Seed: SATGFKQSSKALQRPVASDF
SATGMKQISPALVRPVASDF

SEQ ID NO: 16928 - protein, 20 aa, synthetic construct
  source 1..20: note = Seed: SATGFKQSSKALQRPVASDF
SATGMKQISRALARPVASDF

SEQ ID NO: 16929 - protein, 20 aa, synthetic construct
  source 1..20: note = Seed: SATGFKQSSKALQRPVASDF
SATGMKQISRALFRPVASDF

SEQ ID NO: 16930 - protein, 20 aa, synthetic construct
  source 1..20: note = Seed: SATGFKQSSKALQRPVASDF
SATGMKQISRALGRPVASDF

SEQ ID NO: 16931 - protein, 20 aa, synthetic construct
  source 1..20: note = Seed: SATGFKQSSKALQRPVASDF
SATGMKQISRALHRPVASDF

SEQ ID NO: 16932 - protein, 20 aa, synthetic construct
  source 1..20: note = Seed: SATGFKQSSKALQRPVASDF
SATGMKQISRALIRPVASDF

SEQ ID NO: 16933 - protein, 20 aa, synthetic construct
  source 1..20: note = Seed: SATGFKQSSKALQRPVASDF
SATGMKQISRALKRPVASDF

SEQ ID NO: 16934 - protein, 20 aa, synthetic construct
  source 1..20: note = Seed: SATGFKQSSKALQRPVASDF
SATGMKQISRALLRPVASDF

SEQ ID NO: 16935 - protein, 20 aa, synthetic construct
  source 1..20: note = Seed: SATGFKQSSKALQRPVASDF
SATGMKQISRALMRPVASDF

SEQ ID NO: 16936 - protein, 20 aa, synthetic construct
  source 1..20: note = Seed: SATGFKQSSKALQRPVASDF
SATGMKQISRALNRPVASDF

SEQ ID NO: 16937 - protein, 20 aa, synthetic construct
  source 1..20: note = Seed: SATGFKQSSKALQRPVASDF
SATGMKQISRALPRPVASDF

SEQ ID NO: 16938 - protein, 20 aa, synthetic construct
  source 1..20: note = Seed: SATGFKQSSKALQRPVASDF
SATGMKQISRALQRPVASDF

SEQ ID NO: 16939 - protein, 20 aa, synthetic construct
  source 1..20: note = Seed: SATGFKQSSKALQRPVASDF
SATGMKQISRALRRPVASDF

SEQ ID NO: 16940 - protein, 20 aa, synthetic construct
  source 1..20: note = Seed: SATGFKQSSKALQRPVASDF
SATGMKQISRALSRPVASDF

SEQ ID NO: 16941 - protein, 20 aa, synthetic construct
  source 1..20: note = Seed: SATGFKQSSKALQRPVASDF
SATGMKQISRALTRPVASDF

SEQ ID NO: 16942 - protein, 20 aa, synthetic construct
  source 1..20: note = Seed: SATGFKQSSKALQRPVASDF
SATGMKQISRALVRPVASDF

SEQ ID NO: 16943 - protein, 20 aa, synthetic construct
  source 1..20: note = Seed: SATGFKQSSKALQRPVASDF
SATGMKQISRALYRPVASDF

SEQ ID NO: 16944 - protein, 20 aa, synthetic construct
  source 1..20: note = Seed: SATGFKQSSKALQRPVASDF
SATGMKQISSALARPVASDF

SEQ ID NO: 16945 - protein, 20 aa, synthetic construct
  source 1..20: note = Seed: SATGFKQSSKALQRPVASDF
SATGMKQISSALGRPVASDF

SEQ ID NO: 16946 - protein, 20 aa, synthetic construct
  source 1..20: note = Seed: SATGFKQSSKALQRPVASDF
SATGMKQISSALIRPVASDF

SEQ ID NO: 16947 - protein, 20 aa, synthetic construct
  source 1..20: note = Seed: SATGFKQSSKALQRPVASDF
SATGMKQISSALLRPVASDF

SEQ ID NO: 16948 - protein, 20 aa, synthetic construct
  source 1..20: note = Seed: SATGFKQSSKALQRPVASDF
SATGMKQISSALMRPVASDF

SEQ ID NO: 16949 - protein, 20 aa, synthetic construct
  source 1..20: note = Seed: SATGFKQSSKALQRPVASDF
SATGMKQISSALNRPVASDF

SEQ ID NO: 16950 - protein, 20 aa, synthetic construct
  source 1..20: note = Seed: SATGFKQSSKALQRPVASDF
SATGMKQISSALSRPVASDF

SEQ ID NO: 16951 - protein, 20 aa, synthetic construct
  source 1..20: note = Seed: SATGFKQSSKALQRPVASDF
SATGMKQISSALVRPVASDF

SEQ ID NO: 16952 - protein, 20 aa, synthetic construct
  source 1..20: note = Seed: SATGFKQSSKALQRPVASDF
SATGMKQISTALARPVASDF

SEQ ID NO: 16953 - protein, 20 aa, synthetic construct
  source 1..20: note = Seed: SATGFKQSSKALQRPVASDF
SATGMKQISTALGRPVASDF

SEQ ID NO: 16954 - protein, 20 aa, synthetic construct
  source 1..20: note = Seed: SATGFKQSSKALQRPVASDF
SATGMKQISTALIRPVASDF

SEQ ID NO: 16955 - protein, 20 aa, synthetic construct
  source 1..20: note = Seed: SATGFKQSSKALQRPVASDF
SATGMKQISTALLRPVASDF

SEQ ID NO: 16956 - protein, 20 aa, synthetic construct
  source 1..20: note = Seed: SATGFKQSSKALQRPVASDF
SATGMKQISTALMRPVASDF

SEQ ID NO: 16957 - protein, 20 aa, synthetic construct
  source 1..20: note = Seed: SATGFKQSSKALQRPVASDF
SATGMKQISTALNRPVASDF

SEQ ID NO: 16958 - protein, 20 aa, synthetic construct
  source 1..20: note = Seed: SATGFKQSSKALQRPVASDF
SATGMKQISTALSRPVASDF

SEQ ID NO: 16959 - protein, 20 aa, synthetic construct
  source 1..20: note = Seed: SATGFKQSSKALQRPVASDF
SATGMKQISTALTRPVASDF

SEQ ID NO: 16960 - protein, 20 aa, synthetic construct
  source 1..20: note = Seed: SATGFKQSSKALQRPVASDF
SATGMKQISTALVRPVASDF

SEQ ID NO: 16961 - protein, 20 aa, synthetic construct
  source 1..20: note = Seed: SATGFKQSSKALQRPVASDF
SATGMKQISVALARPVASDF

SEQ ID NO: 16962 - protein, 20 aa, synthetic construct
  source 1..20: note = Seed: SATGFKQSSKALQRPVASDF
SATGMKQISVALGRPVASDF

SEQ ID NO: 16963 - protein, 20 aa, synthetic construct
  source 1..20: note = Seed: SATGFKQSSKALQRPVASDF
SATGMKQISVALHRPVASDF

SEQ ID NO: 16964 - protein, 20 aa, synthetic construct
  source 1..20: note = Seed: SATGFKQSSKALQRPVASDF
SATGMKQISVALNRPVASDF

SEQ ID NO: 16965 - protein, 20 aa, synthetic construct
  source 1..20: note = Seed: SATGFKQSSKALQRPVASDF
SATGMKQISVALQRPVASDF

SEQ ID NO: 16966 - protein, 20 aa, synthetic construct
  source 1..20: note = Seed: SATGFKQSSKALQRPVASDF
SATGMKQISVALSRPVASDF

SEQ ID NO: 16967 - protein, 20 aa, synthetic construct
  source 1..20: note = Seed: SATGFKQSSKALQRPVASDF
SATGMKQISVALTRPVASDF

SEQ ID NO: 16968 - protein, 20 aa, synthetic construct
  source 1..20: note = Seed: SATGFKQSSKALQRPVASDF
SATGMKQISVALVRPVASDF

SEQ ID NO: 16969 - protein, 20 aa, synthetic construct
  source 1..20: note = Seed: SATGFKQSSKALQRPVASDF
SATGMKQKSRALRRPVASDF

SEQ ID NO: 16970 - protein, 20 aa, synthetic construct
  source 1..20: note = Seed: SATGFKQSSKALQRPVASDF
SATGMKQLSAALARPVASDF

SEQ ID NO: 16971 - protein, 20 aa, synthetic construct
  source 1..20: note = Seed: SATGFKQSSKALQRPVASDF
SATGMKQLSAALCRPVASDF

SEQ ID NO: 16972 - protein, 20 aa, synthetic construct
  source 1..20: note = Seed: SATGFKQSSKALQRPVASDF
SATGMKQLSAALDRPVASDF

SEQ ID NO: 16973 - protein, 20 aa, synthetic construct
  source 1..20: note = Seed: SATGFKQSSKALQRPVASDF
SATGMKQLSAALFRPVASDF

SEQ ID NO: 16974 - protein, 20 aa, synthetic construct
  source 1..20: note = Seed: SATGFKQSSKALQRPVASDF
SATGMKQLSAALGRPVASDF

SEQ ID NO: 16975 - protein, 20 aa, synthetic construct
  source 1..20: note = Seed: SATGFKQSSKALQRPVASDF
SATGMKQLSAALHRPVASDF

SEQ ID NO: 16976 - protein, 20 aa, synthetic construct
  source 1..20: note = Seed: SATGFKQSSKALQRPVASDF
SATGMKQLSAALIRPVASDF

SEQ ID NO: 16977 - protein, 20 aa, synthetic construct
  source 1..20: note = Seed: SATGFKQSSKALQRPVASDF
SATGMKQLSAALLRPVASDF

SEQ ID NO: 16978 - protein, 20 aa, synthetic construct
  source 1..20: note = Seed: SATGFKQSSKALQRPVASDF
SATGMKQLSAALMRPVASDF

SEQ ID NO: 16979 - protein, 20 aa, synthetic construct
  source 1..20: note = Seed: SATGFKQSSKALQRPVASDF
SATGMKQLSAALNRPVASDF

SEQ ID NO: 16980 - protein, 20 aa, synthetic construct
  source 1..20: note = Seed: SATGFKQSSKALQRPVASDF
SATGMKQLSAALPRPVASDF

SEQ ID NO: 16981 - protein, 20 aa, synthetic construct
  source 1..20: note = Seed: SATGFKQSSKALQRPVASDF
SATGMKQLSAALQRPVASDF

SEQ ID NO: 16982 - protein, 20 aa, synthetic construct
  source 1..20: note = Seed: SATGFKQSSKALQRPVASDF
SATGMKQLSAALSRPVASDF

SEQ ID NO: 16983 - protein, 20 aa, synthetic construct
  source 1..20: note = Seed: SATGFKQSSKALQRPVASDF
SATGMKQLSAALTRPVASDF

SEQ ID NO: 16984 - protein, 20 aa, synthetic construct
  source 1..20: note = Seed: SATGFKQSSKALQRPVASDF
SATGMKQLSAALVRPVASDF

SEQ ID NO: 16985 - protein, 20 aa, synthetic construct
  source 1..20: note = Seed: SATGFKQSSKALQRPVASDF
SATGMKQLSCALARPVASDF

SEQ ID NO: 16986 - protein, 20 aa, synthetic construct
  source 1..20: note = Seed: SATGFKQSSKALQRPVASDF
SATGMKQLSCALIRPVASDF

SEQ ID NO: 16987 - protein, 20 aa, synthetic construct
  source 1..20: note = Seed: SATGFKQSSKALQRPVASDF
SATGMKQLSCALSRPVASDF

SEQ ID NO: 16988 - protein, 20 aa, synthetic construct
  source 1..20: note = Seed: SATGFKQSSKALQRPVASDF
SATGMKQLSCALVRPVASDF

SEQ ID NO: 16989 - protein, 20 aa, synthetic construct
  source 1..20: note = Seed: SATGFKQSSKALQRPVASDF
SATGMKQLSFALARPVASDF

SEQ ID NO: 16990 - protein, 20 aa, synthetic construct
  source 1..20: note = Seed: SATGFKQSSKALQRPVASDF
SATGMKQLSGALARPVASDF

SEQ ID NO: 16991 - protein, 20 aa, synthetic construct
  source 1..20: note = Seed: SATGFKQSSKALQRPVASDF
SATGMKQLSGALCRPVASDF

SEQ ID NO: 16992 - protein, 20 aa, synthetic construct
  source 1..20: note = Seed: SATGFKQSSKALQRPVASDF
SATGMKQLSGALFRPVASDF

SEQ ID NO: 16993 - protein, 20 aa, synthetic construct
  source 1..20: note = Seed: SATGFKQSSKALQRPVASDF
SATGMKQLSGALGRPVASDF

SEQ ID NO: 16994 - protein, 20 aa, synthetic construct
  source 1..20: note = Seed: SATGFKQSSKALQRPVASDF
SATGMKQLSGALIRPVASDF

SEQ ID NO: 16995 - protein, 20 aa, synthetic construct
  source 1..20: note = Seed: SATGFKQSSKALQRPVASDF
SATGMKQLSGALLRPVASDF

SEQ ID NO: 16996 - protein, 20 aa, synthetic construct
  source 1..20: note = Seed: SATGFKQSSKALQRPVASDF
SATGMKQLSGALMRPVASDF

SEQ ID NO: 16997 - protein, 20 aa, synthetic construct
  source 1..20: note = Seed: SATGFKQSSKALQRPVASDF
SATGMKQLSGALNRPVASDF

SEQ ID NO: 16998 - protein, 20 aa, synthetic construct
  source 1..20: note = Seed: SATGFKQSSKALQRPVASDF
SATGMKQLSGALSRPVASDF

SEQ ID NO: 16999 - protein, 20 aa, synthetic construct
  source 1..20: note = Seed: SATGFKQSSKALQRPVASDF
SATGMKQLSGALTRPVASDF

SEQ ID NO: 17000 - protein, 20 aa, synthetic construct
  source 1..20: note = Seed: SATGFKQSSKALQRPVASDF
SATGMKQLSGALVRPVASDF

SEQ ID NO: 17001 - protein, 20 aa, synthetic construct
  source 1..20: note = Seed: SATGFKQSSKALQRPVASDF
SATGMKQLSHALIRPVASDF

SEQ ID NO: 17002 - protein, 20 aa, synthetic construct
  source 1..20: note = Seed: SATGFKQSSKALQRPVASDF
SATGMKQLSHALLRPVASDF

SEQ ID NO: 17003 - protein, 20 aa, synthetic construct
  source 1..20: note = Seed: SATGFKQSSKALQRPVASDF
SATGMKQLSHALMRPVASDF

SEQ ID NO: 17004 - protein, 20 aa, synthetic construct
  source 1..20: note = Seed: SATGFKQSSKALQRPVASDF
SATGMKQLSHALRRPVASDF

SEQ ID NO: 17005 - protein, 20 aa, synthetic construct
  source 1..20: note = Seed: SATGFKQSSKALQRPVASDF
SATGMKQLSHALVRPVASDF

SEQ ID NO: 17006 - protein, 20 aa, synthetic construct
  source 1..20: note = Seed: SATGFKQSSKALQRPVASDF
SATGMKQLSIALARPVASDF

SEQ ID NO: 17007 - protein, 20 aa, synthetic construct
  source 1..20: note = Seed: SATGFKQSSKALQRPVASDF
SATGMKQLSIALCRPVASDF

SEQ ID NO: 17008 - protein, 20 aa, synthetic construct
  source 1..20: note = Seed: SATGFKQSSKALQRPVASDF
SATGMKQLSIALGRPVASDF

SEQ ID NO: 17009 - protein, 20 aa, synthetic construct
  source 1..20: note = Seed: SATGFKQSSKALQRPVASDF
SATGMKQLSIALHRPVASDF

SEQ ID NO: 17010 - protein, 20 aa, synthetic construct
  source 1..20: note = Seed: SATGFKQSSKALQRPVASDF
SATGMKQLSIALNRPVASDF

SEQ ID NO: 17011 - protein, 20 aa, synthetic construct
  source 1..20: note = Seed: SATGFKQSSKALQRPVASDF
SATGMKQLSIALSRPVASDF

SEQ ID NO: 17012 - protein, 20 aa, synthetic construct
  source 1..20: note = Seed: SATGFKQSSKALQRPVASDF
SATGMKQLSIALTRPVASDF

SEQ ID NO: 17013 - protein, 20 aa, synthetic construct
  source 1..20: note = Seed: SATGFKQSSKALQRPVASDF
SATGMKQLSIALVRPVASDF

SEQ ID NO: 17014 - protein, 20 aa, synthetic construct
  source 1..20: note = Seed: SATGFKQSSKALQRPVASDF
SATGMKQLSKALARPVASDF

SEQ ID NO: 17015 - protein, 20 aa, synthetic construct
  source 1..20: note = Seed: SATGFKQSSKALQRPVASDF
SATGMKQLSKALGRPVASDF

SEQ ID NO: 17016 - protein, 20 aa, synthetic construct
  source 1..20: note = Seed: SATGFKQSSKALQRPVASDF
SATGMKQLSKALHRPVASDF

SEQ ID NO: 17017 - protein, 20 aa, synthetic construct
  source 1..20: note = Seed: SATGFKQSSKALQRPVASDF
SATGMKQLSKALIRPVASDF

SEQ ID NO: 17018 - protein, 20 aa, synthetic construct
  source 1..20: note = Seed: SATGFKQSSKALQRPVASDF
SATGMKQLSKALKRPVASDF

SEQ ID NO: 17019 - protein, 20 aa, synthetic construct
  source 1..20: note = Seed: SATGFKQSSKALQRPVASDF
SATGMKQLSKALLRPVASDF

SEQ ID NO: 17020 - protein, 20 aa, synthetic construct
  source 1..20: note = Seed: SATGFKQSSKALQRPVASDF
SATGMKQLSKALMRPVASDF

SEQ ID NO: 17021 - protein, 20 aa, synthetic construct
  source 1..20: note = Seed: SATGFKQSSKALQRPVASDF
SATGMKQLSKALNRPVASDF

SEQ ID NO: 17022 - protein, 20 aa, synthetic construct
  source 1..20: note = Seed: SATGFKQSSKALQRPVASDF
SATGMKQLSKALQRPVASDF

SEQ ID NO: 17023 - protein, 20 aa, synthetic construct
  source 1..20: note = Seed: SATGFKQSSKALQRPVASDF
SATGMKQLSKALRRPVASDF

SEQ ID NO: 17024 - protein, 20 aa, synthetic construct
  source 1..20: note = Seed: SATGFKQSSKALQRPVASDF
SATGMKQLSKALSRPVASDF

SEQ ID NO: 17025 - protein, 20 aa, synthetic construct
  source 1..20: note = Seed: SATGFKQSSKALQRPVASDF
SATGMKQLSKALTRPVASDF

SEQ ID NO: 17026 - protein, 20 aa, synthetic construct
  source 1..20: note = Seed: SATGFKQSSKALQRPVASDF
SATGMKQLSKALVRPVASDF

SEQ ID NO: 17027 - protein, 20 aa, synthetic construct
  source 1..20: note = Seed: SATGFKQSSKALQRPVASDF
SATGMKQLSKALYRPVASDF

SEQ ID NO: 17028 - protein, 20 aa, synthetic construct
  source 1..20: note = Seed: SATGFKQSSKALQRPVASDF
SATGMKQLSLALCRPVASDF

SEQ ID NO: 17029 - protein, 20 aa, synthetic construct
  source 1..20: note = Seed: SATGFKQSSKALQRPVASDF
SATGMKQLSLALGRPVASDF

SEQ ID NO: 17030 - protein, 20 aa, synthetic construct
  source 1..20: note = Seed: SATGFKQSSKALQRPVASDF
SATGMKQLSLALHRPVASDF

SEQ ID NO: 17031 - protein, 20 aa, synthetic construct
  source 1..20: note = Seed: SATGFKQSSKALQRPVASDF
SATGMKQLSLALNRPVASDF

SEQ ID NO: 17032 - protein, 20 aa, synthetic construct
  source 1..20: note = Seed: SATGFKQSSKALQRPVASDF
SATGMKQLSLALSRPVASDF

SEQ ID NO: 17033 - protein, 20 aa, synthetic construct
  source 1..20: note = Seed: SATGFKQSSKALQRPVASDF
SATGMKQLSMALCRPVASDF

SEQ ID NO: 17034 - protein, 20 aa, synthetic construct
  source 1..20: note = Seed: SATGFKQSSKALQRPVASDF
SATGMKQLSMALHRPVASDF

SEQ ID NO: 17035 - protein, 20 aa, synthetic construct
  source 1..20: note = Seed: SATGFKQSSKALQRPVASDF
SATGMKQLSMALNRPVASDF

SEQ ID NO: 17036 - protein, 20 aa, synthetic construct
  source 1..20: note = Seed: SATGFKQSSKALQRPVASDF
SATGMKQLSNALARPVASDF

SEQ ID NO: 17037 - protein, 20 aa, synthetic construct
  source 1..20: note = Seed: SATGFKQSSKALQRPVASDF
SATGMKQLSNALGRPVASDF

SEQ ID NO: 17038 - protein, 20 aa, synthetic construct
  source 1..20: note = Seed: SATGFKQSSKALQRPVASDF
SATGMKQLSNALIRPVASDF

SEQ ID NO: 17039 - protein, 20 aa, synthetic construct
  source 1..20: note = Seed: SATGFKQSSKALQRPVASDF
SATGMKQLSNALLRPVASDF

SEQ ID NO: 17040 - protein, 20 aa, synthetic construct
  source 1..20: note = Seed: SATGFKQSSKALQRPVASDF
SATGMKQLSNALMRPVASDF

SEQ ID NO: 17041 - protein, 20 aa, synthetic construct
  source 1..20: note = Seed: SATGFKQSSKALQRPVASDF
SATGMKQLSNALNRPVASDF

SEQ ID NO: 17042 - protein, 20 aa, synthetic construct
  source 1..20: note = Seed: SATGFKQSSKALQRPVASDF
SATGMKQLSNALSRPVASDF

SEQ ID NO: 17043 - protein, 20 aa, synthetic construct
  source 1..20: note = Seed: SATGFKQSSKALQRPVASDF
SATGMKQLSNALTRPVASDF

SEQ ID NO: 17044 - protein, 20 aa, synthetic construct
  source 1..20: note = Seed: SATGFKQSSKALQRPVASDF
SATGMKQLSNALVRPVASDF

SEQ ID NO: 17045 - protein, 20 aa, synthetic construct
  source 1..20: note = Seed: SATGFKQSSKALQRPVASDF
SATGMKQLSPALARPVASDF

SEQ ID NO: 17046 - protein, 20 aa, synthetic construct
  source 1..20: note = Seed: SATGFKQSSKALQRPVASDF
SATGMKQLSPALCRPVASDF

SEQ ID NO: 17047 - protein, 20 aa, synthetic construct
  source 1..20: note = Seed: SATGFKQSSKALQRPVASDF
SATGMKQLSPALGRPVASDF

SEQ ID NO: 17048 - protein, 20 aa, synthetic construct
  source 1..20: note = Seed: SATGFKQSSKALQRPVASDF
SATGMKQLSPALHRPVASDF

SEQ ID NO: 17049 - protein, 20 aa, synthetic construct
  source 1..20: note = Seed: SATGFKQSSKALQRPVASDF
SATGMKQLSPALIRPVASDF

SEQ ID NO: 17050 - protein, 20 aa, synthetic construct
  source 1..20: note = Seed: SATGFKQSSKALQRPVASDF
SATGMKQLSPALLRPVASDF

SEQ ID NO: 17051 - protein, 20 aa, synthetic construct
  source 1..20: note = Seed: SATGFKQSSKALQRPVASDF
SATGMKQLSPALMRPVASDF

SEQ ID NO: 17052 - protein, 20 aa, synthetic construct
  source 1..20: note = Seed: SATGFKQSSKALQRPVASDF
SATGMKQLSPALNRPVASDF

SEQ ID NO: 17053 - protein, 20 aa, synthetic construct
  source 1..20: note = Seed: SATGFKQSSKALQRPVASDF
SATGMKQLSPALPRPVASDF

SEQ ID NO: 17054 - protein, 20 aa, synthetic construct
  source 1..20: note = Seed: SATGFKQSSKALQRPVASDF
SATGMKQLSPALQRPVASDF

SEQ ID NO: 17055 - protein, 20 aa, synthetic construct
  source 1..20: note = Seed: SATGFKQSSKALQRPVASDF
SATGMKQLSPALSRPVASDF

SEQ ID NO: 17056 - protein, 20 aa, synthetic construct
  source 1..20: note = Seed: SATGFKQSSKALQRPVASDF
SATGMKQLSPALTRPVASDF

SEQ ID NO: 17057 - protein, 20 aa, synthetic construct
  source 1..20: note = Seed: SATGFKQSSKALQRPVASDF
SATGMKQLSPALVRPVASDF

SEQ ID NO: 17058 - protein, 20 aa, synthetic construct
  source 1..20: note = Seed: SATGFKQSSKALQRPVASDF
SATGMKQLSQALIRPVASDF

SEQ ID NO: 17059 - protein, 20 aa, synthetic construct
  source 1..20: note = Seed: SATGFKQSSKALQRPVASDF
SATGMKQLSQALSRPVASDF

SEQ ID NO: 17060 - protein, 20 aa, synthetic construct
  source 1..20: note = Seed: SATGFKQSSKALQRPVASDF
SATGMKQLSQALVRPVASDF

SEQ ID NO: 17061 - protein, 20 aa, synthetic construct
  source 1..20: note = Seed: SATGFKQSSKALQRPVASDF
SATGMKQLSRALARPVASDF

SEQ ID NO: 17062 - protein, 20 aa, synthetic construct
  source 1..20: note = Seed: SATGFKQSSKALQRPVASDF
SATGMKQLSRALFRPVASDF

SEQ ID NO: 17063 - protein, 20 aa, synthetic construct
  source 1..20: note = Seed: SATGFKQSSKALQRPVASDF
SATGMKQLSRALGRPVASDF

SEQ ID NO: 17064 - protein, 20 aa, synthetic construct
  source 1..20: note = Seed: SATGFKQSSKALQRPVASDF
SATGMKQLSRALHRPVASDF

SEQ ID NO: 17065 - protein, 20 aa, synthetic construct
  source 1..20: note = Seed: SATGFKQSSKALQRPVASDF
SATGMKQLSRALIRPVASDF

SEQ ID NO: 17066 - protein, 20 aa, synthetic construct
  source 1..20: note = Seed: SATGFKQSSKALQRPVASDF
SATGMKQLSRALKRPVASDF

SEQ ID NO: 17067 - protein, 20 aa, synthetic construct
  source 1..20: note = Seed: SATGFKQSSKALQRPVASDF
SATGMKQLSRALLRPVASDF

SEQ ID NO: 17068 - protein, 20 aa, synthetic construct
  source 1..20: note = Seed: SATGFKQSSKALQRPVASDF
SATGMKQLSRALMRPVASDF

SEQ ID NO: 17069 - protein, 20 aa, synthetic construct
  source 1..20: note = Seed: SATGFKQSSKALQRPVASDF
SATGMKQLSRALNRPVASDF

SEQ ID NO: 17070 - protein, 20 aa, synthetic construct
  source 1..20: note = Seed: SATGFKQSSKALQRPVASDF
SATGMKQLSRALPRPVASDF

SEQ ID NO: 17071 - protein, 20 aa, synthetic construct
  source 1..20: note = Seed: SATGFKQSSKALQRPVASDF
SATGMKQLSRALQRPVASDF

SEQ ID NO: 17072 - protein, 20 aa, synthetic construct
  source 1..20: note = Seed: SATGFKQSSKALQRPVASDF
SATGMKQLSRALRRPVASDF

SEQ ID NO: 17073 - protein, 20 aa, synthetic construct
  source 1..20: note = Seed: SATGFKQSSKALQRPVASDF
SATGMKQLSRALSRPVASDF

SEQ ID NO: 17074 - protein, 20 aa, synthetic construct
  source 1..20: note = Seed: SATGFKQSSKALQRPVASDF
SATGMKQLSRALTRPVASDF

SEQ ID NO: 17075 - protein, 20 aa, synthetic construct
  source 1..20: note = Seed: SATGFKQSSKALQRPVASDF
SATGMKQLSRALVRPVASDF

SEQ ID NO: 17076 - protein, 20 aa, synthetic construct
  source 1..20: note = Seed: SATGFKQSSKALQRPVASDF
SATGMKQLSRALYRPVASDF

SEQ ID NO: 17077 - protein, 20 aa, synthetic construct
  source 1..20: note = Seed: SATGFKQSSKALQRPVASDF
SATGMKQLSSALARPVASDF

SEQ ID NO: 17078 - protein, 20 aa, synthetic construct
  source 1..20: note = Seed: SATGFKQSSKALQRPVASDF
SATGMKQLSSALCRPVASDF

SEQ ID NO: 17079 - protein, 20 aa, synthetic construct
  source 1..20: note = Seed: SATGFKQSSKALQRPVASDF
SATGMKQLSSALFRPVASDF

SEQ ID NO: 17080 - protein, 20 aa, synthetic construct
  source 1..20: note = Seed: SATGFKQSSKALQRPVASDF
SATGMKQLSSALGRPVASDF

SEQ ID NO: 17081 - protein, 20 aa, synthetic construct
  source 1..20: note = Seed: SATGFKQSSKALQRPVASDF
SATGMKQLSSALHRPVASDF

SEQ ID NO: 17082 - protein, 20 aa, synthetic construct
  source 1..20: note = Seed: SATGFKQSSKALQRPVASDF
SATGMKQLSSALIRPVASDF

SEQ ID NO: 17083 - protein, 20 aa, synthetic construct
  source 1..20: note = Seed: SATGFKQSSKALQRPVASDF
SATGMKQLSSALLRPVASDF

SEQ ID NO: 17084 - protein, 20 aa, synthetic construct
  source 1..20: note = Seed: SATGFKQSSKALQRPVASDF
SATGMKQLSSALMRPVASDF

SEQ ID NO: 17085 - protein, 20 aa, synthetic construct
  source 1..20: note = Seed: SATGFKQSSKALQRPVASDF
SATGMKQLSSALNRPVASDF

SEQ ID NO: 17086 - protein, 20 aa, synthetic construct
  source 1..20: note = Seed: SATGFKQSSKALQRPVASDF
SATGMKQLSSALSRPVASDF

SEQ ID NO: 17087 - protein, 20 aa, synthetic construct
  source 1..20: note = Seed: SATGFKQSSKALQRPVASDF
SATGMKQLSSALTRPVASDF

SEQ ID NO: 17088 - protein, 20 aa, synthetic construct
  source 1..20: note = Seed: SATGFKQSSKALQRPVASDF
SATGMKQLSSALVRPVASDF

SEQ ID NO: 17089 - protein, 20 aa, synthetic construct
  source 1..20: note = Seed: SATGFKQSSKALQRPVASDF
SATGMKQLSTALARPVASDF

SEQ ID NO: 17090 - protein, 20 aa, synthetic construct
  source 1..20: note = Seed: SATGFKQSSKALQRPVASDF
SATGMKQLSTALGRPVASDF

SEQ ID NO: 17091 - protein, 20 aa, synthetic construct
  source 1..20: note = Seed: SATGFKQSSKALQRPVASDF
SATGMKQLSTALHRPVASDF

SEQ ID NO: 17092 - protein, 20 aa, synthetic construct
  source 1..20: note = Seed: SATGFKQSSKALQRPVASDF
SATGMKQLSTALIRPVASDF

SEQ ID NO: 17093 - protein, 20 aa, synthetic construct
  source 1..20: note = Seed: SATGFKQSSKALQRPVASDF
SATGMKQLSTALLRPVASDF

SEQ ID NO: 17094 - protein, 20 aa, synthetic construct
  source 1..20: note = Seed: SATGFKQSSKALQRPVASDF
SATGMKQLSTALMRPVASDF

SEQ ID NO: 17095 - protein, 20 aa, synthetic construct
  source 1..20: note = Seed: SATGFKQSSKALQRPVASDF
SATGMKQLSTALNRPVASDF

SEQ ID NO: 17096 - protein, 20 aa, synthetic construct
  source 1..20: note = Seed: SATGFKQSSKALQRPVASDF
SATGMKQLSTALPRPVASDF

SEQ ID NO: 17097 - protein, 20 aa, synthetic construct
  source 1..20: note = Seed: SATGFKQSSKALQRPVASDF
SATGMKQLSTALSRPVASDF

SEQ ID NO: 17098 - protein, 20 aa, synthetic construct
  source 1..20: note = Seed: SATGFKQSSKALQRPVASDF
SATGMKQLSTALTRPVASDF

SEQ ID NO: 17099 - protein, 20 aa, synthetic construct
  source 1..20: note = Seed: SATGFKQSSKALQRPVASDF
SATGMKQLSTALVRPVASDF

SEQ ID NO: 17100 - protein, 20 aa, synthetic construct
  source 1..20: note = Seed: SATGFKQSSKALQRPVASDF
SATGMKQLSVALARPVASDF

SEQ ID NO: 17101 - protein, 20 aa, synthetic construct
  source 1..20: note = Seed: SATGFKQSSKALQRPVASDF
SATGMKQLSVALCRPVASDF

SEQ ID NO: 17102 - protein, 20 aa, synthetic construct
  source 1..20: note = Seed: SATGFKQSSKALQRPVASDF
SATGMKQLSVALERPVASDF

SEQ ID NO: 17103 - protein, 20 aa, synthetic construct
  source 1..20: note = Seed: SATGFKQSSKALQRPVASDF
SATGMKQLSVALFRPVASDF

SEQ ID NO: 17104 - protein, 20 aa, synthetic construct
  source 1..20: note = Seed: SATGFKQSSKALQRPVASDF
SATGMKQLSVALGRPVASDF

SEQ ID NO: 17105 - protein, 20 aa, synthetic construct
  source 1..20: note = Seed: SATGFKQSSKALQRPVASDF
SATGMKQLSVALHRPVASDF

SEQ ID NO: 17106 - protein, 20 aa, synthetic construct
  source 1..20: note = Seed: SATGFKQSSKALQRPVASDF
SATGMKQLSVALIRPVASDF

SEQ ID NO: 17107 - protein, 20 aa, synthetic construct
  source 1..20: note = Seed: SATGFKQSSKALQRPVASDF
SATGMKQLSVALLRPVASDF

SEQ ID NO: 17108 - protein, 20 aa, synthetic construct
  source 1..20: note = Seed: SATGFKQSSKALQRPVASDF
SATGMKQLSVALMRPVASDF

SEQ ID NO: 17109 - protein, 20 aa, synthetic construct
  source 1..20: note = Seed: SATGFKQSSKALQRPVASDF
SATGMKQLSVALNRPVASDF

SEQ ID NO: 17110 - protein, 20 aa, synthetic construct
  source 1..20: note = Seed: SATGFKQSSKALQRPVASDF
SATGMKQLSVALQRPVASDF

SEQ ID NO: 17111 - protein, 20 aa, synthetic construct
  source 1..20: note = Seed: SATGFKQSSKALQRPVASDF
SATGMKQLSVALSRPVASDF

SEQ ID NO: 17112 - protein, 20 aa, synthetic construct
  source 1..20: note = Seed: SATGFKQSSKALQRPVASDF
SATGMKQLSVALTRPVASDF

SEQ ID NO: 17113 - protein, 20 aa, synthetic construct
  source 1..20: note = Seed: SATGFKQSSKALQRPVASDF
SATGMKQLSVALVRPVASDF

SEQ ID NO: 17114 - protein, 20 aa, synthetic construct
  source 1..20: note = Seed: SATGFKQSSKALQRPVASDF
SATGMKQMSAALARPVASDF

SEQ ID NO: 17115 - protein, 20 aa, synthetic construct
  source 1..20: note = Seed: SATGFKQSSKALQRPVASDF
SATGMKQMSAALCRPVASDF

SEQ ID NO: 17116 - protein, 20 aa, synthetic construct
  source 1..20: note = Seed: SATGFKQSSKALQRPVASDF
SATGMKQMSAALDRPVASDF

SEQ ID NO: 17117 - protein, 20 aa, synthetic construct
  source 1..20: note = Seed: SATGFKQSSKALQRPVASDF
SATGMKQMSAALERPVASDF

SEQ ID NO: 17118 - protein, 20 aa, synthetic construct
  source 1..20: note = Seed: SATGFKQSSKALQRPVASDF
SATGMKQMSAALFRPVASDF

SEQ ID NO: 17119 - protein, 20 aa, synthetic construct
  source 1..20: note = Seed: SATGFKQSSKALQRPVASDF
SATGMKQMSAALGRPVASDF

SEQ ID NO: 17120 - protein, 20 aa, synthetic construct
  source 1..20: note = Seed: SATGFKQSSKALQRPVASDF
SATGMKQMSAALHRPVASDF

SEQ ID NO: 17121 - protein, 20 aa, synthetic construct
  source 1..20: note = Seed: SATGFKQSSKALQRPVASDF
SATGMKQMSAALIRPVASDF

SEQ ID NO: 17122 - protein, 20 aa, synthetic construct
  source 1..20: note = Seed: SATGFKQSSKALQRPVASDF
SATGMKQMSAALLRPVASDF

SEQ ID NO: 17123 - protein, 20 aa, synthetic construct
  source 1..20: note = Seed: SATGFKQSSKALQRPVASDF
SATGMKQMSAALMRPVASDF

SEQ ID NO: 17124 - protein, 20 aa, synthetic construct
  source 1..20: note = Seed: SATGFKQSSKALQRPVASDF
SATGMKQMSAALNRPVASDF

SEQ ID NO: 17125 - protein, 20 aa, synthetic construct
  source 1..20: note = Seed: SATGFKQSSKALQRPVASDF
SATGMKQMSAALPRPVASDF

SEQ ID NO: 17126 - protein, 20 aa, synthetic construct
  source 1..20: note = Seed: SATGFKQSSKALQRPVASDF
SATGMKQMSAALQRPVASDF

SEQ ID NO: 17127 - protein, 20 aa, synthetic construct
  source 1..20: note = Seed: SATGFKQSSKALQRPVASDF
SATGMKQMSAALSRPVASDF

SEQ ID NO: 17128 - protein, 20 aa, synthetic construct
  source 1..20: note = Seed: SATGFKQSSKALQRPVASDF
SATGMKQMSAALTRPVASDF

SEQ ID NO: 17129 - protein, 20 aa, synthetic construct
  source 1..20: note = Seed: SATGFKQSSKALQRPVASDF
SATGMKQMSAALVRPVASDF

SEQ ID NO: 17130 - protein, 20 aa, synthetic construct
  source 1..20: note = Seed: SATGFKQSSKALQRPVASDF
SATGMKQMSAALYRPVASDF

SEQ ID NO: 17131 - protein, 20 aa, synthetic construct
  source 1..20: note = Seed: SATGFKQSSKALQRPVASDF
SATGMKQMSCALARPVASDF

SEQ ID NO: 17132 - protein, 20 aa, synthetic construct
  source 1..20: note = Seed: SATGFKQSSKALQRPVASDF
SATGMKQMSCALVRPVASDF

SEQ ID NO: 17133 - protein, 20 aa, synthetic construct
  source 1..20: note = Seed: SATGFKQSSKALQRPVASDF
SATGMKQMSFALARPVASDF

SEQ ID NO: 17134 - protein, 20 aa, synthetic construct
  source 1..20: note = Seed: SATGFKQSSKALQRPVASDF
SATGMKQMSFALVRPVASDF

SEQ ID NO: 17135 - protein, 20 aa, synthetic construct
  source 1..20: note = Seed: SATGFKQSSKALQRPVASDF
SATGMKQMSGALARPVASDF

SEQ ID NO: 17136 - protein, 20 aa, synthetic construct
  source 1..20: note = Seed: SATGFKQSSKALQRPVASDF
SATGMKQMSGALCRPVASDF

SEQ ID NO: 17137 - protein, 20 aa, synthetic construct
  source 1..20: note = Seed: SATGFKQSSKALQRPVASDF
SATGMKQMSGALFRPVASDF

SEQ ID NO: 17138 - protein, 20 aa, synthetic construct
  source 1..20: note = Seed: SATGFKQSSKALQRPVASDF
SATGMKQMSGALGRPVASDF

SEQ ID NO: 17139 - protein, 20 aa, synthetic construct
  source 1..20: note = Seed: SATGFKQSSKALQRPVASDF
SATGMKQMSGALIRPVASDF

SEQ ID NO: 17140 - protein, 20 aa, synthetic construct
  source 1..20: note = Seed: SATGFKQSSKALQRPVASDF
SATGMKQMSGALLRPVASDF

SEQ ID NO: 17141 - protein, 20 aa, synthetic construct
  source 1..20: note = Seed: SATGFKQSSKALQRPVASDF
SATGMKQMSGALMRPVASDF

SEQ ID NO: 17142 - protein, 20 aa, synthetic construct
  source 1..20: note = Seed: SATGFKQSSKALQRPVASDF
SATGMKQMSGALNRPVASDF

SEQ ID NO: 17143 - protein, 20 aa, synthetic construct
  source 1..20: note = Seed: SATGFKQSSKALQRPVASDF
SATGMKQMSGALSRPVASDF

SEQ ID NO: 17144 - protein, 20 aa, synthetic construct
  source 1..20: note = Seed: SATGFKQSSKALQRPVASDF
SATGMKQMSGALTRPVASDF

SEQ ID NO: 17145 - protein, 20 aa, synthetic construct
  source 1..20: note = Seed: SATGFKQSSKALQRPVASDF
SATGMKQMSGALVRPVASDF

SEQ ID NO: 17146 - protein, 20 aa, synthetic construct
  source 1..20: note = Seed: SATGFKQSSKALQRPVASDF
SATGMKQMSHALARPVASDF

SEQ ID NO: 17147 - protein, 20 aa, synthetic construct
  source 1..20: note = Seed: SATGFKQSSKALQRPVASDF
SATGMKQMSHALIRPVASDF

SEQ ID NO: 17148 - protein, 20 aa, synthetic construct
  source 1..20: note = Seed: SATGFKQSSKALQRPVASDF
SATGMKQMSHALKRPVASDF

SEQ ID NO: 17149 - protein, 20 aa, synthetic construct
  source 1..20: note = Seed: SATGFKQSSKALQRPVASDF
SATGMKQMSHALLRPVASDF

SEQ ID NO: 17150 - protein, 20 aa, synthetic construct
  source 1..20: note = Seed: SATGFKQSSKALQRPVASDF
SATGMKQMSHALMRPVASDF

SEQ ID NO: 17151 - protein, 20 aa, synthetic construct
  source 1..20: note = Seed: SATGFKQSSKALQRPVASDF
SATGMKQMSHALRRPVASDF

SEQ ID NO: 17152 - protein, 20 aa, synthetic construct
  source 1..20: note = Seed: SATGFKQSSKALQRPVASDF
SATGMKQMSHALSRPVASDF

SEQ ID NO: 17153 - protein, 20 aa, synthetic construct
  source 1..20: note = Seed: SATGFKQSSKALQRPVASDF
SATGMKQMSHALVRPVASDF

SEQ ID NO: 17154 - protein, 20 aa, synthetic construct
  source 1..20: note = Seed: SATGFKQSSKALQRPVASDF
SATGMKQMSIALARPVASDF

SEQ ID NO: 17155 - protein, 20 aa, synthetic construct
  source 1..20: note = Seed: SATGFKQSSKALQRPVASDF
SATGMKQMSIALCRPVASDF

SEQ ID NO: 17156 - protein, 20 aa, synthetic construct
  source 1..20: note = Seed: SATGFKQSSKALQRPVASDF
SATGMKQMSIALGRPVASDF

SEQ ID NO: 17157 - protein, 20 aa, synthetic construct
  source 1..20: note = Seed: SATGFKQSSKALQRPVASDF
SATGMKQMSIALHRPVASDF

SEQ ID NO: 17158 - protein, 20 aa, synthetic construct
  source 1..20: note = Seed: SATGFKQSSKALQRPVASDF
SATGMKQMSIALKRPVASDF

SEQ ID NO: 17159 - protein, 20 aa, synthetic construct
  source 1..20: note = Seed: SATGFKQSSKALQRPVASDF
SATGMKQMSIALNRPVASDF

SEQ ID NO: 17160 - protein, 20 aa, synthetic construct
  source 1..20: note = Seed: SATGFKQSSKALQRPVASDF
SATGMKQMSIALRRPVASDF

SEQ ID NO: 17161 - protein, 20 aa, synthetic construct
  source 1..20: note = Seed: SATGFKQSSKALQRPVASDF
SATGMKQMSIALSRPVASDF

SEQ ID NO: 17162 - protein, 20 aa, synthetic construct
  source 1..20: note = Seed: SATGFKQSSKALQRPVASDF
SATGMKQMSIALTRPVASDF

SEQ ID NO: 17163 - protein, 20 aa, synthetic construct
  source 1..20: note = Seed: SATGFKQSSKALQRPVASDF
SATGMKQMSIALVRPVASDF

SEQ ID NO: 17164 - protein, 20 aa, synthetic construct
  source 1..20: note = Seed: SATGFKQSSKALQRPVASDF
SATGMKQMSIALYRPVASDF

SEQ ID NO: 17165 - protein, 20 aa, synthetic construct
  source 1..20: note = Seed: SATGFKQSSKALQRPVASDF
SATGMKQMSKALARPVASDF

SEQ ID NO: 17166 - protein, 20 aa, synthetic construct
  source 1..20: note = Seed: SATGFKQSSKALQRPVASDF
SATGMKQMSKALFRPVASDF

SEQ ID NO: 17167 - protein, 20 aa, synthetic construct
  source 1..20: note = Seed: SATGFKQSSKALQRPVASDF
SATGMKQMSKALGRPVASDF

SEQ ID NO: 17168 - protein, 20 aa, synthetic construct
  source 1..20: note = Seed: SATGFKQSSKALQRPVASDF
SATGMKQMSKALHRPVASDF

SEQ ID NO: 17169 - protein, 20 aa, synthetic construct
  source 1..20: note = Seed: SATGFKQSSKALQRPVASDF
SATGMKQMSKALIRPVASDF

SEQ ID NO: 17170 - protein, 20 aa, synthetic construct
  source 1..20: note = Seed: SATGFKQSSKALQRPVASDF
SATGMKQMSKALKRPVASDF

SEQ ID NO: 17171 - protein, 20 aa, synthetic construct
  source 1..20: note = Seed: SATGFKQSSKALQRPVASDF
SATGMKQMSKALLRPVASDF

SEQ ID NO: 17172 - protein, 20 aa, synthetic construct
  source 1..20: note = Seed: SATGFKQSSKALQRPVASDF
SATGMKQMSKALMRPVASDF

SEQ ID NO: 17173 - protein, 20 aa, synthetic construct
  source 1..20: note = Seed: SATGFKQSSKALQRPVASDF
SATGMKQMSKALNRPVASDF

SEQ ID NO: 17174 - protein, 20 aa, synthetic construct
  source 1..20: note = Seed: SATGFKQSSKALQRPVASDF
SATGMKQMSKALPRPVASDF

SEQ ID NO: 17175 - protein, 20 aa, synthetic construct
  source 1..20: note = Seed: SATGFKQSSKALQRPVASDF
SATGMKQMSKALQRPVASDF

SEQ ID NO: 17176 - protein, 20 aa, synthetic construct
  source 1..20: note = Seed: SATGFKQSSKALQRPVASDF
SATGMKQMSKALRRPVASDF

SEQ ID NO: 17177 - protein, 20 aa, synthetic construct
  source 1..20: note = Seed: SATGFKQSSKALQRPVASDF
SATGMKQMSKALSRPVASDF

SEQ ID NO: 17178 - protein, 20 aa, synthetic construct
  source 1..20: note = Seed: SATGFKQSSKALQRPVASDF
SATGMKQMSKALTRPVASDF

SEQ ID NO: 17179 - protein, 20 aa, synthetic construct
  source 1..20: note = Seed: SATGFKQSSKALQRPVASDF
SATGMKQMSKALVRPVASDF

SEQ ID NO: 17180 - protein, 20 aa, synthetic construct
  source 1..20: note = Seed: SATGFKQSSKALQRPVASDF
SATGMKQMSKALYRPVASDF

SEQ ID NO: 17181 - protein, 20 aa, synthetic construct
  source 1..20: note = Seed: SATGFKQSSKALQRPVASDF
SATGMKQMSLALARPVASDF

SEQ ID NO: 17182 - protein, 20 aa, synthetic construct
  source 1..20: note = Seed: SATGFKQSSKALQRPVASDF
SATGMKQMSLALCRPVASDF

SEQ ID NO: 17183 - protein, 20 aa, synthetic construct
  source 1..20: note = Seed: SATGFKQSSKALQRPVASDF
SATGMKQMSLALGRPVASDF

SEQ ID NO: 17184 - protein, 20 aa, synthetic construct
  source 1..20: note = Seed: SATGFKQSSKALQRPVASDF
SATGMKQMSLALHRPVASDF

SEQ ID NO: 17185 - protein, 20 aa, synthetic construct
  source 1..20: note = Seed: SATGFKQSSKALQRPVASDF
SATGMKQMSLALIRPVASDF

SEQ ID NO: 17186 - protein, 20 aa, synthetic construct
  source 1..20: note = Seed: SATGFKQSSKALQRPVASDF
SATGMKQMSLALMRPVASDF

SEQ ID NO: 17187 - protein, 20 aa, synthetic construct
  source 1..20: note = Seed: SATGFKQSSKALQRPVASDF
SATGMKQMSLALNRPVASDF

SEQ ID NO: 17188 - protein, 20 aa, synthetic construct
  source 1..20: note = Seed: SATGFKQSSKALQRPVASDF
SATGMKQMSLALSRPVASDF

SEQ ID NO: 17189 - protein, 20 aa, synthetic construct
  source 1..20: note = Seed: SATGFKQSSKALQRPVASDF
SATGMKQMSLALTRPVASDF

SEQ ID NO: 17190 - protein, 20 aa, synthetic construct
  source 1..20: note = Seed: SATGFKQSSKALQRPVASDF
SATGMKQMSLALVRPVASDF

SEQ ID NO: 17191 - protein, 20 aa, synthetic construct
  source 1..20: note = Seed: SATGFKQSSKALQRPVASDF
SATGMKQMSMALCRPVASDF

SEQ ID NO: 17192 - protein, 20 aa, synthetic construct
  source 1..20: note = Seed: SATGFKQSSKALQRPVASDF
SATGMKQMSMALGRPVASDF

SEQ ID NO: 17193 - protein, 20 aa, synthetic construct
  source 1..20: note = Seed: SATGFKQSSKALQRPVASDF
SATGMKQMSMALHRPVASDF

SEQ ID NO: 17194 - protein, 20 aa, synthetic construct
  source 1..20: note = Seed: SATGFKQSSKALQRPVASDF
SATGMKQMSMALNRPVASDF

SEQ ID NO: 17195 - protein, 20 aa, synthetic construct
  source 1..20: note = Seed: SATGFKQSSKALQRPVASDF
SATGMKQMSMALSRPVASDF

SEQ ID NO: 17196 - protein, 20 aa, synthetic construct
  source 1..20: note = Seed: SATGFKQSSKALQRPVASDF
SATGMKQMSNALARPVASDF

SEQ ID NO: 17197 - protein, 20 aa, synthetic construct
  source 1..20: note = Seed: SATGFKQSSKALQRPVASDF
SATGMKQMSNALGRPVASDF

SEQ ID NO: 17198 - protein, 20 aa, synthetic construct
  source 1..20: note = Seed: SATGFKQSSKALQRPVASDF
SATGMKQMSNALIRPVASDF

SEQ ID NO: 17199 - protein, 20 aa, synthetic construct
  source 1..20: note = Seed: SATGFKQSSKALQRPVASDF
SATGMKQMSNALLRPVASDF

SEQ ID NO: 17200 - protein, 20 aa, synthetic construct
  source 1..20: note = Seed: SATGFKQSSKALQRPVASDF
SATGMKQMSNALMRPVASDF

SEQ ID NO: 17201 - protein, 20 aa, synthetic construct
  source 1..20: note = Seed: SATGFKQSSKALQRPVASDF
SATGMKQMSNALNRPVASDF

SEQ ID NO: 17202 - protein, 20 aa, synthetic construct
  source 1..20: note = Seed: SATGFKQSSKALQRPVASDF
SATGMKQMSNALSRPVASDF

SEQ ID NO: 17203 - protein, 20 aa, synthetic construct
  source 1..20: note = Seed: SATGFKQSSKALQRPVASDF
SATGMKQMSNALTRPVASDF

SEQ ID NO: 17204 - protein, 20 aa, synthetic construct
  source 1..20: note = Seed: SATGFKQSSKALQRPVASDF
SATGMKQMSNALVRPVASDF

SEQ ID NO: 17205 - protein, 20 aa, synthetic construct
  source 1..20: note = Seed: SATGFKQSSKALQRPVASDF
SATGMKQMSPALARPVASDF

SEQ ID NO: 17206 - protein, 20 aa, synthetic construct
  source 1..20: note = Seed: SATGFKQSSKALQRPVASDF
SATGMKQMSPALCRPVASDF

SEQ ID NO: 17207 - protein, 20 aa, synthetic construct
  source 1..20: note = Seed: SATGFKQSSKALQRPVASDF
SATGMKQMSPALGRPVASDF

SEQ ID NO: 17208 - protein, 20 aa, synthetic construct
  source 1..20: note = Seed: SATGFKQSSKALQRPVASDF
SATGMKQMSPALHRPVASDF

SEQ ID NO: 17209 - protein, 20 aa, synthetic construct
  source 1..20: note = Seed: SATGFKQSSKALQRPVASDF
SATGMKQMSPALIRPVASDF

SEQ ID NO: 17210 - protein, 20 aa, synthetic construct
  source 1..20: note = Seed: SATGFKQSSKALQRPVASDF
SATGMKQMSPALLRPVASDF

SEQ ID NO: 17211 - protein, 20 aa, synthetic construct
  source 1..20: note = Seed: SATGFKQSSKALQRPVASDF
SATGMKQMSPALMRPVASDF

SEQ ID NO: 17212 - protein, 20 aa, synthetic construct
  source 1..20: note = Seed: SATGFKQSSKALQRPVASDF
SATGMKQMSPALNRPVASDF

SEQ ID NO: 17213 - protein, 20 aa, synthetic construct
  source 1..20: note = Seed: SATGFKQSSKALQRPVASDF
SATGMKQMSPALPRPVASDF

SEQ ID NO: 17214 - protein, 20 aa, synthetic construct
  source 1..20: note = Seed: SATGFKQSSKALQRPVASDF
SATGMKQMSPALQRPVASDF

SEQ ID NO: 17215 - protein, 20 aa, synthetic construct
  source 1..20: note = Seed: SATGFKQSSKALQRPVASDF
SATGMKQMSPALSRPVASDF

SEQ ID NO: 17216 - protein, 20 aa, synthetic construct
  source 1..20: note = Seed: SATGFKQSSKALQRPVASDF
SATGMKQMSPALTRPVASDF

SEQ ID NO: 17217 - protein, 20 aa, synthetic construct
  source 1..20: note = Seed: SATGFKQSSKALQRPVASDF
SATGMKQMSPALVRPVASDF

SEQ ID NO: 17218 - protein, 20 aa, synthetic construct
  source 1..20: note = Seed: SATGFKQSSKALQRPVASDF
SATGMKQMSQALARPVASDF

SEQ ID NO: 17219 - protein, 20 aa, synthetic construct
  source 1..20: note = Seed: SATGFKQSSKALQRPVASDF
SATGMKQMSQALSRPVASDF

SEQ ID NO: 17220 - protein, 20 aa, synthetic construct
  source 1..20: note = Seed: SATGFKQSSKALQRPVASDF
SATGMKQMSRALARPVASDF

SEQ ID NO: 17221 - protein, 20 aa, synthetic construct
  source 1..20: note = Seed: SATGFKQSSKALQRPVASDF
SATGMKQMSRALCRPVASDF

SEQ ID NO: 17222 - protein, 20 aa, synthetic construct
  source 1..20: note = Seed: SATGFKQSSKALQRPVASDF
SATGMKQMSRALFRPVASDF

SEQ ID NO: 17223 - protein, 20 aa, synthetic construct
  source 1..20: note = Seed: SATGFKQSSKALQRPVASDF
SATGMKQMSRALGRPVASDF

SEQ ID NO: 17224 - protein, 20 aa, synthetic construct
  source 1..20: note = Seed: SATGFKQSSKALQRPVASDF
SATGMKQMSRALHRPVASDF

SEQ ID NO: 17225 - protein, 20 aa, synthetic construct
  source 1..20: note = Seed: SATGFKQSSKALQRPVASDF
SATGMKQMSRALIRPVASDF

SEQ ID NO: 17226 - protein, 20 aa, synthetic construct
  source 1..20: note = Seed: SATGFKQSSKALQRPVASDF
SATGMKQMSRALKRPVASDF

SEQ ID NO: 17227 - protein, 20 aa, synthetic construct
  source 1..20: note = Seed: SATGFKQSSKALQRPVASDF
SATGMKQMSRALLRPVASDF

SEQ ID NO: 17228 - protein, 20 aa, synthetic construct
  source 1..20: note = Seed: SATGFKQSSKALQRPVASDF
SATGMKQMSRALMRPVASDF

SEQ ID NO: 17229 - protein, 20 aa, synthetic construct
  source 1..20: note = Seed: SATGFKQSSKALQRPVASDF
SATGMKQMSRALNRPVASDF

SEQ ID NO: 17230 - protein, 20 aa, synthetic construct
  source 1..20: note = Seed: SATGFKQSSKALQRPVASDF
SATGMKQMSRALPRPVASDF

SEQ ID NO: 17231 - protein, 20 aa, synthetic construct
  source 1..20: note = Seed: SATGFKQSSKALQRPVASDF
SATGMKQMSRALQRPVASDF

SEQ ID NO: 17232 - protein, 20 aa, synthetic construct
  source 1..20: note = Seed: SATGFKQSSKALQRPVASDF
SATGMKQMSRALRRPVASDF

SEQ ID NO: 17233 - protein, 20 aa, synthetic construct
  source 1..20: note = Seed: SATGFKQSSKALQRPVASDF
SATGMKQMSRALSRPVASDF

SEQ ID NO: 17234 - protein, 20 aa, synthetic construct
  source 1..20: note = Seed: SATGFKQSSKALQRPVASDF
SATGMKQMSRALTRPVASDF

SEQ ID NO: 17235 - protein, 20 aa, synthetic construct
  source 1..20: note = Seed: SATGFKQSSKALQRPVASDF
SATGMKQMSRALVRPVASDF

SEQ ID NO: 17236 - protein, 20 aa, synthetic construct
  source 1..20: note = Seed: SATGFKQSSKALQRPVASDF
SATGMKQMSRALWRPVASDF

SEQ ID NO: 17237 - protein, 20 aa, synthetic construct
  source 1..20: note = Seed: SATGFKQSSKALQRPVASDF
SATGMKQMSRALYRPVASDF

SEQ ID NO: 17238 - protein, 20 aa, synthetic construct
  source 1..20: note = Seed: SATGFKQSSKALQRPVASDF
SATGMKQMSSALARPVASDF

SEQ ID NO: 17239 - protein, 20 aa, synthetic construct
  source 1..20: note = Seed: SATGFKQSSKALQRPVASDF
SATGMKQMSSALCRPVASDF

SEQ ID NO: 17240 - protein, 20 aa, synthetic construct
  source 1..20: note = Seed: SATGFKQSSKALQRPVASDF
SATGMKQMSSALFRPVASDF

SEQ ID NO: 17241 - protein, 20 aa, synthetic construct
  source 1..20: note = Seed: SATGFKQSSKALQRPVASDF
SATGMKQMSSALGRPVASDF

SEQ ID NO: 17242 - protein, 20 aa, synthetic construct
  source 1..20: note = Seed: SATGFKQSSKALQRPVASDF
SATGMKQMSSALHRPVASDF

SEQ ID NO: 17243 - protein, 20 aa, synthetic construct
  source 1..20: note = Seed: SATGFKQSSKALQRPVASDF
SATGMKQMSSALIRPVASDF

SEQ ID NO: 17244 - protein, 20 aa, synthetic construct
  source 1..20: note = Seed: SATGFKQSSKALQRPVASDF
SATGMKQMSSALLRPVASDF

SEQ ID NO: 17245 - protein, 20 aa, synthetic construct
  source 1..20: note = Seed: SATGFKQSSKALQRPVASDF
SATGMKQMSSALMRPVASDF

SEQ ID NO: 17246 - protein, 20 aa, synthetic construct
  source 1..20: note = Seed: SATGFKQSSKALQRPVASDF
SATGMKQMSSALNRPVASDF

SEQ ID NO: 17247 - protein, 20 aa, synthetic construct
  source 1..20: note = Seed: SATGFKQSSKALQRPVASDF
SATGMKQMSSALQRPVASDF

SEQ ID NO: 17248 - protein, 20 aa, synthetic construct
  source 1..20: note = Seed: SATGFKQSSKALQRPVASDF
SATGMKQMSSALSRPVASDF

SEQ ID NO: 17249 - protein, 20 aa, synthetic construct
  source 1..20: note = Seed: SATGFKQSSKALQRPVASDF
SATGMKQMSSALTRPVASDF

SEQ ID NO: 17250 - protein, 20 aa, synthetic construct
  source 1..20: note = Seed: SATGFKQSSKALQRPVASDF
SATGMKQMSSALVRPVASDF

SEQ ID NO: 17251 - protein, 20 aa, synthetic construct
  source 1..20: note = Seed: SATGFKQSSKALQRPVASDF
SATGMKQMSTALARPVASDF

SEQ ID NO: 17252 - protein, 20 aa, synthetic construct
  source 1..20: note = Seed: SATGFKQSSKALQRPVASDF
SATGMKQMSTALGRPVASDF

SEQ ID NO: 17253 - protein, 20 aa, synthetic construct
  source 1..20: note = Seed: SATGFKQSSKALQRPVASDF
SATGMKQMSTALHRPVASDF

SEQ ID NO: 17254 - protein, 20 aa, synthetic construct
  source 1..20: note = Seed: SATGFKQSSKALQRPVASDF
SATGMKQMSTALIRPVASDF

SEQ ID NO: 17255 - protein, 20 aa, synthetic construct
  source 1..20: note = Seed: SATGFKQSSKALQRPVASDF
SATGMKQMSTALLRPVASDF

SEQ ID NO: 17256 - protein, 20 aa, synthetic construct
  source 1..20: note = Seed: SATGFKQSSKALQRPVASDF
SATGMKQMSTALMRPVASDF

SEQ ID NO: 17257 - protein, 20 aa, synthetic construct
  source 1..20: note = Seed: SATGFKQSSKALQRPVASDF
SATGMKQMSTALNRPVASDF

SEQ ID NO: 17258 - protein, 20 aa, synthetic construct
  source 1..20: note = Seed: SATGFKQSSKALQRPVASDF
SATGMKQMSTALPRPVASDF

SEQ ID NO: 17259 - protein, 20 aa, synthetic construct
  source 1..20: note = Seed: SATGFKQSSKALQRPVASDF
SATGMKQMSTALQRPVASDF

SEQ ID NO: 17260 - protein, 20 aa, synthetic construct
  source 1..20: note = Seed: SATGFKQSSKALQRPVASDF
SATGMKQMSTALRRPVASDF

SEQ ID NO: 17261 - protein, 20 aa, synthetic construct
  source 1..20: note = Seed: SATGFKQSSKALQRPVASDF
SATGMKQMSTALSRPVASDF

SEQ ID NO: 17262 - protein, 20 aa, synthetic construct
  source 1..20: note = Seed: SATGFKQSSKALQRPVASDF
SATGMKQMSTALTRPVASDF

SEQ ID NO: 17263 - protein, 20 aa, synthetic construct
  source 1..20: note = Seed: SATGFKQSSKALQRPVASDF
SATGMKQMSTALVRPVASDF

SEQ ID NO: 17264 - protein, 20 aa, synthetic construct
  source 1..20: note = Seed: SATGFKQSSKALQRPVASDF
SATGMKQMSVALARPVASDF

SEQ ID NO: 17265 - protein, 20 aa, synthetic construct
  source 1..20: note = Seed: SATGFKQSSKALQRPVASDF
SATGMKQMSVALCRPVASDF

SEQ ID NO: 17266 - protein, 20 aa, synthetic construct
  source 1..20: note = Seed: SATGFKQSSKALQRPVASDF
SATGMKQMSVALERPVASDF

SEQ ID NO: 17267 - protein, 20 aa, synthetic construct
  source 1..20: note = Seed: SATGFKQSSKALQRPVASDF
SATGMKQMSVALFRPVASDF

SEQ ID NO: 17268 - protein, 20 aa, synthetic construct
  source 1..20: note = Seed: SATGFKQSSKALQRPVASDF
SATGMKQMSVALGRPVASDF

SEQ ID NO: 17269 - protein, 20 aa, synthetic construct
  source 1..20: note = Seed: SATGFKQSSKALQRPVASDF
SATGMKQMSVALHRPVASDF

SEQ ID NO: 17270 - protein, 20 aa, synthetic construct
  source 1..20: note = Seed: SATGFKQSSKALQRPVASDF
SATGMKQMSVALIRPVASDF

SEQ ID NO: 17271 - protein, 20 aa, synthetic construct
  source 1..20: note = Seed: SATGFKQSSKALQRPVASDF
SATGMKQMSVALLRPVASDF

SEQ ID NO: 17272 - protein, 20 aa, synthetic construct
  source 1..20: note = Seed: SATGFKQSSKALQRPVASDF
SATGMKQMSVALMRPVASDF

SEQ ID NO: 17273 - protein, 20 aa, synthetic construct
  source 1..20: note = Seed: SATGFKQSSKALQRPVASDF
SATGMKQMSVALNRPVASDF

SEQ ID NO: 17274 - protein, 20 aa, synthetic construct
  source 1..20: note = Seed: SATGFKQSSKALQRPVASDF
SATGMKQMSVALPRPVASDF

SEQ ID NO: 17275 - protein, 20 aa, synthetic construct
  source 1..20: note = Seed: SATGFKQSSKALQRPVASDF
SATGMKQMSVALQRPVASDF

SEQ ID NO: 17276 - protein, 20 aa, synthetic construct
  source 1..20: note = Seed: SATGFKQSSKALQRPVASDF
SATGMKQMSVALRRPVASDF

SEQ ID NO: 17277 - protein, 20 aa, synthetic construct
  source 1..20: note = Seed: SATGFKQSSKALQRPVASDF
SATGMKQMSVALSRPVASDF

SEQ ID NO: 17278 - protein, 20 aa, synthetic construct
  source 1..20: note = Seed: SATGFKQSSKALQRPVASDF
SATGMKQMSVALTRPVASDF

SEQ ID NO: 17279 - protein, 20 aa, synthetic construct
  source 1..20: note = Seed: SATGFKQSSKALQRPVASDF
SATGMKQMSVALVRPVASDF

SEQ ID NO: 17280 - protein, 20 aa, synthetic construct
  source 1..20: note = Seed: SATGFKQSSKALQRPVASDF
SATGMKQMSVALYRPVASDF

SEQ ID NO: 17281 - protein, 20 aa, synthetic construct
  source 1..20: note = Seed: SATGFKQSSKALQRPVASDF
SATGMKQQSAALARPVASDF

SEQ ID NO: 17282 - protein, 20 aa, synthetic construct
  source 1..20: note = Seed: SATGFKQSSKALQRPVASDF
SATGMKQQSAALIRPVASDF

SEQ ID NO: 17283 - protein, 20 aa, synthetic construct
  source 1..20: note = Seed: SATGFKQSSKALQRPVASDF
SATGMKQQSAALLRPVASDF

SEQ ID NO: 17284 - protein, 20 aa, synthetic construct
  source 1..20: note = Seed: SATGFKQSSKALQRPVASDF
SATGMKQQSAALMRPVASDF

SEQ ID NO: 17285 - protein, 20 aa, synthetic construct
  source 1..20: note = Seed: SATGFKQSSKALQRPVASDF
SATGMKQQSAALNRPVASDF

SEQ ID NO: 17286 - protein, 20 aa, synthetic construct
  source 1..20: note = Seed: SATGFKQSSKALQRPVASDF
SATGMKQQSAALSRPVASDF

SEQ ID NO: 17287 - protein, 20 aa, synthetic construct
  source 1..20: note = Seed: SATGFKQSSKALQRPVASDF
SATGMKQQSAALTRPVASDF

SEQ ID NO: 17288 - protein, 20 aa, synthetic construct
  source 1..20: note = Seed: SATGFKQSSKALQRPVASDF
SATGMKQQSAALVRPVASDF

SEQ ID NO: 17289 - protein, 20 aa, synthetic construct
  source 1..20: note = Seed: SATGFKQSSKALQRPVASDF
SATGMKQQSFALLRPVASDF

SEQ ID NO: 17290 - protein, 20 aa, synthetic construct
  source 1..20: note = Seed: SATGFKQSSKALQRPVASDF
SATGMKQQSGALARPVASDF

SEQ ID NO: 17291 - protein, 20 aa, synthetic construct
  source 1..20: note = Seed: SATGFKQSSKALQRPVASDF
SATGMKQQSGALIRPVASDF

SEQ ID NO: 17292 - protein, 20 aa, synthetic construct
  source 1..20: note = Seed: SATGFKQSSKALQRPVASDF
SATGMKQQSGALLRPVASDF

SEQ ID NO: 17293 - protein, 20 aa, synthetic construct
  source 1..20: note = Seed: SATGFKQSSKALQRPVASDF
SATGMKQQSGALVRPVASDF

SEQ ID NO: 17294 - protein, 20 aa, synthetic construct
  source 1..20: note = Seed: SATGFKQSSKALQRPVASDF
SATGMKQQSIALHRPVASDF

SEQ ID NO: 17295 - protein, 20 aa, synthetic construct
  source 1..20: note = Seed: SATGFKQSSKALQRPVASDF
SATGMKQQSIALNRPVASDF

SEQ ID NO: 17296 - protein, 20 aa, synthetic construct
  source 1..20: note = Seed: SATGFKQSSKALQRPVASDF
SATGMKQQSIALSRPVASDF

SEQ ID NO: 17297 - protein, 20 aa, synthetic construct
  source 1..20: note = Seed: SATGFKQSSKALQRPVASDF
SATGMKQQSLALNRPVASDF

SEQ ID NO: 17298 - protein, 20 aa, synthetic construct
  source 1..20: note = Seed: SATGFKQSSKALQRPVASDF
SATGMKQQSMALSRPVASDF

SEQ ID NO: 17299 - protein, 20 aa, synthetic construct
  source 1..20: note = Seed: SATGFKQSSKALQRPVASDF
SATGMKQQSPALARPVASDF

SEQ ID NO: 17300 - protein, 20 aa, synthetic construct
  source 1..20: note = Seed: SATGFKQSSKALQRPVASDF
SATGMKQQSPALIRPVASDF

SEQ ID NO: 17301 - protein, 20 aa, synthetic construct
  source 1..20: note = Seed: SATGFKQSSKALQRPVASDF
SATGMKQQSPALLRPVASDF

SEQ ID NO: 17302 - protein, 20 aa, synthetic construct
  source 1..20: note = Seed: SATGFKQSSKALQRPVASDF
SATGMKQQSPALVRPVASDF

SEQ ID NO: 17303 - protein, 20 aa, synthetic construct
  source 1..20: note = Seed: SATGFKQSSKALQRPVASDF
SATGMKQQSRALARPVASDF

SEQ ID NO: 17304 - protein, 20 aa, synthetic construct
  source 1..20: note = Seed: SATGFKQSSKALQRPVASDF
SATGMKQQSRALRRPVASDF

SEQ ID NO: 17305 - protein, 20 aa, synthetic construct
  source 1..20: note = Seed: SATGFKQSSKALQRPVASDF
SATGMKQQSRALSRPVASDF

SEQ ID NO: 17306 - protein, 20 aa, synthetic construct
  source 1..20: note = Seed: SATGFKQSSKALQRPVASDF
SATGMKQQSSALARPVASDF

SEQ ID NO: 17307 - protein, 20 aa, synthetic construct
  source 1..20: note = Seed: SATGFKQSSKALQRPVASDF
SATGMKQQSSALIRPVASDF

SEQ ID NO: 17308 - protein, 20 aa, synthetic construct
  source 1..20: note = Seed: SATGFKQSSKALQRPVASDF
SATGMKQQSSALLRPVASDF

SEQ ID NO: 17309 - protein, 20 aa, synthetic construct
  source 1..20: note = Seed: SATGFKQSSKALQRPVASDF
SATGMKQQSSALVRPVASDF

SEQ ID NO: 17310 - protein, 20 aa, synthetic construct
  source 1..20: note = Seed: SATGFKQSSKALQRPVASDF
SATGMKQQSTALARPVASDF

SEQ ID NO: 17311 - protein, 20 aa, synthetic construct
  source 1..20: note = Seed: SATGFKQSSKALQRPVASDF
SATGMKQQSVALARPVASDF

SEQ ID NO: 17312 - protein, 20 aa, synthetic construct
  source 1..20: note = Seed: SATGFKQSSKALQRPVASDF
SATGMKQQSVALIRPVASDF

SEQ ID NO: 17313 - protein, 20 aa, synthetic construct
  source 1..20: note = Seed: SATGFKQSSKALQRPVASDF
SATGMKQQSVALNRPVASDF

SEQ ID NO: 17314 - protein, 20 aa, synthetic construct
  source 1..20: note = Seed: SATGFKQSSKALQRPVASDF
SATGMKQQSVALQRPVASDF

SEQ ID NO: 17315 - protein, 20 aa, synthetic construct
  source 1..20: note = Seed: SATGFKQSSKALQRPVASDF
SATGMKQQSVALSRPVASDF

SEQ ID NO: 17316 - protein, 20 aa, synthetic construct
  source 1..20: note = Seed: SATGFKQSSKALQRPVASDF
SATGMKQQSVALTRPVASDF

SEQ ID NO: 17317 - protein, 20 aa, synthetic construct
  source 1..20: note = Seed: SATGFKQSSKALQRPVASDF
SATGMKQQSVALVRPVASDF

SEQ ID NO: 17318 - protein, 20 aa, synthetic construct
  source 1..20: note = Seed: SATGFKQSSKALQRPVASDF
SATGMKQRSRALRRPVASDF

SEQ ID NO: 17319 - protein, 20 aa, synthetic construct
  source 1..20: note = Seed: SATGFKQSSKALQRPVASDF
SATGMKQSSAALARPVASDF

SEQ ID NO: 17320 - protein, 20 aa, synthetic construct
  source 1..20: note = Seed: SATGFKQSSKALQRPVASDF
SATGMKQSSAALIRPVASDF

SEQ ID NO: 17321 - protein, 20 aa, synthetic construct
  source 1..20: note = Seed: SATGFKQSSKALQRPVASDF
SATGMKQSSAALLRPVASDF

SEQ ID NO: 17322 - protein, 20 aa, synthetic construct
  source 1..20: note = Seed: SATGFKQSSKALQRPVASDF
SATGMKQSSAALMRPVASDF

SEQ ID NO: 17323 - protein, 20 aa, synthetic construct
  source 1..20: note = Seed: SATGFKQSSKALQRPVASDF
SATGMKQSSAALNRPVASDF

SEQ ID NO: 17324 - protein, 20 aa, synthetic construct
  source 1..20: note = Seed: SATGFKQSSKALQRPVASDF
SATGMKQSSAALSRPVASDF

SEQ ID NO: 17325 - protein, 20 aa, synthetic construct
  source 1..20: note = Seed: SATGFKQSSKALQRPVASDF
SATGMKQSSAALVRPVASDF

SEQ ID NO: 17326 - protein, 20 aa, synthetic construct
  source 1..20: note = Seed: SATGFKQSSKALQRPVASDF
SATGMKQSSFALARPVASDF

SEQ ID NO: 17327 - protein, 20 aa, synthetic construct
  source 1..20: note = Seed: SATGFKQSSKALQRPVASDF
SATGMKQSSFALERPVASDF

SEQ ID NO: 17328 - protein, 20 aa, synthetic construct
  source 1..20: note = Seed: SATGFKQSSKALQRPVASDF
SATGMKQSSFALFRPVASDF

SEQ ID NO: 17329 - protein, 20 aa, synthetic construct
  source 1..20: note = Seed: SATGFKQSSKALQRPVASDF
SATGMKQSSFALIRPVASDF

SEQ ID NO: 17330 - protein, 20 aa, synthetic construct
  source 1..20: note = Seed: SATGFKQSSKALQRPVASDF
SATGMKQSSFALLRPVASDF

SEQ ID NO: 17331 - protein, 20 aa, synthetic construct
  source 1..20: note = Seed: SATGFKQSSKALQRPVASDF
SATGMKQSSFALVRPVASDF

SEQ ID NO: 17332 - protein, 20 aa, synthetic construct
  source 1..20: note = Seed: SATGFKQSSKALQRPVASDF
SATGMKQSSGALIRPVASDF

SEQ ID NO: 17333 - protein, 20 aa, synthetic construct
  source 1..20: note = Seed: SATGFKQSSKALQRPVASDF
SATGMKQSSGALLRPVASDF

SEQ ID NO: 17334 - protein, 20 aa, synthetic construct
  source 1..20: note = Seed: SATGFKQSSKALQRPVASDF
SATGMKQSSGALVRPVASDF

SEQ ID NO: 17335 - protein, 20 aa, synthetic construct
  source 1..20: note = Seed: SATGFKQSSKALQRPVASDF
SATGMKQSSRALRRPVASDF

SEQ ID NO: 17336 - protein, 20 aa, synthetic construct
  source 1..20: note = Seed: SATGFKQSSKALQRPVASDF
SATGMKQSSSALIRPVASDF

SEQ ID NO: 17337 - protein, 20 aa, synthetic construct
  source 1..20: note = Seed: SATGFKQSSKALQRPVASDF
SATGMKQSSSALVRPVASDF

SEQ ID NO: 17338 - protein, 20 aa, synthetic construct
  source 1..20: note = Seed: SATGFKQSSKALQRPVASDF
SATGMKQSSVALSRPVASDF

SEQ ID NO: 17339 - protein, 20 aa, synthetic construct
  source 1..20: note = Seed: SATGFKQSSKALQRPVASDF
SATGMKQTSAALARPVASDF

SEQ ID NO: 17340 - protein, 20 aa, synthetic construct
  source 1..20: note = Seed: SATGFKQSSKALQRPVASDF
SATGMKQTSAALIRPVASDF

SEQ ID NO: 17341 - protein, 20 aa, synthetic construct
  source 1..20: note = Seed: SATGFKQSSKALQRPVASDF
SATGMKQTSAALLRPVASDF

SEQ ID NO: 17342 - protein, 20 aa, synthetic construct
  source 1..20: note = Seed: SATGFKQSSKALQRPVASDF
SATGMKQTSAALVRPVASDF

SEQ ID NO: 17343 - protein, 20 aa, synthetic construct
  source 1..20: note = Seed: SATGFKQSSKALQRPVASDF
SATGMKQTSFALARPVASDF

SEQ ID NO: 17344 - protein, 20 aa, synthetic construct
  source 1..20: note = Seed: SATGFKQSSKALQRPVASDF
SATGMKQTSFALERPVASDF

SEQ ID NO: 17345 - protein, 20 aa, synthetic construct
  source 1..20: note = Seed: SATGFKQSSKALQRPVASDF
SATGMKQTSFALFRPVASDF

SEQ ID NO: 17346 - protein, 20 aa, synthetic construct
  source 1..20: note = Seed: SATGFKQSSKALQRPVASDF
SATGMKQTSFALIRPVASDF

SEQ ID NO: 17347 - protein, 20 aa, synthetic construct
  source 1..20: note = Seed: SATGFKQSSKALQRPVASDF
SATGMKQTSFALLRPVASDF

SEQ ID NO: 17348 - protein, 20 aa, synthetic construct
  source 1..20: note = Seed: SATGFKQSSKALQRPVASDF
SATGMKQTSFALMRPVASDF

SEQ ID NO: 17349 - protein, 20 aa, synthetic construct
  source 1..20: note = Seed: SATGFKQSSKALQRPVASDF
SATGMKQTSFALVRPVASDF

SEQ ID NO: 17350 - protein, 20 aa, synthetic construct
  source 1..20: note = Seed: SATGFKQSSKALQRPVASDF
SATGMKQTSRALRRPVASDF

SEQ ID NO: 17351 - protein, 20 aa, synthetic construct
  source 1..20: note = Seed: SATGFKQSSKALQRPVASDF
SATGMKQTSVALSRPVASDF

SEQ ID NO: 17352 - protein, 20 aa, synthetic construct
  source 1..20: note = Seed: SATGFKQSSKALQRPVASDF
SATGMKQVSAALARPVASDF

SEQ ID NO: 17353 - protein, 20 aa, synthetic construct
  source 1..20: note = Seed: SATGFKQSSKALQRPVASDF
SATGMKQVSAALIRPVASDF

SEQ ID NO: 17354 - protein, 20 aa, synthetic construct
  source 1..20: note = Seed: SATGFKQSSKALQRPVASDF
SATGMKQVSAALLRPVASDF

SEQ ID NO: 17355 - protein, 20 aa, synthetic construct
  source 1..20: note = Seed: SATGFKQSSKALQRPVASDF
SATGMKQVSAALMRPVASDF

SEQ ID NO: 17356 - protein, 20 aa, synthetic construct
  source 1..20: note = Seed: SATGFKQSSKALQRPVASDF
SATGMKQVSAALNRPVASDF

SEQ ID NO: 17357 - protein, 20 aa, synthetic construct
  source 1..20: note = Seed: SATGFKQSSKALQRPVASDF
SATGMKQVSAALSRPVASDF

SEQ ID NO: 17358 - protein, 20 aa, synthetic construct
  source 1..20: note = Seed: SATGFKQSSKALQRPVASDF
SATGMKQVSAALTRPVASDF

SEQ ID NO: 17359 - protein, 20 aa, synthetic construct
  source 1..20: note = Seed: SATGFKQSSKALQRPVASDF
SATGMKQVSAALVRPVASDF

SEQ ID NO: 17360 - protein, 20 aa, synthetic construct
  source 1..20: note = Seed: SATGFKQSSKALQRPVASDF
SATGMKQVSFALARPVASDF

SEQ ID NO: 17361 - protein, 20 aa, synthetic construct
  source 1..20: note = Seed: SATGFKQSSKALQRPVASDF
SATGMKQVSFALERPVASDF

SEQ ID NO: 17362 - protein, 20 aa, synthetic construct
  source 1..20: note = Seed: SATGFKQSSKALQRPVASDF
SATGMKQVSFALIRPVASDF

SEQ ID NO: 17363 - protein, 20 aa, synthetic construct
  source 1..20: note = Seed: SATGFKQSSKALQRPVASDF
SATGMKQVSFALMRPVASDF

SEQ ID NO: 17364 - protein, 20 aa, synthetic construct
  source 1..20: note = Seed: SATGFKQSSKALQRPVASDF
SATGMKQVSFALSRPVASDF

SEQ ID NO: 17365 - protein, 20 aa, synthetic construct
  source 1..20: note = Seed: SATGFKQSSKALQRPVASDF
SATGMKQVSFALVRPVASDF

SEQ ID NO: 17366 - protein, 20 aa, synthetic construct
  source 1..20: note = Seed: SATGFKQSSKALQRPVASDF
SATGMKQVSGALARPVASDF

SEQ ID NO: 17367 - protein, 20 aa, synthetic construct
  source 1..20: note = Seed: SATGFKQSSKALQRPVASDF
SATGMKQVSGALIRPVASDF

SEQ ID NO: 17368 - protein, 20 aa, synthetic construct
  source 1..20: note = Seed: SATGFKQSSKALQRPVASDF
SATGMKQVSGALLRPVASDF

SEQ ID NO: 17369 - protein, 20 aa, synthetic construct
  source 1..20: note = Seed: SATGFKQSSKALQRPVASDF
SATGMKQVSGALMRPVASDF

SEQ ID NO: 17370 - protein, 20 aa, synthetic construct
  source 1..20: note = Seed: SATGFKQSSKALQRPVASDF
SATGMKQVSGALTRPVASDF

SEQ ID NO: 17371 - protein, 20 aa, synthetic construct
  source 1..20: note = Seed: SATGFKQSSKALQRPVASDF
SATGMKQVSGALVRPVASDF

SEQ ID NO: 17372 - protein, 20 aa, synthetic construct
  source 1..20: note = Seed: SATGFKQSSKALQRPVASDF
SATGMKQVSIALARPVASDF

SEQ ID NO: 17373 - protein, 20 aa, synthetic construct
  source 1..20: note = Seed: SATGFKQSSKALQRPVASDF
SATGMKQVSIALGRPVASDF

SEQ ID NO: 17374 - protein, 20 aa, synthetic construct
  source 1..20: note = Seed: SATGFKQSSKALQRPVASDF
SATGMKQVSIALNRPVASDF

SEQ ID NO: 17375 - protein, 20 aa, synthetic construct
  source 1..20: note = Seed: SATGFKQSSKALQRPVASDF
SATGMKQVSKALARPVASDF

SEQ ID NO: 17376 - protein, 20 aa, synthetic construct
  source 1..20: note = Seed: SATGFKQSSKALQRPVASDF
SATGMKQVSKALGRPVASDF

SEQ ID NO: 17377 - protein, 20 aa, synthetic construct
  source 1..20: note = Seed: SATGFKQSSKALQRPVASDF
SATGMKQVSKALHRPVASDF

SEQ ID NO: 17378 - protein, 20 aa, synthetic construct
  source 1..20: note = Seed: SATGFKQSSKALQRPVASDF
SATGMKQVSKALKRPVASDF

SEQ ID NO: 17379 - protein, 20 aa, synthetic construct
  source 1..20: note = Seed: SATGFKQSSKALQRPVASDF
SATGMKQVSKALMRPVASDF

SEQ ID NO: 17380 - protein, 20 aa, synthetic construct
  source 1..20: note = Seed: SATGFKQSSKALQRPVASDF
SATGMKQVSKALQRPVASDF

SEQ ID NO: 17381 - protein, 20 aa, synthetic construct
  source 1..20: note = Seed: SATGFKQSSKALQRPVASDF
SATGMKQVSKALRRPVASDF

SEQ ID NO: 17382 - protein, 20 aa, synthetic construct
  source 1..20: note = Seed: SATGFKQSSKALQRPVASDF
SATGMKQVSKALSRPVASDF

SEQ ID NO: 17383 - protein, 20 aa, synthetic construct
  source 1..20: note = Seed: SATGFKQSSKALQRPVASDF
SATGMKQVSKALTRPVASDF

SEQ ID NO: 17384 - protein, 20 aa, synthetic construct
  source 1..20: note = Seed: SATGFKQSSKALQRPVASDF
SATGMKQVSKALVRPVASDF

SEQ ID NO: 17385 - protein, 20 aa, synthetic construct
  source 1..20: note = Seed: SATGFKQSSKALQRPVASDF
SATGMKQVSLALIRPVASDF

SEQ ID NO: 17386 - protein, 20 aa, synthetic construct
  source 1..20: note = Seed: SATGFKQSSKALQRPVASDF
SATGMKQVSLALLRPVASDF

SEQ ID NO: 17387 - protein, 20 aa, synthetic construct
  source 1..20: note = Seed: SATGFKQSSKALQRPVASDF
SATGMKQVSLALNRPVASDF

SEQ ID NO: 17388 - protein, 20 aa, synthetic construct
  source 1..20: note = Seed: SATGFKQSSKALQRPVASDF
SATGMKQVSNALARPVASDF

SEQ ID NO: 17389 - protein, 20 aa, synthetic construct
  source 1..20: note = Seed: SATGFKQSSKALQRPVASDF
SATGMKQVSPALARPVASDF

SEQ ID NO: 17390 - protein, 20 aa, synthetic construct
  source 1..20: note = Seed: SATGFKQSSKALQRPVASDF
SATGMKQVSPALIRPVASDF

SEQ ID NO: 17391 - protein, 20 aa, synthetic construct
  source 1..20: note = Seed: SATGFKQSSKALQRPVASDF
SATGMKQVSPALLRPVASDF

SEQ ID NO: 17392 - protein, 20 aa, synthetic construct
  source 1..20: note = Seed: SATGFKQSSKALQRPVASDF
SATGMKQVSPALNRPVASDF

SEQ ID NO: 17393 - protein, 20 aa, synthetic construct
  source 1..20: note = Seed: SATGFKQSSKALQRPVASDF
SATGMKQVSPALSRPVASDF

SEQ ID NO: 17394 - protein, 20 aa, synthetic construct
  source 1..20: note = Seed: SATGFKQSSKALQRPVASDF
SATGMKQVSPALTRPVASDF

SEQ ID NO: 17395 - protein, 20 aa, synthetic construct
  source 1..20: note = Seed: SATGFKQSSKALQRPVASDF
SATGMKQVSPALVRPVASDF

SEQ ID NO: 17396 - protein, 20 aa, synthetic construct
  source 1..20: note = Seed: SATGFKQSSKALQRPVASDF
SATGMKQVSRALARPVASDF

SEQ ID NO: 17397 - protein, 20 aa, synthetic construct
  source 1..20: note = Seed: SATGFKQSSKALQRPVASDF
SATGMKQVSRALGRPVASDF

SEQ ID NO: 17398 - protein, 20 aa, synthetic construct
  source 1..20: note = Seed: SATGFKQSSKALQRPVASDF
SATGMKQVSRALHRPVASDF

SEQ ID NO: 17399 - protein, 20 aa, synthetic construct
  source 1..20: note = Seed: SATGFKQSSKALQRPVASDF
SATGMKQVSRALIRPVASDF

SEQ ID NO: 17400 - protein, 20 aa, synthetic construct
  source 1..20: note = Seed: SATGFKQSSKALQRPVASDF
SATGMKQVSRALKRPVASDF

SEQ ID NO: 17401 - protein, 20 aa, synthetic construct
  source 1..20: note = Seed: SATGFKQSSKALQRPVASDF
SATGMKQVSRALLRPVASDF

SEQ ID NO: 17402 - protein, 20 aa, synthetic construct
  source 1..20: note = Seed: SATGFKQSSKALQRPVASDF
SATGMKQVSRALMRPVASDF

SEQ ID NO: 17403 - protein, 20 aa, synthetic construct
  source 1..20: note = Seed: SATGFKQSSKALQRPVASDF
SATGMKQVSRALQRPVASDF

SEQ ID NO: 17404 - protein, 20 aa, synthetic construct
  source 1..20: note = Seed: SATGFKQSSKALQRPVASDF
SATGMKQVSRALRRPVASDF

SEQ ID NO: 17405 - protein, 20 aa, synthetic construct
  source 1..20: note = Seed: SATGFKQSSKALQRPVASDF
SATGMKQVSRALSRPVASDF

SEQ ID NO: 17406 - protein, 20 aa, synthetic construct
  source 1..20: note = Seed: SATGFKQSSKALQRPVASDF
SATGMKQVSRALTRPVASDF

SEQ ID NO: 17407 - protein, 20 aa, synthetic construct
  source 1..20: note = Seed: SATGFKQSSKALQRPVASDF
SATGMKQVSRALVRPVASDF

SEQ ID NO: 17408 - protein, 20 aa, synthetic construct
  source 1..20: note = Seed: SATGFKQSSKALQRPVASDF
SATGMKQVSRALYRPVASDF

SEQ ID NO: 17409 - protein, 20 aa, synthetic construct
  source 1..20: note = Seed: SATGFKQSSKALQRPVASDF
SATGMKQVSSALARPVASDF

SEQ ID NO: 17410 - protein, 20 aa, synthetic construct
  source 1..20: note = Seed: SATGFKQSSKALQRPVASDF
SATGMKQVSSALIRPVASDF

SEQ ID NO: 17411 - protein, 20 aa, synthetic construct
  source 1..20: note = Seed: SATGFKQSSKALQRPVASDF
SATGMKQVSSALLRPVASDF

SEQ ID NO: 17412 - protein, 20 aa, synthetic construct
  source 1..20: note = Seed: SATGFKQSSKALQRPVASDF
SATGMKQVSSALNRPVASDF

SEQ ID NO: 17413 - protein, 20 aa, synthetic construct
  source 1..20: note = Seed: SATGFKQSSKALQRPVASDF
SATGMKQVSSALSRPVASDF

SEQ ID NO: 17414 - protein, 20 aa, synthetic construct
  source 1..20: note = Seed: SATGFKQSSKALQRPVASDF
SATGMKQVSSALTRPVASDF

SEQ ID NO: 17415 - protein, 20 aa, synthetic construct
  source 1..20: note = Seed: SATGFKQSSKALQRPVASDF
SATGMKQVSSALVRPVASDF

SEQ ID NO: 17416 - protein, 20 aa, synthetic construct
  source 1..20: note = Seed: SATGFKQSSKALQRPVASDF
SATGMKQVSTALARPVASDF

SEQ ID NO: 17417 - protein, 20 aa, synthetic construct
  source 1..20: note = Seed: SATGFKQSSKALQRPVASDF
SATGMKQVSTALMRPVASDF

SEQ ID NO: 17418 - protein, 20 aa, synthetic construct
  source 1..20: note = Seed: SATGFKQSSKALQRPVASDF
SATGMKQVSTALNRPVASDF

SEQ ID NO: 17419 - protein, 20 aa, synthetic construct
  source 1..20: note = Seed: SATGFKQSSKALQRPVASDF
SATGMKQVSTALSRPVASDF

SEQ ID NO: 17420 - protein, 20 aa, synthetic construct
  source 1..20: note = Seed: SATGFKQSSKALQRPVASDF
SATGMKQVSTALTRPVASDF

SEQ ID NO: 17421 - protein, 20 aa, synthetic construct
  source 1..20: note = Seed: SATGFKQSSKALQRPVASDF
SATGMKQVSTALVRPVASDF

SEQ ID NO: 17422 - protein, 20 aa, synthetic construct
  source 1..20: note = Seed: SATGFKQSSKALQRPVASDF
SATGMKQVSVALARPVASDF

SEQ ID NO: 17423 - protein, 20 aa, synthetic construct
  source 1..20: note = Seed: SATGFKQSSKALQRPVASDF
SATGMKQVSVALGRPVASDF

SEQ ID NO: 17424 - protein, 20 aa, synthetic construct
  source 1..20: note = Seed: SATGFKQSSKALQRPVASDF
SATGMKQVSVALNRPVASDF

SEQ ID NO: 17425 - protein, 20 aa, synthetic construct
  source 1..20: note = Seed: SATGFKQSSKALQRPVASDF
SATGMKQVSVALSRPVASDF

SEQ ID NO: 17426 - protein, 20 aa, synthetic construct
  source 1..20: note = Seed: SATGFKQSSKALQRPVASDF
SATGMKQVSVALTRPVASDF

SEQ ID NO: 17427 - protein, 20 aa, synthetic construct
  source 1..20: note = Seed: SATGFKQSSKALQRPVASDF
SATGMKQVSVALVRPVASDF

SEQ ID NO: 17428 - protein, 20 aa, synthetic construct
  source 1..20: note = Seed: SATGFKQSSKALQRPVASDF
SATGMKQWSAALLRPVASDF

SEQ ID NO: 17429 - protein, 20 aa, synthetic construct
  source 1..20: note = Seed: SATGFKQSSKALQRPVASDF
SATGMKQWSAALRRPVASDF

SEQ ID NO: 17430 - protein, 20 aa, synthetic construct
  source 1..20: note = Seed: SATGFKQSSKALQRPVASDF
SATGMKQWSFALVRPVASDF

SEQ ID NO: 17431 - protein, 20 aa, synthetic construct
  source 1..20: note = Seed: SATGFKQSSKALQRPVASDF
SATGMKQWSGALVRPVASDF

SEQ ID NO: 17432 - protein, 20 aa, synthetic construct
  source 1..20: note = Seed: SATGFKQSSKALQRPVASDF
SATGMKQWSIALARPVASDF

SEQ ID NO: 17433 - protein, 20 aa, synthetic construct
  source 1..20: note = Seed: SATGFKQSSKALQRPVASDF
SATGMKQWSIALRRPVASDF

SEQ ID NO: 17434 - protein, 20 aa, synthetic construct
  source 1..20: note = Seed: SATGFKQSSKALQRPVASDF
SATGMKQWSKALARPVASDF

SEQ ID NO: 17435 - protein, 20 aa, synthetic construct
  source 1..20: note = Seed: SATGFKQSSKALQRPVASDF
SATGMKQWSKALKRPVASDF

SEQ ID NO: 17436 - protein, 20 aa, synthetic construct
  source 1..20: note = Seed: SATGFKQSSKALQRPVASDF
SATGMKQWSKALRRPVASDF

SEQ ID NO: 17437 - protein, 20 aa, synthetic construct
  source 1..20: note = Seed: SATGFKQSSKALQRPVASDF
SATGMKQWSLALARPVASDF

SEQ ID NO: 17438 - protein, 20 aa, synthetic construct
  source 1..20: note = Seed: SATGFKQSSKALQRPVASDF
SATGMKQWSLALIRPVASDF

SEQ ID NO: 17439 - protein, 20 aa, synthetic construct
  source 1..20: note = Seed: SATGFKQSSKALQRPVASDF
SATGMKQWSLALLRPVASDF

SEQ ID NO: 17440 - protein, 20 aa, synthetic construct
  source 1..20: note = Seed: SATGFKQSSKALQRPVASDF
SATGMKQWSLALMRPVASDF

SEQ ID NO: 17441 - protein, 20 aa, synthetic construct
  source 1..20: note = Seed: SATGFKQSSKALQRPVASDF
SATGMKQWSLALRRPVASDF

SEQ ID NO: 17442 - protein, 20 aa, synthetic construct
  source 1..20: note = Seed: SATGFKQSSKALQRPVASDF
SATGMKQWSLALVRPVASDF

SEQ ID NO: 17443 - protein, 20 aa, synthetic construct
  source 1..20: note = Seed: SATGFKQSSKALQRPVASDF
SATGMKQWSRALARPVASDF

SEQ ID NO: 17444 - protein, 20 aa, synthetic construct
  source 1..20: note = Seed: SATGFKQSSKALQRPVASDF
SATGMKQWSRALFRPVASDF

SEQ ID NO: 17445 - protein, 20 aa, synthetic construct
  source 1..20: note = Seed: SATGFKQSSKALQRPVASDF
SATGMKQWSRALKRPVASDF

SEQ ID NO: 17446 - protein, 20 aa, synthetic construct
  source 1..20: note = Seed: SATGFKQSSKALQRPVASDF
SATGMKQWSRALRRPVASDF

SEQ ID NO: 17447 - protein, 20 aa, synthetic construct
  source 1..20: note = Seed: SATGFKQSSKALQRPVASDF
SATGMKQWSRALSRPVASDF

SEQ ID NO: 17448 - protein, 20 aa, synthetic construct
  source 1..20: note = Seed: SATGFKQSSKALQRPVASDF
SATGMKQWSRALYRPVASDF

SEQ ID NO: 17449 - protein, 20 aa, synthetic construct
  source 1..20: note = Seed: SATGFKQSSKALQRPVASDF
SATGMKQWSSALLRPVASDF

SEQ ID NO: 17450 - protein, 20 aa, synthetic construct
  source 1..20: note = Seed: SATGFKQSSKALQRPVASDF
SATGMKQWSTALMRPVASDF

SEQ ID NO: 17451 - protein, 20 aa, synthetic construct
  source 1..20: note = Seed: SATGFKQSSKALQRPVASDF
SATGMKQWSVALRRPVASDF

SEQ ID NO: 17452 - protein, 20 aa, synthetic construct
  source 1..20: note = Seed: SATGFKQSSKALQRPVASDF
SATGMKQYSIALRRPVASDF

SEQ ID NO: 17453 - protein, 20 aa, synthetic construct
  source 1..20: note = Seed: SATGFKQSSKALQRPVASDF
SATGMKQYSKALKRPVASDF

SEQ ID NO: 17454 - protein, 20 aa, synthetic construct
  source 1..20: note = Seed: SATGFKQSSKALQRPVASDF
SATGMKQYSKALRRPVASDF

SEQ ID NO: 17455 - protein, 20 aa, synthetic construct
  source 1..20: note = Seed: SATGFKQSSKALQRPVASDF
SATGMKQYSLALARPVASDF

SEQ ID NO: 17456 - protein, 20 aa, synthetic construct
  source 1..20: note = Seed: SATGFKQSSKALQRPVASDF
SATGMKQYSRALARPVASDF

SEQ ID NO: 17457 - protein, 20 aa, synthetic construct
  source 1..20: note = Seed: SATGFKQSSKALQRPVASDF
SATGMKQYSRALKRPVASDF

SEQ ID NO: 17458 - protein, 20 aa, synthetic construct
  source 1..20: note = Seed: SATGFKQSSKALQRPVASDF
SATGMKQYSRALRRPVASDF

SEQ ID NO: 17459 - protein, 20 aa, synthetic construct
  source 1..20: note = Seed: SATGFKQSSKALQRPVASDF
SATGMKQYSRALSRPVASDF

SEQ ID NO: 17460 - protein, 20 aa, synthetic construct
  source 1..20: note = Seed: SATGFKQSSKALQRPVASDF
SATGMKQYSVALRRPVASDF

SEQ ID NO: 17461 - protein, 20 aa, synthetic construct
  source 1..20: note = Seed: SATGFKQSSKALQRPVASDF
SATGNKQLSAALIRPVASDF

SEQ ID NO: 17462 - protein, 20 aa, synthetic construct
  source 1..20: note = Seed: SATGFKQSSKALQRPVASDF
SATGNKQLSAALLRPVASDF

SEQ ID NO: 17463 - protein, 20 aa, synthetic construct
  source 1..20: note = Seed: SATGFKQSSKALQRPVASDF
SATGNKQLSGALIRPVASDF

SEQ ID NO: 17464 - protein, 20 aa, synthetic construct
  source 1..20: note = Seed: SATGFKQSSKALQRPVASDF
SATGNKQLSGALLRPVASDF

SEQ ID NO: 17465 - protein, 20 aa, synthetic construct
  source 1..20: note = Seed: SATGFKQSSKALQRPVASDF
SATGNKQLSGALVRPVASDF

SEQ ID NO: 17466 - protein, 20 aa, synthetic construct
  source 1..20: note = Seed: SATGFKQSSKALQRPVASDF
SATGNKQMSAALIRPVASDF

SEQ ID NO: 17467 - protein, 20 aa, synthetic construct
  source 1..20: note = Seed: SATGFKQSSKALQRPVASDF
SATGNKQMSAALLRPVASDF

SEQ ID NO: 17468 - protein, 20 aa, synthetic construct
  source 1..20: note = Seed: SATGFKQSSKALQRPVASDF
SATGNKQMSSALIRPVASDF

SEQ ID NO: 17469 - protein, 20 aa, synthetic construct
  source 1..20: note = Seed: SATGFKQSSKALQRPVASDF
SATGPKQFSIALARPVASDF

SEQ ID NO: 17470 - protein, 20 aa, synthetic construct
  source 1..20: note = Seed: SATGFKQSSKALQRPVASDF
SATGPKQFSLALARPVASDF

SEQ ID NO: 17471 - protein, 20 aa, synthetic construct
  source 1..20: note = Seed: SATGFKQSSKALQRPVASDF
SATGPKQLSAALIRPVASDF

SEQ ID NO: 17472 - protein, 20 aa, synthetic construct
  source 1..20: note = Seed: SATGFKQSSKALQRPVASDF
SATGPKQLSAALLRPVASDF

SEQ ID NO: 17473 - protein, 20 aa, synthetic construct
  source 1..20: note = Seed: SATGFKQSSKALQRPVASDF
SATGPKQLSAALVRPVASDF

SEQ ID NO: 17474 - protein, 20 aa, synthetic construct
  source 1..20: note = Seed: SATGFKQSSKALQRPVASDF
SATGPKQLSGALVRPVASDF

SEQ ID NO: 17475 - protein, 20 aa, synthetic construct
  source 1..20: note = Seed: SATGFKQSSKALQRPVASDF
SATGPKQLSSALIRPVASDF

SEQ ID NO: 17476 - protein, 20 aa, synthetic construct
  source 1..20: note = Seed: SATGFKQSSKALQRPVASDF
SATGPKQMSAALIRPVASDF

SEQ ID NO: 17477 - protein, 20 aa, synthetic construct
  source 1..20: note = Seed: SATGFKQSSKALQRPVASDF
SATGPKQMSAALVRPVASDF

SEQ ID NO: 17478 - protein, 20 aa, synthetic construct
  source 1..20: note = Seed: SATGFKQSSKALQRPVASDF
SATGQKQASFALARPVASDF

SEQ ID NO: 17479 - protein, 20 aa, synthetic construct
  source 1..20: note = Seed: SATGFKQSSKALQRPVASDF
SATGQKQFSIALARPVASDF

SEQ ID NO: 17480 - protein, 20 aa, synthetic construct
  source 1..20: note = Seed: SATGFKQSSKALQRPVASDF
SATGQKQFSLALARPVASDF

SEQ ID NO: 17481 - protein, 20 aa, synthetic construct
  source 1..20: note = Seed: SATGFKQSSKALQRPVASDF
SATGQKQFSVALARPVASDF

SEQ ID NO: 17482 - protein, 20 aa, synthetic construct
  source 1..20: note = Seed: SATGFKQSSKALQRPVASDF
SATGQKQLSAALIRPVASDF

SEQ ID NO: 17483 - protein, 20 aa, synthetic construct
  source 1..20: note = Seed: SATGFKQSSKALQRPVASDF
SATGQKQLSAALLRPVASDF

SEQ ID NO: 17484 - protein, 20 aa, synthetic construct
  source 1..20: note = Seed: SATGFKQSSKALQRPVASDF
SATGQKQLSAALMRPVASDF

SEQ ID NO: 17485 - protein, 20 aa, synthetic construct
  source 1..20: note = Seed: SATGFKQSSKALQRPVASDF
SATGQKQLSAALVRPVASDF

SEQ ID NO: 17486 - protein, 20 aa, synthetic construct
  source 1..20: note = Seed: SATGFKQSSKALQRPVASDF
SATGQKQLSGALIRPVASDF

SEQ ID NO: 17487 - protein, 20 aa, synthetic construct
  source 1..20: note = Seed: SATGFKQSSKALQRPVASDF
SATGQKQLSGALLRPVASDF

SEQ ID NO: 17488 - protein, 20 aa, synthetic construct
  source 1..20: note = Seed: SATGFKQSSKALQRPVASDF
SATGQKQLSGALVRPVASDF

SEQ ID NO: 17489 - protein, 20 aa, synthetic construct
  source 1..20: note = Seed: SATGFKQSSKALQRPVASDF
SATGQKQLSPALVRPVASDF

SEQ ID NO: 17490 - protein, 20 aa, synthetic construct
  source 1..20: note = Seed: SATGFKQSSKALQRPVASDF
SATGQKQLSSALIRPVASDF

SEQ ID NO: 17491 - protein, 20 aa, synthetic construct
  source 1..20: note = Seed: SATGFKQSSKALQRPVASDF
SATGQKQLSSALLRPVASDF

SEQ ID NO: 17492 - protein, 20 aa, synthetic construct
  source 1..20: note = Seed: SATGFKQSSKALQRPVASDF
SATGQKQMSAALIRPVASDF

SEQ ID NO: 17493 - protein, 20 aa, synthetic construct
  source 1..20: note = Seed: SATGFKQSSKALQRPVASDF
SATGQKQMSAALLRPVASDF

SEQ ID NO: 17494 - protein, 20 aa, synthetic construct
  source 1..20: note = Seed: SATGFKQSSKALQRPVASDF
SATGQKQMSAALMRPVASDF

SEQ ID NO: 17495 - protein, 20 aa, synthetic construct
  source 1..20: note = Seed: SATGFKQSSKALQRPVASDF
SATGQKQMSAALVRPVASDF

SEQ ID NO: 17496 - protein, 20 aa, synthetic construct
  source 1..20: note = Seed: SATGFKQSSKALQRPVASDF
SATGQKQMSGALIRPVASDF

SEQ ID NO: 17497 - protein, 20 aa, synthetic construct
  source 1..20: note = Seed: SATGFKQSSKALQRPVASDF
SATGQKQMSGALVRPVASDF

SEQ ID NO: 17498 - protein, 20 aa, synthetic construct
  source 1..20: note = Seed: SATGFKQSSKALQRPVASDF
SATGQKQMSSALIRPVASDF

SEQ ID NO: 17499 - protein, 20 aa, synthetic construct
  source 1..20: note = Seed: SATGFKQSSKALQRPVASDF
SATGQKQMSVALNRPVASDF

SEQ ID NO: 17500 - protein, 20 aa, synthetic construct
  source 1..20: note = Seed: SATGFKQSSKALQRPVASDF
SATGQKQWSIALARPVASDF

SEQ ID NO: 17501 - protein, 20 aa, synthetic construct
  source 1..20: note = Seed: SATGFKQSSKALQRPVASDF
SATGQKQYSIALARPVASDF

SEQ ID NO: 17502 - protein, 20 aa, synthetic construct
  source 1..20: note = Seed: SATGFKQSSKALQRPVASDF
SATGQKQYSLALARPVASDF

SEQ ID NO: 17503 - protein, 20 aa, synthetic construct
  source 1..20: note = Seed: SATGFKQSSKALQRPVASDF
SATGRKQASAALARPVASDF

SEQ ID NO: 17504 - protein, 20 aa, synthetic construct
  source 1..20: note = Seed: SATGFKQSSKALQRPVASDF
SATGRKQASAALIRPVASDF

SEQ ID NO: 17505 - protein, 20 aa, synthetic construct
  source 1..20: note = Seed: SATGFKQSSKALQRPVASDF
SATGRKQASAALLRPVASDF

SEQ ID NO: 17506 - protein, 20 aa, synthetic construct
  source 1..20: note = Seed: SATGFKQSSKALQRPVASDF
SATGRKQASAALVRPVASDF

SEQ ID NO: 17507 - protein, 20 aa, synthetic construct
  source 1..20: note = Seed: SATGFKQSSKALQRPVASDF
SATGRKQASFALARPVASDF

SEQ ID NO: 17508 - protein, 20 aa, synthetic construct
  source 1..20: note = Seed: SATGFKQSSKALQRPVASDF
SATGRKQASFALIRPVASDF

SEQ ID NO: 17509 - protein, 20 aa, synthetic construct
  source 1..20: note = Seed: SATGFKQSSKALQRPVASDF
SATGRKQASFALLRPVASDF

SEQ ID NO: 17510 - protein, 20 aa, synthetic construct
  source 1..20: note = Seed: SATGFKQSSKALQRPVASDF
SATGRKQASFALSRPVASDF

SEQ ID NO: 17511 - protein, 20 aa, synthetic construct
  source 1..20: note = Seed: SATGFKQSSKALQRPVASDF
SATGRKQASFALVRPVASDF

SEQ ID NO: 17512 - protein, 20 aa, synthetic construct
  source 1..20: note = Seed: SATGFKQSSKALQRPVASDF
SATGRKQASIALARPVASDF

SEQ ID NO: 17513 - protein, 20 aa, synthetic construct
  source 1..20: note = Seed: SATGFKQSSKALQRPVASDF
SATGRKQASIALIRPVASDF

SEQ ID NO: 17514 - protein, 20 aa, synthetic construct
  source 1..20: note = Seed: SATGFKQSSKALQRPVASDF
SATGRKQASIALLRPVASDF

SEQ ID NO: 17515 - protein, 20 aa, synthetic construct
  source 1..20: note = Seed: SATGFKQSSKALQRPVASDF
SATGRKQASIALMRPVASDF

SEQ ID NO: 17516 - protein, 20 aa, synthetic construct
  source 1..20: note = Seed: SATGFKQSSKALQRPVASDF
SATGRKQASIALNRPVASDF

SEQ ID NO: 17517 - protein, 20 aa, synthetic construct
  source 1..20: note = Seed: SATGFKQSSKALQRPVASDF
SATGRKQASIALSRPVASDF

SEQ ID NO: 17518 - protein, 20 aa, synthetic construct
  source 1..20: note = Seed: SATGFKQSSKALQRPVASDF
SATGRKQASIALTRPVASDF

SEQ ID NO: 17519 - protein, 20 aa, synthetic construct
  source 1..20: note = Seed: SATGFKQSSKALQRPVASDF
SATGRKQASIALVRPVASDF

SEQ ID NO: 17520 - protein, 20 aa, synthetic construct
  source 1..20: note = Seed: SATGFKQSSKALQRPVASDF
SATGRKQASLALARPVASDF

SEQ ID NO: 17521 - protein, 20 aa, synthetic construct
  source 1..20: note = Seed: SATGFKQSSKALQRPVASDF
SATGRKQASLALIRPVASDF

SEQ ID NO: 17522 - protein, 20 aa, synthetic construct
  source 1..20: note = Seed: SATGFKQSSKALQRPVASDF
SATGRKQASLALVRPVASDF

SEQ ID NO: 17523 - protein, 20 aa, synthetic construct
  source 1..20: note = Seed: SATGFKQSSKALQRPVASDF
SATGRKQASMALARPVASDF

SEQ ID NO: 17524 - protein, 20 aa, synthetic construct
  source 1..20: note = Seed: SATGFKQSSKALQRPVASDF
SATGRKQASVALARPVASDF

SEQ ID NO: 17525 - protein, 20 aa, synthetic construct
  source 1..20: note = Seed: SATGFKQSSKALQRPVASDF
SATGRKQASVALIRPVASDF

SEQ ID NO: 17526 - protein, 20 aa, synthetic construct
  source 1..20: note = Seed: SATGFKQSSKALQRPVASDF
SATGRKQASVALLRPVASDF

SEQ ID NO: 17527 - protein, 20 aa, synthetic construct
  source 1..20: note = Seed: SATGFKQSSKALQRPVASDF
SATGRKQASVALMRPVASDF

SEQ ID NO: 17528 - protein, 20 aa, synthetic construct
  source 1..20: note = Seed: SATGFKQSSKALQRPVASDF
SATGRKQASVALNRPVASDF

SEQ ID NO: 17529 - protein, 20 aa, synthetic construct
  source 1..20: note = Seed: SATGFKQSSKALQRPVASDF
SATGRKQASVALSRPVASDF

SEQ ID NO: 17530 - protein, 20 aa, synthetic construct
  source 1..20: note = Seed: SATGFKQSSKALQRPVASDF
SATGRKQASVALVRPVASDF

SEQ ID NO: 17531 - protein, 20 aa, synthetic construct
  source 1..20: note = Seed: SATGFKQSSKALQRPVASDF
SATGRKQESFALIRPVASDF

SEQ ID NO: 17532 - protein, 20 aa, synthetic construct
  source 1..20: note = Seed: SATGFKQSSKALQRPVASDF
SATGRKQESFALLRPVASDF

SEQ ID NO: 17533 - protein, 20 aa, synthetic construct
  source 1..20: note = Seed: SATGFKQSSKALQRPVASDF
SATGRKQESFALVRPVASDF

SEQ ID NO: 17534 - protein, 20 aa, synthetic construct
  source 1..20: note = Seed: SATGFKQSSKALQRPVASDF
SATGRKQFSAALARPVASDF

SEQ ID NO: 17535 - protein, 20 aa, synthetic construct
  source 1..20: note = Seed: SATGFKQSSKALQRPVASDF
SATGRKQFSAALIRPVASDF

SEQ ID NO: 17536 - protein, 20 aa, synthetic construct
  source 1..20: note = Seed: SATGFKQSSKALQRPVASDF
SATGRKQFSAALVRPVASDF

SEQ ID NO: 17537 - protein, 20 aa, synthetic construct
  source 1..20: note = Seed: SATGFKQSSKALQRPVASDF
SATGRKQFSFALSRPVASDF

SEQ ID NO: 17538 - protein, 20 aa, synthetic construct
  source 1..20: note = Seed: SATGFKQSSKALQRPVASDF
SATGRKQFSIALARPVASDF

SEQ ID NO: 17539 - protein, 20 aa, synthetic construct
  source 1..20: note = Seed: SATGFKQSSKALQRPVASDF
SATGRKQFSIALIRPVASDF

SEQ ID NO: 17540 - protein, 20 aa, synthetic construct
  source 1..20: note = Seed: SATGFKQSSKALQRPVASDF
SATGRKQFSIALMRPVASDF

SEQ ID NO: 17541 - protein, 20 aa, synthetic construct
  source 1..20: note = Seed: SATGFKQSSKALQRPVASDF
SATGRKQFSIALSRPVASDF

SEQ ID NO: 17542 - protein, 20 aa, synthetic construct
  source 1..20: note = Seed: SATGFKQSSKALQRPVASDF
SATGRKQFSIALTRPVASDF

SEQ ID NO: 17543 - protein, 20 aa, synthetic construct
  source 1..20: note = Seed: SATGFKQSSKALQRPVASDF
SATGRKQFSIALVRPVASDF

SEQ ID NO: 17544 - protein, 20 aa, synthetic construct
  source 1..20: note = Seed: SATGFKQSSKALQRPVASDF
SATGRKQFSLALARPVASDF

SEQ ID NO: 17545 - protein, 20 aa, synthetic construct
  source 1..20: note = Seed: SATGFKQSSKALQRPVASDF
SATGRKQFSLALERPVASDF

SEQ ID NO: 17546 - protein, 20 aa, synthetic construct
  source 1..20: note = Seed: SATGFKQSSKALQRPVASDF
SATGRKQFSLALIRPVASDF

SEQ ID NO: 17547 - protein, 20 aa, synthetic construct
  source 1..20: note = Seed: SATGFKQSSKALQRPVASDF
SATGRKQFSLALMRPVASDF

SEQ ID NO: 17548 - protein, 20 aa, synthetic construct
  source 1..20: note = Seed: SATGFKQSSKALQRPVASDF
SATGRKQFSLALSRPVASDF

SEQ ID NO: 17549 - protein, 20 aa, synthetic construct
  source 1..20: note = Seed: SATGFKQSSKALQRPVASDF
SATGRKQFSLALVRPVASDF

SEQ ID NO: 17550 - protein, 20 aa, synthetic construct
  source 1..20: note = Seed: SATGFKQSSKALQRPVASDF
SATGRKQFSMALARPVASDF

SEQ ID NO: 17551 - protein, 20 aa, synthetic construct
  source 1..20: note = Seed: SATGFKQSSKALQRPVASDF
SATGRKQFSMALSRPVASDF

SEQ ID NO: 17552 - protein, 20 aa, synthetic construct
  source 1..20: note = Seed: SATGFKQSSKALQRPVASDF
SATGRKQFSTALARPVASDF

SEQ ID NO: 17553 - protein, 20 aa, synthetic construct
  source 1..20: note = Seed: SATGFKQSSKALQRPVASDF
SATGRKQFSVALARPVASDF

SEQ ID NO: 17554 - protein, 20 aa, synthetic construct
  source 1..20: note = Seed: SATGFKQSSKALQRPVASDF
SATGRKQFSVALIRPVASDF

SEQ ID NO: 17555 - protein, 20 aa, synthetic construct
  source 1..20: note = Seed: SATGFKQSSKALQRPVASDF
SATGRKQFSVALSRPVASDF

SEQ ID NO: 17556 - protein, 20 aa, synthetic construct
  source 1..20: note = Seed: SATGFKQSSKALQRPVASDF
SATGRKQFSVALVRPVASDF

SEQ ID NO: 17557 - protein, 20 aa, synthetic construct
  source 1..20: note = Seed: SATGFKQSSKALQRPVASDF
SATGRKQISAALARPVASDF

SEQ ID NO: 17558 - protein, 20 aa, synthetic construct
  source 1..20: note = Seed: SATGFKQSSKALQRPVASDF
SATGRKQISAALIRPVASDF

SEQ ID NO: 17559 - protein, 20 aa, synthetic construct
  source 1..20: note = Seed: SATGFKQSSKALQRPVASDF
SATGRKQISAALLRPVASDF

SEQ ID NO: 17560 - protein, 20 aa, synthetic construct
  source 1..20: note = Seed: SATGFKQSSKALQRPVASDF
SATGRKQISAALVRPVASDF

SEQ ID NO: 17561 - protein, 20 aa, synthetic construct
  source 1..20: note = Seed: SATGFKQSSKALQRPVASDF
SATGRKQISFALARPVASDF

SEQ ID NO: 17562 - protein, 20 aa, synthetic construct
  source 1..20: note = Seed: SATGFKQSSKALQRPVASDF
SATGRKQISFALERPVASDF

SEQ ID NO: 17563 - protein, 20 aa, synthetic construct
  source 1..20: note = Seed: SATGFKQSSKALQRPVASDF
SATGRKQISFALIRPVASDF

SEQ ID NO: 17564 - protein, 20 aa, synthetic construct
  source 1..20: note = Seed: SATGFKQSSKALQRPVASDF
SATGRKQISFALLRPVASDF

SEQ ID NO: 17565 - protein, 20 aa, synthetic construct
  source 1..20: note = Seed: SATGFKQSSKALQRPVASDF
SATGRKQISFALMRPVASDF

SEQ ID NO: 17566 - protein, 20 aa, synthetic construct
  source 1..20: note = Seed: SATGFKQSSKALQRPVASDF
SATGRKQISFALSRPVASDF

SEQ ID NO: 17567 - protein, 20 aa, synthetic construct
  source 1..20: note = Seed: SATGFKQSSKALQRPVASDF
SATGRKQISFALVRPVASDF

SEQ ID NO: 17568 - protein, 20 aa, synthetic construct
  source 1..20: note = Seed: SATGFKQSSKALQRPVASDF
SATGRKQISIALARPVASDF

SEQ ID NO: 17569 - protein, 20 aa, synthetic construct
  source 1..20: note = Seed: SATGFKQSSKALQRPVASDF
SATGRKQISIALSRPVASDF

SEQ ID NO: 17570 - protein, 20 aa, synthetic construct
  source 1..20: note = Seed: SATGFKQSSKALQRPVASDF
SATGRKQISIALVRPVASDF

SEQ ID NO: 17571 - protein, 20 aa, synthetic construct
  source 1..20: note = Seed: SATGFKQSSKALQRPVASDF
SATGRKQISLALARPVASDF

SEQ ID NO: 17572 - protein, 20 aa, synthetic construct
  source 1..20: note = Seed: SATGFKQSSKALQRPVASDF
SATGRKQISLALVRPVASDF

SEQ ID NO: 17573 - protein, 20 aa, synthetic construct
  source 1..20: note = Seed: SATGFKQSSKALQRPVASDF
SATGRKQISMALARPVASDF

SEQ ID NO: 17574 - protein, 20 aa, synthetic construct
  source 1..20: note = Seed: SATGFKQSSKALQRPVASDF
SATGRKQISVALARPVASDF

SEQ ID NO: 17575 - protein, 20 aa, synthetic construct
  source 1..20: note = Seed: SATGFKQSSKALQRPVASDF
SATGRKQISVALIRPVASDF

SEQ ID NO: 17576 - protein, 20 aa, synthetic construct
  source 1..20: note = Seed: SATGFKQSSKALQRPVASDF
SATGRKQISVALSRPVASDF

SEQ ID NO: 17577 - protein, 20 aa, synthetic construct
  source 1..20: note = Seed: SATGFKQSSKALQRPVASDF
SATGRKQISVALVRPVASDF

SEQ ID NO: 17578 - protein, 20 aa, synthetic construct
  source 1..20: note = Seed: SATGFKQSSKALQRPVASDF
SATGRKQLSAALARPVASDF

SEQ ID NO: 17579 - protein, 20 aa, synthetic construct
  source 1..20: note = Seed: SATGFKQSSKALQRPVASDF
SATGRKQLSAALLRPVASDF

SEQ ID NO: 17580 - protein, 20 aa, synthetic construct
  source 1..20: note = Seed: SATGFKQSSKALQRPVASDF
SATGRKQLSFALARPVASDF

SEQ ID NO: 17581 - protein, 20 aa, synthetic construct
  source 1..20: note = Seed: SATGFKQSSKALQRPVASDF
SATGRKQLSFALIRPVASDF

SEQ ID NO: 17582 - protein, 20 aa, synthetic construct
  source 1..20: note = Seed: SATGFKQSSKALQRPVASDF
SATGRKQLSFALMRPVASDF

SEQ ID NO: 17583 - protein, 20 aa, synthetic construct
  source 1..20: note = Seed: SATGFKQSSKALQRPVASDF
SATGRKQLSFALVRPVASDF

SEQ ID NO: 17584 - protein, 20 aa, synthetic construct
  source 1..20: note = Seed: SATGFKQSSKALQRPVASDF
SATGRKQLSGALIRPVASDF

SEQ ID NO: 17585 - protein, 20 aa, synthetic construct
  source 1..20: note = Seed: SATGFKQSSKALQRPVASDF
SATGRKQLSGALVRPVASDF

SEQ ID NO: 17586 - protein, 20 aa, synthetic construct
  source 1..20: note = Seed: SATGFKQSSKALQRPVASDF
SATGRKQLSIALARPVASDF

SEQ ID NO: 17587 - protein, 20 aa, synthetic construct
  source 1..20: note = Seed: SATGFKQSSKALQRPVASDF
SATGRKQLSIALSRPVASDF

SEQ ID NO: 17588 - protein, 20 aa, synthetic construct
  source 1..20: note = Seed: SATGFKQSSKALQRPVASDF
SATGRKQLSLALARPVASDF

SEQ ID NO: 17589 - protein, 20 aa, synthetic construct
  source 1..20: note = Seed: SATGFKQSSKALQRPVASDF
SATGRKQLSMALARPVASDF

SEQ ID NO: 17590 - protein, 20 aa, synthetic construct
  source 1..20: note = Seed: SATGFKQSSKALQRPVASDF
SATGRKQLSVALARPVASDF

SEQ ID NO: 17591 - protein, 20 aa, synthetic construct
  source 1..20: note = Seed: SATGFKQSSKALQRPVASDF
SATGRKQMSAALIRPVASDF

SEQ ID NO: 17592 - protein, 20 aa, synthetic construct
  source 1..20: note = Seed: SATGFKQSSKALQRPVASDF
SATGRKQMSAALLRPVASDF

SEQ ID NO: 17593 - protein, 20 aa, synthetic construct
  source 1..20: note = Seed: SATGFKQSSKALQRPVASDF
SATGRKQMSAALMRPVASDF

SEQ ID NO: 17594 - protein, 20 aa, synthetic construct
  source 1..20: note = Seed: SATGFKQSSKALQRPVASDF
SATGRKQMSFALIRPVASDF

SEQ ID NO: 17595 - protein, 20 aa, synthetic construct
  source 1..20: note = Seed: SATGFKQSSKALQRPVASDF
SATGRKQMSFALLRPVASDF

SEQ ID NO: 17596 - protein, 20 aa, synthetic construct
  source 1..20: note = Seed: SATGFKQSSKALQRPVASDF
SATGRKQMSFALMRPVASDF

SEQ ID NO: 17597 - protein, 20 aa, synthetic construct
  source 1..20: note = Seed: SATGFKQSSKALQRPVASDF
SATGRKQMSIALARPVASDF

SEQ ID NO: 17598 - protein, 20 aa, synthetic construct
  source 1..20: note = Seed: SATGFKQSSKALQRPVASDF
SATGRKQMSIALSRPVASDF

SEQ ID NO: 17599 - protein, 20 aa, synthetic construct
  source 1..20: note = Seed: SATGFKQSSKALQRPVASDF
SATGRKQMSIALVRPVASDF

SEQ ID NO: 17600 - protein, 20 aa, synthetic construct
  source 1..20: note = Seed: SATGFKQSSKALQRPVASDF
SATGRKQMSLALARPVASDF

SEQ ID NO: 17601 - protein, 20 aa, synthetic construct
  source 1..20: note = Seed: SATGFKQSSKALQRPVASDF
SATGRKQMSLALVRPVASDF

SEQ ID NO: 17602 - protein, 20 aa, synthetic construct
  source 1..20: note = Seed: SATGFKQSSKALQRPVASDF
SATGRKQMSMALARPVASDF

SEQ ID NO: 17603 - protein, 20 aa, synthetic construct
  source 1..20: note = Seed: SATGFKQSSKALQRPVASDF
SATGRKQMSTALMRPVASDF

SEQ ID NO: 17604 - protein, 20 aa, synthetic construct
  source 1..20: note = Seed: SATGFKQSSKALQRPVASDF
SATGRKQMSVALARPVASDF

SEQ ID NO: 17605 - protein, 20 aa, synthetic construct
  source 1..20: note = Seed: SATGFKQSSKALQRPVASDF
SATGRKQSSAALARPVASDF

SEQ ID NO: 17606 - protein, 20 aa, synthetic construct
  source 1..20: note = Seed: SATGFKQSSKALQRPVASDF
SATGRKQSSAALVRPVASDF

SEQ ID NO: 17607 - protein, 20 aa, synthetic construct
  source 1..20: note = Seed: SATGFKQSSKALQRPVASDF
SATGRKQSSFALARPVASDF

SEQ ID NO: 17608 - protein, 20 aa, synthetic construct
  source 1..20: note = Seed: SATGFKQSSKALQRPVASDF
SATGRKQSSFALFRPVASDF

SEQ ID NO: 17609 - protein, 20 aa, synthetic construct
  source 1..20: note = Seed: SATGFKQSSKALQRPVASDF
SATGRKQSSFALIRPVASDF

SEQ ID NO: 17610 - protein, 20 aa, synthetic construct
  source 1..20: note = Seed: SATGFKQSSKALQRPVASDF
SATGRKQSSFALLRPVASDF

SEQ ID NO: 17611 - protein, 20 aa, synthetic construct
  source 1..20: note = Seed: SATGFKQSSKALQRPVASDF
SATGRKQSSFALSRPVASDF

SEQ ID NO: 17612 - protein, 20 aa, synthetic construct
  source 1..20: note = Seed: SATGFKQSSKALQRPVASDF
SATGRKQSSFALVRPVASDF

SEQ ID NO: 17613 - protein, 20 aa, synthetic construct
  source 1..20: note = Seed: SATGFKQSSKALQRPVASDF
SATGRKQSSIALARPVASDF

SEQ ID NO: 17614 - protein, 20 aa, synthetic construct
  source 1..20: note = Seed: SATGFKQSSKALQRPVASDF
SATGRKQSSIALIRPVASDF

SEQ ID NO: 17615 - protein, 20 aa, synthetic construct
  source 1..20: note = Seed: SATGFKQSSKALQRPVASDF
SATGRKQSSIALSRPVASDF

SEQ ID NO: 17616 - protein, 20 aa, synthetic construct
  source 1..20: note = Seed: SATGFKQSSKALQRPVASDF
SATGRKQSSIALVRPVASDF

SEQ ID NO: 17617 - protein, 20 aa, synthetic construct
  source 1..20: note = Seed: SATGFKQSSKALQRPVASDF
SATGRKQSSLALARPVASDF

SEQ ID NO: 17618 - protein, 20 aa, synthetic construct
  source 1..20: note = Seed: SATGFKQSSKALQRPVASDF
SATGRKQSSVALARPVASDF

SEQ ID NO: 17619 - protein, 20 aa, synthetic construct
  source 1..20: note = Seed: SATGFKQSSKALQRPVASDF
SATGRKQSSVALSRPVASDF

SEQ ID NO: 17620 - protein, 20 aa, synthetic construct
  source 1..20: note = Seed: SATGFKQSSKALQRPVASDF
SATGRKQSSVALVRPVASDF

SEQ ID NO: 17621 - protein, 20 aa, synthetic construct
  source 1..20: note = Seed: SATGFKQSSKALQRPVASDF
SATGRKQTSFALARPVASDF

SEQ ID NO: 17622 - protein, 20 aa, synthetic construct
  source 1..20: note = Seed: SATGFKQSSKALQRPVASDF
SATGRKQTSFALFRPVASDF

SEQ ID NO: 17623 - protein, 20 aa, synthetic construct
  source 1..20: note = Seed: SATGFKQSSKALQRPVASDF
SATGRKQTSFALIRPVASDF

SEQ ID NO: 17624 - protein, 20 aa, synthetic construct
  source 1..20: note = Seed: SATGFKQSSKALQRPVASDF
SATGRKQTSFALLRPVASDF

SEQ ID NO: 17625 - protein, 20 aa, synthetic construct
  source 1..20: note = Seed: SATGFKQSSKALQRPVASDF
SATGRKQTSFALVRPVASDF

SEQ ID NO: 17626 - protein, 20 aa, synthetic construct
  source 1..20: note = Seed: SATGFKQSSKALQRPVASDF
SATGRKQTSIALARPVASDF

SEQ ID NO: 17627 - protein, 20 aa, synthetic construct
  source 1..20: note = Seed: SATGFKQSSKALQRPVASDF
SATGRKQTSVALARPVASDF

SEQ ID NO: 17628 - protein, 20 aa, synthetic construct
  source 1..20: note = Seed: SATGFKQSSKALQRPVASDF
SATGRKQVSAALARPVASDF

SEQ ID NO: 17629 - protein, 20 aa, synthetic construct
  source 1..20: note = Seed: SATGFKQSSKALQRPVASDF
SATGRKQVSAALIRPVASDF

SEQ ID NO: 17630 - protein, 20 aa, synthetic construct
  source 1..20: note = Seed: SATGFKQSSKALQRPVASDF
SATGRKQVSAALVRPVASDF

SEQ ID NO: 17631 - protein, 20 aa, synthetic construct
  source 1..20: note = Seed: SATGFKQSSKALQRPVASDF
SATGRKQVSFALARPVASDF

SEQ ID NO: 17632 - protein, 20 aa, synthetic construct
  source 1..20: note = Seed: SATGFKQSSKALQRPVASDF
SATGRKQVSFALERPVASDF

SEQ ID NO: 17633 - protein, 20 aa, synthetic construct
  source 1..20: note = Seed: SATGFKQSSKALQRPVASDF
SATGRKQVSFALIRPVASDF

SEQ ID NO: 17634 - protein, 20 aa, synthetic construct
  source 1..20: note = Seed: SATGFKQSSKALQRPVASDF
SATGRKQVSFALLRPVASDF

SEQ ID NO: 17635 - protein, 20 aa, synthetic construct
  source 1..20: note = Seed: SATGFKQSSKALQRPVASDF
SATGRKQVSFALSRPVASDF

SEQ ID NO: 17636 - protein, 20 aa, synthetic construct
  source 1..20: note = Seed: SATGFKQSSKALQRPVASDF
SATGRKQVSIALARPVASDF

SEQ ID NO: 17637 - protein, 20 aa, synthetic construct
  source 1..20: note = Seed: SATGFKQSSKALQRPVASDF
SATGRKQVSIALSRPVASDF

SEQ ID NO: 17638 - protein, 20 aa, synthetic construct
  source 1..20: note = Seed: SATGFKQSSKALQRPVASDF
SATGRKQVSLALARPVASDF

SEQ ID NO: 17639 - protein, 20 aa, synthetic construct
  source 1..20: note = Seed: SATGFKQSSKALQRPVASDF
SATGRKQVSLALIRPVASDF

SEQ ID NO: 17640 - protein, 20 aa, synthetic construct
  source 1..20: note = Seed: SATGFKQSSKALQRPVASDF
SATGRKQVSMALARPVASDF

SEQ ID NO: 17641 - protein, 20 aa, synthetic construct
  source 1..20: note = Seed: SATGFKQSSKALQRPVASDF
SATGRKQVSVALARPVASDF

SEQ ID NO: 17642 - protein, 20 aa, synthetic construct
  source 1..20: note = Seed: SATGFKQSSKALQRPVASDF
SATGRKQWSIALARPVASDF

SEQ ID NO: 17643 - protein, 20 aa, synthetic construct
  source 1..20: note = Seed: SATGFKQSSKALQRPVASDF
SATGRKQWSLALARPVASDF

SEQ ID NO: 17644 - protein, 20 aa, synthetic construct
  source 1..20: note = Seed: SATGFKQSSKALQRPVASDF
SATGRKQWSLALIRPVASDF

SEQ ID NO: 17645 - protein, 20 aa, synthetic construct
  source 1..20: note = Seed: SATGFKQSSKALQRPVASDF
SATGRKQWSLALMRPVASDF

SEQ ID NO: 17646 - protein, 20 aa, synthetic construct
  source 1..20: note = Seed: SATGFKQSSKALQRPVASDF
SATGRKQWSMALARPVASDF

SEQ ID NO: 17647 - protein, 20 aa, synthetic construct
  source 1..20: note = Seed: SATGFKQSSKALQRPVASDF
SATGRKQWSVALARPVASDF

SEQ ID NO: 17648 - protein, 20 aa, synthetic construct
  source 1..20: note = Seed: SATGFKQSSKALQRPVASDF
SATGRKQYSIALARPVASDF

SEQ ID NO: 17649 - protein, 20 aa, synthetic construct
  source 1..20: note = Seed: SATGFKQSSKALQRPVASDF
SATGRKQYSIALSRPVASDF

SEQ ID NO: 17650 - protein, 20 aa, synthetic construct
  source 1..20: note = Seed: SATGFKQSSKALQRPVASDF
SATGRKQYSIALVRPVASDF

SEQ ID NO: 17651 - protein, 20 aa, synthetic construct
  source 1..20: note = Seed: SATGFKQSSKALQRPVASDF
SATGRKQYSLALARPVASDF

SEQ ID NO: 17652 - protein, 20 aa, synthetic construct
  source 1..20: note = Seed: SATGFKQSSKALQRPVASDF
SATGRKQYSLALMRPVASDF

SEQ ID NO: 17653 - protein, 20 aa, synthetic construct
  source 1..20: note = Seed: SATGFKQSSKALQRPVASDF
SATGRKQYSVALARPVASDF

SEQ ID NO: 17654 - protein, 20 aa, synthetic construct
  source 1..20: note = Seed: SATGFKQSSKALQRPVASDF
SATGSKQLSAALLRPVASDF

SEQ ID NO: 17655 - protein, 20 aa, synthetic construct
  source 1..20: note = Seed: SATGFKQSSKALQRPVASDF
SATGSKQLSGALIRPVASDF

SEQ ID NO: 17656 - protein, 20 aa, synthetic construct
  source 1..20: note = Seed: SATGFKQSSKALQRPVASDF
SATGSKQLSGALVRPVASDF

SEQ ID NO: 17657 - protein, 20 aa, synthetic construct
  source 1..20: note = Seed: SATGFKQSSKALQRPVASDF
SATGTKQFSIALARPVASDF

SEQ ID NO: 17658 - protein, 20 aa, synthetic construct
  source 1..20: note = Seed: SATGFKQSSKALQRPVASDF
SATGTKQFSLALARPVASDF

SEQ ID NO: 17659 - protein, 20 aa, synthetic construct
  source 1..20: note = Seed: SATGFKQSSKALQRPVASDF
SATGTKQFSVALARPVASDF

SEQ ID NO: 17660 - protein, 20 aa, synthetic construct
  source 1..20: note = Seed: SATGFKQSSKALQRPVASDF
SATGTKQLSAALIRPVASDF

SEQ ID NO: 17661 - protein, 20 aa, synthetic construct
  source 1..20: note = Seed: SATGFKQSSKALQRPVASDF
SATGTKQLSAALLRPVASDF

SEQ ID NO: 17662 - protein, 20 aa, synthetic construct
  source 1..20: note = Seed: SATGFKQSSKALQRPVASDF
SATGTKQLSAALMRPVASDF

SEQ ID NO: 17663 - protein, 20 aa, synthetic construct
  source 1..20: note = Seed: SATGFKQSSKALQRPVASDF
SATGTKQLSGALIRPVASDF

SEQ ID NO: 17664 - protein, 20 aa, synthetic construct
  source 1..20: note = Seed: SATGFKQSSKALQRPVASDF
SATGTKQLSGALLRPVASDF

SEQ ID NO: 17665 - protein, 20 aa, synthetic construct
  source 1..20: note = Seed: SATGFKQSSKALQRPVASDF
SATGTKQLSGALVRPVASDF

SEQ ID NO: 17666 - protein, 20 aa, synthetic construct
  source 1..20: note = Seed: SATGFKQSSKALQRPVASDF
SATGTKQMSAALIRPVASDF

SEQ ID NO: 17667 - protein, 20 aa, synthetic construct
  source 1..20: note = Seed: SATGFKQSSKALQRPVASDF
SATGTKQMSAALLRPVASDF

SEQ ID NO: 17668 - protein, 20 aa, synthetic construct
  source 1..20: note = Seed: SATGFKQSSKALQRPVASDF
SATGTKQMSGALIRPVASDF

SEQ ID NO: 17669 - protein, 20 aa, synthetic construct
  source 1..20: note = Seed: SATGFKQSSKALQRPVASDF
SATGTKQMSGALVRPVASDF

SEQ ID NO: 17670 - protein, 20 aa, synthetic construct
  source 1..20: note = Seed: SATGFKQSSKALQRPVASDF
SATGTKQMSVALNRPVASDF

SEQ ID NO: 17671 - protein, 20 aa, synthetic construct
  source 1..20: note = Seed: SATGFKQSSKALQRPVASDF
SATGTKQYSIALARPVASDF

SEQ ID NO: 17672 - protein, 20 aa, synthetic construct
  source 1..20: note = Seed: SATGFKQSSKALQRPVASDF
SATGTKQYSLALARPVASDF

SEQ ID NO: 17673 - protein, 20 aa, synthetic construct
  source 1..20: note = Seed: SATGFKQSSKALQRPVASDF
SATGVKQASAALARPVASDF

SEQ ID NO: 17674 - protein, 20 aa, synthetic construct
  source 1..20: note = Seed: SATGFKQSSKALQRPVASDF
SATGVKQASAALIRPVASDF

SEQ ID NO: 17675 - protein, 20 aa, synthetic construct
  source 1..20: note = Seed: SATGFKQSSKALQRPVASDF
SATGVKQASAALLRPVASDF

SEQ ID NO: 17676 - protein, 20 aa, synthetic construct
  source 1..20: note = Seed: SATGFKQSSKALQRPVASDF
SATGVKQASAALMRPVASDF

SEQ ID NO: 17677 - protein, 20 aa, synthetic construct
  source 1..20: note = Seed: SATGFKQSSKALQRPVASDF
SATGVKQASAALNRPVASDF

SEQ ID NO: 17678 - protein, 20 aa, synthetic construct
  source 1..20: note = Seed: SATGFKQSSKALQRPVASDF
SATGVKQASAALSRPVASDF

SEQ ID NO: 17679 - protein, 20 aa, synthetic construct
  source 1..20: note = Seed: SATGFKQSSKALQRPVASDF
SATGVKQASAALTRPVASDF

SEQ ID NO: 17680 - protein, 20 aa, synthetic construct
  source 1..20: note = Seed: SATGFKQSSKALQRPVASDF
SATGVKQASAALVRPVASDF

SEQ ID NO: 17681 - protein, 20 aa, synthetic construct
  source 1..20: note = Seed: SATGFKQSSKALQRPVASDF
SATGVKQASFALARPVASDF

SEQ ID NO: 17682 - protein, 20 aa, synthetic construct
  source 1..20: note = Seed: SATGFKQSSKALQRPVASDF
SATGVKQASFALFRPVASDF

SEQ ID NO: 17683 - protein, 20 aa, synthetic construct
  source 1..20: note = Seed: SATGFKQSSKALQRPVASDF
SATGVKQASFALIRPVASDF

SEQ ID NO: 17684 - protein, 20 aa, synthetic construct
  source 1..20: note = Seed: SATGFKQSSKALQRPVASDF
SATGVKQASFALLRPVASDF

SEQ ID NO: 17685 - protein, 20 aa, synthetic construct
  source 1..20: note = Seed: SATGFKQSSKALQRPVASDF
SATGVKQASFALVRPVASDF

SEQ ID NO: 17686 - protein, 20 aa, synthetic construct
  source 1..20: note = Seed: SATGFKQSSKALQRPVASDF
SATGVKQASGALARPVASDF

SEQ ID NO: 17687 - protein, 20 aa, synthetic construct
  source 1..20: note = Seed: SATGFKQSSKALQRPVASDF
SATGVKQASGALIRPVASDF

SEQ ID NO: 17688 - protein, 20 aa, synthetic construct
  source 1..20: note = Seed: SATGFKQSSKALQRPVASDF
SATGVKQASGALLRPVASDF

SEQ ID NO: 17689 - protein, 20 aa, synthetic construct
  source 1..20: note = Seed: SATGFKQSSKALQRPVASDF
SATGVKQASGALMRPVASDF

SEQ ID NO: 17690 - protein, 20 aa, synthetic construct
  source 1..20: note = Seed: SATGFKQSSKALQRPVASDF
SATGVKQASGALVRPVASDF

SEQ ID NO: 17691 - protein, 20 aa, synthetic construct
  source 1..20: note = Seed: SATGFKQSSKALQRPVASDF
SATGVKQASIALHRPVASDF

SEQ ID NO: 17692 - protein, 20 aa, synthetic construct
  source 1..20: note = Seed: SATGFKQSSKALQRPVASDF
SATGVKQASIALNRPVASDF

SEQ ID NO: 17693 - protein, 20 aa, synthetic construct
  source 1..20: note = Seed: SATGFKQSSKALQRPVASDF
SATGVKQASIALSRPVASDF

SEQ ID NO: 17694 - protein, 20 aa, synthetic construct
  source 1..20: note = Seed: SATGFKQSSKALQRPVASDF
SATGVKQASKALARPVASDF

SEQ ID NO: 17695 - protein, 20 aa, synthetic construct
  source 1..20: note = Seed: SATGFKQSSKALQRPVASDF
SATGVKQASKALKRPVASDF

SEQ ID NO: 17696 - protein, 20 aa, synthetic construct
  source 1..20: note = Seed: SATGFKQSSKALQRPVASDF
SATGVKQASKALRRPVASDF

SEQ ID NO: 17697 - protein, 20 aa, synthetic construct
  source 1..20: note = Seed: SATGFKQSSKALQRPVASDF
SATGVKQASKALSRPVASDF

SEQ ID NO: 17698 - protein, 20 aa, synthetic construct
  source 1..20: note = Seed: SATGFKQSSKALQRPVASDF
SATGVKQASLALNRPVASDF

SEQ ID NO: 17699 - protein, 20 aa, synthetic construct
  source 1..20: note = Seed: SATGFKQSSKALQRPVASDF
SATGVKQASNALARPVASDF

SEQ ID NO: 17700 - protein, 20 aa, synthetic construct
  source 1..20: note = Seed: SATGFKQSSKALQRPVASDF
SATGVKQASPALARPVASDF

SEQ ID NO: 17701 - protein, 20 aa, synthetic construct
  source 1..20: note = Seed: SATGFKQSSKALQRPVASDF
SATGVKQASPALIRPVASDF

SEQ ID NO: 17702 - protein, 20 aa, synthetic construct
  source 1..20: note = Seed: SATGFKQSSKALQRPVASDF
SATGVKQASPALLRPVASDF

SEQ ID NO: 17703 - protein, 20 aa, synthetic construct
  source 1..20: note = Seed: SATGFKQSSKALQRPVASDF
SATGVKQASPALMRPVASDF

SEQ ID NO: 17704 - protein, 20 aa, synthetic construct
  source 1..20: note = Seed: SATGFKQSSKALQRPVASDF
SATGVKQASPALSRPVASDF

SEQ ID NO: 17705 - protein, 20 aa, synthetic construct
  source 1..20: note = Seed: SATGFKQSSKALQRPVASDF
SATGVKQASPALVRPVASDF

SEQ ID NO: 17706 - protein, 20 aa, synthetic construct
  source 1..20: note = Seed: SATGFKQSSKALQRPVASDF
SATGVKQASRALARPVASDF

SEQ ID NO: 17707 - protein, 20 aa, synthetic construct
  source 1..20: note = Seed: SATGFKQSSKALQRPVASDF
SATGVKQASRALGRPVASDF

SEQ ID NO: 17708 - protein, 20 aa, synthetic construct
  source 1..20: note = Seed: SATGFKQSSKALQRPVASDF
SATGVKQASRALHRPVASDF

SEQ ID NO: 17709 - protein, 20 aa, synthetic construct
  source 1..20: note = Seed: SATGFKQSSKALQRPVASDF
SATGVKQASRALKRPVASDF

SEQ ID NO: 17710 - protein, 20 aa, synthetic construct
  source 1..20: note = Seed: SATGFKQSSKALQRPVASDF
SATGVKQASRALQRPVASDF

SEQ ID NO: 17711 - protein, 20 aa, synthetic construct
  source 1..20: note = Seed: SATGFKQSSKALQRPVASDF
SATGVKQASRALRRPVASDF

SEQ ID NO: 17712 - protein, 20 aa, synthetic construct
  source 1..20: note = Seed: SATGFKQSSKALQRPVASDF
SATGVKQASRALSRPVASDF

SEQ ID NO: 17713 - protein, 20 aa, synthetic construct
  source 1..20: note = Seed: SATGFKQSSKALQRPVASDF
SATGVKQASSALARPVASDF

SEQ ID NO: 17714 - protein, 20 aa, synthetic construct
  source 1..20: note = Seed: SATGFKQSSKALQRPVASDF
SATGVKQASSALIRPVASDF

SEQ ID NO: 17715 - protein, 20 aa, synthetic construct
  source 1..20: note = Seed: SATGFKQSSKALQRPVASDF
SATGVKQASSALLRPVASDF

SEQ ID NO: 17716 - protein, 20 aa, synthetic construct
  source 1..20: note = Seed: SATGFKQSSKALQRPVASDF
SATGVKQASSALMRPVASDF

SEQ ID NO: 17717 - protein, 20 aa, synthetic construct
  source 1..20: note = Seed: SATGFKQSSKALQRPVASDF
SATGVKQASSALNRPVASDF

SEQ ID NO: 17718 - protein, 20 aa, synthetic construct
  source 1..20: note = Seed: SATGFKQSSKALQRPVASDF
SATGVKQASSALSRPVASDF

SEQ ID NO: 17719 - protein, 20 aa, synthetic construct
  source 1..20: note = Seed: SATGFKQSSKALQRPVASDF
SATGVKQASSALVRPVASDF

SEQ ID NO: 17720 - protein, 20 aa, synthetic construct
  source 1..20: note = Seed: SATGFKQSSKALQRPVASDF
SATGVKQASTALARPVASDF

SEQ ID NO: 17721 - protein, 20 aa, synthetic construct
  source 1..20: note = Seed: SATGFKQSSKALQRPVASDF
SATGVKQASTALNRPVASDF

SEQ ID NO: 17722 - protein, 20 aa, synthetic construct
  source 1..20: note = Seed: SATGFKQSSKALQRPVASDF
SATGVKQASTALSRPVASDF

SEQ ID NO: 17723 - protein, 20 aa, synthetic construct
  source 1..20: note = Seed: SATGFKQSSKALQRPVASDF
SATGVKQASVALARPVASDF

SEQ ID NO: 17724 - protein, 20 aa, synthetic construct
  source 1..20: note = Seed: SATGFKQSSKALQRPVASDF
SATGVKQASVALIRPVASDF

SEQ ID NO: 17725 - protein, 20 aa, synthetic construct
  source 1..20: note = Seed: SATGFKQSSKALQRPVASDF
SATGVKQASVALNRPVASDF

SEQ ID NO: 17726 - protein, 20 aa, synthetic construct
  source 1..20: note = Seed: SATGFKQSSKALQRPVASDF
SATGVKQASVALQRPVASDF

SEQ ID NO: 17727 - protein, 20 aa, synthetic construct
  source 1..20: note = Seed: SATGFKQSSKALQRPVASDF
SATGVKQASVALSRPVASDF

SEQ ID NO: 17728 - protein, 20 aa, synthetic construct
  source 1..20: note = Seed: SATGFKQSSKALQRPVASDF
SATGVKQASVALTRPVASDF

SEQ ID NO: 17729 - protein, 20 aa, synthetic construct
  source 1..20: note = Seed: SATGFKQSSKALQRPVASDF
SATGVKQASVALVRPVASDF

SEQ ID NO: 17730 - protein, 20 aa, synthetic construct
  source 1..20: note = Seed: SATGFKQSSKALQRPVASDF
SATGVKQCSAALARPVASDF

SEQ ID NO: 17731 - protein, 20 aa, synthetic construct
  source 1..20: note = Seed: SATGFKQSSKALQRPVASDF
SATGVKQCSIALSRPVASDF

SEQ ID NO: 17732 - protein, 20 aa, synthetic construct
  source 1..20: note = Seed: SATGFKQSSKALQRPVASDF
SATGVKQCSSALARPVASDF

SEQ ID NO: 17733 - protein, 20 aa, synthetic construct
  source 1..20: note = Seed: SATGFKQSSKALQRPVASDF
SATGVKQCSVALARPVASDF

SEQ ID NO: 17734 - protein, 20 aa, synthetic construct
  source 1..20: note = Seed: SATGFKQSSKALQRPVASDF
SATGVKQESAALARPVASDF

SEQ ID NO: 17735 - protein, 20 aa, synthetic construct
  source 1..20: note = Seed: SATGFKQSSKALQRPVASDF
SATGVKQESAALIRPVASDF

SEQ ID NO: 17736 - protein, 20 aa, synthetic construct
  source 1..20: note = Seed: SATGFKQSSKALQRPVASDF
SATGVKQESAALLRPVASDF

SEQ ID NO: 17737 - protein, 20 aa, synthetic construct
  source 1..20: note = Seed: SATGFKQSSKALQRPVASDF
SATGVKQESAALVRPVASDF

SEQ ID NO: 17738 - protein, 20 aa, synthetic construct
  source 1..20: note = Seed: SATGFKQSSKALQRPVASDF
SATGVKQESFALIRPVASDF

SEQ ID NO: 17739 - protein, 20 aa, synthetic construct
  source 1..20: note = Seed: SATGFKQSSKALQRPVASDF
SATGVKQESFALLRPVASDF

SEQ ID NO: 17740 - protein, 20 aa, synthetic construct
  source 1..20: note = Seed: SATGFKQSSKALQRPVASDF
SATGVKQESFALVRPVASDF

SEQ ID NO: 17741 - protein, 20 aa, synthetic construct
  source 1..20: note = Seed: SATGFKQSSKALQRPVASDF
SATGVKQESIALSRPVASDF

SEQ ID NO: 17742 - protein, 20 aa, synthetic construct
  source 1..20: note = Seed: SATGFKQSSKALQRPVASDF
SATGVKQESVALARPVASDF

SEQ ID NO: 17743 - protein, 20 aa, synthetic construct
  source 1..20: note = Seed: SATGFKQSSKALQRPVASDF
SATGVKQESVALVRPVASDF

SEQ ID NO: 17744 - protein, 20 aa, synthetic construct
  source 1..20: note = Seed: SATGFKQSSKALQRPVASDF
SATGVKQFSAALLRPVASDF

SEQ ID NO: 17745 - protein, 20 aa, synthetic construct
  source 1..20: note = Seed: SATGFKQSSKALQRPVASDF
SATGVKQFSAALRRPVASDF

SEQ ID NO: 17746 - protein, 20 aa, synthetic construct
  source 1..20: note = Seed: SATGFKQSSKALQRPVASDF
SATGVKQFSAALVRPVASDF

SEQ ID NO: 17747 - protein, 20 aa, synthetic construct
  source 1..20: note = Seed: SATGFKQSSKALQRPVASDF
SATGVKQFSFALERPVASDF

SEQ ID NO: 17748 - protein, 20 aa, synthetic construct
  source 1..20: note = Seed: SATGFKQSSKALQRPVASDF
SATGVKQFSGALARPVASDF

SEQ ID NO: 17749 - protein, 20 aa, synthetic construct
  source 1..20: note = Seed: SATGFKQSSKALQRPVASDF
SATGVKQFSGALIRPVASDF

SEQ ID NO: 17750 - protein, 20 aa, synthetic construct
  source 1..20: note = Seed: SATGFKQSSKALQRPVASDF
SATGVKQFSGALLRPVASDF

SEQ ID NO: 17751 - protein, 20 aa, synthetic construct
  source 1..20: note = Seed: SATGFKQSSKALQRPVASDF
SATGVKQFSGALMRPVASDF

SEQ ID NO: 17752 - protein, 20 aa, synthetic construct
  source 1..20: note = Seed: SATGFKQSSKALQRPVASDF
SATGVKQFSGALVRPVASDF

SEQ ID NO: 17753 - protein, 20 aa, synthetic construct
  source 1..20: note = Seed: SATGFKQSSKALQRPVASDF
SATGVKQFSHALKRPVASDF

SEQ ID NO: 17754 - protein, 20 aa, synthetic construct
  source 1..20: note = Seed: SATGFKQSSKALQRPVASDF
SATGVKQFSHALRRPVASDF

SEQ ID NO: 17755 - protein, 20 aa, synthetic construct
  source 1..20: note = Seed: SATGFKQSSKALQRPVASDF
SATGVKQFSIALARPVASDF

SEQ ID NO: 17756 - protein, 20 aa, synthetic construct
  source 1..20: note = Seed: SATGFKQSSKALQRPVASDF
SATGVKQFSKALARPVASDF

SEQ ID NO: 17757 - protein, 20 aa, synthetic construct
  source 1..20: note = Seed: SATGFKQSSKALQRPVASDF
SATGVKQFSKALGRPVASDF

SEQ ID NO: 17758 - protein, 20 aa, synthetic construct
  source 1..20: note = Seed: SATGFKQSSKALQRPVASDF
SATGVKQFSKALHRPVASDF

SEQ ID NO: 17759 - protein, 20 aa, synthetic construct
  source 1..20: note = Seed: SATGFKQSSKALQRPVASDF
SATGVKQFSKALIRPVASDF

SEQ ID NO: 17760 - protein, 20 aa, synthetic construct
  source 1..20: note = Seed: SATGFKQSSKALQRPVASDF
SATGVKQFSKALKRPVASDF

SEQ ID NO: 17761 - protein, 20 aa, synthetic construct
  source 1..20: note = Seed: SATGFKQSSKALQRPVASDF
SATGVKQFSKALLRPVASDF

SEQ ID NO: 17762 - protein, 20 aa, synthetic construct
  source 1..20: note = Seed: SATGFKQSSKALQRPVASDF
SATGVKQFSKALMRPVASDF

SEQ ID NO: 17763 - protein, 20 aa, synthetic construct
  source 1..20: note = Seed: SATGFKQSSKALQRPVASDF
SATGVKQFSKALQRPVASDF

SEQ ID NO: 17764 - protein, 20 aa, synthetic construct
  source 1..20: note = Seed: SATGFKQSSKALQRPVASDF
SATGVKQFSKALRRPVASDF

SEQ ID NO: 17765 - protein, 20 aa, synthetic construct
  source 1..20: note = Seed: SATGFKQSSKALQRPVASDF
SATGVKQFSKALSRPVASDF

SEQ ID NO: 17766 - protein, 20 aa, synthetic construct
  source 1..20: note = Seed: SATGFKQSSKALQRPVASDF
SATGVKQFSKALTRPVASDF

SEQ ID NO: 17767 - protein, 20 aa, synthetic construct
  source 1..20: note = Seed: SATGFKQSSKALQRPVASDF
SATGVKQFSKALVRPVASDF

SEQ ID NO: 17768 - protein, 20 aa, synthetic construct
  source 1..20: note = Seed: SATGFKQSSKALQRPVASDF
SATGVKQFSLALARPVASDF

SEQ ID NO: 17769 - protein, 20 aa, synthetic construct
  source 1..20: note = Seed: SATGFKQSSKALQRPVASDF
SATGVKQFSLALSRPVASDF

SEQ ID NO: 17770 - protein, 20 aa, synthetic construct
  source 1..20: note = Seed: SATGFKQSSKALQRPVASDF
SATGVKQFSNALARPVASDF

SEQ ID NO: 17771 - protein, 20 aa, synthetic construct
  source 1..20: note = Seed: SATGFKQSSKALQRPVASDF
SATGVKQFSNALLRPVASDF

SEQ ID NO: 17772 - protein, 20 aa, synthetic construct
  source 1..20: note = Seed: SATGFKQSSKALQRPVASDF
SATGVKQFSPALLRPVASDF

SEQ ID NO: 17773 - protein, 20 aa, synthetic construct
  source 1..20: note = Seed: SATGFKQSSKALQRPVASDF
SATGVKQFSRALARPVASDF

SEQ ID NO: 17774 - protein, 20 aa, synthetic construct
  source 1..20: note = Seed: SATGFKQSSKALQRPVASDF
SATGVKQFSRALGRPVASDF

SEQ ID NO: 17775 - protein, 20 aa, synthetic construct
  source 1..20: note = Seed: SATGFKQSSKALQRPVASDF
SATGVKQFSRALHRPVASDF

SEQ ID NO: 17776 - protein, 20 aa, synthetic construct
  source 1..20: note = Seed: SATGFKQSSKALQRPVASDF
SATGVKQFSRALIRPVASDF

SEQ ID NO: 17777 - protein, 20 aa, synthetic construct
  source 1..20: note = Seed: SATGFKQSSKALQRPVASDF
SATGVKQFSRALKRPVASDF

SEQ ID NO: 17778 - protein, 20 aa, synthetic construct
  source 1..20: note = Seed: SATGFKQSSKALQRPVASDF
SATGVKQFSRALLRPVASDF

SEQ ID NO: 17779 - protein, 20 aa, synthetic construct
  source 1..20: note = Seed: SATGFKQSSKALQRPVASDF
SATGVKQFSRALMRPVASDF

SEQ ID NO: 17780 - protein, 20 aa, synthetic construct
  source 1..20: note = Seed: SATGFKQSSKALQRPVASDF
SATGVKQFSRALQRPVASDF

SEQ ID NO: 17781 - protein, 20 aa, synthetic construct
  source 1..20: note = Seed: SATGFKQSSKALQRPVASDF
SATGVKQFSRALRRPVASDF

SEQ ID NO: 17782 - protein, 20 aa, synthetic construct
  source 1..20: note = Seed: SATGFKQSSKALQRPVASDF
SATGVKQFSRALSRPVASDF

SEQ ID NO: 17783 - protein, 20 aa, synthetic construct
  source 1..20: note = Seed: SATGFKQSSKALQRPVASDF
SATGVKQFSRALTRPVASDF

SEQ ID NO: 17784 - protein, 20 aa, synthetic construct
  source 1..20: note = Seed: SATGFKQSSKALQRPVASDF
SATGVKQFSRALVRPVASDF

SEQ ID NO: 17785 - protein, 20 aa, synthetic construct
  source 1..20: note = Seed: SATGFKQSSKALQRPVASDF
SATGVKQFSRALYRPVASDF

SEQ ID NO: 17786 - protein, 20 aa, synthetic construct
  source 1..20: note = Seed: SATGFKQSSKALQRPVASDF
SATGVKQFSSALARPVASDF

SEQ ID NO: 17787 - protein, 20 aa, synthetic construct
  source 1..20: note = Seed: SATGFKQSSKALQRPVASDF
SATGVKQFSSALLRPVASDF

SEQ ID NO: 17788 - protein, 20 aa, synthetic construct
  source 1..20: note = Seed: SATGFKQSSKALQRPVASDF
SATGVKQFSSALRRPVASDF

SEQ ID NO: 17789 - protein, 20 aa, synthetic construct
  source 1..20: note = Seed: SATGFKQSSKALQRPVASDF
SATGVKQFSSALVRPVASDF

SEQ ID NO: 17790 - protein, 20 aa, synthetic construct
  source 1..20: note = Seed: SATGFKQSSKALQRPVASDF
SATGVKQFSTALQRPVASDF

SEQ ID NO: 17791 - protein, 20 aa, synthetic construct
  source 1..20: note = Seed: SATGFKQSSKALQRPVASDF
SATGVKQFSTALRRPVASDF

SEQ ID NO: 17792 - protein, 20 aa, synthetic construct
  source 1..20: note = Seed: SATGFKQSSKALQRPVASDF
SATGVKQFSVALARPVASDF

SEQ ID NO: 17793 - protein, 20 aa, synthetic construct
  source 1..20: note = Seed: SATGFKQSSKALQRPVASDF
SATGVKQFSVALRRPVASDF

SEQ ID NO: 17794 - protein, 20 aa, synthetic construct
  source 1..20: note = Seed: SATGFKQSSKALQRPVASDF
SATGVKQGSAALIRPVASDF

SEQ ID NO: 17795 - protein, 20 aa, synthetic construct
  source 1..20: note = Seed: SATGFKQSSKALQRPVASDF
SATGVKQGSAALLRPVASDF

SEQ ID NO: 17796 - protein, 20 aa, synthetic construct
  source 1..20: note = Seed: SATGFKQSSKALQRPVASDF
SATGVKQGSAALVRPVASDF

SEQ ID NO: 17797 - protein, 20 aa, synthetic construct
  source 1..20: note = Seed: SATGFKQSSKALQRPVASDF
SATGVKQHSIALRRPVASDF

SEQ ID NO: 17798 - protein, 20 aa, synthetic construct
  source 1..20: note = Seed: SATGFKQSSKALQRPVASDF
SATGVKQHSRALRRPVASDF

SEQ ID NO: 17799 - protein, 20 aa, synthetic construct
  source 1..20: note = Seed: SATGFKQSSKALQRPVASDF
SATGVKQHSVALRRPVASDF

SEQ ID NO: 17800 - protein, 20 aa, synthetic construct
  source 1..20: note = Seed: SATGFKQSSKALQRPVASDF
SATGVKQHSVALSRPVASDF

SEQ ID NO: 17801 - protein, 20 aa, synthetic construct
  source 1..20: note = Seed: SATGFKQSSKALQRPVASDF
SATGVKQISAALARPVASDF

SEQ ID NO: 17802 - protein, 20 aa, synthetic construct
  source 1..20: note = Seed: SATGFKQSSKALQRPVASDF
SATGVKQISAALCRPVASDF

SEQ ID NO: 17803 - protein, 20 aa, synthetic construct
  source 1..20: note = Seed: SATGFKQSSKALQRPVASDF
SATGVKQISAALGRPVASDF

SEQ ID NO: 17804 - protein, 20 aa, synthetic construct
  source 1..20: note = Seed: SATGFKQSSKALQRPVASDF
SATGVKQISAALIRPVASDF

SEQ ID NO: 17805 - protein, 20 aa, synthetic construct
  source 1..20: note = Seed: SATGFKQSSKALQRPVASDF
SATGVKQISAALLRPVASDF

SEQ ID NO: 17806 - protein, 20 aa, synthetic construct
  source 1..20: note = Seed: SATGFKQSSKALQRPVASDF
SATGVKQISAALMRPVASDF

SEQ ID NO: 17807 - protein, 20 aa, synthetic construct
  source 1..20: note = Seed: SATGFKQSSKALQRPVASDF
SATGVKQISAALNRPVASDF

SEQ ID NO: 17808 - protein, 20 aa, synthetic construct
  source 1..20: note = Seed: SATGFKQSSKALQRPVASDF
SATGVKQISAALRRPVASDF

SEQ ID NO: 17809 - protein, 20 aa, synthetic construct
  source 1..20: note = Seed: SATGFKQSSKALQRPVASDF
SATGVKQISAALSRPVASDF

SEQ ID NO: 17810 - protein, 20 aa, synthetic construct
  source 1..20: note = Seed: SATGFKQSSKALQRPVASDF
SATGVKQISAALTRPVASDF

SEQ ID NO: 17811 - protein, 20 aa, synthetic construct
  source 1..20: note = Seed: SATGFKQSSKALQRPVASDF
SATGVKQISAALVRPVASDF

SEQ ID NO: 17812 - protein, 20 aa, synthetic construct
  source 1..20: note = Seed: SATGFKQSSKALQRPVASDF
SATGVKQISFALARPVASDF

SEQ ID NO: 17813 - protein, 20 aa, synthetic construct
  source 1..20: note = Seed: SATGFKQSSKALQRPVASDF
SATGVKQISFALERPVASDF

SEQ ID NO: 17814 - protein, 20 aa, synthetic construct
  source 1..20: note = Seed: SATGFKQSSKALQRPVASDF
SATGVKQISFALSRPVASDF

SEQ ID NO: 17815 - protein, 20 aa, synthetic construct
  source 1..20: note = Seed: SATGFKQSSKALQRPVASDF
SATGVKQISFALTRPVASDF

SEQ ID NO: 17816 - protein, 20 aa, synthetic construct
  source 1..20: note = Seed: SATGFKQSSKALQRPVASDF
SATGVKQISFALVRPVASDF

SEQ ID NO: 17817 - protein, 20 aa, synthetic construct
  source 1..20: note = Seed: SATGFKQSSKALQRPVASDF
SATGVKQISGALARPVASDF

SEQ ID NO: 17818 - protein, 20 aa, synthetic construct
  source 1..20: note = Seed: SATGFKQSSKALQRPVASDF
SATGVKQISGALIRPVASDF

SEQ ID NO: 17819 - protein, 20 aa, synthetic construct
  source 1..20: note = Seed: SATGFKQSSKALQRPVASDF
SATGVKQISGALLRPVASDF

SEQ ID NO: 17820 - protein, 20 aa, synthetic construct
  source 1..20: note = Seed: SATGFKQSSKALQRPVASDF
SATGVKQISGALMRPVASDF

SEQ ID NO: 17821 - protein, 20 aa, synthetic construct
  source 1..20: note = Seed: SATGFKQSSKALQRPVASDF
SATGVKQISGALNRPVASDF

SEQ ID NO: 17822 - protein, 20 aa, synthetic construct
  source 1..20: note = Seed: SATGFKQSSKALQRPVASDF
SATGVKQISGALSRPVASDF

SEQ ID NO: 17823 - protein, 20 aa, synthetic construct
  source 1..20: note = Seed: SATGFKQSSKALQRPVASDF
SATGVKQISGALTRPVASDF

SEQ ID NO: 17824 - protein, 20 aa, synthetic construct
  source 1..20: note = Seed: SATGFKQSSKALQRPVASDF
SATGVKQISGALVRPVASDF

SEQ ID NO: 17825 - protein, 20 aa, synthetic construct
  source 1..20: note = Seed: SATGFKQSSKALQRPVASDF
SATGVKQISHALLRPVASDF

SEQ ID NO: 17826 - protein, 20 aa, synthetic construct
  source 1..20: note = Seed: SATGFKQSSKALQRPVASDF
SATGVKQISHALRRPVASDF

SEQ ID NO: 17827 - protein, 20 aa, synthetic construct
  source 1..20: note = Seed: SATGFKQSSKALQRPVASDF
SATGVKQISIALARPVASDF

SEQ ID NO: 17828 - protein, 20 aa, synthetic construct
  source 1..20: note = Seed: SATGFKQSSKALQRPVASDF
SATGVKQISIALCRPVASDF

SEQ ID NO: 17829 - protein, 20 aa, synthetic construct
  source 1..20: note = Seed: SATGFKQSSKALQRPVASDF
SATGVKQISIALGRPVASDF

SEQ ID NO: 17830 - protein, 20 aa, synthetic construct
  source 1..20: note = Seed: SATGFKQSSKALQRPVASDF
SATGVKQISIALHRPVASDF

SEQ ID NO: 17831 - protein, 20 aa, synthetic construct
  source 1..20: note = Seed: SATGFKQSSKALQRPVASDF
SATGVKQISIALNRPVASDF

SEQ ID NO: 17832 - protein, 20 aa, synthetic construct
  source 1..20: note = Seed: SATGFKQSSKALQRPVASDF
SATGVKQISIALSRPVASDF

SEQ ID NO: 17833 - protein, 20 aa, synthetic construct
  source 1..20: note = Seed: SATGFKQSSKALQRPVASDF
SATGVKQISKALARPVASDF

SEQ ID NO: 17834 - protein, 20 aa, synthetic construct
  source 1..20: note = Seed: SATGFKQSSKALQRPVASDF
SATGVKQISKALGRPVASDF

SEQ ID NO: 17835 - protein, 20 aa, synthetic construct
  source 1..20: note = Seed: SATGFKQSSKALQRPVASDF
SATGVKQISKALHRPVASDF

SEQ ID NO: 17836 - protein, 20 aa, synthetic construct
  source 1..20: note = Seed: SATGFKQSSKALQRPVASDF
SATGVKQISKALIRPVASDF

SEQ ID NO: 17837 - protein, 20 aa, synthetic construct
  source 1..20: note = Seed: SATGFKQSSKALQRPVASDF
SATGVKQISKALKRPVASDF

SEQ ID NO: 17838 - protein, 20 aa, synthetic construct
  source 1..20: note = Seed: SATGFKQSSKALQRPVASDF
SATGVKQISKALLRPVASDF

SEQ ID NO: 17839 - protein, 20 aa, synthetic construct
  source 1..20: note = Seed: SATGFKQSSKALQRPVASDF
SATGVKQISKALMRPVASDF

SEQ ID NO: 17840 - protein, 20 aa, synthetic construct
  source 1..20: note = Seed: SATGFKQSSKALQRPVASDF
SATGVKQISKALNRPVASDF

SEQ ID NO: 17841 - protein, 20 aa, synthetic construct
  source 1..20: note = Seed: SATGFKQSSKALQRPVASDF
SATGVKQISKALQRPVASDF

SEQ ID NO: 17842 - protein, 20 aa, synthetic construct
  source 1..20: note = Seed: SATGFKQSSKALQRPVASDF
SATGVKQISKALRRPVASDF

SEQ ID NO: 17843 - protein, 20 aa, synthetic construct
  source 1..20: note = Seed: SATGFKQSSKALQRPVASDF
SATGVKQISKALSRPVASDF

SEQ ID NO: 17844 - protein, 20 aa, synthetic construct
  source 1..20: note = Seed: SATGFKQSSKALQRPVASDF
SATGVKQISKALTRPVASDF

SEQ ID NO: 17845 - protein, 20 aa, synthetic construct
  source 1..20: note = Seed: SATGFKQSSKALQRPVASDF
SATGVKQISKALVRPVASDF

SEQ ID NO: 17846 - protein, 20 aa, synthetic construct
  source 1..20: note = Seed: SATGFKQSSKALQRPVASDF
SATGVKQISKALYRPVASDF

SEQ ID NO: 17847 - protein, 20 aa, synthetic construct
  source 1..20: note = Seed: SATGFKQSSKALQRPVASDF
SATGVKQISLALNRPVASDF

SEQ ID NO: 17848 - protein, 20 aa, synthetic construct
  source 1..20: note = Seed: SATGFKQSSKALQRPVASDF
SATGVKQISLALVRPVASDF

SEQ ID NO: 17849 - protein, 20 aa, synthetic construct
  source 1..20: note = Seed: SATGFKQSSKALQRPVASDF
SATGVKQISNALARPVASDF

SEQ ID NO: 17850 - protein, 20 aa, synthetic construct
  source 1..20: note = Seed: SATGFKQSSKALQRPVASDF
SATGVKQISNALIRPVASDF

SEQ ID NO: 17851 - protein, 20 aa, synthetic construct
  source 1..20: note = Seed: SATGFKQSSKALQRPVASDF
SATGVKQISNALLRPVASDF

SEQ ID NO: 17852 - protein, 20 aa, synthetic construct
  source 1..20: note = Seed: SATGFKQSSKALQRPVASDF
SATGVKQISNALSRPVASDF

SEQ ID NO: 17853 - protein, 20 aa, synthetic construct
  source 1..20: note = Seed: SATGFKQSSKALQRPVASDF
SATGVKQISNALVRPVASDF

SEQ ID NO: 17854 - protein, 20 aa, synthetic construct
  source 1..20: note = Seed: SATGFKQSSKALQRPVASDF
SATGVKQISPALARPVASDF

SEQ ID NO: 17855 - protein, 20 aa, synthetic construct
  source 1..20: note = Seed: SATGFKQSSKALQRPVASDF
SATGVKQISPALIRPVASDF

SEQ ID NO: 17856 - protein, 20 aa, synthetic construct
  source 1..20: note = Seed: SATGFKQSSKALQRPVASDF
SATGVKQISPALLRPVASDF

SEQ ID NO: 17857 - protein, 20 aa, synthetic construct
  source 1..20: note = Seed: SATGFKQSSKALQRPVASDF
SATGVKQISPALMRPVASDF

SEQ ID NO: 17858 - protein, 20 aa, synthetic construct
  source 1..20: note = Seed: SATGFKQSSKALQRPVASDF
SATGVKQISPALNRPVASDF

SEQ ID NO: 17859 - protein, 20 aa, synthetic construct
  source 1..20: note = Seed: SATGFKQSSKALQRPVASDF
SATGVKQISPALSRPVASDF

SEQ ID NO: 17860 - protein, 20 aa, synthetic construct
  source 1..20: note = Seed: SATGFKQSSKALQRPVASDF
SATGVKQISPALTRPVASDF

SEQ ID NO: 17861 - protein, 20 aa, synthetic construct
  source 1..20: note = Seed: SATGFKQSSKALQRPVASDF
SATGVKQISPALVRPVASDF

SEQ ID NO: 17862 - protein, 20 aa, synthetic construct
  source 1..20: note = Seed: SATGFKQSSKALQRPVASDF
SATGVKQISRALARPVASDF

SEQ ID NO: 17863 - protein, 20 aa, synthetic construct
  source 1..20: note = Seed: SATGFKQSSKALQRPVASDF
SATGVKQISRALFRPVASDF

SEQ ID NO: 17864 - protein, 20 aa, synthetic construct
  source 1..20: note = Seed: SATGFKQSSKALQRPVASDF
SATGVKQISRALGRPVASDF

SEQ ID NO: 17865 - protein, 20 aa, synthetic construct
  source 1..20: note = Seed: SATGFKQSSKALQRPVASDF
SATGVKQISRALHRPVASDF

SEQ ID NO: 17866 - protein, 20 aa, synthetic construct
  source 1..20: note = Seed: SATGFKQSSKALQRPVASDF
SATGVKQISRALIRPVASDF

SEQ ID NO: 17867 - protein, 20 aa, synthetic construct
  source 1..20: note = Seed: SATGFKQSSKALQRPVASDF
SATGVKQISRALKRPVASDF

SEQ ID NO: 17868 - protein, 20 aa, synthetic construct
  source 1..20: note = Seed: SATGFKQSSKALQRPVASDF
SATGVKQISRALLRPVASDF

SEQ ID NO: 17869 - protein, 20 aa, synthetic construct
  source 1..20: note = Seed: SATGFKQSSKALQRPVASDF
SATGVKQISRALMRPVASDF

SEQ ID NO: 17870 - protein, 20 aa, synthetic construct
  source 1..20: note = Seed: SATGFKQSSKALQRPVASDF
SATGVKQISRALNRPVASDF

SEQ ID NO: 17871 - protein, 20 aa, synthetic construct
  source 1..20: note = Seed: SATGFKQSSKALQRPVASDF
SATGVKQISRALPRPVASDF

SEQ ID NO: 17872 - protein, 20 aa, synthetic construct
  source 1..20: note = Seed: SATGFKQSSKALQRPVASDF
SATGVKQISRALQRPVASDF

SEQ ID NO: 17873 - protein, 20 aa, synthetic construct
  source 1..20: note = Seed: SATGFKQSSKALQRPVASDF
SATGVKQISRALRRPVASDF

SEQ ID NO: 17874 - protein, 20 aa, synthetic construct
  source 1..20: note = Seed: SATGFKQSSKALQRPVASDF
SATGVKQISRALSRPVASDF

SEQ ID NO: 17875 - protein, 20 aa, synthetic construct
  source 1..20: note = Seed: SATGFKQSSKALQRPVASDF
SATGVKQISRALTRPVASDF

SEQ ID NO: 17876 - protein, 20 aa, synthetic construct
  source 1..20: note = Seed: SATGFKQSSKALQRPVASDF
SATGVKQISRALVRPVASDF

SEQ ID NO: 17877 - protein, 20 aa, synthetic construct
  source 1..20: note = Seed: SATGFKQSSKALQRPVASDF
SATGVKQISRALYRPVASDF

SEQ ID NO: 17878 - protein, 20 aa, synthetic construct
  source 1..20: note = Seed: SATGFKQSSKALQRPVASDF
SATGVKQISSALARPVASDF

SEQ ID NO: 17879 - protein, 20 aa, synthetic construct
  source 1..20: note = Seed: SATGFKQSSKALQRPVASDF
SATGVKQISSALGRPVASDF

SEQ ID NO: 17880 - protein, 20 aa, synthetic construct
  source 1..20: note = Seed: SATGFKQSSKALQRPVASDF
SATGVKQISSALIRPVASDF

SEQ ID NO: 17881 - protein, 20 aa, synthetic construct
  source 1..20: note = Seed: SATGFKQSSKALQRPVASDF
SATGVKQISSALLRPVASDF

SEQ ID NO: 17882 - protein, 20 aa, synthetic construct
  source 1..20: note = Seed: SATGFKQSSKALQRPVASDF
SATGVKQISSALMRPVASDF

SEQ ID NO: 17883 - protein, 20 aa, synthetic construct
  source 1..20: note = Seed: SATGFKQSSKALQRPVASDF
SATGVKQISSALNRPVASDF

SEQ ID NO: 17884 - protein, 20 aa, synthetic construct
  source 1..20: note = Seed: SATGFKQSSKALQRPVASDF
SATGVKQISSALSRPVASDF

SEQ ID NO: 17885 - protein, 20 aa, synthetic construct
  source 1..20: note = Seed: SATGFKQSSKALQRPVASDF
SATGVKQISSALVRPVASDF

SEQ ID NO: 17886 - protein, 20 aa, synthetic construct
  source 1..20: note = Seed: SATGFKQSSKALQRPVASDF
SATGVKQISTALARPVASDF

SEQ ID NO: 17887 - protein, 20 aa, synthetic construct
  source 1..20: note = Seed: SATGFKQSSKALQRPVASDF
SATGVKQISTALIRPVASDF

SEQ ID NO: 17888 - protein, 20 aa, synthetic construct
  source 1..20: note = Seed: SATGFKQSSKALQRPVASDF
SATGVKQISTALLRPVASDF

SEQ ID NO: 17889 - protein, 20 aa, synthetic construct
  source 1..20: note = Seed: SATGFKQSSKALQRPVASDF
SATGVKQISTALMRPVASDF

SEQ ID NO: 17890 - protein, 20 aa, synthetic construct
  source 1..20: note = Seed: SATGFKQSSKALQRPVASDF
SATGVKQISTALNRPVASDF

SEQ ID NO: 17891 - protein, 20 aa, synthetic construct
  source 1..20: note = Seed: SATGFKQSSKALQRPVASDF
SATGVKQISTALSRPVASDF

SEQ ID NO: 17892 - protein, 20 aa, synthetic construct
  source 1..20: note = Seed: SATGFKQSSKALQRPVASDF
SATGVKQISTALTRPVASDF

SEQ ID NO: 17893 - protein, 20 aa, synthetic construct
  source 1..20: note = Seed: SATGFKQSSKALQRPVASDF
SATGVKQISTALVRPVASDF

SEQ ID NO: 17894 - protein, 20 aa, synthetic construct
  source 1..20: note = Seed: SATGFKQSSKALQRPVASDF
SATGVKQISVALARPVASDF

SEQ ID NO: 17895 - protein, 20 aa, synthetic construct
  source 1..20: note = Seed: SATGFKQSSKALQRPVASDF
SATGVKQISVALGRPVASDF

SEQ ID NO: 17896 - protein, 20 aa, synthetic construct
  source 1..20: note = Seed: SATGFKQSSKALQRPVASDF
SATGVKQISVALHRPVASDF

SEQ ID NO: 17897 - protein, 20 aa, synthetic construct
  source 1..20: note = Seed: SATGFKQSSKALQRPVASDF
SATGVKQISVALNRPVASDF

SEQ ID NO: 17898 - protein, 20 aa, synthetic construct
  source 1..20: note = Seed: SATGFKQSSKALQRPVASDF
SATGVKQISVALQRPVASDF

SEQ ID NO: 17899 - protein, 20 aa, synthetic construct
  source 1..20: note = Seed: SATGFKQSSKALQRPVASDF
SATGVKQISVALSRPVASDF

SEQ ID NO: 17900 - protein, 20 aa, synthetic construct
  source 1..20: note = Seed: SATGFKQSSKALQRPVASDF
SATGVKQKSRALRRPVASDF

SEQ ID NO: 17901 - protein, 20 aa, synthetic construct
  source 1..20: note = Seed: SATGFKQSSKALQRPVASDF
SATGVKQLSAALARPVASDF

SEQ ID NO: 17902 - protein, 20 aa, synthetic construct
  source 1..20: note = Seed: SATGFKQSSKALQRPVASDF
SATGVKQLSAALCRPVASDF

SEQ ID NO: 17903 - protein, 20 aa, synthetic construct
  source 1..20: note = Seed: SATGFKQSSKALQRPVASDF
SATGVKQLSAALFRPVASDF

SEQ ID NO: 17904 - protein, 20 aa, synthetic construct
  source 1..20: note = Seed: SATGFKQSSKALQRPVASDF
SATGVKQLSAALGRPVASDF

SEQ ID NO: 17905 - protein, 20 aa, synthetic construct
  source 1..20: note = Seed: SATGFKQSSKALQRPVASDF
SATGVKQLSAALHRPVASDF

SEQ ID NO: 17906 - protein, 20 aa, synthetic construct
  source 1..20: note = Seed: SATGFKQSSKALQRPVASDF
SATGVKQLSAALIRPVASDF

SEQ ID NO: 17907 - protein, 20 aa, synthetic construct
  source 1..20: note = Seed: SATGFKQSSKALQRPVASDF
SATGVKQLSAALLRPVASDF

SEQ ID NO: 17908 - protein, 20 aa, synthetic construct
  source 1..20: note = Seed: SATGFKQSSKALQRPVASDF
SATGVKQLSAALMRPVASDF

SEQ ID NO: 17909 - protein, 20 aa, synthetic construct
  source 1..20: note = Seed: SATGFKQSSKALQRPVASDF
SATGVKQLSAALNRPVASDF

SEQ ID NO: 17910 - protein, 20 aa, synthetic construct
  source 1..20: note = Seed: SATGFKQSSKALQRPVASDF
SATGVKQLSAALSRPVASDF

SEQ ID NO: 17911 - protein, 20 aa, synthetic construct
  source 1..20: note = Seed: SATGFKQSSKALQRPVASDF
SATGVKQLSAALTRPVASDF

SEQ ID NO: 17912 - protein, 20 aa, synthetic construct
  source 1..20: note = Seed: SATGFKQSSKALQRPVASDF
SATGVKQLSAALVRPVASDF

SEQ ID NO: 17913 - protein, 20 aa, synthetic construct
  source 1..20: note = Seed: SATGFKQSSKALQRPVASDF
SATGVKQLSCALARPVASDF

SEQ ID NO: 17914 - protein, 20 aa, synthetic construct
  source 1..20: note = Seed: SATGFKQSSKALQRPVASDF
SATGVKQLSCALVRPVASDF

SEQ ID NO: 17915 - protein, 20 aa, synthetic construct
  source 1..20: note = Seed: SATGFKQSSKALQRPVASDF
SATGVKQLSGALARPVASDF

SEQ ID NO: 17916 - protein, 20 aa, synthetic construct
  source 1..20: note = Seed: SATGFKQSSKALQRPVASDF
SATGVKQLSGALCRPVASDF

SEQ ID NO: 17917 - protein, 20 aa, synthetic construct
  source 1..20: note = Seed: SATGFKQSSKALQRPVASDF
SATGVKQLSGALFRPVASDF

SEQ ID NO: 17918 - protein, 20 aa, synthetic construct
  source 1..20: note = Seed: SATGFKQSSKALQRPVASDF
SATGVKQLSGALGRPVASDF

SEQ ID NO: 17919 - protein, 20 aa, synthetic construct
  source 1..20: note = Seed: SATGFKQSSKALQRPVASDF
SATGVKQLSGALIRPVASDF

SEQ ID NO: 17920 - protein, 20 aa, synthetic construct
  source 1..20: note = Seed: SATGFKQSSKALQRPVASDF
SATGVKQLSGALLRPVASDF

SEQ ID NO: 17921 - protein, 20 aa, synthetic construct
  source 1..20: note = Seed: SATGFKQSSKALQRPVASDF
SATGVKQLSGALMRPVASDF

SEQ ID NO: 17922 - protein, 20 aa, synthetic construct
  source 1..20: note = Seed: SATGFKQSSKALQRPVASDF
SATGVKQLSGALNRPVASDF

SEQ ID NO: 17923 - protein, 20 aa, synthetic construct
  source 1..20: note = Seed: SATGFKQSSKALQRPVASDF
SATGVKQLSGALSRPVASDF

SEQ ID NO: 17924 - protein, 20 aa, synthetic construct
  source 1..20: note = Seed: SATGFKQSSKALQRPVASDF
SATGVKQLSGALTRPVASDF

SEQ ID NO: 17925 - protein, 20 aa, synthetic construct
  source 1..20: note = Seed: SATGFKQSSKALQRPVASDF
SATGVKQLSGALVRPVASDF

SEQ ID NO: 17926 - protein, 20 aa, synthetic construct
  source 1..20: note = Seed: SATGFKQSSKALQRPVASDF
SATGVKQLSHALIRPVASDF

SEQ ID NO: 17927 - protein, 20 aa, synthetic construct
  source 1..20: note = Seed: SATGFKQSSKALQRPVASDF
SATGVKQLSHALLRPVASDF

SEQ ID NO: 17928 - protein, 20 aa, synthetic construct
  source 1..20: note = Seed: SATGFKQSSKALQRPVASDF
SATGVKQLSHALMRPVASDF

SEQ ID NO: 17929 - protein, 20 aa, synthetic construct
  source 1..20: note = Seed: SATGFKQSSKALQRPVASDF
SATGVKQLSHALRRPVASDF

SEQ ID NO: 17930 - protein, 20 aa, synthetic construct
  source 1..20: note = Seed: SATGFKQSSKALQRPVASDF
SATGVKQLSHALVRPVASDF

SEQ ID NO: 17931 - protein, 20 aa, synthetic construct
  source 1..20: note = Seed: SATGFKQSSKALQRPVASDF
SATGVKQLSIALARPVASDF

SEQ ID NO: 17932 - protein, 20 aa, synthetic construct
  source 1..20: note = Seed: SATGFKQSSKALQRPVASDF
SATGVKQLSIALCRPVASDF

SEQ ID NO: 17933 - protein, 20 aa, synthetic construct
  source 1..20: note = Seed: SATGFKQSSKALQRPVASDF
SATGVKQLSIALGRPVASDF

SEQ ID NO: 17934 - protein, 20 aa, synthetic construct
  source 1..20: note = Seed: SATGFKQSSKALQRPVASDF
SATGVKQLSIALHRPVASDF

SEQ ID NO: 17935 - protein, 20 aa, synthetic construct
  source 1..20: note = Seed: SATGFKQSSKALQRPVASDF
SATGVKQLSIALNRPVASDF

SEQ ID NO: 17936 - protein, 20 aa, synthetic construct
  source 1..20: note = Seed: SATGFKQSSKALQRPVASDF
SATGVKQLSIALSRPVASDF

SEQ ID NO: 17937 - protein, 20 aa, synthetic construct
  source 1..20: note = Seed: SATGFKQSSKALQRPVASDF
SATGVKQLSIALTRPVASDF

SEQ ID NO: 17938 - protein, 20 aa, synthetic construct
  source 1..20: note = Seed: SATGFKQSSKALQRPVASDF
SATGVKQLSIALVRPVASDF

SEQ ID NO: 17939 - protein, 20 aa, synthetic construct
  source 1..20: note = Seed: SATGFKQSSKALQRPVASDF
SATGVKQLSKALARPVASDF

SEQ ID NO: 17940 - protein, 20 aa, synthetic construct
  source 1..20: note = Seed: SATGFKQSSKALQRPVASDF
SATGVKQLSKALGRPVASDF

SEQ ID NO: 17941 - protein, 20 aa, synthetic construct
  source 1..20: note = Seed: SATGFKQSSKALQRPVASDF
SATGVKQLSKALHRPVASDF

SEQ ID NO: 17942 - protein, 20 aa, synthetic construct
  source 1..20: note = Seed: SATGFKQSSKALQRPVASDF
SATGVKQLSKALIRPVASDF

SEQ ID NO: 17943 - protein, 20 aa, synthetic construct
  source 1..20: note = Seed: SATGFKQSSKALQRPVASDF
SATGVKQLSKALKRPVASDF

SEQ ID NO: 17944 - protein, 20 aa, synthetic construct
  source 1..20: note = Seed: SATGFKQSSKALQRPVASDF
SATGVKQLSKALLRPVASDF

SEQ ID NO: 17945 - protein, 20 aa, synthetic construct
  source 1..20: note = Seed: SATGFKQSSKALQRPVASDF
SATGVKQLSKALMRPVASDF

SEQ ID NO: 17946 - protein, 20 aa, synthetic construct
  source 1..20: note = Seed: SATGFKQSSKALQRPVASDF
SATGVKQLSKALNRPVASDF

SEQ ID NO: 17947 - protein, 20 aa, synthetic construct
  source 1..20: note = Seed: SATGFKQSSKALQRPVASDF
SATGVKQLSKALQRPVASDF

SEQ ID NO: 17948 - protein, 20 aa, synthetic construct
  source 1..20: note = Seed: SATGFKQSSKALQRPVASDF
SATGVKQLSKALRRPVASDF

SEQ ID NO: 17949 - protein, 20 aa, synthetic construct
  source 1..20: note = Seed: SATGFKQSSKALQRPVASDF
SATGVKQLSKALSRPVASDF

SEQ ID NO: 17950 - protein, 20 aa, synthetic construct
  source 1..20: note = Seed: SATGFKQSSKALQRPVASDF
SATGVKQLSKALTRPVASDF

SEQ ID NO: 17951 - protein, 20 aa, synthetic construct
  source 1..20: note = Seed: SATGFKQSSKALQRPVASDF
SATGVKQLSKALVRPVASDF

SEQ ID NO: 17952 - protein, 20 aa, synthetic construct
  source 1..20: note = Seed: SATGFKQSSKALQRPVASDF
SATGVKQLSKALYRPVASDF

SEQ ID NO: 17953 - protein, 20 aa, synthetic construct
  source 1..20: note = Seed: SATGFKQSSKALQRPVASDF
SATGVKQLSLALGRPVASDF

SEQ ID NO: 17954 - protein, 20 aa, synthetic construct
  source 1..20: note = Seed: SATGFKQSSKALQRPVASDF
SATGVKQLSLALHRPVASDF

SEQ ID NO: 17955 - protein, 20 aa, synthetic construct
  source 1..20: note = Seed: SATGFKQSSKALQRPVASDF
SATGVKQLSLALNRPVASDF

SEQ ID NO: 17956 - protein, 20 aa, synthetic construct
  source 1..20: note = Seed: SATGFKQSSKALQRPVASDF
SATGVKQLSLALSRPVASDF

SEQ ID NO: 17957 - protein, 20 aa, synthetic construct
  source 1..20: note = Seed: SATGFKQSSKALQRPVASDF
SATGVKQLSMALHRPVASDF

SEQ ID NO: 17958 - protein, 20 aa, synthetic construct
  source 1..20: note = Seed: SATGFKQSSKALQRPVASDF
SATGVKQLSMALNRPVASDF

SEQ ID NO: 17959 - protein, 20 aa, synthetic construct
  source 1..20: note = Seed: SATGFKQSSKALQRPVASDF
SATGVKQLSNALARPVASDF

SEQ ID NO: 17960 - protein, 20 aa, synthetic construct
  source 1..20: note = Seed: SATGFKQSSKALQRPVASDF
SATGVKQLSNALGRPVASDF

SEQ ID NO: 17961 - protein, 20 aa, synthetic construct
  source 1..20: note = Seed: SATGFKQSSKALQRPVASDF
SATGVKQLSNALIRPVASDF

SEQ ID NO: 17962 - protein, 20 aa, synthetic construct
  source 1..20: note = Seed: SATGFKQSSKALQRPVASDF
SATGVKQLSNALLRPVASDF

SEQ ID NO: 17963 - protein, 20 aa, synthetic construct
  source 1..20: note = Seed: SATGFKQSSKALQRPVASDF
SATGVKQLSNALMRPVASDF

SEQ ID NO: 17964 - protein, 20 aa, synthetic construct
  source 1..20: note = Seed: SATGFKQSSKALQRPVASDF
SATGVKQLSNALNRPVASDF

SEQ ID NO: 17965 - protein, 20 aa, synthetic construct
  source 1..20: note = Seed: SATGFKQSSKALQRPVASDF
SATGVKQLSNALSRPVASDF

SEQ ID NO: 17966 - protein, 20 aa, synthetic construct
  source 1..20: note = Seed: SATGFKQSSKALQRPVASDF
SATGVKQLSNALTRPVASDF

SEQ ID NO: 17967 - protein, 20 aa, synthetic construct
  source 1..20: note = Seed: SATGFKQSSKALQRPVASDF
SATGVKQLSNALVRPVASDF

SEQ ID NO: 17968 - protein, 20 aa, synthetic construct
  source 1..20: note = Seed: SATGFKQSSKALQRPVASDF
SATGVKQLSPALARPVASDF

SEQ ID NO: 17969 - protein, 20 aa, synthetic construct
  source 1..20: note = Seed: SATGFKQSSKALQRPVASDF
SATGVKQLSPALCRPVASDF

SEQ ID NO: 17970 - protein, 20 aa, synthetic construct
  source 1..20: note = Seed: SATGFKQSSKALQRPVASDF
SATGVKQLSPALGRPVASDF

SEQ ID NO: 17971 - protein, 20 aa, synthetic construct
  source 1..20: note = Seed: SATGFKQSSKALQRPVASDF
SATGVKQLSPALIRPVASDF

SEQ ID NO: 17972 - protein, 20 aa, synthetic construct
  source 1..20: note = Seed: SATGFKQSSKALQRPVASDF
SATGVKQLSPALLRPVASDF

SEQ ID NO: 17973 - protein, 20 aa, synthetic construct
  source 1..20: note = Seed: SATGFKQSSKALQRPVASDF
SATGVKQLSPALMRPVASDF

SEQ ID NO: 17974 - protein, 20 aa, synthetic construct
  source 1..20: note = Seed: SATGFKQSSKALQRPVASDF
SATGVKQLSPALNRPVASDF

SEQ ID NO: 17975 - protein, 20 aa, synthetic construct
  source 1..20: note = Seed: SATGFKQSSKALQRPVASDF
SATGVKQLSPALPRPVASDF

SEQ ID NO: 17976 - protein, 20 aa, synthetic construct
  source 1..20: note = Seed: SATGFKQSSKALQRPVASDF
SATGVKQLSPALSRPVASDF

SEQ ID NO: 17977 - protein, 20 aa, synthetic construct
  source 1..20: note = Seed: SATGFKQSSKALQRPVASDF
SATGVKQLSPALTRPVASDF

SEQ ID NO: 17978 - protein, 20 aa, synthetic construct
  source 1..20: note = Seed: SATGFKQSSKALQRPVASDF
SATGVKQLSPALVRPVASDF

SEQ ID NO: 17979 - protein, 20 aa, synthetic construct
  source 1..20: note = Seed: SATGFKQSSKALQRPVASDF
SATGVKQLSQALIRPVASDF

SEQ ID NO: 17980 - protein, 20 aa, synthetic construct
  source 1..20: note = Seed: SATGFKQSSKALQRPVASDF
SATGVKQLSQALVRPVASDF

SEQ ID NO: 17981 - protein, 20 aa, synthetic construct
  source 1..20: note = Seed: SATGFKQSSKALQRPVASDF
SATGVKQLSRALARPVASDF

SEQ ID NO: 17982 - protein, 20 aa, synthetic construct
  source 1..20: note = Seed: SATGFKQSSKALQRPVASDF
SATGVKQLSRALFRPVASDF

SEQ ID NO: 17983 - protein, 20 aa, synthetic construct
  source 1..20: note = Seed: SATGFKQSSKALQRPVASDF
SATGVKQLSRALGRPVASDF

SEQ ID NO: 17984 - protein, 20 aa, synthetic construct
  source 1..20: note = Seed: SATGFKQSSKALQRPVASDF
SATGVKQLSRALHRPVASDF

SEQ ID NO: 17985 - protein, 20 aa, synthetic construct
  source 1..20: note = Seed: SATGFKQSSKALQRPVASDF
SATGVKQLSRALIRPVASDF

SEQ ID NO: 17986 - protein, 20 aa, synthetic construct
  source 1..20: note = Seed: SATGFKQSSKALQRPVASDF
SATGVKQLSRALKRPVASDF

SEQ ID NO: 17987 - protein, 20 aa, synthetic construct
  source 1..20: note = Seed: SATGFKQSSKALQRPVASDF
SATGVKQLSRALLRPVASDF

SEQ ID NO: 17988 - protein, 20 aa, synthetic construct
  source 1..20: note = Seed: SATGFKQSSKALQRPVASDF
SATGVKQLSRALMRPVASDF

SEQ ID NO: 17989 - protein, 20 aa, synthetic construct
  source 1..20: note = Seed: SATGFKQSSKALQRPVASDF
SATGVKQLSRALNRPVASDF

SEQ ID NO: 17990 - protein, 20 aa, synthetic construct
  source 1..20: note = Seed: SATGFKQSSKALQRPVASDF
SATGVKQLSRALPRPVASDF

SEQ ID NO: 17991 - protein, 20 aa, synthetic construct
  source 1..20: note = Seed: SATGFKQSSKALQRPVASDF
SATGVKQLSRALQRPVASDF

SEQ ID NO: 17992 - protein, 20 aa, synthetic construct
  source 1..20: note = Seed: SATGFKQSSKALQRPVASDF
SATGVKQLSRALRRPVASDF

SEQ ID NO: 17993 - protein, 20 aa, synthetic construct
  source 1..20: note = Seed: SATGFKQSSKALQRPVASDF
SATGVKQLSRALSRPVASDF

SEQ ID NO: 17994 - protein, 20 aa, synthetic construct
  source 1..20: note = Seed: SATGFKQSSKALQRPVASDF
SATGVKQLSRALTRPVASDF

SEQ ID NO: 17995 - protein, 20 aa, synthetic construct
  source 1..20: note = Seed: SATGFKQSSKALQRPVASDF
SATGVKQLSRALVRPVASDF

SEQ ID NO: 17996 - protein, 20 aa, synthetic construct
  source 1..20: note = Seed: SATGFKQSSKALQRPVASDF
SATGVKQLSRALYRPVASDF

SEQ ID NO: 17997 - protein, 20 aa, synthetic construct
  source 1..20: note = Seed: SATGFKQSSKALQRPVASDF
SATGVKQLSSALARPVASDF

SEQ ID NO: 17998 - protein, 20 aa, synthetic construct
  source 1..20: note = Seed: SATGFKQSSKALQRPVASDF
SATGVKQLSSALCRPVASDF

SEQ ID NO: 17999 - protein, 20 aa, synthetic construct
  source 1..20: note = Seed: SATGFKQSSKALQRPVASDF
SATGVKQLSSALFRPVASDF

SEQ ID NO: 18000 - protein, 20 aa, synthetic construct
  source 1..20: note = Seed: SATGFKQSSKALQRPVASDF
SATGVKQLSSALGRPVASDF

SEQ ID NO: 18001 - protein, 20 aa, synthetic construct
  source 1..20: note = Seed: SATGFKQSSKALQRPVASDF
SATGVKQLSSALIRPVASDF

SEQ ID NO: 18002 - protein, 20 aa, synthetic construct
  source 1..20: note = Seed: SATGFKQSSKALQRPVASDF
SATGVKQLSSALLRPVASDF

SEQ ID NO: 18003 - protein, 20 aa, synthetic construct
  source 1..20: note = Seed: SATGFKQSSKALQRPVASDF
SATGVKQLSSALMRPVASDF

SEQ ID NO: 18004 - protein, 20 aa, synthetic construct
  source 1..20: note = Seed: SATGFKQSSKALQRPVASDF
SATGVKQLSSALNRPVASDF

SEQ ID NO: 18005 - protein, 20 aa, synthetic construct
  source 1..20: note = Seed: SATGFKQSSKALQRPVASDF
SATGVKQLSSALSRPVASDF

SEQ ID NO: 18006 - protein, 20 aa, synthetic construct
  source 1..20: note = Seed: SATGFKQSSKALQRPVASDF
SATGVKQLSSALTRPVASDF

SEQ ID NO: 18007 - protein, 20 aa, synthetic construct
  source 1..20: note = Seed: SATGFKQSSKALQRPVASDF
SATGVKQLSSALVRPVASDF

SEQ ID NO: 18008 - protein, 20 aa, synthetic construct
  source 1..20: note = Seed: SATGFKQSSKALQRPVASDF
SATGVKQLSTALARPVASDF

SEQ ID NO: 18009 - protein, 20 aa, synthetic construct
  source 1..20: note = Seed: SATGFKQSSKALQRPVASDF
SATGVKQLSTALGRPVASDF

SEQ ID NO: 18010 - protein, 20 aa, synthetic construct
  source 1..20: note = Seed: SATGFKQSSKALQRPVASDF
SATGVKQLSTALIRPVASDF

SEQ ID NO: 18011 - protein, 20 aa, synthetic construct
  source 1..20: note = Seed: SATGFKQSSKALQRPVASDF
SATGVKQLSTALLRPVASDF

SEQ ID NO: 18012 - protein, 20 aa, synthetic construct
  source 1..20: note = Seed: SATGFKQSSKALQRPVASDF
SATGVKQLSTALMRPVASDF

SEQ ID NO: 18013 - protein, 20 aa, synthetic construct
  source 1..20: note = Seed: SATGFKQSSKALQRPVASDF
SATGVKQLSTALNRPVASDF

SEQ ID NO: 18014 - protein, 20 aa, synthetic construct
  source 1..20: note = Seed: SATGFKQSSKALQRPVASDF
SATGVKQLSTALSRPVASDF

SEQ ID NO: 18015 - protein, 20 aa, synthetic construct
  source 1..20: note = Seed: SATGFKQSSKALQRPVASDF
SATGVKQLSTALTRPVASDF

SEQ ID NO: 18016 - protein, 20 aa, synthetic construct
  source 1..20: note = Seed: SATGFKQSSKALQRPVASDF
SATGVKQLSTALVRPVASDF

SEQ ID NO: 18017 - protein, 20 aa, synthetic construct
  source 1..20: note = Seed: SATGFKQSSKALQRPVASDF
SATGVKQLSVALARPVASDF

SEQ ID NO: 18018 - protein, 20 aa, synthetic construct
  source 1..20: note = Seed: SATGFKQSSKALQRPVASDF
SATGVKQLSVALGRPVASDF

SEQ ID NO: 18019 - protein, 20 aa, synthetic construct
  source 1..20: note = Seed: SATGFKQSSKALQRPVASDF
SATGVKQLSVALHRPVASDF

SEQ ID NO: 18020 - protein, 20 aa, synthetic construct
  source 1..20: note = Seed: SATGFKQSSKALQRPVASDF
SATGVKQLSVALIRPVASDF

SEQ ID NO: 18021 - protein, 20 aa, synthetic construct
  source 1..20: note = Seed: SATGFKQSSKALQRPVASDF
SATGVKQLSVALLRPVASDF

SEQ ID NO: 18022 - protein, 20 aa, synthetic construct
  source 1..20: note = Seed: SATGFKQSSKALQRPVASDF
SATGVKQLSVALMRPVASDF

SEQ ID NO: 18023 - protein, 20 aa, synthetic construct
  source 1..20: note = Seed: SATGFKQSSKALQRPVASDF
SATGVKQLSVALNRPVASDF

SEQ ID NO: 18024 - protein, 20 aa, synthetic construct
  source 1..20: note = Seed: SATGFKQSSKALQRPVASDF
SATGVKQLSVALQRPVASDF

SEQ ID NO: 18025 - protein, 20 aa, synthetic construct
  source 1..20: note = Seed: SATGFKQSSKALQRPVASDF
SATGVKQLSVALSRPVASDF

SEQ ID NO: 18026 - protein, 20 aa, synthetic construct
  source 1..20: note = Seed: SATGFKQSSKALQRPVASDF
SATGVKQLSVALTRPVASDF

SEQ ID NO: 18027 - protein, 20 aa, synthetic construct
  source 1..20: note = Seed: SATGFKQSSKALQRPVASDF
SATGVKQLSVALVRPVASDF

SEQ ID NO: 18028 - protein, 20 aa, synthetic construct
  source 1..20: note = Seed: SATGFKQSSKALQRPVASDF
SATGVKQMSAALARPVASDF

SEQ ID NO: 18029 - protein, 20 aa, synthetic construct
  source 1..20: note = Seed: SATGFKQSSKALQRPVASDF
SATGVKQMSAALCRPVASDF

SEQ ID NO: 18030 - protein, 20 aa, synthetic construct
  source 1..20: note = Seed: SATGFKQSSKALQRPVASDF
SATGVKQMSAALFRPVASDF

SEQ ID NO: 18031 - protein, 20 aa, synthetic construct
  source 1..20: note = Seed: SATGFKQSSKALQRPVASDF
SATGVKQMSAALGRPVASDF

SEQ ID NO: 18032 - protein, 20 aa, synthetic construct
  source 1..20: note = Seed: SATGFKQSSKALQRPVASDF
SATGVKQMSAALHRPVASDF

SEQ ID NO: 18033 - protein, 20 aa, synthetic construct
  source 1..20: note = Seed: SATGFKQSSKALQRPVASDF
SATGVKQMSAALIRPVASDF

SEQ ID NO: 18034 - protein, 20 aa, synthetic construct
  source 1..20: note = Seed: SATGFKQSSKALQRPVASDF
SATGVKQMSAALLRPVASDF

SEQ ID NO: 18035 - protein, 20 aa, synthetic construct
  source 1..20: note = Seed: SATGFKQSSKALQRPVASDF
SATGVKQMSAALMRPVASDF

SEQ ID NO: 18036 - protein, 20 aa, synthetic construct
  source 1..20: note = Seed: SATGFKQSSKALQRPVASDF
SATGVKQMSAALNRPVASDF

SEQ ID NO: 18037 - protein, 20 aa, synthetic construct
  source 1..20: note = Seed: SATGFKQSSKALQRPVASDF
SATGVKQMSAALPRPVASDF

SEQ ID NO: 18038 - protein, 20 aa, synthetic construct
  source 1..20: note = Seed: SATGFKQSSKALQRPVASDF
SATGVKQMSAALRRPVASDF

SEQ ID NO: 18039 - protein, 20 aa, synthetic construct
  source 1..20: note = Seed: SATGFKQSSKALQRPVASDF
SATGVKQMSAALSRPVASDF

SEQ ID NO: 18040 - protein, 20 aa, synthetic construct
  source 1..20: note = Seed: SATGFKQSSKALQRPVASDF
SATGVKQMSAALTRPVASDF

SEQ ID NO: 18041 - protein, 20 aa, synthetic construct
  source 1..20: note = Seed: SATGFKQSSKALQRPVASDF
SATGVKQMSAALVRPVASDF

SEQ ID NO: 18042 - protein, 20 aa, synthetic construct
  source 1..20: note = Seed: SATGFKQSSKALQRPVASDF
SATGVKQMSAALYRPVASDF

SEQ ID NO: 18043 - protein, 20 aa, synthetic construct
  source 1..20: note = Seed: SATGFKQSSKALQRPVASDF
SATGVKQMSGALARPVASDF

SEQ ID NO: 18044 - protein, 20 aa, synthetic construct
  source 1..20: note = Seed: SATGFKQSSKALQRPVASDF
SATGVKQMSGALCRPVASDF

SEQ ID NO: 18045 - protein, 20 aa, synthetic construct
  source 1..20: note = Seed: SATGFKQSSKALQRPVASDF
SATGVKQMSGALFRPVASDF

SEQ ID NO: 18046 - protein, 20 aa, synthetic construct
  source 1..20: note = Seed: SATGFKQSSKALQRPVASDF
SATGVKQMSGALGRPVASDF

SEQ ID NO: 18047 - protein, 20 aa, synthetic construct
  source 1..20: note = Seed: SATGFKQSSKALQRPVASDF
SATGVKQMSGALIRPVASDF

SEQ ID NO: 18048 - protein, 20 aa, synthetic construct
  source 1..20: note = Seed: SATGFKQSSKALQRPVASDF
SATGVKQMSGALLRPVASDF

SEQ ID NO: 18049 - protein, 20 aa, synthetic construct
  source 1..20: note = Seed: SATGFKQSSKALQRPVASDF
SATGVKQMSGALMRPVASDF

SEQ ID NO: 18050 - protein, 20 aa, synthetic construct
  source 1..20: note = Seed: SATGFKQSSKALQRPVASDF
SATGVKQMSGALNRPVASDF

SEQ ID NO: 18051 - protein, 20 aa, synthetic construct
  source 1..20: note = Seed: SATGFKQSSKALQRPVASDF
SATGVKQMSGALSRPVASDF

SEQ ID NO: 18052 - protein, 20 aa, synthetic construct
  source 1..20: note = Seed: SATGFKQSSKALQRPVASDF
SATGVKQMSGALTRPVASDF

SEQ ID NO: 18053 - protein, 20 aa, synthetic construct
  source 1..20: note = Seed: SATGFKQSSKALQRPVASDF
SATGVKQMSGALVRPVASDF

SEQ ID NO: 18054 - protein, 20 aa, synthetic construct
  source 1..20: note = Seed: SATGFKQSSKALQRPVASDF
SATGVKQMSHALIRPVASDF

SEQ ID NO: 18055 - protein, 20 aa, synthetic construct
  source 1..20: note = Seed: SATGFKQSSKALQRPVASDF
SATGVKQMSHALKRPVASDF

SEQ ID NO: 18056 - protein, 20 aa, synthetic construct
  source 1..20: note = Seed: SATGFKQSSKALQRPVASDF
SATGVKQMSHALLRPVASDF

SEQ ID NO: 18057 - protein, 20 aa, synthetic construct
  source 1..20: note = Seed: SATGFKQSSKALQRPVASDF
SATGVKQMSHALMRPVASDF

SEQ ID NO: 18058 - protein, 20 aa, synthetic construct
  source 1..20: note = Seed: SATGFKQSSKALQRPVASDF
SATGVKQMSHALRRPVASDF

SEQ ID NO: 18059 - protein, 20 aa, synthetic construct
  source 1..20: note = Seed: SATGFKQSSKALQRPVASDF
SATGVKQMSHALSRPVASDF

SEQ ID NO: 18060 - protein, 20 aa, synthetic construct
  source 1..20: note = Seed: SATGFKQSSKALQRPVASDF
SATGVKQMSHALVRPVASDF

SEQ ID NO: 18061 - protein, 20 aa, synthetic construct
  source 1..20: note = Seed: SATGFKQSSKALQRPVASDF
SATGVKQMSIALARPVASDF

SEQ ID NO: 18062 - protein, 20 aa, synthetic construct
  source 1..20: note = Seed: SATGFKQSSKALQRPVASDF
SATGVKQMSIALCRPVASDF

SEQ ID NO: 18063 - protein, 20 aa, synthetic construct
  source 1..20: note = Seed: SATGFKQSSKALQRPVASDF
SATGVKQMSIALGRPVASDF

SEQ ID NO: 18064 - protein, 20 aa, synthetic construct
  source 1..20: note = Seed: SATGFKQSSKALQRPVASDF
SATGVKQMSIALHRPVASDF

SEQ ID NO: 18065 - protein, 20 aa, synthetic construct
  source 1..20: note = Seed: SATGFKQSSKALQRPVASDF
SATGVKQMSIALNRPVASDF

SEQ ID NO: 18066 - protein, 20 aa, synthetic construct
  source 1..20: note = Seed: SATGFKQSSKALQRPVASDF
SATGVKQMSIALRRPVASDF

SEQ ID NO: 18067 - protein, 20 aa, synthetic construct
  source 1..20: note = Seed: SATGFKQSSKALQRPVASDF
SATGVKQMSIALSRPVASDF

SEQ ID NO: 18068 - protein, 20 aa, synthetic construct
  source 1..20: note = Seed: SATGFKQSSKALQRPVASDF
SATGVKQMSIALTRPVASDF

SEQ ID NO: 18069 - protein, 20 aa, synthetic construct
  source 1..20: note = Seed: SATGFKQSSKALQRPVASDF
SATGVKQMSIALVRPVASDF

SEQ ID NO: 18070 - protein, 20 aa, synthetic construct
  source 1..20: note = Seed: SATGFKQSSKALQRPVASDF
SATGVKQMSIALYRPVASDF

SEQ ID NO: 18071 - protein, 20 aa, synthetic construct
  source 1..20: note = Seed: SATGFKQSSKALQRPVASDF
SATGVKQMSKALARPVASDF

SEQ ID NO: 18072 - protein, 20 aa, synthetic construct
  source 1..20: note = Seed: SATGFKQSSKALQRPVASDF
SATGVKQMSKALFRPVASDF

SEQ ID NO: 18073 - protein, 20 aa, synthetic construct
  source 1..20: note = Seed: SATGFKQSSKALQRPVASDF
SATGVKQMSKALGRPVASDF

SEQ ID NO: 18074 - protein, 20 aa, synthetic construct
  source 1..20: note = Seed: SATGFKQSSKALQRPVASDF
SATGVKQMSKALHRPVASDF

SEQ ID NO: 18075 - protein, 20 aa, synthetic construct
  source 1..20: note = Seed: SATGFKQSSKALQRPVASDF
SATGVKQMSKALIRPVASDF

SEQ ID NO: 18076 - protein, 20 aa, synthetic construct
  source 1..20: note = Seed: SATGFKQSSKALQRPVASDF
SATGVKQMSKALKRPVASDF

SEQ ID NO: 18077 - protein, 20 aa, synthetic construct
  source 1..20: note = Seed: SATGFKQSSKALQRPVASDF
SATGVKQMSKALLRPVASDF

SEQ ID NO: 18078 - protein, 20 aa, synthetic construct
  source 1..20: note = Seed: SATGFKQSSKALQRPVASDF
SATGVKQMSKALMRPVASDF

SEQ ID NO: 18079 - protein, 20 aa, synthetic construct
  source 1..20: note = Seed: SATGFKQSSKALQRPVASDF
SATGVKQMSKALNRPVASDF

SEQ ID NO: 18080 - protein, 20 aa, synthetic construct
  source 1..20: note = Seed: SATGFKQSSKALQRPVASDF
SATGVKQMSKALPRPVASDF

SEQ ID NO: 18081 - protein, 20 aa, synthetic construct
  source 1..20: note = Seed: SATGFKQSSKALQRPVASDF
SATGVKQMSKALQRPVASDF

SEQ ID NO: 18082 - protein, 20 aa, synthetic construct
  source 1..20: note = Seed: SATGFKQSSKALQRPVASDF
SATGVKQMSKALRRPVASDF

SEQ ID NO: 18083 - protein, 20 aa, synthetic construct
  source 1..20: note = Seed: SATGFKQSSKALQRPVASDF
SATGVKQMSKALSRPVASDF

SEQ ID NO: 18084 - protein, 20 aa, synthetic construct
  source 1..20: note = Seed: SATGFKQSSKALQRPVASDF
SATGVKQMSKALTRPVASDF

SEQ ID NO: 18085 - protein, 20 aa, synthetic construct
  source 1..20: note = Seed: SATGFKQSSKALQRPVASDF
SATGVKQMSKALVRPVASDF

SEQ ID NO: 18086 - protein, 20 aa, synthetic construct
  source 1..20: note = Seed: SATGFKQSSKALQRPVASDF
SATGVKQMSKALYRPVASDF

SEQ ID NO: 18087 - protein, 20 aa, synthetic construct
  source 1..20: note = Seed: SATGFKQSSKALQRPVASDF
SATGVKQMSLALCRPVASDF

SEQ ID NO: 18088 - protein, 20 aa, synthetic construct
  source 1..20: note = Seed: SATGFKQSSKALQRPVASDF
SATGVKQMSLALGRPVASDF

SEQ ID NO: 18089 - protein, 20 aa, synthetic construct
  source 1..20: note = Seed: SATGFKQSSKALQRPVASDF
SATGVKQMSLALHRPVASDF

SEQ ID NO: 18090 - protein, 20 aa, synthetic construct
  source 1..20: note = Seed: SATGFKQSSKALQRPVASDF
SATGVKQMSLALNRPVASDF

SEQ ID NO: 18091 - protein, 20 aa, synthetic construct
  source 1..20: note = Seed: SATGFKQSSKALQRPVASDF
SATGVKQMSLALSRPVASDF

SEQ ID NO: 18092 - protein, 20 aa, synthetic construct
  source 1..20: note = Seed: SATGFKQSSKALQRPVASDF
SATGVKQMSMALGRPVASDF

SEQ ID NO: 18093 - protein, 20 aa, synthetic construct
  source 1..20: note = Seed: SATGFKQSSKALQRPVASDF
SATGVKQMSMALHRPVASDF

SEQ ID NO: 18094 - protein, 20 aa, synthetic construct
  source 1..20: note = Seed: SATGFKQSSKALQRPVASDF
SATGVKQMSMALNRPVASDF

SEQ ID NO: 18095 - protein, 20 aa, synthetic construct
  source 1..20: note = Seed: SATGFKQSSKALQRPVASDF
SATGVKQMSNALARPVASDF

SEQ ID NO: 18096 - protein, 20 aa, synthetic construct
  source 1..20: note = Seed: SATGFKQSSKALQRPVASDF
SATGVKQMSNALGRPVASDF

SEQ ID NO: 18097 - protein, 20 aa, synthetic construct
  source 1..20: note = Seed: SATGFKQSSKALQRPVASDF
SATGVKQMSNALIRPVASDF

SEQ ID NO: 18098 - protein, 20 aa, synthetic construct
  source 1..20: note = Seed: SATGFKQSSKALQRPVASDF
SATGVKQMSNALLRPVASDF

SEQ ID NO: 18099 - protein, 20 aa, synthetic construct
  source 1..20: note = Seed: SATGFKQSSKALQRPVASDF
SATGVKQMSNALMRPVASDF

SEQ ID NO: 18100 - protein, 20 aa, synthetic construct
  source 1..20: note = Seed: SATGFKQSSKALQRPVASDF
SATGVKQMSNALNRPVASDF

SEQ ID NO: 18101 - protein, 20 aa, synthetic construct
  source 1..20: note = Seed: SATGFKQSSKALQRPVASDF
SATGVKQMSNALSRPVASDF

SEQ ID NO: 18102 - protein, 20 aa, synthetic construct
  source 1..20: note = Seed: SATGFKQSSKALQRPVASDF
SATGVKQMSNALTRPVASDF

SEQ ID NO: 18103 - protein, 20 aa, synthetic construct
  source 1..20: note = Seed: SATGFKQSSKALQRPVASDF
SATGVKQMSNALVRPVASDF

SEQ ID NO: 18104 - protein, 20 aa, synthetic construct
  source 1..20: note = Seed: SATGFKQSSKALQRPVASDF
SATGVKQMSPALARPVASDF

SEQ ID NO: 18105 - protein, 20 aa, synthetic construct
  source 1..20: note = Seed: SATGFKQSSKALQRPVASDF
SATGVKQMSPALGRPVASDF

SEQ ID NO: 18106 - protein, 20 aa, synthetic construct
  source 1..20: note = Seed: SATGFKQSSKALQRPVASDF
SATGVKQMSPALHRPVASDF

SEQ ID NO: 18107 - protein, 20 aa, synthetic construct
  source 1..20: note = Seed: SATGFKQSSKALQRPVASDF
SATGVKQMSPALIRPVASDF

SEQ ID NO: 18108 - protein, 20 aa, synthetic construct
  source 1..20: note = Seed: SATGFKQSSKALQRPVASDF
SATGVKQMSPALLRPVASDF

SEQ ID NO: 18109 - protein, 20 aa, synthetic construct
  source 1..20: note = Seed: SATGFKQSSKALQRPVASDF
SATGVKQMSPALMRPVASDF

SEQ ID NO: 18110 - protein, 20 aa, synthetic construct
  source 1..20: note = Seed: SATGFKQSSKALQRPVASDF
SATGVKQMSPALNRPVASDF

SEQ ID NO: 18111 - protein, 20 aa, synthetic construct
  source 1..20: note = Seed: SATGFKQSSKALQRPVASDF
SATGVKQMSPALSRPVASDF

SEQ ID NO: 18112 - protein, 20 aa, synthetic construct
  source 1..20: note = Seed: SATGFKQSSKALQRPVASDF
SATGVKQMSPALTRPVASDF

SEQ ID NO: 18113 - protein, 20 aa, synthetic construct
  source 1..20: note = Seed: SATGFKQSSKALQRPVASDF
SATGVKQMSPALVRPVASDF

SEQ ID NO: 18114 - protein, 20 aa, synthetic construct
  source 1..20: note = Seed: SATGFKQSSKALQRPVASDF
SATGVKQMSQALVRPVASDF

SEQ ID NO: 18115 - protein, 20 aa, synthetic construct
  source 1..20: note = Seed: SATGFKQSSKALQRPVASDF
SATGVKQMSRALARPVASDF

SEQ ID NO: 18116 - protein, 20 aa, synthetic construct
  source 1..20: note = Seed: SATGFKQSSKALQRPVASDF
SATGVKQMSRALFRPVASDF

SEQ ID NO: 18117 - protein, 20 aa, synthetic construct
  source 1..20: note = Seed: SATGFKQSSKALQRPVASDF
SATGVKQMSRALGRPVASDF

SEQ ID NO: 18118 - protein, 20 aa, synthetic construct
  source 1..20: note = Seed: SATGFKQSSKALQRPVASDF
SATGVKQMSRALHRPVASDF

SEQ ID NO: 18119 - protein, 20 aa, synthetic construct
  source 1..20: note = Seed: SATGFKQSSKALQRPVASDF
SATGVKQMSRALIRPVASDF

SEQ ID NO: 18120 - protein, 20 aa, synthetic construct
  source 1..20: note = Seed: SATGFKQSSKALQRPVASDF
SATGVKQMSRALKRPVASDF

SEQ ID NO: 18121 - protein, 20 aa, synthetic construct
  source 1..20: note = Seed: SATGFKQSSKALQRPVASDF
SATGVKQMSRALLRPVASDF

SEQ ID NO: 18122 - protein, 20 aa, synthetic construct
  source 1..20: note = Seed: SATGFKQSSKALQRPVASDF
SATGVKQMSRALMRPVASDF

SEQ ID NO: 18123 - protein, 20 aa, synthetic construct
  source 1..20: note = Seed: SATGFKQSSKALQRPVASDF
SATGVKQMSRALNRPVASDF

SEQ ID NO: 18124 - protein, 20 aa, synthetic construct
  source 1..20: note = Seed: SATGFKQSSKALQRPVASDF
SATGVKQMSRALPRPVASDF

SEQ ID NO: 18125 - protein, 20 aa, synthetic construct
  source 1..20: note = Seed: SATGFKQSSKALQRPVASDF
SATGVKQMSRALQRPVASDF

SEQ ID NO: 18126 - protein, 20 aa, synthetic construct
  source 1..20: note = Seed: SATGFKQSSKALQRPVASDF
SATGVKQMSRALRRPVASDF

SEQ ID NO: 18127 - protein, 20 aa, synthetic construct
  source 1..20: note = Seed: SATGFKQSSKALQRPVASDF
SATGVKQMSRALSRPVASDF

SEQ ID NO: 18128 - protein, 20 aa, synthetic construct
  source 1..20: note = Seed: SATGFKQSSKALQRPVASDF
SATGVKQMSRALTRPVASDF

SEQ ID NO: 18129 - protein, 20 aa, synthetic construct
  source 1..20: note = Seed: SATGFKQSSKALQRPVASDF
SATGVKQMSRALVRPVASDF

SEQ ID NO: 18130 - protein, 20 aa, synthetic construct
  source 1..20: note = Seed: SATGFKQSSKALQRPVASDF
SATGVKQMSRALWRPVASDF

SEQ ID NO: 18131 - protein, 20 aa, synthetic construct
  source 1..20: note = Seed: SATGFKQSSKALQRPVASDF
SATGVKQMSRALYRPVASDF

SEQ ID NO: 18132 - protein, 20 aa, synthetic construct
  source 1..20: note = Seed: SATGFKQSSKALQRPVASDF
SATGVKQMSSALARPVASDF

SEQ ID NO: 18133 - protein, 20 aa, synthetic construct
  source 1..20: note = Seed: SATGFKQSSKALQRPVASDF
SATGVKQMSSALCRPVASDF

SEQ ID NO: 18134 - protein, 20 aa, synthetic construct
  source 1..20: note = Seed: SATGFKQSSKALQRPVASDF
SATGVKQMSSALFRPVASDF

SEQ ID NO: 18135 - protein, 20 aa, synthetic construct
  source 1..20: note = Seed: SATGFKQSSKALQRPVASDF
SATGVKQMSSALGRPVASDF

SEQ ID NO: 18136 - protein, 20 aa, synthetic construct
  source 1..20: note = Seed: SATGFKQSSKALQRPVASDF
SATGVKQMSSALIRPVASDF

SEQ ID NO: 18137 - protein, 20 aa, synthetic construct
  source 1..20: note = Seed: SATGFKQSSKALQRPVASDF
SATGVKQMSSALLRPVASDF

SEQ ID NO: 18138 - protein, 20 aa, synthetic construct
  source 1..20: note = Seed: SATGFKQSSKALQRPVASDF
SATGVKQMSSALMRPVASDF

SEQ ID NO: 18139 - protein, 20 aa, synthetic construct
  source 1..20: note = Seed: SATGFKQSSKALQRPVASDF
SATGVKQMSSALNRPVASDF

SEQ ID NO: 18140 - protein, 20 aa, synthetic construct
  source 1..20: note = Seed: SATGFKQSSKALQRPVASDF
SATGVKQMSSALRRPVASDF

SEQ ID NO: 18141 - protein, 20 aa, synthetic construct
  source 1..20: note = Seed: SATGFKQSSKALQRPVASDF
SATGVKQMSSALSRPVASDF

SEQ ID NO: 18142 - protein, 20 aa, synthetic construct
  source 1..20: note = Seed: SATGFKQSSKALQRPVASDF
SATGVKQMSSALTRPVASDF

SEQ ID NO: 18143 - protein, 20 aa, synthetic construct
  source 1..20: note = Seed: SATGFKQSSKALQRPVASDF
SATGVKQMSSALVRPVASDF

SEQ ID NO: 18144 - protein, 20 aa, synthetic construct
  source 1..20: note = Seed: SATGFKQSSKALQRPVASDF
SATGVKQMSTALARPVASDF

SEQ ID NO: 18145 - protein, 20 aa, synthetic construct
  source 1..20: note = Seed: SATGFKQSSKALQRPVASDF
SATGVKQMSTALGRPVASDF

SEQ ID NO: 18146 - protein, 20 aa, synthetic construct
  source 1..20: note = Seed: SATGFKQSSKALQRPVASDF
SATGVKQMSTALIRPVASDF

SEQ ID NO: 18147 - protein, 20 aa, synthetic construct
  source 1..20: note = Seed: SATGFKQSSKALQRPVASDF
SATGVKQMSTALKRPVASDF

SEQ ID NO: 18148 - protein, 20 aa, synthetic construct
  source 1..20: note = Seed: SATGFKQSSKALQRPVASDF
SATGVKQMSTALLRPVASDF

SEQ ID NO: 18149 - protein, 20 aa, synthetic construct
  source 1..20: note = Seed: SATGFKQSSKALQRPVASDF
SATGVKQMSTALMRPVASDF

SEQ ID NO: 18150 - protein, 20 aa, synthetic construct
  source 1..20: note = Seed: SATGFKQSSKALQRPVASDF
SATGVKQMSTALNRPVASDF

SEQ ID NO: 18151 - protein, 20 aa, synthetic construct
  source 1..20: note = Seed: SATGFKQSSKALQRPVASDF
SATGVKQMSTALRRPVASDF

SEQ ID NO: 18152 - protein, 20 aa, synthetic construct
  source 1..20: note = Seed: SATGFKQSSKALQRPVASDF
SATGVKQMSTALSRPVASDF

SEQ ID NO: 18153 - protein, 20 aa, synthetic construct
  source 1..20: note = Seed: SATGFKQSSKALQRPVASDF
SATGVKQMSTALTRPVASDF

SEQ ID NO: 18154 - protein, 20 aa, synthetic construct
  source 1..20: note = Seed: SATGFKQSSKALQRPVASDF
SATGVKQMSTALVRPVASDF

SEQ ID NO: 18155 - protein, 20 aa, synthetic construct
  source 1..20: note = Seed: SATGFKQSSKALQRPVASDF
SATGVKQMSVALARPVASDF

SEQ ID NO: 18156 - protein, 20 aa, synthetic construct
  source 1..20: note = Seed: SATGFKQSSKALQRPVASDF
SATGVKQMSVALFRPVASDF

SEQ ID NO: 18157 - protein, 20 aa, synthetic construct
  source 1..20: note = Seed: SATGFKQSSKALQRPVASDF
SATGVKQMSVALGRPVASDF

SEQ ID NO: 18158 - protein, 20 aa, synthetic construct
  source 1..20: note = Seed: SATGFKQSSKALQRPVASDF
SATGVKQMSVALHRPVASDF

SEQ ID NO: 18159 - protein, 20 aa, synthetic construct
  source 1..20: note = Seed: SATGFKQSSKALQRPVASDF
SATGVKQMSVALIRPVASDF

SEQ ID NO: 18160 - protein, 20 aa, synthetic construct
  source 1..20: note = Seed: SATGFKQSSKALQRPVASDF
SATGVKQMSVALLRPVASDF

SEQ ID NO: 18161 - protein, 20 aa, synthetic construct
  source 1..20: note = Seed: SATGFKQSSKALQRPVASDF
SATGVKQMSVALMRPVASDF

SEQ ID NO: 18162 - protein, 20 aa, synthetic construct
  source 1..20: note = Seed: SATGFKQSSKALQRPVASDF
SATGVKQMSVALNRPVASDF

SEQ ID NO: 18163 - protein, 20 aa, synthetic construct
  source 1..20: note = Seed: SATGFKQSSKALQRPVASDF
SATGVKQMSVALQRPVASDF

SEQ ID NO: 18164 - protein, 20 aa, synthetic construct
  source 1..20: note = Seed: SATGFKQSSKALQRPVASDF
SATGVKQMSVALRRPVASDF

SEQ ID NO: 18165 - protein, 20 aa, synthetic construct
  source 1..20: note = Seed: SATGFKQSSKALQRPVASDF
SATGVKQMSVALSRPVASDF

SEQ ID NO: 18166 - protein, 20 aa, synthetic construct
  source 1..20: note = Seed: SATGFKQSSKALQRPVASDF
SATGVKQMSVALTRPVASDF

SEQ ID NO: 18167 - protein, 20 aa, synthetic construct
  source 1..20: note = Seed: SATGFKQSSKALQRPVASDF
SATGVKQMSVALVRPVASDF

SEQ ID NO: 18168 - protein, 20 aa, synthetic construct
  source 1..20: note = Seed: SATGFKQSSKALQRPVASDF
SATGVKQQSAALARPVASDF

SEQ ID NO: 18169 - protein, 20 aa, synthetic construct
  source 1..20: note = Seed: SATGFKQSSKALQRPVASDF
SATGVKQQSAALIRPVASDF

SEQ ID NO: 18170 - protein, 20 aa, synthetic construct
  source 1..20: note = Seed: SATGFKQSSKALQRPVASDF
SATGVKQQSAALLRPVASDF

SEQ ID NO: 18171 - protein, 20 aa, synthetic construct
  source 1..20: note = Seed: SATGFKQSSKALQRPVASDF
SATGVKQQSAALMRPVASDF

SEQ ID NO: 18172 - protein, 20 aa, synthetic construct
  source 1..20: note = Seed: SATGFKQSSKALQRPVASDF
SATGVKQQSAALSRPVASDF

SEQ ID NO: 18173 - protein, 20 aa, synthetic construct
  source 1..20: note = Seed: SATGFKQSSKALQRPVASDF
SATGVKQQSAALTRPVASDF

SEQ ID NO: 18174 - protein, 20 aa, synthetic construct
  source 1..20: note = Seed: SATGFKQSSKALQRPVASDF
SATGVKQQSAALVRPVASDF

SEQ ID NO: 18175 - protein, 20 aa, synthetic construct
  source 1..20: note = Seed: SATGFKQSSKALQRPVASDF
SATGVKQQSGALARPVASDF

SEQ ID NO: 18176 - protein, 20 aa, synthetic construct
  source 1..20: note = Seed: SATGFKQSSKALQRPVASDF
SATGVKQQSGALIRPVASDF

SEQ ID NO: 18177 - protein, 20 aa, synthetic construct
  source 1..20: note = Seed: SATGFKQSSKALQRPVASDF
SATGVKQQSGALLRPVASDF

SEQ ID NO: 18178 - protein, 20 aa, synthetic construct
  source 1..20: note = Seed: SATGFKQSSKALQRPVASDF
SATGVKQQSGALVRPVASDF

SEQ ID NO: 18179 - protein, 20 aa, synthetic construct
  source 1..20: note = Seed: SATGFKQSSKALQRPVASDF
SATGVKQQSIALNRPVASDF

SEQ ID NO: 18180 - protein, 20 aa, synthetic construct
  source 1..20: note = Seed: SATGFKQSSKALQRPVASDF
SATGVKQQSIALSRPVASDF

SEQ ID NO: 18181 - protein, 20 aa, synthetic construct
  source 1..20: note = Seed: SATGFKQSSKALQRPVASDF
SATGVKQQSLALSRPVASDF

SEQ ID NO: 18182 - protein, 20 aa, synthetic construct
  source 1..20: note = Seed: SATGFKQSSKALQRPVASDF
SATGVKQQSMALSRPVASDF

SEQ ID NO: 18183 - protein, 20 aa, synthetic construct
  source 1..20: note = Seed: SATGFKQSSKALQRPVASDF
SATGVKQQSPALIRPVASDF

SEQ ID NO: 18184 - protein, 20 aa, synthetic construct
  source 1..20: note = Seed: SATGFKQSSKALQRPVASDF
SATGVKQQSPALLRPVASDF

SEQ ID NO: 18185 - protein, 20 aa, synthetic construct
  source 1..20: note = Seed: SATGFKQSSKALQRPVASDF
SATGVKQQSPALVRPVASDF

SEQ ID NO: 18186 - protein, 20 aa, synthetic construct
  source 1..20: note = Seed: SATGFKQSSKALQRPVASDF
SATGVKQQSRALARPVASDF

SEQ ID NO: 18187 - protein, 20 aa, synthetic construct
  source 1..20: note = Seed: SATGFKQSSKALQRPVASDF
SATGVKQQSRALSRPVASDF

SEQ ID NO: 18188 - protein, 20 aa, synthetic construct
  source 1..20: note = Seed: SATGFKQSSKALQRPVASDF
SATGVKQQSSALARPVASDF

SEQ ID NO: 18189 - protein, 20 aa, synthetic construct
  source 1..20: note = Seed: SATGFKQSSKALQRPVASDF
SATGVKQQSSALIRPVASDF

SEQ ID NO: 18190 - protein, 20 aa, synthetic construct
  source 1..20: note = Seed: SATGFKQSSKALQRPVASDF
SATGVKQQSSALLRPVASDF

SEQ ID NO: 18191 - protein, 20 aa, synthetic construct
  source 1..20: note = Seed: SATGFKQSSKALQRPVASDF
SATGVKQQSSALVRPVASDF

SEQ ID NO: 18192 - protein, 20 aa, synthetic construct
  source 1..20: note = Seed: SATGFKQSSKALQRPVASDF
SATGVKQQSVALARPVASDF

SEQ ID NO: 18193 - protein, 20 aa, synthetic construct
  source 1..20: note = Seed: SATGFKQSSKALQRPVASDF
SATGVKQQSVALIRPVASDF

SEQ ID NO: 18194 - protein, 20 aa, synthetic construct
  source 1..20: note = Seed: SATGFKQSSKALQRPVASDF
SATGVKQQSVALQRPVASDF

SEQ ID NO: 18195 - protein, 20 aa, synthetic construct
  source 1..20: note = Seed: SATGFKQSSKALQRPVASDF
SATGVKQQSVALSRPVASDF

SEQ ID NO: 18196 - protein, 20 aa, synthetic construct
  source 1..20: note = Seed: SATGFKQSSKALQRPVASDF
SATGVKQQSVALTRPVASDF

SEQ ID NO: 18197 - protein, 20 aa, synthetic construct
  source 1..20: note = Seed: SATGFKQSSKALQRPVASDF
SATGVKQQSVALVRPVASDF

SEQ ID NO: 18198 - protein, 20 aa, synthetic construct
  source 1..20: note = Seed: SATGFKQSSKALQRPVASDF
SATGVKQRSRALRRPVASDF

SEQ ID NO: 18199 - protein, 20 aa, synthetic construct
  source 1..20: note = Seed: SATGFKQSSKALQRPVASDF
SATGVKQSSAALARPVASDF

SEQ ID NO: 18200 - protein, 20 aa, synthetic construct
  source 1..20: note = Seed: SATGFKQSSKALQRPVASDF
SATGVKQSSAALIRPVASDF

SEQ ID NO: 18201 - protein, 20 aa, synthetic construct
  source 1..20: note = Seed: SATGFKQSSKALQRPVASDF
SATGVKQSSAALLRPVASDF

SEQ ID NO: 18202 - protein, 20 aa, synthetic construct
  source 1..20: note = Seed: SATGFKQSSKALQRPVASDF
SATGVKQSSAALVRPVASDF

SEQ ID NO: 18203 - protein, 20 aa, synthetic construct
  source 1..20: note = Seed: SATGFKQSSKALQRPVASDF
SATGVKQSSFALARPVASDF

SEQ ID NO: 18204 - protein, 20 aa, synthetic construct
  source 1..20: note = Seed: SATGFKQSSKALQRPVASDF
SATGVKQSSFALIRPVASDF

SEQ ID NO: 18205 - protein, 20 aa, synthetic construct
  source 1..20: note = Seed: SATGFKQSSKALQRPVASDF
SATGVKQSSFALLRPVASDF

SEQ ID NO: 18206 - protein, 20 aa, synthetic construct
  source 1..20: note = Seed: SATGFKQSSKALQRPVASDF
SATGVKQSSFALVRPVASDF

SEQ ID NO: 18207 - protein, 20 aa, synthetic construct
  source 1..20: note = Seed: SATGFKQSSKALQRPVASDF
SATGVKQSSRALRRPVASDF

SEQ ID NO: 18208 - protein, 20 aa, synthetic construct
  source 1..20: note = Seed: SATGFKQSSKALQRPVASDF
SATGVKQSSVALSRPVASDF

SEQ ID NO: 18209 - protein, 20 aa, synthetic construct
  source 1..20: note = Seed: SATGFKQSSKALQRPVASDF
SATGVKQTSAALIRPVASDF

SEQ ID NO: 18210 - protein, 20 aa, synthetic construct
  source 1..20: note = Seed: SATGFKQSSKALQRPVASDF
SATGVKQTSAALLRPVASDF

SEQ ID NO: 18211 - protein, 20 aa, synthetic construct
  source 1..20: note = Seed: SATGFKQSSKALQRPVASDF
SATGVKQTSAALVRPVASDF

SEQ ID NO: 18212 - protein, 20 aa, synthetic construct
  source 1..20: note = Seed: SATGFKQSSKALQRPVASDF
SATGVKQTSFALARPVASDF

SEQ ID NO: 18213 - protein, 20 aa, synthetic construct
  source 1..20: note = Seed: SATGFKQSSKALQRPVASDF
SATGVKQTSFALFRPVASDF

SEQ ID NO: 18214 - protein, 20 aa, synthetic construct
  source 1..20: note = Seed: SATGFKQSSKALQRPVASDF
SATGVKQTSFALIRPVASDF

SEQ ID NO: 18215 - protein, 20 aa, synthetic construct
  source 1..20: note = Seed: SATGFKQSSKALQRPVASDF
SATGVKQTSFALLRPVASDF

SEQ ID NO: 18216 - protein, 20 aa, synthetic construct
  source 1..20: note = Seed: SATGFKQSSKALQRPVASDF
SATGVKQTSFALMRPVASDF

SEQ ID NO: 18217 - protein, 20 aa, synthetic construct
  source 1..20: note = Seed: SATGFKQSSKALQRPVASDF
SATGVKQTSFALVRPVASDF

SEQ ID NO: 18218 - protein, 20 aa, synthetic construct
  source 1..20: note = Seed: SATGFKQSSKALQRPVASDF
SATGVKQTSRALRRPVASDF

SEQ ID NO: 18219 - protein, 20 aa, synthetic construct
  source 1..20: note = Seed: SATGFKQSSKALQRPVASDF
SATGVKQVSAALARPVASDF

SEQ ID NO: 18220 - protein, 20 aa, synthetic construct
  source 1..20: note = Seed: SATGFKQSSKALQRPVASDF
SATGVKQVSAALIRPVASDF

SEQ ID NO: 18221 - protein, 20 aa, synthetic construct
  source 1..20: note = Seed: SATGFKQSSKALQRPVASDF
SATGVKQVSAALLRPVASDF

SEQ ID NO: 18222 - protein, 20 aa, synthetic construct
  source 1..20: note = Seed: SATGFKQSSKALQRPVASDF
SATGVKQVSAALMRPVASDF

SEQ ID NO: 18223 - protein, 20 aa, synthetic construct
  source 1..20: note = Seed: SATGFKQSSKALQRPVASDF
SATGVKQVSAALNRPVASDF

SEQ ID NO: 18224 - protein, 20 aa, synthetic construct
  source 1..20: note = Seed: SATGFKQSSKALQRPVASDF
SATGVKQVSAALSRPVASDF

SEQ ID NO: 18225 - protein, 20 aa, synthetic construct
  source 1..20: note = Seed: SATGFKQSSKALQRPVASDF
SATGVKQVSAALTRPVASDF

SEQ ID NO: 18226 - protein, 20 aa, synthetic construct
  source 1..20: note = Seed: SATGFKQSSKALQRPVASDF
SATGVKQVSAALVRPVASDF

SEQ ID NO: 18227 - protein, 20 aa, synthetic construct
  source 1..20: note = Seed: SATGFKQSSKALQRPVASDF
SATGVKQVSFALARPVASDF

SEQ ID NO: 18228 - protein, 20 aa, synthetic construct
  source 1..20: note = Seed: SATGFKQSSKALQRPVASDF
SATGVKQVSFALIRPVASDF

SEQ ID NO: 18229 - protein, 20 aa, synthetic construct
  source 1..20: note = Seed: SATGFKQSSKALQRPVASDF
SATGVKQVSFALLRPVASDF

SEQ ID NO: 18230 - protein, 20 aa, synthetic construct
  source 1..20: note = Seed: SATGFKQSSKALQRPVASDF
SATGVKQVSFALMRPVASDF

SEQ ID NO: 18231 - protein, 20 aa, synthetic construct
  source 1..20: note = Seed: SATGFKQSSKALQRPVASDF
SATGVKQVSFALVRPVASDF

SEQ ID NO: 18232 - protein, 20 aa, synthetic construct
  source 1..20: note = Seed: SATGFKQSSKALQRPVASDF
SATGVKQVSGALARPVASDF

SEQ ID NO: 18233 - protein, 20 aa, synthetic construct
  source 1..20: note = Seed: SATGFKQSSKALQRPVASDF
SATGVKQVSGALIRPVASDF

SEQ ID NO: 18234 - protein, 20 aa, synthetic construct
  source 1..20: note = Seed: SATGFKQSSKALQRPVASDF
SATGVKQVSGALLRPVASDF

SEQ ID NO: 18235 - protein, 20 aa, synthetic construct
  source 1..20: note = Seed: SATGFKQSSKALQRPVASDF
SATGVKQVSGALSRPVASDF

SEQ ID NO: 18236 - protein, 20 aa, synthetic construct
  source 1..20: note = Seed: SATGFKQSSKALQRPVASDF
SATGVKQVSGALTRPVASDF

SEQ ID NO: 18237 - protein, 20 aa, synthetic construct
  source 1..20: note = Seed: SATGFKQSSKALQRPVASDF
SATGVKQVSGALVRPVASDF

SEQ ID NO: 18238 - protein, 20 aa, synthetic construct
  source 1..20: note = Seed: SATGFKQSSKALQRPVASDF
SATGVKQVSHALRRPVASDF

SEQ ID NO: 18239 - protein, 20 aa, synthetic construct
  source 1..20: note = Seed: SATGFKQSSKALQRPVASDF
SATGVKQVSIALGRPVASDF

SEQ ID NO: 18240 - protein, 20 aa, synthetic construct
  source 1..20: note = Seed: SATGFKQSSKALQRPVASDF
SATGVKQVSIALNRPVASDF

SEQ ID NO: 18241 - protein, 20 aa, synthetic construct
  source 1..20: note = Seed: SATGFKQSSKALQRPVASDF
SATGVKQVSKALARPVASDF

SEQ ID NO: 18242 - protein, 20 aa, synthetic construct
  source 1..20: note = Seed: SATGFKQSSKALQRPVASDF
SATGVKQVSKALGRPVASDF

SEQ ID NO: 18243 - protein, 20 aa, synthetic construct
  source 1..20: note = Seed: SATGFKQSSKALQRPVASDF
SATGVKQVSKALHRPVASDF

SEQ ID NO: 18244 - protein, 20 aa, synthetic construct
  source 1..20: note = Seed: SATGFKQSSKALQRPVASDF
SATGVKQVSKALKRPVASDF

SEQ ID NO: 18245 - protein, 20 aa, synthetic construct
  source 1..20: note = Seed: SATGFKQSSKALQRPVASDF
SATGVKQVSKALQRPVASDF

SEQ ID NO: 18246 - protein, 20 aa, synthetic construct
  source 1..20: note = Seed: SATGFKQSSKALQRPVASDF
SATGVKQVSKALRRPVASDF

SEQ ID NO: 18247 - protein, 20 aa, synthetic construct
  source 1..20: note = Seed: SATGFKQSSKALQRPVASDF
SATGVKQVSKALSRPVASDF

SEQ ID NO: 18248 - protein, 20 aa, synthetic construct
  source 1..20: note = Seed: SATGFKQSSKALQRPVASDF
SATGVKQVSKALTRPVASDF

SEQ ID NO: 18249 - protein, 20 aa, synthetic construct
  source 1..20: note = Seed: SATGFKQSSKALQRPVASDF
SATGVKQVSLALIRPVASDF

SEQ ID NO: 18250 - protein, 20 aa, synthetic construct
  source 1..20: note = Seed: SATGFKQSSKALQRPVASDF
SATGVKQVSLALLRPVASDF

SEQ ID NO: 18251 - protein, 20 aa, synthetic construct
  source 1..20: note = Seed: SATGFKQSSKALQRPVASDF
SATGVKQVSLALNRPVASDF

SEQ ID NO: 18252 - protein, 20 aa, synthetic construct
  source 1..20: note = Seed: SATGFKQSSKALQRPVASDF
SATGVKQVSPALARPVASDF

SEQ ID NO: 18253 - protein, 20 aa, synthetic construct
  source 1..20: note = Seed: SATGFKQSSKALQRPVASDF
SATGVKQVSPALIRPVASDF

SEQ ID NO: 18254 - protein, 20 aa, synthetic construct
  source 1..20: note = Seed: SATGFKQSSKALQRPVASDF
SATGVKQVSPALLRPVASDF

SEQ ID NO: 18255 - protein, 20 aa, synthetic construct
  source 1..20: note = Seed: SATGFKQSSKALQRPVASDF
SATGVKQVSPALNRPVASDF

SEQ ID NO: 18256 - protein, 20 aa, synthetic construct
  source 1..20: note = Seed: SATGFKQSSKALQRPVASDF
SATGVKQVSPALSRPVASDF

SEQ ID NO: 18257 - protein, 20 aa, synthetic construct
  source 1..20: note = Seed: SATGFKQSSKALQRPVASDF
SATGVKQVSPALVRPVASDF

SEQ ID NO: 18258 - protein, 20 aa, synthetic construct
  source 1..20: note = Seed: SATGFKQSSKALQRPVASDF
SATGVKQVSRALARPVASDF

SEQ ID NO: 18259 - protein, 20 aa, synthetic construct
  source 1..20: note = Seed: SATGFKQSSKALQRPVASDF
SATGVKQVSRALGRPVASDF

SEQ ID NO: 18260 - protein, 20 aa, synthetic construct
  source 1..20: note = Seed: SATGFKQSSKALQRPVASDF
SATGVKQVSRALHRPVASDF

SEQ ID NO: 18261 - protein, 20 aa, synthetic construct
  source 1..20: note = Seed: SATGFKQSSKALQRPVASDF
SATGVKQVSRALIRPVASDF

SEQ ID NO: 18262 - protein, 20 aa, synthetic construct
  source 1..20: note = Seed: SATGFKQSSKALQRPVASDF
SATGVKQVSRALKRPVASDF

SEQ ID NO: 18263 - protein, 20 aa, synthetic construct
  source 1..20: note = Seed: SATGFKQSSKALQRPVASDF
SATGVKQVSRALLRPVASDF

SEQ ID NO: 18264 - protein, 20 aa, synthetic construct
  source 1..20: note = Seed: SATGFKQSSKALQRPVASDF
SATGVKQVSRALMRPVASDF

SEQ ID NO: 18265 - protein, 20 aa, synthetic construct
  source 1..20: note = Seed: SATGFKQSSKALQRPVASDF
SATGVKQVSRALQRPVASDF

SEQ ID NO: 18266 - protein, 20 aa, synthetic construct
  source 1..20: note = Seed: SATGFKQSSKALQRPVASDF
SATGVKQVSRALRRPVASDF

SEQ ID NO: 18267 - protein, 20 aa, synthetic construct
  source 1..20: note = Seed: SATGFKQSSKALQRPVASDF
SATGVKQVSRALSRPVASDF

SEQ ID NO: 18268 - protein, 20 aa, synthetic construct
  source 1..20: note = Seed: SATGFKQSSKALQRPVASDF
SATGVKQVSRALTRPVASDF

SEQ ID NO: 18269 - protein, 20 aa, synthetic construct
  source 1..20: note = Seed: SATGFKQSSKALQRPVASDF
SATGVKQVSRALVRPVASDF

SEQ ID NO: 18270 - protein, 20 aa, synthetic construct
  source 1..20: note = Seed: SATGFKQSSKALQRPVASDF
SATGVKQVSRALYRPVASDF

SEQ ID NO: 18271 - protein, 20 aa, synthetic construct
  source 1..20: note = Seed: SATGFKQSSKALQRPVASDF
SATGVKQVSSALARPVASDF

SEQ ID NO: 18272 - protein, 20 aa, synthetic construct
  source 1..20: note = Seed: SATGFKQSSKALQRPVASDF
SATGVKQVSSALIRPVASDF

SEQ ID NO: 18273 - protein, 20 aa, synthetic construct
  source 1..20: note = Seed: SATGFKQSSKALQRPVASDF
SATGVKQVSSALLRPVASDF

SEQ ID NO: 18274 - protein, 20 aa, synthetic construct
  source 1..20: note = Seed: SATGFKQSSKALQRPVASDF
SATGVKQVSSALNRPVASDF

SEQ ID NO: 18275 - protein, 20 aa, synthetic construct
  source 1..20: note = Seed: SATGFKQSSKALQRPVASDF
SATGVKQVSSALSRPVASDF

SEQ ID NO: 18276 - protein, 20 aa, synthetic construct
  source 1..20: note = Seed: SATGFKQSSKALQRPVASDF
SATGVKQVSSALVRPVASDF

SEQ ID NO: 18277 - protein, 20 aa, synthetic construct
  source 1..20: note = Seed: SATGFKQSSKALQRPVASDF
SATGVKQVSTALARPVASDF

SEQ ID NO: 18278 - protein, 20 aa, synthetic construct
  source 1..20: note = Seed: SATGFKQSSKALQRPVASDF
SATGVKQVSTALSRPVASDF

SEQ ID NO: 18279 - protein, 20 aa, synthetic construct
  source 1..20: note = Seed: SATGFKQSSKALQRPVASDF
SATGVKQVSVALARPVASDF

SEQ ID NO: 18280 - protein, 20 aa, synthetic construct
  source 1..20: note = Seed: SATGFKQSSKALQRPVASDF
SATGVKQVSVALNRPVASDF

SEQ ID NO: 18281 - protein, 20 aa, synthetic construct
  source 1..20: note = Seed: SATGFKQSSKALQRPVASDF
SATGVKQVSVALSRPVASDF

SEQ ID NO: 18282 - protein, 20 aa, synthetic construct
  source 1..20: note = Seed: SATGFKQSSKALQRPVASDF
SATGVKQVSVALTRPVASDF

SEQ ID NO: 18283 - protein, 20 aa, synthetic construct
  source 1..20: note = Seed: SATGFKQSSKALQRPVASDF
SATGVKQWSAALIRPVASDF

SEQ ID NO: 18284 - protein, 20 aa, synthetic construct
  source 1..20: note = Seed: SATGFKQSSKALQRPVASDF
SATGVKQWSAALLRPVASDF

SEQ ID NO: 18285 - protein, 20 aa, synthetic construct
  source 1..20: note = Seed: SATGFKQSSKALQRPVASDF
SATGVKQWSAALMRPVASDF

SEQ ID NO: 18286 - protein, 20 aa, synthetic construct
  source 1..20: note = Seed: SATGFKQSSKALQRPVASDF
SATGVKQWSFALVRPVASDF

SEQ ID NO: 18287 - protein, 20 aa, synthetic construct
  source 1..20: note = Seed: SATGFKQSSKALQRPVASDF
SATGVKQWSGALVRPVASDF

SEQ ID NO: 18288 - protein, 20 aa, synthetic construct
  source 1..20: note = Seed: SATGFKQSSKALQRPVASDF
SATGVKQWSIALARPVASDF

SEQ ID NO: 18289 - protein, 20 aa, synthetic construct
  source 1..20: note = Seed: SATGFKQSSKALQRPVASDF
SATGVKQWSIALRRPVASDF

SEQ ID NO: 18290 - protein, 20 aa, synthetic construct
  source 1..20: note = Seed: SATGFKQSSKALQRPVASDF
SATGVKQWSKALKRPVASDF

SEQ ID NO: 18291 - protein, 20 aa, synthetic construct
  source 1..20: note = Seed: SATGFKQSSKALQRPVASDF
SATGVKQWSKALRRPVASDF

SEQ ID NO: 18292 - protein, 20 aa, synthetic construct
  source 1..20: note = Seed: SATGFKQSSKALQRPVASDF
SATGVKQWSLALARPVASDF

SEQ ID NO: 18293 - protein, 20 aa, synthetic construct
  source 1..20: note = Seed: SATGFKQSSKALQRPVASDF
SATGVKQWSLALIRPVASDF

SEQ ID NO: 18294 - protein, 20 aa, synthetic construct
  source 1..20: note = Seed: SATGFKQSSKALQRPVASDF
SATGVKQWSLALMRPVASDF

SEQ ID NO: 18295 - protein, 20 aa, synthetic construct
  source 1..20: note = Seed: SATGFKQSSKALQRPVASDF
SATGVKQWSLALVRPVASDF

SEQ ID NO: 18296 - protein, 20 aa, synthetic construct
  source 1..20: note = Seed: SATGFKQSSKALQRPVASDF
SATGVKQWSRALARPVASDF

SEQ ID NO: 18297 - protein, 20 aa, synthetic construct
  source 1..20: note = Seed: SATGFKQSSKALQRPVASDF
SATGVKQWSRALFRPVASDF

SEQ ID NO: 18298 - protein, 20 aa, synthetic construct
  source 1..20: note = Seed: SATGFKQSSKALQRPVASDF
SATGVKQWSRALKRPVASDF

SEQ ID NO: 18299 - protein, 20 aa, synthetic construct
  source 1..20: note = Seed: SATGFKQSSKALQRPVASDF
SATGVKQWSRALRRPVASDF

SEQ ID NO: 18300 - protein, 20 aa, synthetic construct
  source 1..20: note = Seed: SATGFKQSSKALQRPVASDF
SATGVKQWSRALYRPVASDF

SEQ ID NO: 18301 - protein, 20 aa, synthetic construct
  source 1..20: note = Seed: SATGFKQSSKALQRPVASDF
SATGVKQWSSALLRPVASDF

SEQ ID NO: 18302 - protein, 20 aa, synthetic construct
  source 1..20: note = Seed: SATGFKQSSKALQRPVASDF
SATGVKQWSVALRRPVASDF

SEQ ID NO: 18303 - protein, 20 aa, synthetic construct
  source 1..20: note = Seed: SATGFKQSSKALQRPVASDF
SATGVKQYSIALARPVASDF

SEQ ID NO: 18304 - protein, 20 aa, synthetic construct
  source 1..20: note = Seed: SATGFKQSSKALQRPVASDF
SATGVKQYSIALRRPVASDF

SEQ ID NO: 18305 - protein, 20 aa, synthetic construct
  source 1..20: note = Seed: SATGFKQSSKALQRPVASDF
SATGVKQYSKALKRPVASDF

SEQ ID NO: 18306 - protein, 20 aa, synthetic construct
  source 1..20: note = Seed: SATGFKQSSKALQRPVASDF
SATGVKQYSKALRRPVASDF

SEQ ID NO: 18307 - protein, 20 aa, synthetic construct
  source 1..20: note = Seed: SATGFKQSSKALQRPVASDF
SATGVKQYSLALARPVASDF

SEQ ID NO: 18308 - protein, 20 aa, synthetic construct
  source 1..20: note = Seed: SATGFKQSSKALQRPVASDF
SATGVKQYSRALARPVASDF

SEQ ID NO: 18309 - protein, 20 aa, synthetic construct
  source 1..20: note = Seed: SATGFKQSSKALQRPVASDF
SATGVKQYSRALHRPVASDF

SEQ ID NO: 18310 - protein, 20 aa, synthetic construct
  source 1..20: note = Seed: SATGFKQSSKALQRPVASDF
SATGVKQYSRALKRPVASDF

SEQ ID NO: 18311 - protein, 20 aa, synthetic construct
  source 1..20: note = Seed: SATGFKQSSKALQRPVASDF
SATGVKQYSRALRRPVASDF

SEQ ID NO: 18312 - protein, 20 aa, synthetic construct
  source 1..20: note = Seed: SATGFKQSSKALQRPVASDF
SATGVKQYSRALSRPVASDF

SEQ ID NO: 18313 - protein, 20 aa, synthetic construct
  source 1..20: note = Seed: SATGFKQSSKALQRPVASDF
SATGVKQYSSALARPVASDF

SEQ ID NO: 18314 - protein, 20 aa, synthetic construct
  source 1..20: note = Seed: SATGFKQSSKALQRPVASDF
SATGWKQASAALARPVASDF

SEQ ID NO: 18315 - protein, 20 aa, synthetic construct
  source 1..20: note = Seed: SATGFKQSSKALQRPVASDF
SATGWKQASAALCRPVASDF

SEQ ID NO: 18316 - protein, 20 aa, synthetic construct
  source 1..20: note = Seed: SATGFKQSSKALQRPVASDF
SATGWKQASAALDRPVASDF

SEQ ID NO: 18317 - protein, 20 aa, synthetic construct
  source 1..20: note = Seed: SATGFKQSSKALQRPVASDF
SATGWKQASAALERPVASDF

SEQ ID NO: 18318 - protein, 20 aa, synthetic construct
  source 1..20: note = Seed: SATGFKQSSKALQRPVASDF
SATGWKQASAALFRPVASDF

SEQ ID NO: 18319 - protein, 20 aa, synthetic construct
  source 1..20: note = Seed: SATGFKQSSKALQRPVASDF
SATGWKQASAALGRPVASDF

SEQ ID NO: 18320 - protein, 20 aa, synthetic construct
  source 1..20: note = Seed: SATGFKQSSKALQRPVASDF
SATGWKQASAALHRPVASDF

SEQ ID NO: 18321 - protein, 20 aa, synthetic construct
  source 1..20: note = Seed: SATGFKQSSKALQRPVASDF
SATGWKQASAALIRPVASDF

SEQ ID NO: 18322 - protein, 20 aa, synthetic construct
  source 1..20: note = Seed: SATGFKQSSKALQRPVASDF
SATGWKQASAALLRPVASDF

SEQ ID NO: 18323 - protein, 20 aa, synthetic construct
  source 1..20: note = Seed: SATGFKQSSKALQRPVASDF
SATGWKQASAALMRPVASDF

SEQ ID NO: 18324 - protein, 20 aa, synthetic construct
  source 1..20: note = Seed: SATGFKQSSKALQRPVASDF
SATGWKQASAALNRPVASDF

SEQ ID NO: 18325 - protein, 20 aa, synthetic construct
  source 1..20: note = Seed: SATGFKQSSKALQRPVASDF
SATGWKQASAALPRPVASDF

SEQ ID NO: 18326 - protein, 20 aa, synthetic construct
  source 1..20: note = Seed: SATGFKQSSKALQRPVASDF
SATGWKQASAALQRPVASDF

SEQ ID NO: 18327 - protein, 20 aa, synthetic construct
  source 1..20: note = Seed: SATGFKQSSKALQRPVASDF
SATGWKQASAALRRPVASDF

SEQ ID NO: 18328 - protein, 20 aa, synthetic construct
  source 1..20: note = Seed: SATGFKQSSKALQRPVASDF
SATGWKQASAALSRPVASDF

SEQ ID NO: 18329 - protein, 20 aa, synthetic construct
  source 1..20: note = Seed: SATGFKQSSKALQRPVASDF
SATGWKQASAALTRPVASDF

SEQ ID NO: 18330 - protein, 20 aa, synthetic construct
  source 1..20: note = Seed: SATGFKQSSKALQRPVASDF
SATGWKQASAALVRPVASDF

SEQ ID NO: 18331 - protein, 20 aa, synthetic construct
  source 1..20: note = Seed: SATGFKQSSKALQRPVASDF
SATGWKQASAALYRPVASDF

SEQ ID NO: 18332 - protein, 20 aa, synthetic construct
  source 1..20: note = Seed: SATGFKQSSKALQRPVASDF
SATGWKQASFALARPVASDF

SEQ ID NO: 18333 - protein, 20 aa, synthetic construct
  source 1..20: note = Seed: SATGFKQSSKALQRPVASDF
SATGWKQASFALERPVASDF

SEQ ID NO: 18334 - protein, 20 aa, synthetic construct
  source 1..20: note = Seed: SATGFKQSSKALQRPVASDF
SATGWKQASFALFRPVASDF

SEQ ID NO: 18335 - protein, 20 aa, synthetic construct
  source 1..20: note = Seed: SATGFKQSSKALQRPVASDF
SATGWKQASFALIRPVASDF

SEQ ID NO: 18336 - protein, 20 aa, synthetic construct
  source 1..20: note = Seed: SATGFKQSSKALQRPVASDF
SATGWKQASFALLRPVASDF

SEQ ID NO: 18337 - protein, 20 aa, synthetic construct
  source 1..20: note = Seed: SATGFKQSSKALQRPVASDF
SATGWKQASFALMRPVASDF

SEQ ID NO: 18338 - protein, 20 aa, synthetic construct
  source 1..20: note = Seed: SATGFKQSSKALQRPVASDF
SATGWKQASFALVRPVASDF

SEQ ID NO: 18339 - protein, 20 aa, synthetic construct
  source 1..20: note = Seed: SATGFKQSSKALQRPVASDF
SATGWKQASGALARPVASDF

SEQ ID NO: 18340 - protein, 20 aa, synthetic construct
  source 1..20: note = Seed: SATGFKQSSKALQRPVASDF
SATGWKQASGALGRPVASDF

SEQ ID NO: 18341 - protein, 20 aa, synthetic construct
  source 1..20: note = Seed: SATGFKQSSKALQRPVASDF
SATGWKQASGALIRPVASDF

SEQ ID NO: 18342 - protein, 20 aa, synthetic construct
  source 1..20: note = Seed: SATGFKQSSKALQRPVASDF
SATGWKQASGALLRPVASDF

SEQ ID NO: 18343 - protein, 20 aa, synthetic construct
  source 1..20: note = Seed: SATGFKQSSKALQRPVASDF
SATGWKQASGALMRPVASDF

SEQ ID NO: 18344 - protein, 20 aa, synthetic construct
  source 1..20: note = Seed: SATGFKQSSKALQRPVASDF
SATGWKQASGALNRPVASDF

SEQ ID NO: 18345 - protein, 20 aa, synthetic construct
  source 1..20: note = Seed: SATGFKQSSKALQRPVASDF
SATGWKQASGALSRPVASDF

SEQ ID NO: 18346 - protein, 20 aa, synthetic construct
  source 1..20: note = Seed: SATGFKQSSKALQRPVASDF
SATGWKQASGALTRPVASDF

SEQ ID NO: 18347 - protein, 20 aa, synthetic construct
  source 1..20: note = Seed: SATGFKQSSKALQRPVASDF
SATGWKQASGALVRPVASDF

SEQ ID NO: 18348 - protein, 20 aa, synthetic construct
  source 1..20: note = Seed: SATGFKQSSKALQRPVASDF
SATGWKQASIALARPVASDF

SEQ ID NO: 18349 - protein, 20 aa, synthetic construct
  source 1..20: note = Seed: SATGFKQSSKALQRPVASDF
SATGWKQASIALCRPVASDF

SEQ ID NO: 18350 - protein, 20 aa, synthetic construct
  source 1..20: note = Seed: SATGFKQSSKALQRPVASDF
SATGWKQASIALGRPVASDF

SEQ ID NO: 18351 - protein, 20 aa, synthetic construct
  source 1..20: note = Seed: SATGFKQSSKALQRPVASDF
SATGWKQASIALHRPVASDF

SEQ ID NO: 18352 - protein, 20 aa, synthetic construct
  source 1..20: note = Seed: SATGFKQSSKALQRPVASDF
SATGWKQASIALIRPVASDF

SEQ ID NO: 18353 - protein, 20 aa, synthetic construct
  source 1..20: note = Seed: SATGFKQSSKALQRPVASDF
SATGWKQASIALNRPVASDF

SEQ ID NO: 18354 - protein, 20 aa, synthetic construct
  source 1..20: note = Seed: SATGFKQSSKALQRPVASDF
SATGWKQASIALQRPVASDF

SEQ ID NO: 18355 - protein, 20 aa, synthetic construct
  source 1..20: note = Seed: SATGFKQSSKALQRPVASDF
SATGWKQASIALSRPVASDF

SEQ ID NO: 18356 - protein, 20 aa, synthetic construct
  source 1..20: note = Seed: SATGFKQSSKALQRPVASDF
SATGWKQASIALTRPVASDF

SEQ ID NO: 18357 - protein, 20 aa, synthetic construct
  source 1..20: note = Seed: SATGFKQSSKALQRPVASDF
SATGWKQASIALVRPVASDF

SEQ ID NO: 18358 - protein, 20 aa, synthetic construct
  source 1..20: note = Seed: SATGFKQSSKALQRPVASDF
SATGWKQASKALARPVASDF

SEQ ID NO: 18359 - protein, 20 aa, synthetic construct
  source 1..20: note = Seed: SATGFKQSSKALQRPVASDF
SATGWKQASKALGRPVASDF

SEQ ID NO: 18360 - protein, 20 aa, synthetic construct
  source 1..20: note = Seed: SATGFKQSSKALQRPVASDF
SATGWKQASKALHRPVASDF

SEQ ID NO: 18361 - protein, 20 aa, synthetic construct
  source 1..20: note = Seed: SATGFKQSSKALQRPVASDF
SATGWKQASKALQRPVASDF

SEQ ID NO: 18362 - protein, 20 aa, synthetic construct
  source 1..20: note = Seed: SATGFKQSSKALQRPVASDF
SATGWKQASKALSRPVASDF

SEQ ID NO: 18363 - protein, 20 aa, synthetic construct
  source 1..20: note = Seed: SATGFKQSSKALQRPVASDF
SATGWKQASKALTRPVASDF

SEQ ID NO: 18364 - protein, 20 aa, synthetic construct
  source 1..20: note = Seed: SATGFKQSSKALQRPVASDF
SATGWKQASLALARPVASDF

SEQ ID NO: 18365 - protein, 20 aa, synthetic construct
  source 1..20: note = Seed: SATGFKQSSKALQRPVASDF
SATGWKQASLALGRPVASDF

SEQ ID NO: 18366 - protein, 20 aa, synthetic construct
  source 1..20: note = Seed: SATGFKQSSKALQRPVASDF
SATGWKQASLALHRPVASDF

SEQ ID NO: 18367 - protein, 20 aa, synthetic construct
  source 1..20: note = Seed: SATGFKQSSKALQRPVASDF
SATGWKQASLALNRPVASDF

SEQ ID NO: 18368 - protein, 20 aa, synthetic construct
  source 1..20: note = Seed: SATGFKQSSKALQRPVASDF
SATGWKQASLALSRPVASDF

SEQ ID NO: 18369 - protein, 20 aa, synthetic construct
  source 1..20: note = Seed: SATGFKQSSKALQRPVASDF
SATGWKQASLALTRPVASDF

SEQ ID NO: 18370 - protein, 20 aa, synthetic construct
  source 1..20: note = Seed: SATGFKQSSKALQRPVASDF
SATGWKQASLALVRPVASDF

SEQ ID NO: 18371 - protein, 20 aa, synthetic construct
  source 1..20: note = Seed: SATGFKQSSKALQRPVASDF
SATGWKQASMALARPVASDF

SEQ ID NO: 18372 - protein, 20 aa, synthetic construct
  source 1..20: note = Seed: SATGFKQSSKALQRPVASDF
SATGWKQASMALHRPVASDF

SEQ ID NO: 18373 - protein, 20 aa, synthetic construct
  source 1..20: note = Seed: SATGFKQSSKALQRPVASDF
SATGWKQASMALIRPVASDF

SEQ ID NO: 18374 - protein, 20 aa, synthetic construct
  source 1..20: note = Seed: SATGFKQSSKALQRPVASDF
SATGWKQASMALNRPVASDF

SEQ ID NO: 18375 - protein, 20 aa, synthetic construct
  source 1..20: note = Seed: SATGFKQSSKALQRPVASDF
SATGWKQASMALSRPVASDF

SEQ ID NO: 18376 - protein, 20 aa, synthetic construct
  source 1..20: note = Seed: SATGFKQSSKALQRPVASDF
SATGWKQASMALTRPVASDF

SEQ ID NO: 18377 - protein, 20 aa, synthetic construct
  source 1..20: note = Seed: SATGFKQSSKALQRPVASDF
SATGWKQASMALVRPVASDF

SEQ ID NO: 18378 - protein, 20 aa, synthetic construct
  source 1..20: note = Seed: SATGFKQSSKALQRPVASDF
SATGWKQASNALARPVASDF

SEQ ID NO: 18379 - protein, 20 aa, synthetic construct
  source 1..20: note = Seed: SATGFKQSSKALQRPVASDF
SATGWKQASNALIRPVASDF

SEQ ID NO: 18380 - protein, 20 aa, synthetic construct
  source 1..20: note = Seed: SATGFKQSSKALQRPVASDF
SATGWKQASNALLRPVASDF

SEQ ID NO: 18381 - protein, 20 aa, synthetic construct
  source 1..20: note = Seed: SATGFKQSSKALQRPVASDF
SATGWKQASNALMRPVASDF

SEQ ID NO: 18382 - protein, 20 aa, synthetic construct
  source 1..20: note = Seed: SATGFKQSSKALQRPVASDF
SATGWKQASNALNRPVASDF

SEQ ID NO: 18383 - protein, 20 aa, synthetic construct
  source 1..20: note = Seed: SATGFKQSSKALQRPVASDF
SATGWKQASNALSRPVASDF

SEQ ID NO: 18384 - protein, 20 aa, synthetic construct
  source 1..20: note = Seed: SATGFKQSSKALQRPVASDF
SATGWKQASNALTRPVASDF

SEQ ID NO: 18385 - protein, 20 aa, synthetic construct
  source 1..20: note = Seed: SATGFKQSSKALQRPVASDF
SATGWKQASNALVRPVASDF

SEQ ID NO: 18386 - protein, 20 aa, synthetic construct
  source 1..20: note = Seed: SATGFKQSSKALQRPVASDF
SATGWKQASPALARPVASDF

SEQ ID NO: 18387 - protein, 20 aa, synthetic construct
  source 1..20: note = Seed: SATGFKQSSKALQRPVASDF
SATGWKQASPALGRPVASDF

SEQ ID NO: 18388 - protein, 20 aa, synthetic construct
  source 1..20: note = Seed: SATGFKQSSKALQRPVASDF
SATGWKQASPALHRPVASDF

SEQ ID NO: 18389 - protein, 20 aa, synthetic construct
  source 1..20: note = Seed: SATGFKQSSKALQRPVASDF
SATGWKQASPALIRPVASDF

SEQ ID NO: 18390 - protein, 20 aa, synthetic construct
  source 1..20: note = Seed: SATGFKQSSKALQRPVASDF
SATGWKQASPALLRPVASDF

SEQ ID NO: 18391 - protein, 20 aa, synthetic construct
  source 1..20: note = Seed: SATGFKQSSKALQRPVASDF
SATGWKQASPALMRPVASDF

SEQ ID NO: 18392 - protein, 20 aa, synthetic construct
  source 1..20: note = Seed: SATGFKQSSKALQRPVASDF
SATGWKQASPALNRPVASDF

SEQ ID NO: 18393 - protein, 20 aa, synthetic construct
  source 1..20: note = Seed: SATGFKQSSKALQRPVASDF
SATGWKQASPALQRPVASDF

SEQ ID NO: 18394 - protein, 20 aa, synthetic construct
  source 1..20: note = Seed: SATGFKQSSKALQRPVASDF
SATGWKQASPALSRPVASDF

SEQ ID NO: 18395 - protein, 20 aa, synthetic construct
  source 1..20: note = Seed: SATGFKQSSKALQRPVASDF
SATGWKQASPALTRPVASDF

SEQ ID NO: 18396 - protein, 20 aa, synthetic construct
  source 1..20: note = Seed: SATGFKQSSKALQRPVASDF
SATGWKQASPALVRPVASDF

SEQ ID NO: 18397 - protein, 20 aa, synthetic construct
  source 1..20: note = Seed: SATGFKQSSKALQRPVASDF
SATGWKQASRALARPVASDF

SEQ ID NO: 18398 - protein, 20 aa, synthetic construct
  source 1..20: note = Seed: SATGFKQSSKALQRPVASDF
SATGWKQASRALGRPVASDF

SEQ ID NO: 18399 - protein, 20 aa, synthetic construct
  source 1..20: note = Seed: SATGFKQSSKALQRPVASDF
SATGWKQASRALHRPVASDF

SEQ ID NO: 18400 - protein, 20 aa, synthetic construct
  source 1..20: note = Seed: SATGFKQSSKALQRPVASDF
SATGWKQASRALQRPVASDF

SEQ ID NO: 18401 - protein, 20 aa, synthetic construct
  source 1..20: note = Seed: SATGFKQSSKALQRPVASDF
SATGWKQASRALRRPVASDF

SEQ ID NO: 18402 - protein, 20 aa, synthetic construct
  source 1..20: note = Seed: SATGFKQSSKALQRPVASDF
SATGWKQASRALSRPVASDF

SEQ ID NO: 18403 - protein, 20 aa, synthetic construct
  source 1..20: note = Seed: SATGFKQSSKALQRPVASDF
SATGWKQASRALTRPVASDF

SEQ ID NO: 18404 - protein, 20 aa, synthetic construct
  source 1..20: note = Seed: SATGFKQSSKALQRPVASDF
SATGWKQASSALARPVASDF

SEQ ID NO: 18405 - protein, 20 aa, synthetic construct
  source 1..20: note = Seed: SATGFKQSSKALQRPVASDF
SATGWKQASSALGRPVASDF

SEQ ID NO: 18406 - protein, 20 aa, synthetic construct
  source 1..20: note = Seed: SATGFKQSSKALQRPVASDF
SATGWKQASSALHRPVASDF

SEQ ID NO: 18407 - protein, 20 aa, synthetic construct
  source 1..20: note = Seed: SATGFKQSSKALQRPVASDF
SATGWKQASSALIRPVASDF

SEQ ID NO: 18408 - protein, 20 aa, synthetic construct
  source 1..20: note = Seed: SATGFKQSSKALQRPVASDF
SATGWKQASSALLRPVASDF

SEQ ID NO: 18409 - protein, 20 aa, synthetic construct
  source 1..20: note = Seed: SATGFKQSSKALQRPVASDF
SATGWKQASSALMRPVASDF

SEQ ID NO: 18410 - protein, 20 aa, synthetic construct
  source 1..20: note = Seed: SATGFKQSSKALQRPVASDF
SATGWKQASSALNRPVASDF

SEQ ID NO: 18411 - protein, 20 aa, synthetic construct
  source 1..20: note = Seed: SATGFKQSSKALQRPVASDF
SATGWKQASSALQRPVASDF

SEQ ID NO: 18412 - protein, 20 aa, synthetic construct
  source 1..20: note = Seed: SATGFKQSSKALQRPVASDF
SATGWKQASSALSRPVASDF

SEQ ID NO: 18413 - protein, 20 aa, synthetic construct
  source 1..20: note = Seed: SATGFKQSSKALQRPVASDF
SATGWKQASSALTRPVASDF

SEQ ID NO: 18414 - protein, 20 aa, synthetic construct
  source 1..20: note = Seed: SATGFKQSSKALQRPVASDF
SATGWKQASSALVRPVASDF

SEQ ID NO: 18415 - protein, 20 aa, synthetic construct
  source 1..20: note = Seed: SATGFKQSSKALQRPVASDF
SATGWKQASTALARPVASDF

SEQ ID NO: 18416 - protein, 20 aa, synthetic construct
  source 1..20: note = Seed: SATGFKQSSKALQRPVASDF
SATGWKQASTALGRPVASDF

SEQ ID NO: 18417 - protein, 20 aa, synthetic construct
  source 1..20: note = Seed: SATGFKQSSKALQRPVASDF
SATGWKQASTALHRPVASDF

SEQ ID NO: 18418 - protein, 20 aa, synthetic construct
  source 1..20: note = Seed: SATGFKQSSKALQRPVASDF
SATGWKQASTALIRPVASDF

SEQ ID NO: 18419 - protein, 20 aa, synthetic construct
  source 1..20: note = Seed: SATGFKQSSKALQRPVASDF
SATGWKQASTALLRPVASDF

SEQ ID NO: 18420 - protein, 20 aa, synthetic construct
  source 1..20: note = Seed: SATGFKQSSKALQRPVASDF
SATGWKQASTALMRPVASDF

SEQ ID NO: 18421 - protein, 20 aa, synthetic construct
  source 1..20: note = Seed: SATGFKQSSKALQRPVASDF
SATGWKQASTALNRPVASDF

SEQ ID NO: 18422 - protein, 20 aa, synthetic construct
  source 1..20: note = Seed: SATGFKQSSKALQRPVASDF
SATGWKQASTALQRPVASDF

SEQ ID NO: 18423 - protein, 20 aa, synthetic construct
  source 1..20: note = Seed: SATGFKQSSKALQRPVASDF
SATGWKQASTALSRPVASDF

SEQ ID NO: 18424 - protein, 20 aa, synthetic construct
  source 1..20: note = Seed: SATGFKQSSKALQRPVASDF
SATGWKQASTALTRPVASDF

SEQ ID NO: 18425 - protein, 20 aa, synthetic construct
  source 1..20: note = Seed: SATGFKQSSKALQRPVASDF
SATGWKQASTALVRPVASDF

SEQ ID NO: 18426 - protein, 20 aa, synthetic construct
  source 1..20: note = Seed: SATGFKQSSKALQRPVASDF
SATGWKQASVALARPVASDF

SEQ ID NO: 18427 - protein, 20 aa, synthetic construct
  source 1..20: note = Seed: SATGFKQSSKALQRPVASDF
SATGWKQASVALERPVASDF

SEQ ID NO: 18428 - protein, 20 aa, synthetic construct
  source 1..20: note = Seed: SATGFKQSSKALQRPVASDF
SATGWKQASVALFRPVASDF

SEQ ID NO: 18429 - protein, 20 aa, synthetic construct
  source 1..20: note = Seed: SATGFKQSSKALQRPVASDF
SATGWKQASVALGRPVASDF

SEQ ID NO: 18430 - protein, 20 aa, synthetic construct
  source 1..20: note = Seed: SATGFKQSSKALQRPVASDF
SATGWKQASVALHRPVASDF

SEQ ID NO: 18431 - protein, 20 aa, synthetic construct
  source 1..20: note = Seed: SATGFKQSSKALQRPVASDF
SATGWKQASVALIRPVASDF

SEQ ID NO: 18432 - protein, 20 aa, synthetic construct
  source 1..20: note = Seed: SATGFKQSSKALQRPVASDF
SATGWKQASVALLRPVASDF

SEQ ID NO: 18433 - protein, 20 aa, synthetic construct
  source 1..20: note = Seed: SATGFKQSSKALQRPVASDF
SATGWKQASVALMRPVASDF

SEQ ID NO: 18434 - protein, 20 aa, synthetic construct
  source 1..20: note = Seed: SATGFKQSSKALQRPVASDF
SATGWKQASVALNRPVASDF

SEQ ID NO: 18435 - protein, 20 aa, synthetic construct
  source 1..20: note = Seed: SATGFKQSSKALQRPVASDF
SATGWKQASVALQRPVASDF

SEQ ID NO: 18436 - protein, 20 aa, synthetic construct
  source 1..20: note = Seed: SATGFKQSSKALQRPVASDF
SATGWKQASVALSRPVASDF

SEQ ID NO: 18437 - protein, 20 aa, synthetic construct
  source 1..20: note = Seed: SATGFKQSSKALQRPVASDF
SATGWKQASVALTRPVASDF

SEQ ID NO: 18438 - protein, 20 aa, synthetic construct
  source 1..20: note = Seed: SATGFKQSSKALQRPVASDF
SATGWKQASVALVRPVASDF

SEQ ID NO: 18439 - protein, 20 aa, synthetic construct
  source 1..20: note = Seed: SATGFKQSSKALQRPVASDF
SATGWKQCSAALARPVASDF

SEQ ID NO: 18440 - protein, 20 aa, synthetic construct
  source 1..20: note = Seed: SATGFKQSSKALQRPVASDF
SATGWKQCSAALIRPVASDF

SEQ ID NO: 18441 - protein, 20 aa, synthetic construct
  source 1..20: note = Seed: SATGFKQSSKALQRPVASDF
SATGWKQCSAALLRPVASDF

SEQ ID NO: 18442 - protein, 20 aa, synthetic construct
  source 1..20: note = Seed: SATGFKQSSKALQRPVASDF
SATGWKQCSAALSRPVASDF

SEQ ID NO: 18443 - protein, 20 aa, synthetic construct
  source 1..20: note = Seed: SATGFKQSSKALQRPVASDF
SATGWKQCSAALVRPVASDF

SEQ ID NO: 18444 - protein, 20 aa, synthetic construct
  source 1..20: note = Seed: SATGFKQSSKALQRPVASDF
SATGWKQCSGALARPVASDF

SEQ ID NO: 18445 - protein, 20 aa, synthetic construct
  source 1..20: note = Seed: SATGFKQSSKALQRPVASDF
SATGWKQCSGALVRPVASDF

SEQ ID NO: 18446 - protein, 20 aa, synthetic construct
  source 1..20: note = Seed: SATGFKQSSKALQRPVASDF
SATGWKQCSIALARPVASDF

SEQ ID NO: 18447 - protein, 20 aa, synthetic construct
  source 1..20: note = Seed: SATGFKQSSKALQRPVASDF
SATGWKQCSIALGRPVASDF

SEQ ID NO: 18448 - protein, 20 aa, synthetic construct
  source 1..20: note = Seed: SATGFKQSSKALQRPVASDF
SATGWKQCSIALIRPVASDF

SEQ ID NO: 18449 - protein, 20 aa, synthetic construct
  source 1..20: note = Seed: SATGFKQSSKALQRPVASDF
SATGWKQCSIALSRPVASDF

SEQ ID NO: 18450 - protein, 20 aa, synthetic construct
  source 1..20: note = Seed: SATGFKQSSKALQRPVASDF
SATGWKQCSIALTRPVASDF

SEQ ID NO: 18451 - protein, 20 aa, synthetic construct
  source 1..20: note = Seed: SATGFKQSSKALQRPVASDF
SATGWKQCSIALVRPVASDF

SEQ ID NO: 18452 - protein, 20 aa, synthetic construct
  source 1..20: note = Seed: SATGFKQSSKALQRPVASDF
SATGWKQCSLALSRPVASDF

SEQ ID NO: 18453 - protein, 20 aa, synthetic construct
  source 1..20: note = Seed: SATGFKQSSKALQRPVASDF
SATGWKQCSMALSRPVASDF

SEQ ID NO: 18454 - protein, 20 aa, synthetic construct
  source 1..20: note = Seed: SATGFKQSSKALQRPVASDF
SATGWKQCSPALARPVASDF

SEQ ID NO: 18455 - protein, 20 aa, synthetic construct
  source 1..20: note = Seed: SATGFKQSSKALQRPVASDF
SATGWKQCSSALARPVASDF

SEQ ID NO: 18456 - protein, 20 aa, synthetic construct
  source 1..20: note = Seed: SATGFKQSSKALQRPVASDF
SATGWKQCSSALLRPVASDF

SEQ ID NO: 18457 - protein, 20 aa, synthetic construct
  source 1..20: note = Seed: SATGFKQSSKALQRPVASDF
SATGWKQCSSALVRPVASDF

SEQ ID NO: 18458 - protein, 20 aa, synthetic construct
  source 1..20: note = Seed: SATGFKQSSKALQRPVASDF
SATGWKQCSTALARPVASDF

SEQ ID NO: 18459 - protein, 20 aa, synthetic construct
  source 1..20: note = Seed: SATGFKQSSKALQRPVASDF
SATGWKQCSVALARPVASDF

SEQ ID NO: 18460 - protein, 20 aa, synthetic construct
  source 1..20: note = Seed: SATGFKQSSKALQRPVASDF
SATGWKQCSVALIRPVASDF

SEQ ID NO: 18461 - protein, 20 aa, synthetic construct
  source 1..20: note = Seed: SATGFKQSSKALQRPVASDF
SATGWKQCSVALSRPVASDF

SEQ ID NO: 18462 - protein, 20 aa, synthetic construct
  source 1..20: note = Seed: SATGFKQSSKALQRPVASDF
SATGWKQCSVALVRPVASDF

SEQ ID NO: 18463 - protein, 20 aa, synthetic construct
  source 1..20: note = Seed: SATGFKQSSKALQRPVASDF
SATGWKQDSFALIRPVASDF

SEQ ID NO: 18464 - protein, 20 aa, synthetic construct
  source 1..20: note = Seed: SATGFKQSSKALQRPVASDF
SATGWKQDSFALVRPVASDF

SEQ ID NO: 18465 - protein, 20 aa, synthetic construct
  source 1..20: note = Seed: SATGFKQSSKALQRPVASDF
SATGWKQDSIALSRPVASDF

SEQ ID NO: 18466 - protein, 20 aa, synthetic construct
  source 1..20: note = Seed: SATGFKQSSKALQRPVASDF
SATGWKQDSLALSRPVASDF

SEQ ID NO: 18467 - protein, 20 aa, synthetic construct
  source 1..20: note = Seed: SATGFKQSSKALQRPVASDF
SATGWKQDSVALARPVASDF

SEQ ID NO: 18468 - protein, 20 aa, synthetic construct
  source 1..20: note = Seed: SATGFKQSSKALQRPVASDF
SATGWKQESAALARPVASDF

SEQ ID NO: 18469 - protein, 20 aa, synthetic construct
  source 1..20: note = Seed: SATGFKQSSKALQRPVASDF
SATGWKQESAALIRPVASDF

SEQ ID NO: 18470 - protein, 20 aa, synthetic construct
  source 1..20: note = Seed: SATGFKQSSKALQRPVASDF
SATGWKQESAALLRPVASDF

SEQ ID NO: 18471 - protein, 20 aa, synthetic construct
  source 1..20: note = Seed: SATGFKQSSKALQRPVASDF
SATGWKQESAALMRPVASDF

SEQ ID NO: 18472 - protein, 20 aa, synthetic construct
  source 1..20: note = Seed: SATGFKQSSKALQRPVASDF
SATGWKQESAALNRPVASDF

SEQ ID NO: 18473 - protein, 20 aa, synthetic construct
  source 1..20: note = Seed: SATGFKQSSKALQRPVASDF
SATGWKQESAALSRPVASDF

SEQ ID NO: 18474 - protein, 20 aa, synthetic construct
  source 1..20: note = Seed: SATGFKQSSKALQRPVASDF
SATGWKQESAALTRPVASDF

SEQ ID NO: 18475 - protein, 20 aa, synthetic construct
  source 1..20: note = Seed: SATGFKQSSKALQRPVASDF
SATGWKQESAALVRPVASDF

SEQ ID NO: 18476 - protein, 20 aa, synthetic construct
  source 1..20: note = Seed: SATGFKQSSKALQRPVASDF
SATGWKQESFALFRPVASDF

SEQ ID NO: 18477 - protein, 20 aa, synthetic construct
  source 1..20: note = Seed: SATGFKQSSKALQRPVASDF
SATGWKQESFALIRPVASDF

SEQ ID NO: 18478 - protein, 20 aa, synthetic construct
  source 1..20: note = Seed: SATGFKQSSKALQRPVASDF
SATGWKQESFALLRPVASDF

SEQ ID NO: 18479 - protein, 20 aa, synthetic construct
  source 1..20: note = Seed: SATGFKQSSKALQRPVASDF
SATGWKQESFALVRPVASDF

SEQ ID NO: 18480 - protein, 20 aa, synthetic construct
  source 1..20: note = Seed: SATGFKQSSKALQRPVASDF
SATGWKQESGALARPVASDF

SEQ ID NO: 18481 - protein, 20 aa, synthetic construct
  source 1..20: note = Seed: SATGFKQSSKALQRPVASDF
SATGWKQESGALIRPVASDF

SEQ ID NO: 18482 - protein, 20 aa, synthetic construct
  source 1..20: note = Seed: SATGFKQSSKALQRPVASDF
SATGWKQESGALLRPVASDF

SEQ ID NO: 18483 - protein, 20 aa, synthetic construct
  source 1..20: note = Seed: SATGFKQSSKALQRPVASDF
SATGWKQESGALVRPVASDF

SEQ ID NO: 18484 - protein, 20 aa, synthetic construct
  source 1..20: note = Seed: SATGFKQSSKALQRPVASDF
SATGWKQESIALARPVASDF

SEQ ID NO: 18485 - protein, 20 aa, synthetic construct
  source 1..20: note = Seed: SATGFKQSSKALQRPVASDF
SATGWKQESIALIRPVASDF

SEQ ID NO: 18486 - protein, 20 aa, synthetic construct
  source 1..20: note = Seed: SATGFKQSSKALQRPVASDF
SATGWKQESIALNRPVASDF

SEQ ID NO: 18487 - protein, 20 aa, synthetic construct
  source 1..20: note = Seed: SATGFKQSSKALQRPVASDF
SATGWKQESIALSRPVASDF

SEQ ID NO: 18488 - protein, 20 aa, synthetic construct
  source 1..20: note = Seed: SATGFKQSSKALQRPVASDF
SATGWKQESIALTRPVASDF

SEQ ID NO: 18489 - protein, 20 aa, synthetic construct
  source 1..20: note = Seed: SATGFKQSSKALQRPVASDF
SATGWKQESIALVRPVASDF

SEQ ID NO: 18490 - protein, 20 aa, synthetic construct
  source 1..20: note = Seed: SATGFKQSSKALQRPVASDF
SATGWKQESLALARPVASDF

SEQ ID NO: 18491 - protein, 20 aa, synthetic construct
  source 1..20: note = Seed: SATGFKQSSKALQRPVASDF
SATGWKQESLALSRPVASDF

SEQ ID NO: 18492 - protein, 20 aa, synthetic construct
  source 1..20: note = Seed: SATGFKQSSKALQRPVASDF
SATGWKQESLALTRPVASDF

SEQ ID NO: 18493 - protein, 20 aa, synthetic construct
  source 1..20: note = Seed: SATGFKQSSKALQRPVASDF
SATGWKQESMALARPVASDF

SEQ ID NO: 18494 - protein, 20 aa, synthetic construct
  source 1..20: note = Seed: SATGFKQSSKALQRPVASDF
SATGWKQESMALSRPVASDF

SEQ ID NO: 18495 - protein, 20 aa, synthetic construct
  source 1..20: note = Seed: SATGFKQSSKALQRPVASDF
SATGWKQESPALARPVASDF

SEQ ID NO: 18496 - protein, 20 aa, synthetic construct
  source 1..20: note = Seed: SATGFKQSSKALQRPVASDF
SATGWKQESPALIRPVASDF

SEQ ID NO: 18497 - protein, 20 aa, synthetic construct
  source 1..20: note = Seed: SATGFKQSSKALQRPVASDF
SATGWKQESPALLRPVASDF

SEQ ID NO: 18498 - protein, 20 aa, synthetic construct
  source 1..20: note = Seed: SATGFKQSSKALQRPVASDF
SATGWKQESPALVRPVASDF

SEQ ID NO: 18499 - protein, 20 aa, synthetic construct
  source 1..20: note = Seed: SATGFKQSSKALQRPVASDF
SATGWKQESSALARPVASDF

SEQ ID NO: 18500 - protein, 20 aa, synthetic construct
  source 1..20: note = Seed: SATGFKQSSKALQRPVASDF
SATGWKQESSALIRPVASDF

SEQ ID NO: 18501 - protein, 20 aa, synthetic construct
  source 1..20: note = Seed: SATGFKQSSKALQRPVASDF
SATGWKQESSALLRPVASDF

SEQ ID NO: 18502 - protein, 20 aa, synthetic construct
  source 1..20: note = Seed: SATGFKQSSKALQRPVASDF
SATGWKQESSALVRPVASDF

SEQ ID NO: 18503 - protein, 20 aa, synthetic construct
  source 1..20: note = Seed: SATGFKQSSKALQRPVASDF
SATGWKQESTALARPVASDF

SEQ ID NO: 18504 - protein, 20 aa, synthetic construct
  source 1..20: note = Seed: SATGFKQSSKALQRPVASDF
SATGWKQESTALSRPVASDF

SEQ ID NO: 18505 - protein, 20 aa, synthetic construct
  source 1..20: note = Seed: SATGFKQSSKALQRPVASDF
SATGWKQESVALARPVASDF

SEQ ID NO: 18506 - protein, 20 aa, synthetic construct
  source 1..20: note = Seed: SATGFKQSSKALQRPVASDF
SATGWKQESVALIRPVASDF

SEQ ID NO: 18507 - protein, 20 aa, synthetic construct
  source 1..20: note = Seed: SATGFKQSSKALQRPVASDF
SATGWKQESVALLRPVASDF

SEQ ID NO: 18508 - protein, 20 aa, synthetic construct
  source 1..20: note = Seed: SATGFKQSSKALQRPVASDF
SATGWKQESVALMRPVASDF

SEQ ID NO: 18509 - protein, 20 aa, synthetic construct
  source 1..20: note = Seed: SATGFKQSSKALQRPVASDF
SATGWKQESVALNRPVASDF

SEQ ID NO: 18510 - protein, 20 aa, synthetic construct
  source 1..20: note = Seed: SATGFKQSSKALQRPVASDF
SATGWKQESVALQRPVASDF

SEQ ID NO: 18511 - protein, 20 aa, synthetic construct
  source 1..20: note = Seed: SATGFKQSSKALQRPVASDF
SATGWKQESVALSRPVASDF

SEQ ID NO: 18512 - protein, 20 aa, synthetic construct
  source 1..20: note = Seed: SATGFKQSSKALQRPVASDF
SATGWKQESVALTRPVASDF

SEQ ID NO: 18513 - protein, 20 aa, synthetic construct
  source 1..20: note = Seed: SATGFKQSSKALQRPVASDF
SATGWKQESVALVRPVASDF

SEQ ID NO: 18514 - protein, 20 aa, synthetic construct
  source 1..20: note = Seed: SATGFKQSSKALQRPVASDF
SATGWKQFSAALARPVASDF

SEQ ID NO: 18515 - protein, 20 aa, synthetic construct
  source 1..20: note = Seed: SATGFKQSSKALQRPVASDF
SATGWKQFSAALCRPVASDF

SEQ ID NO: 18516 - protein, 20 aa, synthetic construct
  source 1..20: note = Seed: SATGFKQSSKALQRPVASDF
SATGWKQFSAALDRPVASDF

SEQ ID NO: 18517 - protein, 20 aa, synthetic construct
  source 1..20: note = Seed: SATGFKQSSKALQRPVASDF
SATGWKQFSAALERPVASDF

SEQ ID NO: 18518 - protein, 20 aa, synthetic construct
  source 1..20: note = Seed: SATGFKQSSKALQRPVASDF
SATGWKQFSAALFRPVASDF

SEQ ID NO: 18519 - protein, 20 aa, synthetic construct
  source 1..20: note = Seed: SATGFKQSSKALQRPVASDF
SATGWKQFSAALGRPVASDF

SEQ ID NO: 18520 - protein, 20 aa, synthetic construct
  source 1..20: note = Seed: SATGFKQSSKALQRPVASDF
SATGWKQFSAALHRPVASDF

SEQ ID NO: 18521 - protein, 20 aa, synthetic construct
  source 1..20: note = Seed: SATGFKQSSKALQRPVASDF
SATGWKQFSAALIRPVASDF

SEQ ID NO: 18522 - protein, 20 aa, synthetic construct
  source 1..20: note = Seed: SATGFKQSSKALQRPVASDF
SATGWKQFSAALKRPVASDF

SEQ ID NO: 18523 - protein, 20 aa, synthetic construct
  source 1..20: note = Seed: SATGFKQSSKALQRPVASDF
SATGWKQFSAALLRPVASDF

SEQ ID NO: 18524 - protein, 20 aa, synthetic construct
  source 1..20: note = Seed: SATGFKQSSKALQRPVASDF
SATGWKQFSAALMRPVASDF

SEQ ID NO: 18525 - protein, 20 aa, synthetic construct
  source 1..20: note = Seed: SATGFKQSSKALQRPVASDF
SATGWKQFSAALNRPVASDF

SEQ ID NO: 18526 - protein, 20 aa, synthetic construct
  source 1..20: note = Seed: SATGFKQSSKALQRPVASDF
SATGWKQFSAALQRPVASDF

SEQ ID NO: 18527 - protein, 20 aa, synthetic construct
  source 1..20: note = Seed: SATGFKQSSKALQRPVASDF
SATGWKQFSAALRRPVASDF

SEQ ID NO: 18528 - protein, 20 aa, synthetic construct
  source 1..20: note = Seed: SATGFKQSSKALQRPVASDF
SATGWKQFSAALVRPVASDF

SEQ ID NO: 18529 - protein, 20 aa, synthetic construct
  source 1..20: note = Seed: SATGFKQSSKALQRPVASDF
SATGWKQFSAALYRPVASDF

SEQ ID NO: 18530 - protein, 20 aa, synthetic construct
  source 1..20: note = Seed: SATGFKQSSKALQRPVASDF
SATGWKQFSCALLRPVASDF

SEQ ID NO: 18531 - protein, 20 aa, synthetic construct
  source 1..20: note = Seed: SATGFKQSSKALQRPVASDF
SATGWKQFSFALERPVASDF

SEQ ID NO: 18532 - protein, 20 aa, synthetic construct
  source 1..20: note = Seed: SATGFKQSSKALQRPVASDF
SATGWKQFSGALARPVASDF

SEQ ID NO: 18533 - protein, 20 aa, synthetic construct
  source 1..20: note = Seed: SATGFKQSSKALQRPVASDF
SATGWKQFSGALGRPVASDF

SEQ ID NO: 18534 - protein, 20 aa, synthetic construct
  source 1..20: note = Seed: SATGFKQSSKALQRPVASDF
SATGWKQFSGALIRPVASDF

SEQ ID NO: 18535 - protein, 20 aa, synthetic construct
  source 1..20: note = Seed: SATGFKQSSKALQRPVASDF
SATGWKQFSGALLRPVASDF

SEQ ID NO: 18536 - protein, 20 aa, synthetic construct
  source 1..20: note = Seed: SATGFKQSSKALQRPVASDF
SATGWKQFSGALMRPVASDF

SEQ ID NO: 18537 - protein, 20 aa, synthetic construct
  source 1..20: note = Seed: SATGFKQSSKALQRPVASDF
SATGWKQFSGALNRPVASDF

SEQ ID NO: 18538 - protein, 20 aa, synthetic construct
  source 1..20: note = Seed: SATGFKQSSKALQRPVASDF
SATGWKQFSGALTRPVASDF

SEQ ID NO: 18539 - protein, 20 aa, synthetic construct
  source 1..20: note = Seed: SATGFKQSSKALQRPVASDF
SATGWKQFSGALVRPVASDF

SEQ ID NO: 18540 - protein, 20 aa, synthetic construct
  source 1..20: note = Seed: SATGFKQSSKALQRPVASDF
SATGWKQFSHALARPVASDF

SEQ ID NO: 18541 - protein, 20 aa, synthetic construct
  source 1..20: note = Seed: SATGFKQSSKALQRPVASDF
SATGWKQFSIALHRPVASDF

SEQ ID NO: 18542 - protein, 20 aa, synthetic construct
  source 1..20: note = Seed: SATGFKQSSKALQRPVASDF
SATGWKQFSKALARPVASDF

SEQ ID NO: 18543 - protein, 20 aa, synthetic construct
  source 1..20: note = Seed: SATGFKQSSKALQRPVASDF
SATGWKQFSKALGRPVASDF

SEQ ID NO: 18544 - protein, 20 aa, synthetic construct
  source 1..20: note = Seed: SATGFKQSSKALQRPVASDF
SATGWKQFSKALHRPVASDF

SEQ ID NO: 18545 - protein, 20 aa, synthetic construct
  source 1..20: note = Seed: SATGFKQSSKALQRPVASDF
SATGWKQFSKALKRPVASDF

SEQ ID NO: 18546 - protein, 20 aa, synthetic construct
  source 1..20: note = Seed: SATGFKQSSKALQRPVASDF
SATGWKQFSKALRRPVASDF

SEQ ID NO: 18547 - protein, 20 aa, synthetic construct
  source 1..20: note = Seed: SATGFKQSSKALQRPVASDF
SATGWKQFSKALSRPVASDF

SEQ ID NO: 18548 - protein, 20 aa, synthetic construct
  source 1..20: note = Seed: SATGFKQSSKALQRPVASDF
SATGWKQFSKALTRPVASDF

SEQ ID NO: 18549 - protein, 20 aa, synthetic construct
  source 1..20: note = Seed: SATGFKQSSKALQRPVASDF
SATGWKQFSLALSRPVASDF

SEQ ID NO: 18550 - protein, 20 aa, synthetic construct
  source 1..20: note = Seed: SATGFKQSSKALQRPVASDF
SATGWKQFSNALARPVASDF

SEQ ID NO: 18551 - protein, 20 aa, synthetic construct
  source 1..20: note = Seed: SATGFKQSSKALQRPVASDF
SATGWKQFSNALGRPVASDF

SEQ ID NO: 18552 - protein, 20 aa, synthetic construct
  source 1..20: note = Seed: SATGFKQSSKALQRPVASDF
SATGWKQFSNALIRPVASDF

SEQ ID NO: 18553 - protein, 20 aa, synthetic construct
  source 1..20: note = Seed: SATGFKQSSKALQRPVASDF
SATGWKQFSNALLRPVASDF

SEQ ID NO: 18554 - protein, 20 aa, synthetic construct
  source 1..20: note = Seed: SATGFKQSSKALQRPVASDF
SATGWKQFSNALMRPVASDF

SEQ ID NO: 18555 - protein, 20 aa, synthetic construct
  source 1..20: note = Seed: SATGFKQSSKALQRPVASDF
SATGWKQFSNALNRPVASDF

SEQ ID NO: 18556 - protein, 20 aa, synthetic construct
  source 1..20: note = Seed: SATGFKQSSKALQRPVASDF
SATGWKQFSNALVRPVASDF

SEQ ID NO: 18557 - protein, 20 aa, synthetic construct
  source 1..20: note = Seed: SATGFKQSSKALQRPVASDF
SATGWKQFSPALARPVASDF

SEQ ID NO: 18558 - protein, 20 aa, synthetic construct
  source 1..20: note = Seed: SATGFKQSSKALQRPVASDF
SATGWKQFSPALCRPVASDF

SEQ ID NO: 18559 - protein, 20 aa, synthetic construct
  source 1..20: note = Seed: SATGFKQSSKALQRPVASDF
SATGWKQFSPALGRPVASDF

SEQ ID NO: 18560 - protein, 20 aa, synthetic construct
  source 1..20: note = Seed: SATGFKQSSKALQRPVASDF
SATGWKQFSPALHRPVASDF

SEQ ID NO: 18561 - protein, 20 aa, synthetic construct
  source 1..20: note = Seed: SATGFKQSSKALQRPVASDF
SATGWKQFSPALIRPVASDF

SEQ ID NO: 18562 - protein, 20 aa, synthetic construct
  source 1..20: note = Seed: SATGFKQSSKALQRPVASDF
SATGWKQFSPALLRPVASDF

SEQ ID NO: 18563 - protein, 20 aa, synthetic construct
  source 1..20: note = Seed: SATGFKQSSKALQRPVASDF
SATGWKQFSPALMRPVASDF

SEQ ID NO: 18564 - protein, 20 aa, synthetic construct
  source 1..20: note = Seed: SATGFKQSSKALQRPVASDF
SATGWKQFSPALNRPVASDF

SEQ ID NO: 18565 - protein, 20 aa, synthetic construct
  source 1..20: note = Seed: SATGFKQSSKALQRPVASDF
SATGWKQFSPALQRPVASDF

SEQ ID NO: 18566 - protein, 20 aa, synthetic construct
  source 1..20: note = Seed: SATGFKQSSKALQRPVASDF
SATGWKQFSPALSRPVASDF

SEQ ID NO: 18567 - protein, 20 aa, synthetic construct
  source 1..20: note = Seed: SATGFKQSSKALQRPVASDF
SATGWKQFSPALVRPVASDF

SEQ ID NO: 18568 - protein, 20 aa, synthetic construct
  source 1..20: note = Seed: SATGFKQSSKALQRPVASDF
SATGWKQFSRALARPVASDF

SEQ ID NO: 18569 - protein, 20 aa, synthetic construct
  source 1..20: note = Seed: SATGFKQSSKALQRPVASDF
SATGWKQFSRALGRPVASDF

SEQ ID NO: 18570 - protein, 20 aa, synthetic construct
  source 1..20: note = Seed: SATGFKQSSKALQRPVASDF
SATGWKQFSRALHRPVASDF

SEQ ID NO: 18571 - protein, 20 aa, synthetic construct
  source 1..20: note = Seed: SATGFKQSSKALQRPVASDF
SATGWKQFSRALIRPVASDF

SEQ ID NO: 18572 - protein, 20 aa, synthetic construct
  source 1..20: note = Seed: SATGFKQSSKALQRPVASDF
SATGWKQFSRALKRPVASDF

SEQ ID NO: 18573 - protein, 20 aa, synthetic construct
  source 1..20: note = Seed: SATGFKQSSKALQRPVASDF
SATGWKQFSRALMRPVASDF

SEQ ID NO: 18574 - protein, 20 aa, synthetic construct
  source 1..20: note = Seed: SATGFKQSSKALQRPVASDF
SATGWKQFSRALNRPVASDF

SEQ ID NO: 18575 - protein, 20 aa, synthetic construct
  source 1..20: note = Seed: SATGFKQSSKALQRPVASDF
SATGWKQFSRALQRPVASDF

SEQ ID NO: 18576 - protein, 20 aa, synthetic construct
  source 1..20: note = Seed: SATGFKQSSKALQRPVASDF
SATGWKQFSRALRRPVASDF

SEQ ID NO: 18577 - protein, 20 aa, synthetic construct
  source 1..20: note = Seed: SATGFKQSSKALQRPVASDF
SATGWKQFSRALSRPVASDF

SEQ ID NO: 18578 - protein, 20 aa, synthetic construct
  source 1..20: note = Seed: SATGFKQSSKALQRPVASDF
SATGWKQFSRALTRPVASDF

SEQ ID NO: 18579 - protein, 20 aa, synthetic construct
  source 1..20: note = Seed: SATGFKQSSKALQRPVASDF
SATGWKQFSRALVRPVASDF

SEQ ID NO: 18580 - protein, 20 aa, synthetic construct
  source 1..20: note = Seed: SATGFKQSSKALQRPVASDF
SATGWKQFSSALARPVASDF

SEQ ID NO: 18581 - protein, 20 aa, synthetic construct
  source 1..20: note = Seed: SATGFKQSSKALQRPVASDF
SATGWKQFSSALCRPVASDF

SEQ ID NO: 18582 - protein, 20 aa, synthetic construct
  source 1..20: note = Seed: SATGFKQSSKALQRPVASDF
SATGWKQFSSALGRPVASDF

SEQ ID NO: 18583 - protein, 20 aa, synthetic construct
  source 1..20: note = Seed: SATGFKQSSKALQRPVASDF
SATGWKQFSSALHRPVASDF

SEQ ID NO: 18584 - protein, 20 aa, synthetic construct
  source 1..20: note = Seed: SATGFKQSSKALQRPVASDF
SATGWKQFSSALIRPVASDF

SEQ ID NO: 18585 - protein, 20 aa, synthetic construct
  source 1..20: note = Seed: SATGFKQSSKALQRPVASDF
SATGWKQFSSALLRPVASDF

SEQ ID NO: 18586 - protein, 20 aa, synthetic construct
  source 1..20: note = Seed: SATGFKQSSKALQRPVASDF
SATGWKQFSSALMRPVASDF

SEQ ID NO: 18587 - protein, 20 aa, synthetic construct
  source 1..20: note = Seed: SATGFKQSSKALQRPVASDF
SATGWKQFSSALNRPVASDF

SEQ ID NO: 18588 - protein, 20 aa, synthetic construct
  source 1..20: note = Seed: SATGFKQSSKALQRPVASDF
SATGWKQFSSALQRPVASDF

SEQ ID NO: 18589 - protein, 20 aa, synthetic construct
  source 1..20: note = Seed: SATGFKQSSKALQRPVASDF
SATGWKQFSSALTRPVASDF

SEQ ID NO: 18590 - protein, 20 aa, synthetic construct
  source 1..20: note = Seed: SATGFKQSSKALQRPVASDF
SATGWKQFSSALVRPVASDF

SEQ ID NO: 18591 - protein, 20 aa, synthetic construct
  source 1..20: note = Seed: SATGFKQSSKALQRPVASDF
SATGWKQFSTALARPVASDF

SEQ ID NO: 18592 - protein, 20 aa, synthetic construct
  source 1..20: note = Seed: SATGFKQSSKALQRPVASDF
SATGWKQFSTALGRPVASDF

SEQ ID NO: 18593 - protein, 20 aa, synthetic construct
  source 1..20: note = Seed: SATGFKQSSKALQRPVASDF
SATGWKQFSTALHRPVASDF

SEQ ID NO: 18594 - protein, 20 aa, synthetic construct
  source 1..20: note = Seed: SATGFKQSSKALQRPVASDF
SATGWKQFSTALIRPVASDF

SEQ ID NO: 18595 - protein, 20 aa, synthetic construct
  source 1..20: note = Seed: SATGFKQSSKALQRPVASDF
SATGWKQFSTALLRPVASDF

SEQ ID NO: 18596 - protein, 20 aa, synthetic construct
  source 1..20: note = Seed: SATGFKQSSKALQRPVASDF
SATGWKQFSTALMRPVASDF

SEQ ID NO: 18597 - protein, 20 aa, synthetic construct
  source 1..20: note = Seed: SATGFKQSSKALQRPVASDF
SATGWKQFSTALNRPVASDF

SEQ ID NO: 18598 - protein, 20 aa, synthetic construct
  source 1..20: note = Seed: SATGFKQSSKALQRPVASDF
SATGWKQFSTALQRPVASDF

SEQ ID NO: 18599 - protein, 20 aa, synthetic construct
  source 1..20: note = Seed: SATGFKQSSKALQRPVASDF
SATGWKQFSTALSRPVASDF

SEQ ID NO: 18600 - protein, 20 aa, synthetic construct
  source 1..20: note = Seed: SATGFKQSSKALQRPVASDF
SATGWKQFSTALVRPVASDF

SEQ ID NO: 18601 - protein, 20 aa, synthetic construct
  source 1..20: note = Seed: SATGFKQSSKALQRPVASDF
SATGWKQFSVALCRPVASDF

SEQ ID NO: 18602 - protein, 20 aa, synthetic construct
  source 1..20: note = Seed: SATGFKQSSKALQRPVASDF
SATGWKQFSVALDRPVASDF

SEQ ID NO: 18603 - protein, 20 aa, synthetic construct
  source 1..20: note = Seed: SATGFKQSSKALQRPVASDF
SATGWKQFSVALERPVASDF

SEQ ID NO: 18604 - protein, 20 aa, synthetic construct
  source 1..20: note = Seed: SATGFKQSSKALQRPVASDF
SATGWKQFSVALHRPVASDF

SEQ ID NO: 18605 - protein, 20 aa, synthetic construct
  source 1..20: note = Seed: SATGFKQSSKALQRPVASDF
SATGWKQFSVALLRPVASDF

SEQ ID NO: 18606 - protein, 20 aa, synthetic construct
  source 1..20: note = Seed: SATGFKQSSKALQRPVASDF
SATGWKQFSVALNRPVASDF

SEQ ID NO: 18607 - protein, 20 aa, synthetic construct
  source 1..20: note = Seed: SATGFKQSSKALQRPVASDF
SATGWKQFSVALQRPVASDF

SEQ ID NO: 18608 - protein, 20 aa, synthetic construct
  source 1..20: note = Seed: SATGFKQSSKALQRPVASDF
SATGWKQGSAALARPVASDF

SEQ ID NO: 18609 - protein, 20 aa, synthetic construct
  source 1..20: note = Seed: SATGFKQSSKALQRPVASDF
SATGWKQGSAALIRPVASDF

SEQ ID NO: 18610 - protein, 20 aa, synthetic construct
  source 1..20: note = Seed: SATGFKQSSKALQRPVASDF
SATGWKQGSAALLRPVASDF

SEQ ID NO: 18611 - protein, 20 aa, synthetic construct
  source 1..20: note = Seed: SATGFKQSSKALQRPVASDF
SATGWKQGSAALMRPVASDF

SEQ ID NO: 18612 - protein, 20 aa, synthetic construct
  source 1..20: note = Seed: SATGFKQSSKALQRPVASDF
SATGWKQGSAALSRPVASDF

SEQ ID NO: 18613 - protein, 20 aa, synthetic construct
  source 1..20: note = Seed: SATGFKQSSKALQRPVASDF
SATGWKQGSAALVRPVASDF

SEQ ID NO: 18614 - protein, 20 aa, synthetic construct
  source 1..20: note = Seed: SATGFKQSSKALQRPVASDF
SATGWKQGSGALIRPVASDF

SEQ ID NO: 18615 - protein, 20 aa, synthetic construct
  source 1..20: note = Seed: SATGFKQSSKALQRPVASDF
SATGWKQGSGALLRPVASDF

SEQ ID NO: 18616 - protein, 20 aa, synthetic construct
  source 1..20: note = Seed: SATGFKQSSKALQRPVASDF
SATGWKQGSGALVRPVASDF

SEQ ID NO: 18617 - protein, 20 aa, synthetic construct
  source 1..20: note = Seed: SATGFKQSSKALQRPVASDF
SATGWKQGSIALNRPVASDF

SEQ ID NO: 18618 - protein, 20 aa, synthetic construct
  source 1..20: note = Seed: SATGFKQSSKALQRPVASDF
SATGWKQGSIALSRPVASDF

SEQ ID NO: 18619 - protein, 20 aa, synthetic construct
  source 1..20: note = Seed: SATGFKQSSKALQRPVASDF
SATGWKQGSIALVRPVASDF

SEQ ID NO: 18620 - protein, 20 aa, synthetic construct
  source 1..20: note = Seed: SATGFKQSSKALQRPVASDF
SATGWKQGSLALSRPVASDF

SEQ ID NO: 18621 - protein, 20 aa, synthetic construct
  source 1..20: note = Seed: SATGFKQSSKALQRPVASDF
SATGWKQGSLALVRPVASDF

SEQ ID NO: 18622 - protein, 20 aa, synthetic construct
  source 1..20: note = Seed: SATGFKQSSKALQRPVASDF
SATGWKQGSPALIRPVASDF

SEQ ID NO: 18623 - protein, 20 aa, synthetic construct
  source 1..20: note = Seed: SATGFKQSSKALQRPVASDF
SATGWKQGSPALLRPVASDF

SEQ ID NO: 18624 - protein, 20 aa, synthetic construct
  source 1..20: note = Seed: SATGFKQSSKALQRPVASDF
SATGWKQGSPALVRPVASDF

SEQ ID NO: 18625 - protein, 20 aa, synthetic construct
  source 1..20: note = Seed: SATGFKQSSKALQRPVASDF
SATGWKQGSSALARPVASDF

SEQ ID NO: 18626 - protein, 20 aa, synthetic construct
  source 1..20: note = Seed: SATGFKQSSKALQRPVASDF
SATGWKQGSSALIRPVASDF

SEQ ID NO: 18627 - protein, 20 aa, synthetic construct
  source 1..20: note = Seed: SATGFKQSSKALQRPVASDF
SATGWKQGSSALLRPVASDF

SEQ ID NO: 18628 - protein, 20 aa, synthetic construct
  source 1..20: note = Seed: SATGFKQSSKALQRPVASDF
SATGWKQGSSALMRPVASDF

SEQ ID NO: 18629 - protein, 20 aa, synthetic construct
  source 1..20: note = Seed: SATGFKQSSKALQRPVASDF
SATGWKQGSSALVRPVASDF

SEQ ID NO: 18630 - protein, 20 aa, synthetic construct
  source 1..20: note = Seed: SATGFKQSSKALQRPVASDF
SATGWKQGSTALLRPVASDF

SEQ ID NO: 18631 - protein, 20 aa, synthetic construct
  source 1..20: note = Seed: SATGFKQSSKALQRPVASDF
SATGWKQGSTALVRPVASDF

SEQ ID NO: 18632 - protein, 20 aa, synthetic construct
  source 1..20: note = Seed: SATGFKQSSKALQRPVASDF
SATGWKQGSVALARPVASDF

SEQ ID NO: 18633 - protein, 20 aa, synthetic construct
  source 1..20: note = Seed: SATGFKQSSKALQRPVASDF
SATGWKQGSVALIRPVASDF

SEQ ID NO: 18634 - protein, 20 aa, synthetic construct
  source 1..20: note = Seed: SATGFKQSSKALQRPVASDF
SATGWKQGSVALLRPVASDF

SEQ ID NO: 18635 - protein, 20 aa, synthetic construct
  source 1..20: note = Seed: SATGFKQSSKALQRPVASDF
SATGWKQGSVALMRPVASDF

SEQ ID NO: 18636 - protein, 20 aa, synthetic construct
  source 1..20: note = Seed: SATGFKQSSKALQRPVASDF
SATGWKQGSVALQRPVASDF

SEQ ID NO: 18637 - protein, 20 aa, synthetic construct
  source 1..20: note = Seed: SATGFKQSSKALQRPVASDF
SATGWKQGSVALSRPVASDF

SEQ ID NO: 18638 - protein, 20 aa, synthetic construct
  source 1..20: note = Seed: SATGFKQSSKALQRPVASDF
SATGWKQGSVALVRPVASDF

SEQ ID NO: 18639 - protein, 20 aa, synthetic construct
  source 1..20: note = Seed: SATGFKQSSKALQRPVASDF
SATGWKQHSAALARPVASDF

SEQ ID NO: 18640 - protein, 20 aa, synthetic construct
  source 1..20: note = Seed: SATGFKQSSKALQRPVASDF
SATGWKQHSAALIRPVASDF

SEQ ID NO: 18641 - protein, 20 aa, synthetic construct
  source 1..20: note = Seed: SATGFKQSSKALQRPVASDF
SATGWKQHSAALLRPVASDF

SEQ ID NO: 18642 - protein, 20 aa, synthetic construct
  source 1..20: note = Seed: SATGFKQSSKALQRPVASDF
SATGWKQHSAALVRPVASDF

SEQ ID NO: 18643 - protein, 20 aa, synthetic construct
  source 1..20: note = Seed: SATGFKQSSKALQRPVASDF
SATGWKQHSGALLRPVASDF

SEQ ID NO: 18644 - protein, 20 aa, synthetic construct
  source 1..20: note = Seed: SATGFKQSSKALQRPVASDF
SATGWKQHSGALVRPVASDF

SEQ ID NO: 18645 - protein, 20 aa, synthetic construct
  source 1..20: note = Seed: SATGFKQSSKALQRPVASDF
SATGWKQHSIALNRPVASDF

SEQ ID NO: 18646 - protein, 20 aa, synthetic construct
  source 1..20: note = Seed: SATGFKQSSKALQRPVASDF
SATGWKQHSSALARPVASDF

SEQ ID NO: 18647 - protein, 20 aa, synthetic construct
  source 1..20: note = Seed: SATGFKQSSKALQRPVASDF
SATGWKQHSSALIRPVASDF

SEQ ID NO: 18648 - protein, 20 aa, synthetic construct
  source 1..20: note = Seed: SATGFKQSSKALQRPVASDF
SATGWKQHSSALVRPVASDF

SEQ ID NO: 18649 - protein, 20 aa, synthetic construct
  source 1..20: note = Seed: SATGFKQSSKALQRPVASDF
SATGWKQHSVALARPVASDF

SEQ ID NO: 18650 - protein, 20 aa, synthetic construct
  source 1..20: note = Seed: SATGFKQSSKALQRPVASDF
SATGWKQHSVALIRPVASDF

SEQ ID NO: 18651 - protein, 20 aa, synthetic construct
  source 1..20: note = Seed: SATGFKQSSKALQRPVASDF
SATGWKQHSVALSRPVASDF

SEQ ID NO: 18652 - protein, 20 aa, synthetic construct
  source 1..20: note = Seed: SATGFKQSSKALQRPVASDF
SATGWKQHSVALVRPVASDF

SEQ ID NO: 18653 - protein, 20 aa, synthetic construct
  source 1..20: note = Seed: SATGFKQSSKALQRPVASDF
SATGWKQISAALARPVASDF

SEQ ID NO: 18654 - protein, 20 aa, synthetic construct
  source 1..20: note = Seed: SATGFKQSSKALQRPVASDF
SATGWKQISAALCRPVASDF

SEQ ID NO: 18655 - protein, 20 aa, synthetic construct
  source 1..20: note = Seed: SATGFKQSSKALQRPVASDF
SATGWKQISAALDRPVASDF

SEQ ID NO: 18656 - protein, 20 aa, synthetic construct
  source 1..20: note = Seed: SATGFKQSSKALQRPVASDF
SATGWKQISAALERPVASDF

SEQ ID NO: 18657 - protein, 20 aa, synthetic construct
  source 1..20: note = Seed: SATGFKQSSKALQRPVASDF
SATGWKQISAALFRPVASDF

SEQ ID NO: 18658 - protein, 20 aa, synthetic construct
  source 1..20: note = Seed: SATGFKQSSKALQRPVASDF
SATGWKQISAALGRPVASDF

SEQ ID NO: 18659 - protein, 20 aa, synthetic construct
  source 1..20: note = Seed: SATGFKQSSKALQRPVASDF
SATGWKQISAALHRPVASDF

SEQ ID NO: 18660 - protein, 20 aa, synthetic construct
  source 1..20: note = Seed: SATGFKQSSKALQRPVASDF
SATGWKQISAALIRPVASDF

SEQ ID NO: 18661 - protein, 20 aa, synthetic construct
  source 1..20: note = Seed: SATGFKQSSKALQRPVASDF
SATGWKQISAALLRPVASDF

SEQ ID NO: 18662 - protein, 20 aa, synthetic construct
  source 1..20: note = Seed: SATGFKQSSKALQRPVASDF
SATGWKQISAALMRPVASDF

SEQ ID NO: 18663 - protein, 20 aa, synthetic construct
  source 1..20: note = Seed: SATGFKQSSKALQRPVASDF
SATGWKQISAALNRPVASDF

SEQ ID NO: 18664 - protein, 20 aa, synthetic construct
  source 1..20: note = Seed: SATGFKQSSKALQRPVASDF
SATGWKQISAALPRPVASDF

SEQ ID NO: 18665 - protein, 20 aa, synthetic construct
  source 1..20: note = Seed: SATGFKQSSKALQRPVASDF
SATGWKQISAALQRPVASDF

SEQ ID NO: 18666 - protein, 20 aa, synthetic construct
  source 1..20: note = Seed: SATGFKQSSKALQRPVASDF
SATGWKQISAALSRPVASDF

SEQ ID NO: 18667 - protein, 20 aa, synthetic construct
  source 1..20: note = Seed: SATGFKQSSKALQRPVASDF
SATGWKQISAALTRPVASDF

SEQ ID NO: 18668 - protein, 20 aa, synthetic construct
  source 1..20: note = Seed: SATGFKQSSKALQRPVASDF
SATGWKQISAALVRPVASDF

SEQ ID NO: 18669 - protein, 20 aa, synthetic construct
  source 1..20: note = Seed: SATGFKQSSKALQRPVASDF
SATGWKQISAALYRPVASDF

SEQ ID NO: 18670 - protein, 20 aa, synthetic construct
  source 1..20: note = Seed: SATGFKQSSKALQRPVASDF
SATGWKQISCALARPVASDF

SEQ ID NO: 18671 - protein, 20 aa, synthetic construct
  source 1..20: note = Seed: SATGFKQSSKALQRPVASDF
SATGWKQISCALVRPVASDF

SEQ ID NO: 18672 - protein, 20 aa, synthetic construct
  source 1..20: note = Seed: SATGFKQSSKALQRPVASDF
SATGWKQISFALARPVASDF

SEQ ID NO: 18673 - protein, 20 aa, synthetic construct
  source 1..20: note = Seed: SATGFKQSSKALQRPVASDF
SATGWKQISFALDRPVASDF

SEQ ID NO: 18674 - protein, 20 aa, synthetic construct
  source 1..20: note = Seed: SATGFKQSSKALQRPVASDF
SATGWKQISFALERPVASDF

SEQ ID NO: 18675 - protein, 20 aa, synthetic construct
  source 1..20: note = Seed: SATGFKQSSKALQRPVASDF
SATGWKQISFALIRPVASDF

SEQ ID NO: 18676 - protein, 20 aa, synthetic construct
  source 1..20: note = Seed: SATGFKQSSKALQRPVASDF
SATGWKQISFALLRPVASDF

SEQ ID NO: 18677 - protein, 20 aa, synthetic construct
  source 1..20: note = Seed: SATGFKQSSKALQRPVASDF
SATGWKQISFALMRPVASDF

SEQ ID NO: 18678 - protein, 20 aa, synthetic construct
  source 1..20: note = Seed: SATGFKQSSKALQRPVASDF
SATGWKQISFALSRPVASDF

SEQ ID NO: 18679 - protein, 20 aa, synthetic construct
  source 1..20: note = Seed: SATGFKQSSKALQRPVASDF
SATGWKQISFALTRPVASDF

SEQ ID NO: 18680 - protein, 20 aa, synthetic construct
  source 1..20: note = Seed: SATGFKQSSKALQRPVASDF
SATGWKQISFALVRPVASDF

SEQ ID NO: 18681 - protein, 20 aa, synthetic construct
  source 1..20: note = Seed: SATGFKQSSKALQRPVASDF
SATGWKQISGALARPVASDF

SEQ ID NO: 18682 - protein, 20 aa, synthetic construct
  source 1..20: note = Seed: SATGFKQSSKALQRPVASDF
SATGWKQISGALCRPVASDF

SEQ ID NO: 18683 - protein, 20 aa, synthetic construct
  source 1..20: note = Seed: SATGFKQSSKALQRPVASDF
SATGWKQISGALGRPVASDF

SEQ ID NO: 18684 - protein, 20 aa, synthetic construct
  source 1..20: note = Seed: SATGFKQSSKALQRPVASDF
SATGWKQISGALIRPVASDF

SEQ ID NO: 18685 - protein, 20 aa, synthetic construct
  source 1..20: note = Seed: SATGFKQSSKALQRPVASDF
SATGWKQISGALLRPVASDF

SEQ ID NO: 18686 - protein, 20 aa, synthetic construct
  source 1..20: note = Seed: SATGFKQSSKALQRPVASDF
SATGWKQISGALMRPVASDF

SEQ ID NO: 18687 - protein, 20 aa, synthetic construct
  source 1..20: note = Seed: SATGFKQSSKALQRPVASDF
SATGWKQISGALNRPVASDF

SEQ ID NO: 18688 - protein, 20 aa, synthetic construct
  source 1..20: note = Seed: SATGFKQSSKALQRPVASDF
SATGWKQISGALPRPVASDF

SEQ ID NO: 18689 - protein, 20 aa, synthetic construct
  source 1..20: note = Seed: SATGFKQSSKALQRPVASDF
SATGWKQISGALSRPVASDF

SEQ ID NO: 18690 - protein, 20 aa, synthetic construct
  source 1..20: note = Seed: SATGFKQSSKALQRPVASDF
SATGWKQISGALTRPVASDF

SEQ ID NO: 18691 - protein, 20 aa, synthetic construct
  source 1..20: note = Seed: SATGFKQSSKALQRPVASDF
SATGWKQISGALVRPVASDF

SEQ ID NO: 18692 - protein, 20 aa, synthetic construct
  source 1..20: note = Seed: SATGFKQSSKALQRPVASDF
SATGWKQISHALARPVASDF

SEQ ID NO: 18693 - protein, 20 aa, synthetic construct
  source 1..20: note = Seed: SATGFKQSSKALQRPVASDF
SATGWKQISHALIRPVASDF

SEQ ID NO: 18694 - protein, 20 aa, synthetic construct
  source 1..20: note = Seed: SATGFKQSSKALQRPVASDF
SATGWKQISHALLRPVASDF

SEQ ID NO: 18695 - protein, 20 aa, synthetic construct
  source 1..20: note = Seed: SATGFKQSSKALQRPVASDF
SATGWKQISHALMRPVASDF

SEQ ID NO: 18696 - protein, 20 aa, synthetic construct
  source 1..20: note = Seed: SATGFKQSSKALQRPVASDF
SATGWKQISHALNRPVASDF

SEQ ID NO: 18697 - protein, 20 aa, synthetic construct
  source 1..20: note = Seed: SATGFKQSSKALQRPVASDF
SATGWKQISHALSRPVASDF

SEQ ID NO: 18698 - protein, 20 aa, synthetic construct
  source 1..20: note = Seed: SATGFKQSSKALQRPVASDF
SATGWKQISHALVRPVASDF

SEQ ID NO: 18699 - protein, 20 aa, synthetic construct
  source 1..20: note = Seed: SATGFKQSSKALQRPVASDF
SATGWKQISIALARPVASDF

SEQ ID NO: 18700 - protein, 20 aa, synthetic construct
  source 1..20: note = Seed: SATGFKQSSKALQRPVASDF
SATGWKQISIALCRPVASDF

SEQ ID NO: 18701 - protein, 20 aa, synthetic construct
  source 1..20: note = Seed: SATGFKQSSKALQRPVASDF
SATGWKQISIALDRPVASDF

SEQ ID NO: 18702 - protein, 20 aa, synthetic construct
  source 1..20: note = Seed: SATGFKQSSKALQRPVASDF
SATGWKQISIALGRPVASDF

SEQ ID NO: 18703 - protein, 20 aa, synthetic construct
  source 1..20: note = Seed: SATGFKQSSKALQRPVASDF
SATGWKQISIALHRPVASDF

SEQ ID NO: 18704 - protein, 20 aa, synthetic construct
  source 1..20: note = Seed: SATGFKQSSKALQRPVASDF
SATGWKQISIALIRPVASDF

SEQ ID NO: 18705 - protein, 20 aa, synthetic construct
  source 1..20: note = Seed: SATGFKQSSKALQRPVASDF
SATGWKQISIALNRPVASDF

SEQ ID NO: 18706 - protein, 20 aa, synthetic construct
  source 1..20: note = Seed: SATGFKQSSKALQRPVASDF
SATGWKQISIALQRPVASDF

SEQ ID NO: 18707 - protein, 20 aa, synthetic construct
  source 1..20: note = Seed: SATGFKQSSKALQRPVASDF
SATGWKQISIALSRPVASDF

SEQ ID NO: 18708 - protein, 20 aa, synthetic construct
  source 1..20: note = Seed: SATGFKQSSKALQRPVASDF
SATGWKQISIALTRPVASDF

SEQ ID NO: 18709 - protein, 20 aa, synthetic construct
  source 1..20: note = Seed: SATGFKQSSKALQRPVASDF
SATGWKQISIALVRPVASDF

SEQ ID NO: 18710 - protein, 20 aa, synthetic construct
  source 1..20: note = Seed: SATGFKQSSKALQRPVASDF
SATGWKQISIALYRPVASDF

SEQ ID NO: 18711 - protein, 20 aa, synthetic construct
  source 1..20: note = Seed: SATGFKQSSKALQRPVASDF
SATGWKQISKALARPVASDF

SEQ ID NO: 18712 - protein, 20 aa, synthetic construct
  source 1..20: note = Seed: SATGFKQSSKALQRPVASDF
SATGWKQISKALGRPVASDF

SEQ ID NO: 18713 - protein, 20 aa, synthetic construct
  source 1..20: note = Seed: SATGFKQSSKALQRPVASDF
SATGWKQISKALHRPVASDF

SEQ ID NO: 18714 - protein, 20 aa, synthetic construct
  source 1..20: note = Seed: SATGFKQSSKALQRPVASDF
SATGWKQISKALIRPVASDF

SEQ ID NO: 18715 - protein, 20 aa, synthetic construct
  source 1..20: note = Seed: SATGFKQSSKALQRPVASDF
SATGWKQISKALKRPVASDF

SEQ ID NO: 18716 - protein, 20 aa, synthetic construct
  source 1..20: note = Seed: SATGFKQSSKALQRPVASDF
SATGWKQISKALMRPVASDF

SEQ ID NO: 18717 - protein, 20 aa, synthetic construct
  source 1..20: note = Seed: SATGFKQSSKALQRPVASDF
SATGWKQISKALNRPVASDF

SEQ ID NO: 18718 - protein, 20 aa, synthetic construct
  source 1..20: note = Seed: SATGFKQSSKALQRPVASDF
SATGWKQISKALPRPVASDF

SEQ ID NO: 18719 - protein, 20 aa, synthetic construct
  source 1..20: note = Seed: SATGFKQSSKALQRPVASDF
SATGWKQISKALQRPVASDF

SEQ ID NO: 18720 - protein, 20 aa, synthetic construct
  source 1..20: note = Seed: SATGFKQSSKALQRPVASDF
SATGWKQISKALRRPVASDF

SEQ ID NO: 18721 - protein, 20 aa, synthetic construct
  source 1..20: note = Seed: SATGFKQSSKALQRPVASDF
SATGWKQISKALSRPVASDF

SEQ ID NO: 18722 - protein, 20 aa, synthetic construct
  source 1..20: note = Seed: SATGFKQSSKALQRPVASDF
SATGWKQISKALTRPVASDF

SEQ ID NO: 18723 - protein, 20 aa, synthetic construct
  source 1..20: note = Seed: SATGFKQSSKALQRPVASDF
SATGWKQISKALVRPVASDF

SEQ ID NO: 18724 - protein, 20 aa, synthetic construct
  source 1..20: note = Seed: SATGFKQSSKALQRPVASDF
SATGWKQISLALARPVASDF

SEQ ID NO: 18725 - protein, 20 aa, synthetic construct
  source 1..20: note = Seed: SATGFKQSSKALQRPVASDF
SATGWKQISLALCRPVASDF

SEQ ID NO: 18726 - protein, 20 aa, synthetic construct
  source 1..20: note = Seed: SATGFKQSSKALQRPVASDF
SATGWKQISLALGRPVASDF

SEQ ID NO: 18727 - protein, 20 aa, synthetic construct
  source 1..20: note = Seed: SATGFKQSSKALQRPVASDF
SATGWKQISLALHRPVASDF

SEQ ID NO: 18728 - protein, 20 aa, synthetic construct
  source 1..20: note = Seed: SATGFKQSSKALQRPVASDF
SATGWKQISLALNRPVASDF

SEQ ID NO: 18729 - protein, 20 aa, synthetic construct
  source 1..20: note = Seed: SATGFKQSSKALQRPVASDF
SATGWKQISLALSRPVASDF

SEQ ID NO: 18730 - protein, 20 aa, synthetic construct
  source 1..20: note = Seed: SATGFKQSSKALQRPVASDF
SATGWKQISLALTRPVASDF

SEQ ID NO: 18731 - protein, 20 aa, synthetic construct
  source 1..20: note = Seed: SATGFKQSSKALQRPVASDF
SATGWKQISLALYRPVASDF

SEQ ID NO: 18732 - protein, 20 aa, synthetic construct
  source 1..20: note = Seed: SATGFKQSSKALQRPVASDF
SATGWKQISMALCRPVASDF

SEQ ID NO: 18733 - protein, 20 aa, synthetic construct
  source 1..20: note = Seed: SATGFKQSSKALQRPVASDF
SATGWKQISMALGRPVASDF

SEQ ID NO: 18734 - protein, 20 aa, synthetic construct
  source 1..20: note = Seed: SATGFKQSSKALQRPVASDF
SATGWKQISMALHRPVASDF

SEQ ID NO: 18735 - protein, 20 aa, synthetic construct
  source 1..20: note = Seed: SATGFKQSSKALQRPVASDF
SATGWKQISMALNRPVASDF

SEQ ID NO: 18736 - protein, 20 aa, synthetic construct
  source 1..20: note = Seed: SATGFKQSSKALQRPVASDF
SATGWKQISMALSRPVASDF

SEQ ID NO: 18737 - protein, 20 aa, synthetic construct
  source 1..20: note = Seed: SATGFKQSSKALQRPVASDF
SATGWKQISNALARPVASDF

SEQ ID NO: 18738 - protein, 20 aa, synthetic construct
  source 1..20: note = Seed: SATGFKQSSKALQRPVASDF
SATGWKQISNALGRPVASDF

SEQ ID NO: 18739 - protein, 20 aa, synthetic construct
  source 1..20: note = Seed: SATGFKQSSKALQRPVASDF
SATGWKQISNALIRPVASDF

SEQ ID NO: 18740 - protein, 20 aa, synthetic construct
  source 1..20: note = Seed: SATGFKQSSKALQRPVASDF
SATGWKQISNALLRPVASDF

SEQ ID NO: 18741 - protein, 20 aa, synthetic construct
  source 1..20: note = Seed: SATGFKQSSKALQRPVASDF
SATGWKQISNALMRPVASDF

SEQ ID NO: 18742 - protein, 20 aa, synthetic construct
  source 1..20: note = Seed: SATGFKQSSKALQRPVASDF
SATGWKQISNALNRPVASDF

SEQ ID NO: 18743 - protein, 20 aa, synthetic construct
  source 1..20: note = Seed: SATGFKQSSKALQRPVASDF
SATGWKQISNALSRPVASDF

SEQ ID NO: 18744 - protein, 20 aa, synthetic construct
  source 1..20: note = Seed: SATGFKQSSKALQRPVASDF
SATGWKQISNALTRPVASDF

SEQ ID NO: 18745 - protein, 20 aa, synthetic construct
  source 1..20: note = Seed: SATGFKQSSKALQRPVASDF
SATGWKQISNALVRPVASDF

SEQ ID NO: 18746 - protein, 20 aa, synthetic construct
  source 1..20: note = Seed: SATGFKQSSKALQRPVASDF
SATGWKQISPALARPVASDF

SEQ ID NO: 18747 - protein, 20 aa, synthetic construct
  source 1..20: note = Seed: SATGFKQSSKALQRPVASDF
SATGWKQISPALCRPVASDF

SEQ ID NO: 18748 - protein, 20 aa, synthetic construct
  source 1..20: note = Seed: SATGFKQSSKALQRPVASDF
SATGWKQISPALDRPVASDF

SEQ ID NO: 18749 - protein, 20 aa, synthetic construct
  source 1..20: note = Seed: SATGFKQSSKALQRPVASDF
SATGWKQISPALGRPVASDF

SEQ ID NO: 18750 - protein, 20 aa, synthetic construct
  source 1..20: note = Seed: SATGFKQSSKALQRPVASDF
SATGWKQISPALHRPVASDF

SEQ ID NO: 18751 - protein, 20 aa, synthetic construct
  source 1..20: note = Seed: SATGFKQSSKALQRPVASDF
SATGWKQISPALIRPVASDF

SEQ ID NO: 18752 - protein, 20 aa, synthetic construct
  source 1..20: note = Seed: SATGFKQSSKALQRPVASDF
SATGWKQISPALLRPVASDF

SEQ ID NO: 18753 - protein, 20 aa, synthetic construct
  source 1..20: note = Seed: SATGFKQSSKALQRPVASDF
SATGWKQISPALMRPVASDF

SEQ ID NO: 18754 - protein, 20 aa, synthetic construct
  source 1..20: note = Seed: SATGFKQSSKALQRPVASDF
SATGWKQISPALNRPVASDF

SEQ ID NO: 18755 - protein, 20 aa, synthetic construct
  source 1..20: note = Seed: SATGFKQSSKALQRPVASDF
SATGWKQISPALPRPVASDF

SEQ ID NO: 18756 - protein, 20 aa, synthetic construct
  source 1..20: note = Seed: SATGFKQSSKALQRPVASDF
SATGWKQISPALQRPVASDF

SEQ ID NO: 18757 - protein, 20 aa, synthetic construct
  source 1..20: note = Seed: SATGFKQSSKALQRPVASDF
SATGWKQISPALSRPVASDF

SEQ ID NO: 18758 - protein, 20 aa, synthetic construct
  source 1..20: note = Seed: SATGFKQSSKALQRPVASDF
SATGWKQISPALTRPVASDF

SEQ ID NO: 18759 - protein, 20 aa, synthetic construct
  source 1..20: note = Seed: SATGFKQSSKALQRPVASDF
SATGWKQISPALVRPVASDF

SEQ ID NO: 18760 - protein, 20 aa, synthetic construct
  source 1..20: note = Seed: SATGFKQSSKALQRPVASDF
SATGWKQISQALARPVASDF

SEQ ID NO: 18761 - protein, 20 aa, synthetic construct
  source 1..20: note = Seed: SATGFKQSSKALQRPVASDF
SATGWKQISQALIRPVASDF

SEQ ID NO: 18762 - protein, 20 aa, synthetic construct
  source 1..20: note = Seed: SATGFKQSSKALQRPVASDF
SATGWKQISQALSRPVASDF

SEQ ID NO: 18763 - protein, 20 aa, synthetic construct
  source 1..20: note = Seed: SATGFKQSSKALQRPVASDF
SATGWKQISQALVRPVASDF

SEQ ID NO: 18764 - protein, 20 aa, synthetic construct
  source 1..20: note = Seed: SATGFKQSSKALQRPVASDF
SATGWKQISRALARPVASDF

SEQ ID NO: 18765 - protein, 20 aa, synthetic construct
  source 1..20: note = Seed: SATGFKQSSKALQRPVASDF
SATGWKQISRALGRPVASDF

SEQ ID NO: 18766 - protein, 20 aa, synthetic construct
  source 1..20: note = Seed: SATGFKQSSKALQRPVASDF
SATGWKQISRALHRPVASDF

SEQ ID NO: 18767 - protein, 20 aa, synthetic construct
  source 1..20: note = Seed: SATGFKQSSKALQRPVASDF
SATGWKQISRALIRPVASDF

SEQ ID NO: 18768 - protein, 20 aa, synthetic construct
  source 1..20: note = Seed: SATGFKQSSKALQRPVASDF
SATGWKQISRALKRPVASDF

SEQ ID NO: 18769 - protein, 20 aa, synthetic construct
  source 1..20: note = Seed: SATGFKQSSKALQRPVASDF
SATGWKQISRALLRPVASDF

SEQ ID NO: 18770 - protein, 20 aa, synthetic construct
  source 1..20: note = Seed: SATGFKQSSKALQRPVASDF
SATGWKQISRALMRPVASDF

SEQ ID NO: 18771 - protein, 20 aa, synthetic construct
  source 1..20: note = Seed: SATGFKQSSKALQRPVASDF
SATGWKQISRALNRPVASDF

SEQ ID NO: 18772 - protein, 20 aa, synthetic construct
  source 1..20: note = Seed: SATGFKQSSKALQRPVASDF
SATGWKQISRALPRPVASDF

SEQ ID NO: 18773 - protein, 20 aa, synthetic construct
  source 1..20: note = Seed: SATGFKQSSKALQRPVASDF
SATGWKQISRALQRPVASDF

SEQ ID NO: 18774 - protein, 20 aa, synthetic construct
  source 1..20: note = Seed: SATGFKQSSKALQRPVASDF
SATGWKQISRALRRPVASDF

SEQ ID NO: 18775 - protein, 20 aa, synthetic construct
  source 1..20: note = Seed: SATGFKQSSKALQRPVASDF
SATGWKQISRALSRPVASDF

SEQ ID NO: 18776 - protein, 20 aa, synthetic construct
  source 1..20: note = Seed: SATGFKQSSKALQRPVASDF
SATGWKQISRALTRPVASDF

SEQ ID NO: 18777 - protein, 20 aa, synthetic construct
  source 1..20: note = Seed: SATGFKQSSKALQRPVASDF
SATGWKQISRALVRPVASDF

SEQ ID NO: 18778 - protein, 20 aa, synthetic construct
  source 1..20: note = Seed: SATGFKQSSKALQRPVASDF
SATGWKQISSALARPVASDF

SEQ ID NO: 18779 - protein, 20 aa, synthetic construct
  source 1..20: note = Seed: SATGFKQSSKALQRPVASDF
SATGWKQISSALCRPVASDF

SEQ ID NO: 18780 - protein, 20 aa, synthetic construct
  source 1..20: note = Seed: SATGFKQSSKALQRPVASDF
SATGWKQISSALFRPVASDF

SEQ ID NO: 18781 - protein, 20 aa, synthetic construct
  source 1..20: note = Seed: SATGFKQSSKALQRPVASDF
SATGWKQISSALGRPVASDF

SEQ ID NO: 18782 - protein, 20 aa, synthetic construct
  source 1..20: note = Seed: SATGFKQSSKALQRPVASDF
SATGWKQISSALHRPVASDF

SEQ ID NO: 18783 - protein, 20 aa, synthetic construct
  source 1..20: note = Seed: SATGFKQSSKALQRPVASDF
SATGWKQISSALIRPVASDF

SEQ ID NO: 18784 - protein, 20 aa, synthetic construct
  source 1..20: note = Seed: SATGFKQSSKALQRPVASDF
SATGWKQISSALLRPVASDF

SEQ ID NO: 18785 - protein, 20 aa, synthetic construct
  source 1..20: note = Seed: SATGFKQSSKALQRPVASDF
SATGWKQISSALMRPVASDF

SEQ ID NO: 18786 - protein, 20 aa, synthetic construct
  source 1..20: note = Seed: SATGFKQSSKALQRPVASDF
SATGWKQISSALNRPVASDF

SEQ ID NO: 18787 - protein, 20 aa, synthetic construct
  source 1..20: note = Seed: SATGFKQSSKALQRPVASDF
SATGWKQISSALPRPVASDF

SEQ ID NO: 18788 - protein, 20 aa, synthetic construct
  source 1..20: note = Seed: SATGFKQSSKALQRPVASDF
SATGWKQISSALQRPVASDF

SEQ ID NO: 18789 - protein, 20 aa, synthetic construct
  source 1..20: note = Seed: SATGFKQSSKALQRPVASDF
SATGWKQISSALSRPVASDF

SEQ ID NO: 18790 - protein, 20 aa, synthetic construct
  source 1..20: note = Seed: SATGFKQSSKALQRPVASDF
SATGWKQISSALTRPVASDF

SEQ ID NO: 18791 - protein, 20 aa, synthetic construct
  source 1..20: note = Seed: SATGFKQSSKALQRPVASDF
SATGWKQISSALVRPVASDF

SEQ ID NO: 18792 - protein, 20 aa, synthetic construct
  source 1..20: note = Seed: SATGFKQSSKALQRPVASDF
SATGWKQISTALARPVASDF

SEQ ID NO: 18793 - protein, 20 aa, synthetic construct
  source 1..20: note = Seed: SATGFKQSSKALQRPVASDF
SATGWKQISTALCRPVASDF

SEQ ID NO: 18794 - protein, 20 aa, synthetic construct
  source 1..20: note = Seed: SATGFKQSSKALQRPVASDF
SATGWKQISTALERPVASDF

SEQ ID NO: 18795 - protein, 20 aa, synthetic construct
  source 1..20: note = Seed: SATGFKQSSKALQRPVASDF
SATGWKQISTALGRPVASDF

SEQ ID NO: 18796 - protein, 20 aa, synthetic construct
  source 1..20: note = Seed: SATGFKQSSKALQRPVASDF
SATGWKQISTALHRPVASDF

SEQ ID NO: 18797 - protein, 20 aa, synthetic construct
  source 1..20: note = Seed: SATGFKQSSKALQRPVASDF
SATGWKQISTALIRPVASDF

SEQ ID NO: 18798 - protein, 20 aa, synthetic construct
  source 1..20: note = Seed: SATGFKQSSKALQRPVASDF
SATGWKQISTALLRPVASDF

SEQ ID NO: 18799 - protein, 20 aa, synthetic construct
  source 1..20: note = Seed: SATGFKQSSKALQRPVASDF
SATGWKQISTALMRPVASDF

SEQ ID NO: 18800 - protein, 20 aa, synthetic construct
  source 1..20: note = Seed: SATGFKQSSKALQRPVASDF
SATGWKQISTALNRPVASDF

SEQ ID NO: 18801 - protein, 20 aa, synthetic construct
  source 1..20: note = Seed: SATGFKQSSKALQRPVASDF
SATGWKQISTALPRPVASDF

SEQ ID NO: 18802 - protein, 20 aa, synthetic construct
  source 1..20: note = Seed: SATGFKQSSKALQRPVASDF
SATGWKQISTALQRPVASDF

SEQ ID NO: 18803 - protein, 20 aa, synthetic construct
  source 1..20: note = Seed: SATGFKQSSKALQRPVASDF
SATGWKQISTALSRPVASDF

SEQ ID NO: 18804 - protein, 20 aa, synthetic construct
  source 1..20: note = Seed: SATGFKQSSKALQRPVASDF
SATGWKQISTALTRPVASDF

SEQ ID NO: 18805 - protein, 20 aa, synthetic construct
  source 1..20: note = Seed: SATGFKQSSKALQRPVASDF
SATGWKQISTALVRPVASDF

SEQ ID NO: 18806 - protein, 20 aa, synthetic construct
  source 1..20: note = Seed: SATGFKQSSKALQRPVASDF
SATGWKQISVALARPVASDF

SEQ ID NO: 18807 - protein, 20 aa, synthetic construct
  source 1..20: note = Seed: SATGFKQSSKALQRPVASDF
SATGWKQISVALCRPVASDF

SEQ ID NO: 18808 - protein, 20 aa, synthetic construct
  source 1..20: note = Seed: SATGFKQSSKALQRPVASDF
SATGWKQISVALDRPVASDF

SEQ ID NO: 18809 - protein, 20 aa, synthetic construct
  source 1..20: note = Seed: SATGFKQSSKALQRPVASDF
SATGWKQISVALERPVASDF

SEQ ID NO: 18810 - protein, 20 aa, synthetic construct
  source 1..20: note = Seed: SATGFKQSSKALQRPVASDF
SATGWKQISVALFRPVASDF

SEQ ID NO: 18811 - protein, 20 aa, synthetic construct
  source 1..20: note = Seed: SATGFKQSSKALQRPVASDF
SATGWKQISVALGRPVASDF

SEQ ID NO: 18812 - protein, 20 aa, synthetic construct
  source 1..20: note = Seed: SATGFKQSSKALQRPVASDF
SATGWKQISVALHRPVASDF

SEQ ID NO: 18813 - protein, 20 aa, synthetic construct
  source 1..20: note = Seed: SATGFKQSSKALQRPVASDF
SATGWKQISVALIRPVASDF

SEQ ID NO: 18814 - protein, 20 aa, synthetic construct
  source 1..20: note = Seed: SATGFKQSSKALQRPVASDF
SATGWKQISVALLRPVASDF

SEQ ID NO: 18815 - protein, 20 aa, synthetic construct
  source 1..20: note = Seed: SATGFKQSSKALQRPVASDF
SATGWKQISVALMRPVASDF

SEQ ID NO: 18816 - protein, 20 aa, synthetic construct
  source 1..20: note = Seed: SATGFKQSSKALQRPVASDF
SATGWKQISVALNRPVASDF

SEQ ID NO: 18817 - protein, 20 aa, synthetic construct
  source 1..20: note = Seed: SATGFKQSSKALQRPVASDF
SATGWKQISVALPRPVASDF

SEQ ID NO: 18818 - protein, 20 aa, synthetic construct
  source 1..20: note = Seed: SATGFKQSSKALQRPVASDF
SATGWKQISVALQRPVASDF

SEQ ID NO: 18819 - protein, 20 aa, synthetic construct
  source 1..20: note = Seed: SATGFKQSSKALQRPVASDF
SATGWKQISVALSRPVASDF

SEQ ID NO: 18820 - protein, 20 aa, synthetic construct
  source 1..20: note = Seed: SATGFKQSSKALQRPVASDF
SATGWKQISVALTRPVASDF

SEQ ID NO: 18821 - protein, 20 aa, synthetic construct
  source 1..20: note = Seed: SATGFKQSSKALQRPVASDF
SATGWKQISVALVRPVASDF

SEQ ID NO: 18822 - protein, 20 aa, synthetic construct
  source 1..20: note = Seed: SATGFKQSSKALQRPVASDF
SATGWKQKSVALSRPVASDF

SEQ ID NO: 18823 - protein, 20 aa, synthetic construct
  source 1..20: note = Seed: SATGFKQSSKALQRPVASDF
SATGWKQLSAALARPVASDF

SEQ ID NO: 18824 - protein, 20 aa, synthetic construct
  source 1..20: note = Seed: SATGFKQSSKALQRPVASDF
SATGWKQLSAALCRPVASDF

SEQ ID NO: 18825 - protein, 20 aa, synthetic construct
  source 1..20: note = Seed: SATGFKQSSKALQRPVASDF
SATGWKQLSAALDRPVASDF

SEQ ID NO: 18826 - protein, 20 aa, synthetic construct
  source 1..20: note = Seed: SATGFKQSSKALQRPVASDF
SATGWKQLSAALERPVASDF

SEQ ID NO: 18827 - protein, 20 aa, synthetic construct
  source 1..20: note = Seed: SATGFKQSSKALQRPVASDF
SATGWKQLSAALFRPVASDF

SEQ ID NO: 18828 - protein, 20 aa, synthetic construct
  source 1..20: note = Seed: SATGFKQSSKALQRPVASDF
SATGWKQLSAALGRPVASDF

SEQ ID NO: 18829 - protein, 20 aa, synthetic construct
  source 1..20: note = Seed: SATGFKQSSKALQRPVASDF
SATGWKQLSAALHRPVASDF

SEQ ID NO: 18830 - protein, 20 aa, synthetic construct
  source 1..20: note = Seed: SATGFKQSSKALQRPVASDF
SATGWKQLSAALIRPVASDF

SEQ ID NO: 18831 - protein, 20 aa, synthetic construct
  source 1..20: note = Seed: SATGFKQSSKALQRPVASDF
SATGWKQLSAALKRPVASDF

SEQ ID NO: 18832 - protein, 20 aa, synthetic construct
  source 1..20: note = Seed: SATGFKQSSKALQRPVASDF
SATGWKQLSAALLRPVASDF

SEQ ID NO: 18833 - protein, 20 aa, synthetic construct
  source 1..20: note = Seed: SATGFKQSSKALQRPVASDF
SATGWKQLSAALMRPVASDF

SEQ ID NO: 18834 - protein, 20 aa, synthetic construct
  source 1..20: note = Seed: SATGFKQSSKALQRPVASDF
SATGWKQLSAALNRPVASDF

SEQ ID NO: 18835 - protein, 20 aa, synthetic construct
  source 1..20: note = Seed: SATGFKQSSKALQRPVASDF
SATGWKQLSAALPRPVASDF

SEQ ID NO: 18836 - protein, 20 aa, synthetic construct
  source 1..20: note = Seed: SATGFKQSSKALQRPVASDF
SATGWKQLSAALQRPVASDF

SEQ ID NO: 18837 - protein, 20 aa, synthetic construct
  source 1..20: note = Seed: SATGFKQSSKALQRPVASDF
SATGWKQLSAALRRPVASDF

SEQ ID NO: 18838 - protein, 20 aa, synthetic construct
  source 1..20: note = Seed: SATGFKQSSKALQRPVASDF
SATGWKQLSAALSRPVASDF

SEQ ID NO: 18839 - protein, 20 aa, synthetic construct
  source 1..20: note = Seed: SATGFKQSSKALQRPVASDF
SATGWKQLSAALTRPVASDF

SEQ ID NO: 18840 - protein, 20 aa, synthetic construct
  source 1..20: note = Seed: SATGFKQSSKALQRPVASDF
SATGWKQLSAALVRPVASDF

SEQ ID NO: 18841 - protein, 20 aa, synthetic construct
  source 1..20: note = Seed: SATGFKQSSKALQRPVASDF
SATGWKQLSAALYRPVASDF

SEQ ID NO: 18842 - protein, 20 aa, synthetic construct
  source 1..20: note = Seed: SATGFKQSSKALQRPVASDF
SATGWKQLSCALARPVASDF

SEQ ID NO: 18843 - protein, 20 aa, synthetic construct
  source 1..20: note = Seed: SATGFKQSSKALQRPVASDF
SATGWKQLSCALSRPVASDF

SEQ ID NO: 18844 - protein, 20 aa, synthetic construct
  source 1..20: note = Seed: SATGFKQSSKALQRPVASDF
SATGWKQLSCALVRPVASDF

SEQ ID NO: 18845 - protein, 20 aa, synthetic construct
  source 1..20: note = Seed: SATGFKQSSKALQRPVASDF
SATGWKQLSDALARPVASDF

SEQ ID NO: 18846 - protein, 20 aa, synthetic construct
  source 1..20: note = Seed: SATGFKQSSKALQRPVASDF
SATGWKQLSDALVRPVASDF

SEQ ID NO: 18847 - protein, 20 aa, synthetic construct
  source 1..20: note = Seed: SATGFKQSSKALQRPVASDF
SATGWKQLSEALARPVASDF

SEQ ID NO: 18848 - protein, 20 aa, synthetic construct
  source 1..20: note = Seed: SATGFKQSSKALQRPVASDF
SATGWKQLSFALERPVASDF

SEQ ID NO: 18849 - protein, 20 aa, synthetic construct
  source 1..20: note = Seed: SATGFKQSSKALQRPVASDF
SATGWKQLSFALVRPVASDF

SEQ ID NO: 18850 - protein, 20 aa, synthetic construct
  source 1..20: note = Seed: SATGFKQSSKALQRPVASDF
SATGWKQLSGALARPVASDF

SEQ ID NO: 18851 - protein, 20 aa, synthetic construct
  source 1..20: note = Seed: SATGFKQSSKALQRPVASDF
SATGWKQLSGALCRPVASDF

SEQ ID NO: 18852 - protein, 20 aa, synthetic construct
  source 1..20: note = Seed: SATGFKQSSKALQRPVASDF
SATGWKQLSGALFRPVASDF

SEQ ID NO: 18853 - protein, 20 aa, synthetic construct
  source 1..20: note = Seed: SATGFKQSSKALQRPVASDF
SATGWKQLSGALGRPVASDF

SEQ ID NO: 18854 - protein, 20 aa, synthetic construct
  source 1..20: note = Seed: SATGFKQSSKALQRPVASDF
SATGWKQLSGALHRPVASDF

SEQ ID NO: 18855 - protein, 20 aa, synthetic construct
  source 1..20: note = Seed: SATGFKQSSKALQRPVASDF
SATGWKQLSGALIRPVASDF

SEQ ID NO: 18856 - protein, 20 aa, synthetic construct
  source 1..20: note = Seed: SATGFKQSSKALQRPVASDF
SATGWKQLSGALLRPVASDF

SEQ ID NO: 18857 - protein, 20 aa, synthetic construct
  source 1..20: note = Seed: SATGFKQSSKALQRPVASDF
SATGWKQLSGALMRPVASDF

SEQ ID NO: 18858 - protein, 20 aa, synthetic construct
  source 1..20: note = Seed: SATGFKQSSKALQRPVASDF
SATGWKQLSGALNRPVASDF

SEQ ID NO: 18859 - protein, 20 aa, synthetic construct
  source 1..20: note = Seed: SATGFKQSSKALQRPVASDF
SATGWKQLSGALPRPVASDF

SEQ ID NO: 18860 - protein, 20 aa, synthetic construct
  source 1..20: note = Seed: SATGFKQSSKALQRPVASDF
SATGWKQLSGALQRPVASDF

SEQ ID NO: 18861 - protein, 20 aa, synthetic construct
  source 1..20: note = Seed: SATGFKQSSKALQRPVASDF
SATGWKQLSGALSRPVASDF

SEQ ID NO: 18862 - protein, 20 aa, synthetic construct
  source 1..20: note = Seed: SATGFKQSSKALQRPVASDF
SATGWKQLSGALTRPVASDF

SEQ ID NO: 18863 - protein, 20 aa, synthetic construct
  source 1..20: note = Seed: SATGFKQSSKALQRPVASDF
SATGWKQLSGALVRPVASDF

SEQ ID NO: 18864 - protein, 20 aa, synthetic construct
  source 1..20: note = Seed: SATGFKQSSKALQRPVASDF
SATGWKQLSGALYRPVASDF

SEQ ID NO: 18865 - protein, 20 aa, synthetic construct
  source 1..20: note = Seed: SATGFKQSSKALQRPVASDF
SATGWKQLSHALARPVASDF

SEQ ID NO: 18866 - protein, 20 aa, synthetic construct
  source 1..20: note = Seed: SATGFKQSSKALQRPVASDF
SATGWKQLSHALIRPVASDF

SEQ ID NO: 18867 - protein, 20 aa, synthetic construct
  source 1..20: note = Seed: SATGFKQSSKALQRPVASDF
SATGWKQLSHALLRPVASDF

SEQ ID NO: 18868 - protein, 20 aa, synthetic construct
  source 1..20: note = Seed: SATGFKQSSKALQRPVASDF
SATGWKQLSHALMRPVASDF

SEQ ID NO: 18869 - protein, 20 aa, synthetic construct
  source 1..20: note = Seed: SATGFKQSSKALQRPVASDF
SATGWKQLSHALNRPVASDF

SEQ ID NO: 18870 - protein, 20 aa, synthetic construct
  source 1..20: note = Seed: SATGFKQSSKALQRPVASDF
SATGWKQLSHALSRPVASDF

SEQ ID NO: 18871 - protein, 20 aa, synthetic construct
  source 1..20: note = Seed: SATGFKQSSKALQRPVASDF
SATGWKQLSHALTRPVASDF

SEQ ID NO: 18872 - protein, 20 aa, synthetic construct
  source 1..20: note = Seed: SATGFKQSSKALQRPVASDF
SATGWKQLSHALVRPVASDF

SEQ ID NO: 18873 - protein, 20 aa, synthetic construct
  source 1..20: note = Seed: SATGFKQSSKALQRPVASDF
SATGWKQLSIALARPVASDF

SEQ ID NO: 18874 - protein, 20 aa, synthetic construct
  source 1..20: note = Seed: SATGFKQSSKALQRPVASDF
SATGWKQLSIALCRPVASDF

SEQ ID NO: 18875 - protein, 20 aa, synthetic construct
  source 1..20: note = Seed: SATGFKQSSKALQRPVASDF
SATGWKQLSIALDRPVASDF

SEQ ID NO: 18876 - protein, 20 aa, synthetic construct
  source 1..20: note = Seed: SATGFKQSSKALQRPVASDF
SATGWKQLSIALERPVASDF

SEQ ID NO: 18877 - protein, 20 aa, synthetic construct
  source 1..20: note = Seed: SATGFKQSSKALQRPVASDF
SATGWKQLSIALGRPVASDF

SEQ ID NO: 18878 - protein, 20 aa, synthetic construct
  source 1..20: note = Seed: SATGFKQSSKALQRPVASDF
SATGWKQLSIALHRPVASDF

SEQ ID NO: 18879 - protein, 20 aa, synthetic construct
  source 1..20: note = Seed: SATGFKQSSKALQRPVASDF
SATGWKQLSIALIRPVASDF

SEQ ID NO: 18880 - protein, 20 aa, synthetic construct
  source 1..20: note = Seed: SATGFKQSSKALQRPVASDF
SATGWKQLSIALKRPVASDF

SEQ ID NO: 18881 - protein, 20 aa, synthetic construct
  source 1..20: note = Seed: SATGFKQSSKALQRPVASDF
SATGWKQLSIALLRPVASDF

SEQ ID NO: 18882 - protein, 20 aa, synthetic construct
  source 1..20: note = Seed: SATGFKQSSKALQRPVASDF
SATGWKQLSIALNRPVASDF

SEQ ID NO: 18883 - protein, 20 aa, synthetic construct
  source 1..20: note = Seed: SATGFKQSSKALQRPVASDF
SATGWKQLSIALPRPVASDF

SEQ ID NO: 18884 - protein, 20 aa, synthetic construct
  source 1..20: note = Seed: SATGFKQSSKALQRPVASDF
SATGWKQLSIALQRPVASDF

SEQ ID NO: 18885 - protein, 20 aa, synthetic construct
  source 1..20: note = Seed: SATGFKQSSKALQRPVASDF
SATGWKQLSIALSRPVASDF

SEQ ID NO: 18886 - protein, 20 aa, synthetic construct
  source 1..20: note = Seed: SATGFKQSSKALQRPVASDF
SATGWKQLSIALTRPVASDF

SEQ ID NO: 18887 - protein, 20 aa, synthetic construct
  source 1..20: note = Seed: SATGFKQSSKALQRPVASDF
SATGWKQLSIALVRPVASDF

SEQ ID NO: 18888 - protein, 20 aa, synthetic construct
  source 1..20: note = Seed: SATGFKQSSKALQRPVASDF
SATGWKQLSIALYRPVASDF

SEQ ID NO: 18889 - protein, 20 aa, synthetic construct
  source 1..20: note = Seed: SATGFKQSSKALQRPVASDF
SATGWKQLSKALARPVASDF

SEQ ID NO: 18890 - protein, 20 aa, synthetic construct
  source 1..20: note = Seed: SATGFKQSSKALQRPVASDF
SATGWKQLSKALGRPVASDF

SEQ ID NO: 18891 - protein, 20 aa, synthetic construct
  source 1..20: note = Seed: SATGFKQSSKALQRPVASDF
SATGWKQLSKALHRPVASDF

SEQ ID NO: 18892 - protein, 20 aa, synthetic construct
  source 1..20: note = Seed: SATGFKQSSKALQRPVASDF
SATGWKQLSKALIRPVASDF

SEQ ID NO: 18893 - protein, 20 aa, synthetic construct
  source 1..20: note = Seed: SATGFKQSSKALQRPVASDF
SATGWKQLSKALKRPVASDF

SEQ ID NO: 18894 - protein, 20 aa, synthetic construct
  source 1..20: note = Seed: SATGFKQSSKALQRPVASDF
SATGWKQLSKALMRPVASDF

SEQ ID NO: 18895 - protein, 20 aa, synthetic construct
  source 1..20: note = Seed: SATGFKQSSKALQRPVASDF
SATGWKQLSKALNRPVASDF

SEQ ID NO: 18896 - protein, 20 aa, synthetic construct
  source 1..20: note = Seed: SATGFKQSSKALQRPVASDF
SATGWKQLSKALPRPVASDF

SEQ ID NO: 18897 - protein, 20 aa, synthetic construct
  source 1..20: note = Seed: SATGFKQSSKALQRPVASDF
SATGWKQLSKALQRPVASDF

SEQ ID NO: 18898 - protein, 20 aa, synthetic construct
  source 1..20: note = Seed: SATGFKQSSKALQRPVASDF
SATGWKQLSKALRRPVASDF

SEQ ID NO: 18899 - protein, 20 aa, synthetic construct
  source 1..20: note = Seed: SATGFKQSSKALQRPVASDF
SATGWKQLSKALSRPVASDF

SEQ ID NO: 18900 - protein, 20 aa, synthetic construct
  source 1..20: note = Seed: SATGFKQSSKALQRPVASDF
SATGWKQLSKALTRPVASDF

SEQ ID NO: 18901 - protein, 20 aa, synthetic construct
  source 1..20: note = Seed: SATGFKQSSKALQRPVASDF
SATGWKQLSKALVRPVASDF

SEQ ID NO: 18902 - protein, 20 aa, synthetic construct
  source 1..20: note = Seed: SATGFKQSSKALQRPVASDF
SATGWKQLSLALARPVASDF

SEQ ID NO: 18903 - protein, 20 aa, synthetic construct
  source 1..20: note = Seed: SATGFKQSSKALQRPVASDF
SATGWKQLSLALCRPVASDF

SEQ ID NO: 18904 - protein, 20 aa, synthetic construct
  source 1..20: note = Seed: SATGFKQSSKALQRPVASDF
SATGWKQLSLALGRPVASDF

SEQ ID NO: 18905 - protein, 20 aa, synthetic construct
  source 1..20: note = Seed: SATGFKQSSKALQRPVASDF
SATGWKQLSLALHRPVASDF

SEQ ID NO: 18906 - protein, 20 aa, synthetic construct
  source 1..20: note = Seed: SATGFKQSSKALQRPVASDF
SATGWKQLSLALIRPVASDF

SEQ ID NO: 18907 - protein, 20 aa, synthetic construct
  source 1..20: note = Seed: SATGFKQSSKALQRPVASDF
SATGWKQLSLALNRPVASDF

SEQ ID NO: 18908 - protein, 20 aa, synthetic construct
  source 1..20: note = Seed: SATGFKQSSKALQRPVASDF
SATGWKQLSLALQRPVASDF

SEQ ID NO: 18909 - protein, 20 aa, synthetic construct
  source 1..20: note = Seed: SATGFKQSSKALQRPVASDF
SATGWKQLSLALSRPVASDF

SEQ ID NO: 18910 - protein, 20 aa, synthetic construct
  source 1..20: note = Seed: SATGFKQSSKALQRPVASDF
SATGWKQLSLALTRPVASDF

SEQ ID NO: 18911 - protein, 20 aa, synthetic construct
  source 1..20: note = Seed: SATGFKQSSKALQRPVASDF
SATGWKQLSLALVRPVASDF

SEQ ID NO: 18912 - protein, 20 aa, synthetic construct
  source 1..20: note = Seed: SATGFKQSSKALQRPVASDF
SATGWKQLSLALYRPVASDF

SEQ ID NO: 18913 - protein, 20 aa, synthetic construct
  source 1..20: note = Seed: SATGFKQSSKALQRPVASDF
SATGWKQLSMALARPVASDF

SEQ ID NO: 18914 - protein, 20 aa, synthetic construct
  source 1..20: note = Seed: SATGFKQSSKALQRPVASDF
SATGWKQLSMALCRPVASDF

SEQ ID NO: 18915 - protein, 20 aa, synthetic construct
  source 1..20: note = Seed: SATGFKQSSKALQRPVASDF
SATGWKQLSMALGRPVASDF

SEQ ID NO: 18916 - protein, 20 aa, synthetic construct
  source 1..20: note = Seed: SATGFKQSSKALQRPVASDF
SATGWKQLSMALHRPVASDF

SEQ ID NO: 18917 - protein, 20 aa, synthetic construct
  source 1..20: note = Seed: SATGFKQSSKALQRPVASDF
SATGWKQLSMALIRPVASDF

SEQ ID NO: 18918 - protein, 20 aa, synthetic construct
  source 1..20: note = Seed: SATGFKQSSKALQRPVASDF
SATGWKQLSMALLRPVASDF

SEQ ID NO: 18919 - protein, 20 aa, synthetic construct
  source 1..20: note = Seed: SATGFKQSSKALQRPVASDF
SATGWKQLSMALMRPVASDF

SEQ ID NO: 18920 - protein, 20 aa, synthetic construct
  source 1..20: note = Seed: SATGFKQSSKALQRPVASDF
SATGWKQLSMALNRPVASDF

SEQ ID NO: 18921 - protein, 20 aa, synthetic construct
  source 1..20: note = Seed: SATGFKQSSKALQRPVASDF
SATGWKQLSMALQRPVASDF

SEQ ID NO: 18922 - protein, 20 aa, synthetic construct
  source 1..20: note = Seed: SATGFKQSSKALQRPVASDF
SATGWKQLSMALSRPVASDF

SEQ ID NO: 18923 - protein, 20 aa, synthetic construct
  source 1..20: note = Seed: SATGFKQSSKALQRPVASDF
SATGWKQLSMALVRPVASDF

SEQ ID NO: 18924 - protein, 20 aa, synthetic construct
  source 1..20: note = Seed: SATGFKQSSKALQRPVASDF
SATGWKQLSMALYRPVASDF

SEQ ID NO: 18925 - protein, 20 aa, synthetic construct
  source 1..20: note = Seed: SATGFKQSSKALQRPVASDF
SATGWKQLSNALARPVASDF

SEQ ID NO: 18926 - protein, 20 aa, synthetic construct
  source 1..20: note = Seed: SATGFKQSSKALQRPVASDF
SATGWKQLSNALCRPVASDF

SEQ ID NO: 18927 - protein, 20 aa, synthetic construct
  source 1..20: note = Seed: SATGFKQSSKALQRPVASDF
SATGWKQLSNALGRPVASDF

SEQ ID NO: 18928 - protein, 20 aa, synthetic construct
  source 1..20: note = Seed: SATGFKQSSKALQRPVASDF
SATGWKQLSNALIRPVASDF

SEQ ID NO: 18929 - protein, 20 aa, synthetic construct
  source 1..20: note = Seed: SATGFKQSSKALQRPVASDF
SATGWKQLSNALLRPVASDF

SEQ ID NO: 18930 - protein, 20 aa, synthetic construct
  source 1..20: note = Seed: SATGFKQSSKALQRPVASDF
SATGWKQLSNALMRPVASDF

SEQ ID NO: 18931 - protein, 20 aa, synthetic construct
  source 1..20: note = Seed: SATGFKQSSKALQRPVASDF
SATGWKQLSNALNRPVASDF

SEQ ID NO: 18932 - protein, 20 aa, synthetic construct
  source 1..20: note = Seed: SATGFKQSSKALQRPVASDF
SATGWKQLSNALPRPVASDF

SEQ ID NO: 18933 - protein, 20 aa, synthetic construct
  source 1..20: note = Seed: SATGFKQSSKALQRPVASDF
SATGWKQLSNALSRPVASDF

SEQ ID NO: 18934 - protein, 20 aa, synthetic construct
  source 1..20: note = Seed: SATGFKQSSKALQRPVASDF
SATGWKQLSNALTRPVASDF

SEQ ID NO: 18935 - protein, 20 aa, synthetic construct
  source 1..20: note = Seed: SATGFKQSSKALQRPVASDF
SATGWKQLSNALVRPVASDF

SEQ ID NO: 18936 - protein, 20 aa, synthetic construct
  source 1..20: note = Seed: SATGFKQSSKALQRPVASDF
SATGWKQLSPALARPVASDF

SEQ ID NO: 18937 - protein, 20 aa, synthetic construct
  source 1..20: note = Seed: SATGFKQSSKALQRPVASDF
SATGWKQLSPALCRPVASDF

SEQ ID NO: 18938 - protein, 20 aa, synthetic construct
  source 1..20: note = Seed: SATGFKQSSKALQRPVASDF
SATGWKQLSPALDRPVASDF

SEQ ID NO: 18939 - protein, 20 aa, synthetic construct
  source 1..20: note = Seed: SATGFKQSSKALQRPVASDF
SATGWKQLSPALERPVASDF

SEQ ID NO: 18940 - protein, 20 aa, synthetic construct
  source 1..20: note = Seed: SATGFKQSSKALQRPVASDF
SATGWKQLSPALFRPVASDF

SEQ ID NO: 18941 - protein, 20 aa, synthetic construct
  source 1..20: note = Seed: SATGFKQSSKALQRPVASDF
SATGWKQLSPALGRPVASDF

SEQ ID NO: 18942 - protein, 20 aa, synthetic construct
  source 1..20: note = Seed: SATGFKQSSKALQRPVASDF
SATGWKQLSPALHRPVASDF

SEQ ID NO: 18943 - protein, 20 aa, synthetic construct
  source 1..20: note = Seed: SATGFKQSSKALQRPVASDF
SATGWKQLSPALIRPVASDF

SEQ ID NO: 18944 - protein, 20 aa, synthetic construct
  source 1..20: note = Seed: SATGFKQSSKALQRPVASDF
SATGWKQLSPALLRPVASDF

SEQ ID NO: 18945 - protein, 20 aa, synthetic construct
  source 1..20: note = Seed: SATGFKQSSKALQRPVASDF
SATGWKQLSPALMRPVASDF

SEQ ID NO: 18946 - protein, 20 aa, synthetic construct
  source 1..20: note = Seed: SATGFKQSSKALQRPVASDF
SATGWKQLSPALNRPVASDF

SEQ ID NO: 18947 - protein, 20 aa, synthetic construct
  source 1..20: note = Seed: SATGFKQSSKALQRPVASDF
SATGWKQLSPALPRPVASDF

SEQ ID NO: 18948 - protein, 20 aa, synthetic construct
  source 1..20: note = Seed: SATGFKQSSKALQRPVASDF
SATGWKQLSPALQRPVASDF

SEQ ID NO: 18949 - protein, 20 aa, synthetic construct
  source 1..20: note = Seed: SATGFKQSSKALQRPVASDF
SATGWKQLSPALSRPVASDF

SEQ ID NO: 18950 - protein, 20 aa, synthetic construct
  source 1..20: note = Seed: SATGFKQSSKALQRPVASDF
SATGWKQLSPALTRPVASDF

SEQ ID NO: 18951 - protein, 20 aa, synthetic construct
  source 1..20: note = Seed: SATGFKQSSKALQRPVASDF
SATGWKQLSPALVRPVASDF

SEQ ID NO: 18952 - protein, 20 aa, synthetic construct
  source 1..20: note = Seed: SATGFKQSSKALQRPVASDF
SATGWKQLSPALYRPVASDF

SEQ ID NO: 18953 - protein, 20 aa, synthetic construct
  source 1..20: note = Seed: SATGFKQSSKALQRPVASDF
SATGWKQLSQALARPVASDF

SEQ ID NO: 18954 - protein, 20 aa, synthetic construct
  source 1..20: note = Seed: SATGFKQSSKALQRPVASDF
SATGWKQLSQALIRPVASDF

SEQ ID NO: 18955 - protein, 20 aa, synthetic construct
  source 1..20: note = Seed: SATGFKQSSKALQRPVASDF
SATGWKQLSQALLRPVASDF

SEQ ID NO: 18956 - protein, 20 aa, synthetic construct
  source 1..20: note = Seed: SATGFKQSSKALQRPVASDF
SATGWKQLSQALMRPVASDF

SEQ ID NO: 18957 - protein, 20 aa, synthetic construct
  source 1..20: note = Seed: SATGFKQSSKALQRPVASDF
SATGWKQLSQALSRPVASDF

SEQ ID NO: 18958 - protein, 20 aa, synthetic construct
  source 1..20: note = Seed: SATGFKQSSKALQRPVASDF
SATGWKQLSQALTRPVASDF

SEQ ID NO: 18959 - protein, 20 aa, synthetic construct
  source 1..20: note = Seed: SATGFKQSSKALQRPVASDF
SATGWKQLSQALVRPVASDF

SEQ ID NO: 18960 - protein, 20 aa, synthetic construct
  source 1..20: note = Seed: SATGFKQSSKALQRPVASDF
SATGWKQLSRALARPVASDF

SEQ ID NO: 18961 - protein, 20 aa, synthetic construct
  source 1..20: note = Seed: SATGFKQSSKALQRPVASDF
SATGWKQLSRALGRPVASDF

SEQ ID NO: 18962 - protein, 20 aa, synthetic construct
  source 1..20: note = Seed: SATGFKQSSKALQRPVASDF
SATGWKQLSRALHRPVASDF

SEQ ID NO: 18963 - protein, 20 aa, synthetic construct
  source 1..20: note = Seed: SATGFKQSSKALQRPVASDF
SATGWKQLSRALIRPVASDF

SEQ ID NO: 18964 - protein, 20 aa, synthetic construct
  source 1..20: note = Seed: SATGFKQSSKALQRPVASDF
SATGWKQLSRALKRPVASDF

SEQ ID NO: 18965 - protein, 20 aa, synthetic construct
  source 1..20: note = Seed: SATGFKQSSKALQRPVASDF
SATGWKQLSRALLRPVASDF

SEQ ID NO: 18966 - protein, 20 aa, synthetic construct
  source 1..20: note = Seed: SATGFKQSSKALQRPVASDF
SATGWKQLSRALMRPVASDF

SEQ ID NO: 18967 - protein, 20 aa, synthetic construct
  source 1..20: note = Seed: SATGFKQSSKALQRPVASDF
SATGWKQLSRALNRPVASDF

SEQ ID NO: 18968 - protein, 20 aa, synthetic construct
  source 1..20: note = Seed: SATGFKQSSKALQRPVASDF
SATGWKQLSRALPRPVASDF

SEQ ID NO: 18969 - protein, 20 aa, synthetic construct
  source 1..20: note = Seed: SATGFKQSSKALQRPVASDF
SATGWKQLSRALQRPVASDF

SEQ ID NO: 18970 - protein, 20 aa, synthetic construct
  source 1..20: note = Seed: SATGFKQSSKALQRPVASDF
SATGWKQLSRALRRPVASDF

SEQ ID NO: 18971 - protein, 20 aa, synthetic construct
  source 1..20: note = Seed: SATGFKQSSKALQRPVASDF
SATGWKQLSRALSRPVASDF

SEQ ID NO: 18972 - protein, 20 aa, synthetic construct
  source 1..20: note = Seed: SATGFKQSSKALQRPVASDF
SATGWKQLSRALTRPVASDF

SEQ ID NO: 18973 - protein, 20 aa, synthetic construct
  source 1..20: note = Seed: SATGFKQSSKALQRPVASDF
SATGWKQLSRALVRPVASDF

SEQ ID NO: 18974 - protein, 20 aa, synthetic construct
  source 1..20: note = Seed: SATGFKQSSKALQRPVASDF
SATGWKQLSSALARPVASDF

SEQ ID NO: 18975 - protein, 20 aa, synthetic construct
  source 1..20: note = Seed: SATGFKQSSKALQRPVASDF
SATGWKQLSSALCRPVASDF

SEQ ID NO: 18976 - protein, 20 aa, synthetic construct
  source 1..20: note = Seed: SATGFKQSSKALQRPVASDF
SATGWKQLSSALDRPVASDF

SEQ ID NO: 18977 - protein, 20 aa, synthetic construct
  source 1..20: note = Seed: SATGFKQSSKALQRPVASDF
SATGWKQLSSALERPVASDF

SEQ ID NO: 18978 - protein, 20 aa, synthetic construct
  source 1..20: note = Seed: SATGFKQSSKALQRPVASDF
SATGWKQLSSALFRPVASDF

SEQ ID NO: 18979 - protein, 20 aa, synthetic construct
  source 1..20: note = Seed: SATGFKQSSKALQRPVASDF
SATGWKQLSSALGRPVASDF

SEQ ID NO: 18980 - protein, 20 aa, synthetic construct
  source 1..20: note = Seed: SATGFKQSSKALQRPVASDF
SATGWKQLSSALHRPVASDF

SEQ ID NO: 18981 - protein, 20 aa, synthetic construct
  source 1..20: note = Seed: SATGFKQSSKALQRPVASDF
SATGWKQLSSALIRPVASDF

SEQ ID NO: 18982 - protein, 20 aa, synthetic construct
  source 1..20: note = Seed: SATGFKQSSKALQRPVASDF
SATGWKQLSSALLRPVASDF

SEQ ID NO: 18983 - protein, 20 aa, synthetic construct
  source 1..20: note = Seed: SATGFKQSSKALQRPVASDF
SATGWKQLSSALMRPVASDF

SEQ ID NO: 18984 - protein, 20 aa, synthetic construct
  source 1..20: note = Seed: SATGFKQSSKALQRPVASDF
SATGWKQLSSALNRPVASDF

SEQ ID NO: 18985 - protein, 20 aa, synthetic construct
  source 1..20: note = Seed: SATGFKQSSKALQRPVASDF
SATGWKQLSSALPRPVASDF

SEQ ID NO: 18986 - protein, 20 aa, synthetic construct
  source 1..20: note = Seed: SATGFKQSSKALQRPVASDF
SATGWKQLSSALQRPVASDF

SEQ ID NO: 18987 - protein, 20 aa, synthetic construct
  source 1..20: note = Seed: SATGFKQSSKALQRPVASDF
SATGWKQLSSALRRPVASDF

SEQ ID NO: 18988 - protein, 20 aa, synthetic construct
  source 1..20: note = Seed: SATGFKQSSKALQRPVASDF
SATGWKQLSSALSRPVASDF

SEQ ID NO: 18989 - protein, 20 aa, synthetic construct
  source 1..20: note = Seed: SATGFKQSSKALQRPVASDF
SATGWKQLSSALTRPVASDF

SEQ ID NO: 18990 - protein, 20 aa, synthetic construct
  source 1..20: note = Seed: SATGFKQSSKALQRPVASDF
SATGWKQLSSALVRPVASDF

SEQ ID NO: 18991 - protein, 20 aa, synthetic construct
  source 1..20: note = Seed: SATGFKQSSKALQRPVASDF
SATGWKQLSSALYRPVASDF

SEQ ID NO: 18992 - protein, 20 aa, synthetic construct
  source 1..20: note = Seed: SATGFKQSSKALQRPVASDF
SATGWKQLSTALARPVASDF

SEQ ID NO: 18993 - protein, 20 aa, synthetic construct
  source 1..20: note = Seed: SATGFKQSSKALQRPVASDF
SATGWKQLSTALCRPVASDF

SEQ ID NO: 18994 - protein, 20 aa, synthetic construct
  source 1..20: note = Seed: SATGFKQSSKALQRPVASDF
SATGWKQLSTALDRPVASDF

SEQ ID NO: 18995 - protein, 20 aa, synthetic construct
  source 1..20: note = Seed: SATGFKQSSKALQRPVASDF
SATGWKQLSTALERPVASDF

SEQ ID NO: 18996 - protein, 20 aa, synthetic construct
  source 1..20: note = Seed: SATGFKQSSKALQRPVASDF
SATGWKQLSTALFRPVASDF

SEQ ID NO: 18997 - protein, 20 aa, synthetic construct
  source 1..20: note = Seed: SATGFKQSSKALQRPVASDF
SATGWKQLSTALGRPVASDF

SEQ ID NO: 18998 - protein, 20 aa, synthetic construct
  source 1..20: note = Seed: SATGFKQSSKALQRPVASDF
SATGWKQLSTALHRPVASDF

SEQ ID NO: 18999 - protein, 20 aa, synthetic construct
  source 1..20: note = Seed: SATGFKQSSKALQRPVASDF
SATGWKQLSTALIRPVASDF

SEQ ID NO: 19000 - protein, 20 aa, synthetic construct
  source 1..20: note = Seed: SATGFKQSSKALQRPVASDF
SATGWKQLSTALLRPVASDF

SEQ ID NO: 19001 - protein, 20 aa, synthetic construct
  source 1..20: note = Seed: SATGFKQSSKALQRPVASDF
SATGWKQLSTALMRPVASDF

SEQ ID NO: 19002 - protein, 20 aa, synthetic construct
  source 1..20: note = Seed: SATGFKQSSKALQRPVASDF
SATGWKQLSTALNRPVASDF

SEQ ID NO: 19003 - protein, 20 aa, synthetic construct
  source 1..20: note = Seed: SATGFKQSSKALQRPVASDF
SATGWKQLSTALPRPVASDF

SEQ ID NO: 19004 - protein, 20 aa, synthetic construct
  source 1..20: note = Seed: SATGFKQSSKALQRPVASDF
SATGWKQLSTALQRPVASDF

SEQ ID NO: 19005 - protein, 20 aa, synthetic construct
  source 1..20: note = Seed: SATGFKQSSKALQRPVASDF
SATGWKQLSTALSRPVASDF

SEQ ID NO: 19006 - protein, 20 aa, synthetic construct
  source 1..20: note = Seed: SATGFKQSSKALQRPVASDF
SATGWKQLSTALTRPVASDF

SEQ ID NO: 19007 - protein, 20 aa, synthetic construct
  source 1..20: note = Seed: SATGFKQSSKALQRPVASDF
SATGWKQLSTALVRPVASDF

SEQ ID NO: 19008 - protein, 20 aa, synthetic construct
  source 1..20: note = Seed: SATGFKQSSKALQRPVASDF
SATGWKQLSVALARPVASDF

SEQ ID NO: 19009 - protein, 20 aa, synthetic construct
  source 1..20: note = Seed: SATGFKQSSKALQRPVASDF
SATGWKQLSVALCRPVASDF

SEQ ID NO: 19010 - protein, 20 aa, synthetic construct
  source 1..20: note = Seed: SATGFKQSSKALQRPVASDF
SATGWKQLSVALDRPVASDF

SEQ ID NO: 19011 - protein, 20 aa, synthetic construct
  source 1..20: note = Seed: SATGFKQSSKALQRPVASDF
SATGWKQLSVALERPVASDF

SEQ ID NO: 19012 - protein, 20 aa, synthetic construct
  source 1..20: note = Seed: SATGFKQSSKALQRPVASDF
SATGWKQLSVALFRPVASDF

SEQ ID NO: 19013 - protein, 20 aa, synthetic construct
  source 1..20: note = Seed: SATGFKQSSKALQRPVASDF
SATGWKQLSVALGRPVASDF

SEQ ID NO: 19014 - protein, 20 aa, synthetic construct
  source 1..20: note = Seed: SATGFKQSSKALQRPVASDF
SATGWKQLSVALHRPVASDF

SEQ ID NO: 19015 - protein, 20 aa, synthetic construct
  source 1..20: note = Seed: SATGFKQSSKALQRPVASDF
SATGWKQLSVALIRPVASDF

SEQ ID NO: 19016 - protein, 20 aa, synthetic construct
  source 1..20: note = Seed: SATGFKQSSKALQRPVASDF
SATGWKQLSVALLRPVASDF

SEQ ID NO: 19017 - protein, 20 aa, synthetic construct
  source 1..20: note = Seed: SATGFKQSSKALQRPVASDF
SATGWKQLSVALMRPVASDF

SEQ ID NO: 19018 - protein, 20 aa, synthetic construct
  source 1..20: note = Seed: SATGFKQSSKALQRPVASDF
SATGWKQLSVALNRPVASDF

SEQ ID NO: 19019 - protein, 20 aa, synthetic construct
  source 1..20: note = Seed: SATGFKQSSKALQRPVASDF
SATGWKQLSVALPRPVASDF

SEQ ID NO: 19020 - protein, 20 aa, synthetic construct
  source 1..20: note = Seed: SATGFKQSSKALQRPVASDF
SATGWKQLSVALQRPVASDF

SEQ ID NO: 19021 - protein, 20 aa, synthetic construct
  source 1..20: note = Seed: SATGFKQSSKALQRPVASDF
SATGWKQLSVALSRPVASDF

SEQ ID NO: 19022 - protein, 20 aa, synthetic construct
  source 1..20: note = Seed: SATGFKQSSKALQRPVASDF
SATGWKQLSVALTRPVASDF

SEQ ID NO: 19023 - protein, 20 aa, synthetic construct
  source 1..20: note = Seed: SATGFKQSSKALQRPVASDF
SATGWKQLSVALVRPVASDF

SEQ ID NO: 19024 - protein, 20 aa, synthetic construct
  source 1..20: note = Seed: SATGFKQSSKALQRPVASDF
SATGWKQLSVALYRPVASDF

SEQ ID NO: 19025 - protein, 20 aa, synthetic construct
  source 1..20: note = Seed: SATGFKQSSKALQRPVASDF
SATGWKQMSAALARPVASDF

SEQ ID NO: 19026 - protein, 20 aa, synthetic construct
  source 1..20: note = Seed: SATGFKQSSKALQRPVASDF
SATGWKQMSAALCRPVASDF

SEQ ID NO: 19027 - protein, 20 aa, synthetic construct
  source 1..20: note = Seed: SATGFKQSSKALQRPVASDF
SATGWKQMSAALDRPVASDF

SEQ ID NO: 19028 - protein, 20 aa, synthetic construct
  source 1..20: note = Seed: SATGFKQSSKALQRPVASDF
SATGWKQMSAALERPVASDF

SEQ ID NO: 19029 - protein, 20 aa, synthetic construct
  source 1..20: note = Seed: SATGFKQSSKALQRPVASDF
SATGWKQMSAALFRPVASDF

SEQ ID NO: 19030 - protein, 20 aa, synthetic construct
  source 1..20: note = Seed: SATGFKQSSKALQRPVASDF
SATGWKQMSAALGRPVASDF

SEQ ID NO: 19031 - protein, 20 aa, synthetic construct
  source 1..20: note = Seed: SATGFKQSSKALQRPVASDF
SATGWKQMSAALHRPVASDF

SEQ ID NO: 19032 - protein, 20 aa, synthetic construct
  source 1..20: note = Seed: SATGFKQSSKALQRPVASDF
SATGWKQMSAALIRPVASDF

SEQ ID NO: 19033 - protein, 20 aa, synthetic construct
  source 1..20: note = Seed: SATGFKQSSKALQRPVASDF
SATGWKQMSAALKRPVASDF

SEQ ID NO: 19034 - protein, 20 aa, synthetic construct
  source 1..20: note = Seed: SATGFKQSSKALQRPVASDF
SATGWKQMSAALLRPVASDF

SEQ ID NO: 19035 - protein, 20 aa, synthetic construct
  source 1..20: note = Seed: SATGFKQSSKALQRPVASDF
SATGWKQMSAALMRPVASDF

SEQ ID NO: 19036 - protein, 20 aa, synthetic construct
  source 1..20: note = Seed: SATGFKQSSKALQRPVASDF
SATGWKQMSAALNRPVASDF

SEQ ID NO: 19037 - protein, 20 aa, synthetic construct
  source 1..20: note = Seed: SATGFKQSSKALQRPVASDF
SATGWKQMSAALPRPVASDF

SEQ ID NO: 19038 - protein, 20 aa, synthetic construct
  source 1..20: note = Seed: SATGFKQSSKALQRPVASDF
SATGWKQMSAALQRPVASDF

SEQ ID NO: 19039 - protein, 20 aa, synthetic construct
  source 1..20: note = Seed: SATGFKQSSKALQRPVASDF
SATGWKQMSAALRRPVASDF

SEQ ID NO: 19040 - protein, 20 aa, synthetic construct
  source 1..20: note = Seed: SATGFKQSSKALQRPVASDF
SATGWKQMSAALSRPVASDF

SEQ ID NO: 19041 - protein, 20 aa, synthetic construct
  source 1..20: note = Seed: SATGFKQSSKALQRPVASDF
SATGWKQMSAALTRPVASDF

SEQ ID NO: 19042 - protein, 20 aa, synthetic construct
  source 1..20: note = Seed: SATGFKQSSKALQRPVASDF
SATGWKQMSAALVRPVASDF

SEQ ID NO: 19043 - protein, 20 aa, synthetic construct
  source 1..20: note = Seed: SATGFKQSSKALQRPVASDF
SATGWKQMSAALYRPVASDF

SEQ ID NO: 19044 - protein, 20 aa, synthetic construct
  source 1..20: note = Seed: SATGFKQSSKALQRPVASDF
SATGWKQMSCALARPVASDF

SEQ ID NO: 19045 - protein, 20 aa, synthetic construct
  source 1..20: note = Seed: SATGFKQSSKALQRPVASDF
SATGWKQMSCALSRPVASDF

SEQ ID NO: 19046 - protein, 20 aa, synthetic construct
  source 1..20: note = Seed: SATGFKQSSKALQRPVASDF
SATGWKQMSCALVRPVASDF

SEQ ID NO: 19047 - protein, 20 aa, synthetic construct
  source 1..20: note = Seed: SATGFKQSSKALQRPVASDF
SATGWKQMSDALVRPVASDF

SEQ ID NO: 19048 - protein, 20 aa, synthetic construct
  source 1..20: note = Seed: SATGFKQSSKALQRPVASDF
SATGWKQMSEALARPVASDF

SEQ ID NO: 19049 - protein, 20 aa, synthetic construct
  source 1..20: note = Seed: SATGFKQSSKALQRPVASDF
SATGWKQMSEALVRPVASDF

SEQ ID NO: 19050 - protein, 20 aa, synthetic construct
  source 1..20: note = Seed: SATGFKQSSKALQRPVASDF
SATGWKQMSFALMRPVASDF

SEQ ID NO: 19051 - protein, 20 aa, synthetic construct
  source 1..20: note = Seed: SATGFKQSSKALQRPVASDF
SATGWKQMSFALVRPVASDF

SEQ ID NO: 19052 - protein, 20 aa, synthetic construct
  source 1..20: note = Seed: SATGFKQSSKALQRPVASDF
SATGWKQMSGALARPVASDF

SEQ ID NO: 19053 - protein, 20 aa, synthetic construct
  source 1..20: note = Seed: SATGFKQSSKALQRPVASDF
SATGWKQMSGALCRPVASDF

SEQ ID NO: 19054 - protein, 20 aa, synthetic construct
  source 1..20: note = Seed: SATGFKQSSKALQRPVASDF
SATGWKQMSGALFRPVASDF

SEQ ID NO: 19055 - protein, 20 aa, synthetic construct
  source 1..20: note = Seed: SATGFKQSSKALQRPVASDF
SATGWKQMSGALGRPVASDF

SEQ ID NO: 19056 - protein, 20 aa, synthetic construct
  source 1..20: note = Seed: SATGFKQSSKALQRPVASDF
SATGWKQMSGALHRPVASDF

SEQ ID NO: 19057 - protein, 20 aa, synthetic construct
  source 1..20: note = Seed: SATGFKQSSKALQRPVASDF
SATGWKQMSGALIRPVASDF

SEQ ID NO: 19058 - protein, 20 aa, synthetic construct
  source 1..20: note = Seed: SATGFKQSSKALQRPVASDF
SATGWKQMSGALLRPVASDF

SEQ ID NO: 19059 - protein, 20 aa, synthetic construct
  source 1..20: note = Seed: SATGFKQSSKALQRPVASDF
SATGWKQMSGALMRPVASDF

SEQ ID NO: 19060 - protein, 20 aa, synthetic construct
  source 1..20: note = Seed: SATGFKQSSKALQRPVASDF
SATGWKQMSGALNRPVASDF

SEQ ID NO: 19061 - protein, 20 aa, synthetic construct
  source 1..20: note = Seed: SATGFKQSSKALQRPVASDF
SATGWKQMSGALPRPVASDF

SEQ ID NO: 19062 - protein, 20 aa, synthetic construct
  source 1..20: note = Seed: SATGFKQSSKALQRPVASDF
SATGWKQMSGALQRPVASDF

SEQ ID NO: 19063 - protein, 20 aa, synthetic construct
  source 1..20: note = Seed: SATGFKQSSKALQRPVASDF
SATGWKQMSGALSRPVASDF

SEQ ID NO: 19064 - protein, 20 aa, synthetic construct
  source 1..20: note = Seed: SATGFKQSSKALQRPVASDF
SATGWKQMSGALTRPVASDF

SEQ ID NO: 19065 - protein, 20 aa, synthetic construct
  source 1..20: note = Seed: SATGFKQSSKALQRPVASDF
SATGWKQMSGALVRPVASDF

SEQ ID NO: 19066 - protein, 20 aa, synthetic construct
  source 1..20: note = Seed: SATGFKQSSKALQRPVASDF
SATGWKQMSGALYRPVASDF

SEQ ID NO: 19067 - protein, 20 aa, synthetic construct
  source 1..20: note = Seed: SATGFKQSSKALQRPVASDF
SATGWKQMSHALARPVASDF

SEQ ID NO: 19068 - protein, 20 aa, synthetic construct
  source 1..20: note = Seed: SATGFKQSSKALQRPVASDF
SATGWKQMSHALGRPVASDF

SEQ ID NO: 19069 - protein, 20 aa, synthetic construct
  source 1..20: note = Seed: SATGFKQSSKALQRPVASDF
SATGWKQMSHALIRPVASDF

SEQ ID NO: 19070 - protein, 20 aa, synthetic construct
  source 1..20: note = Seed: SATGFKQSSKALQRPVASDF
SATGWKQMSHALLRPVASDF

SEQ ID NO: 19071 - protein, 20 aa, synthetic construct
  source 1..20: note = Seed: SATGFKQSSKALQRPVASDF
SATGWKQMSHALMRPVASDF

SEQ ID NO: 19072 - protein, 20 aa, synthetic construct
  source 1..20: note = Seed: SATGFKQSSKALQRPVASDF
SATGWKQMSHALNRPVASDF

SEQ ID NO: 19073 - protein, 20 aa, synthetic construct
  source 1..20: note = Seed: SATGFKQSSKALQRPVASDF
SATGWKQMSHALRRPVASDF

SEQ ID NO: 19074 - protein, 20 aa, synthetic construct
  source 1..20: note = Seed: SATGFKQSSKALQRPVASDF
SATGWKQMSHALSRPVASDF

SEQ ID NO: 19075 - protein, 20 aa, synthetic construct
  source 1..20: note = Seed: SATGFKQSSKALQRPVASDF
SATGWKQMSHALTRPVASDF

SEQ ID NO: 19076 - protein, 20 aa, synthetic construct
  source 1..20: note = Seed: SATGFKQSSKALQRPVASDF
SATGWKQMSHALVRPVASDF

SEQ ID NO: 19077 - protein, 20 aa, synthetic construct
  source 1..20: note = Seed: SATGFKQSSKALQRPVASDF
SATGWKQMSIALARPVASDF

SEQ ID NO: 19078 - protein, 20 aa, synthetic construct
  source 1..20: note = Seed: SATGFKQSSKALQRPVASDF
SATGWKQMSIALCRPVASDF

SEQ ID NO: 19079 - protein, 20 aa, synthetic construct
  source 1..20: note = Seed: SATGFKQSSKALQRPVASDF
SATGWKQMSIALDRPVASDF

SEQ ID NO: 19080 - protein, 20 aa, synthetic construct
  source 1..20: note = Seed: SATGFKQSSKALQRPVASDF
SATGWKQMSIALERPVASDF

SEQ ID NO: 19081 - protein, 20 aa, synthetic construct
  source 1..20: note = Seed: SATGFKQSSKALQRPVASDF
SATGWKQMSIALGRPVASDF

SEQ ID NO: 19082 - protein, 20 aa, synthetic construct
  source 1..20: note = Seed: SATGFKQSSKALQRPVASDF
SATGWKQMSIALHRPVASDF

SEQ ID NO: 19083 - protein, 20 aa, synthetic construct
  source 1..20: note = Seed: SATGFKQSSKALQRPVASDF
SATGWKQMSIALIRPVASDF

SEQ ID NO: 19084 - protein, 20 aa, synthetic construct
  source 1..20: note = Seed: SATGFKQSSKALQRPVASDF
SATGWKQMSIALKRPVASDF

SEQ ID NO: 19085 - protein, 20 aa, synthetic construct
  source 1..20: note = Seed: SATGFKQSSKALQRPVASDF
SATGWKQMSIALNRPVASDF

SEQ ID NO: 19086 - protein, 20 aa, synthetic construct
  source 1..20: note = Seed: SATGFKQSSKALQRPVASDF
SATGWKQMSIALPRPVASDF

SEQ ID NO: 19087 - protein, 20 aa, synthetic construct
  source 1..20: note = Seed: SATGFKQSSKALQRPVASDF
SATGWKQMSIALQRPVASDF

SEQ ID NO: 19088 - protein, 20 aa, synthetic construct
  source 1..20: note = Seed: SATGFKQSSKALQRPVASDF
SATGWKQMSIALRRPVASDF

SEQ ID NO: 19089 - protein, 20 aa, synthetic construct
  source 1..20: note = Seed: SATGFKQSSKALQRPVASDF
SATGWKQMSIALSRPVASDF

SEQ ID NO: 19090 - protein, 20 aa, synthetic construct
  source 1..20: note = Seed: SATGFKQSSKALQRPVASDF
SATGWKQMSIALTRPVASDF

SEQ ID NO: 19091 - protein, 20 aa, synthetic construct
  source 1..20: note = Seed: SATGFKQSSKALQRPVASDF
SATGWKQMSIALVRPVASDF

SEQ ID NO: 19092 - protein, 20 aa, synthetic construct
  source 1..20: note = Seed: SATGFKQSSKALQRPVASDF
SATGWKQMSIALYRPVASDF

SEQ ID NO: 19093 - protein, 20 aa, synthetic construct
  source 1..20: note = Seed: SATGFKQSSKALQRPVASDF
SATGWKQMSKALARPVASDF

SEQ ID NO: 19094 - protein, 20 aa, synthetic construct
  source 1..20: note = Seed: SATGFKQSSKALQRPVASDF
SATGWKQMSKALGRPVASDF

SEQ ID NO: 19095 - protein, 20 aa, synthetic construct
  source 1..20: note = Seed: SATGFKQSSKALQRPVASDF
SATGWKQMSKALHRPVASDF

SEQ ID NO: 19096 - protein, 20 aa, synthetic construct
  source 1..20: note = Seed: SATGFKQSSKALQRPVASDF
SATGWKQMSKALIRPVASDF

SEQ ID NO: 19097 - protein, 20 aa, synthetic construct
  source 1..20: note = Seed: SATGFKQSSKALQRPVASDF
SATGWKQMSKALKRPVASDF

SEQ ID NO: 19098 - protein, 20 aa, synthetic construct
  source 1..20: note = Seed: SATGFKQSSKALQRPVASDF
SATGWKQMSKALLRPVASDF

SEQ ID NO: 19099 - protein, 20 aa, synthetic construct
  source 1..20: note = Seed: SATGFKQSSKALQRPVASDF
SATGWKQMSKALMRPVASDF

SEQ ID NO: 19100 - protein, 20 aa, synthetic construct
  source 1..20: note = Seed: SATGFKQSSKALQRPVASDF
SATGWKQMSKALNRPVASDF

SEQ ID NO: 19101 - protein, 20 aa, synthetic construct
  source 1..20: note = Seed: SATGFKQSSKALQRPVASDF
SATGWKQMSKALPRPVASDF

SEQ ID NO: 19102 - protein, 20 aa, synthetic construct
  source 1..20: note = Seed: SATGFKQSSKALQRPVASDF
SATGWKQMSKALQRPVASDF

SEQ ID NO: 19103 - protein, 20 aa, synthetic construct
  source 1..20: note = Seed: SATGFKQSSKALQRPVASDF
SATGWKQMSKALRRPVASDF

SEQ ID NO: 19104 - protein, 20 aa, synthetic construct
  source 1..20: note = Seed: SATGFKQSSKALQRPVASDF
SATGWKQMSKALSRPVASDF

SEQ ID NO: 19105 - protein, 20 aa, synthetic construct
  source 1..20: note = Seed: SATGFKQSSKALQRPVASDF
SATGWKQMSKALTRPVASDF

SEQ ID NO: 19106 - protein, 20 aa, synthetic construct
  source 1..20: note = Seed: SATGFKQSSKALQRPVASDF
SATGWKQMSKALVRPVASDF

SEQ ID NO: 19107 - protein, 20 aa, synthetic construct
  source 1..20: note = Seed: SATGFKQSSKALQRPVASDF
SATGWKQMSLALARPVASDF

SEQ ID NO: 19108 - protein, 20 aa, synthetic construct
  source 1..20: note = Seed: SATGFKQSSKALQRPVASDF
SATGWKQMSLALCRPVASDF

SEQ ID NO: 19109 - protein, 20 aa, synthetic construct
  source 1..20: note = Seed: SATGFKQSSKALQRPVASDF
SATGWKQMSLALGRPVASDF

SEQ ID NO: 19110 - protein, 20 aa, synthetic construct
  source 1..20: note = Seed: SATGFKQSSKALQRPVASDF
SATGWKQMSLALHRPVASDF

SEQ ID NO: 19111 - protein, 20 aa, synthetic construct
  source 1..20: note = Seed: SATGFKQSSKALQRPVASDF
SATGWKQMSLALIRPVASDF

SEQ ID NO: 19112 - protein, 20 aa, synthetic construct
  source 1..20: note = Seed: SATGFKQSSKALQRPVASDF
SATGWKQMSLALNRPVASDF

SEQ ID NO: 19113 - protein, 20 aa, synthetic construct
  source 1..20: note = Seed: SATGFKQSSKALQRPVASDF
SATGWKQMSLALQRPVASDF

SEQ ID NO: 19114 - protein, 20 aa, synthetic construct
  source 1..20: note = Seed: SATGFKQSSKALQRPVASDF
SATGWKQMSLALSRPVASDF

SEQ ID NO: 19115 - protein, 20 aa, synthetic construct
  source 1..20: note = Seed: SATGFKQSSKALQRPVASDF
SATGWKQMSLALTRPVASDF

SEQ ID NO: 19116 - protein, 20 aa, synthetic construct
  source 1..20: note = Seed: SATGFKQSSKALQRPVASDF
SATGWKQMSLALVRPVASDF

SEQ ID NO: 19117 - protein, 20 aa, synthetic construct
  source 1..20: note = Seed: SATGFKQSSKALQRPVASDF
SATGWKQMSLALYRPVASDF

SEQ ID NO: 19118 - protein, 20 aa, synthetic construct
  source 1..20: note = Seed: SATGFKQSSKALQRPVASDF
SATGWKQMSMALARPVASDF

SEQ ID NO: 19119 - protein, 20 aa, synthetic construct
  source 1..20: note = Seed: SATGFKQSSKALQRPVASDF
SATGWKQMSMALCRPVASDF

SEQ ID NO: 19120 - protein, 20 aa, synthetic construct
  source 1..20: note = Seed: SATGFKQSSKALQRPVASDF
SATGWKQMSMALGRPVASDF

SEQ ID NO: 19121 - protein, 20 aa, synthetic construct
  source 1..20: note = Seed: SATGFKQSSKALQRPVASDF
SATGWKQMSMALHRPVASDF

SEQ ID NO: 19122 - protein, 20 aa, synthetic construct
  source 1..20: note = Seed: SATGFKQSSKALQRPVASDF
SATGWKQMSMALIRPVASDF

SEQ ID NO: 19123 - protein, 20 aa, synthetic construct
  source 1..20: note = Seed: SATGFKQSSKALQRPVASDF
SATGWKQMSMALNRPVASDF

SEQ ID NO: 19124 - protein, 20 aa, synthetic construct
  source 1..20: note = Seed: SATGFKQSSKALQRPVASDF
SATGWKQMSMALQRPVASDF

SEQ ID NO: 19125 - protein, 20 aa, synthetic construct
  source 1..20: note = Seed: SATGFKQSSKALQRPVASDF
SATGWKQMSMALSRPVASDF

SEQ ID NO: 19126 - protein, 20 aa, synthetic construct
  source 1..20: note = Seed: SATGFKQSSKALQRPVASDF
SATGWKQMSMALTRPVASDF

SEQ ID NO: 19127 - protein, 20 aa, synthetic construct
  source 1..20: note = Seed: SATGFKQSSKALQRPVASDF
SATGWKQMSMALVRPVASDF

SEQ ID NO: 19128 - protein, 20 aa, synthetic construct
  source 1..20: note = Seed: SATGFKQSSKALQRPVASDF
SATGWKQMSMALYRPVASDF

SEQ ID NO: 19129 - protein, 20 aa, synthetic construct
  source 1..20: note = Seed: SATGFKQSSKALQRPVASDF
SATGWKQMSNALARPVASDF

SEQ ID NO: 19130 - protein, 20 aa, synthetic construct
  source 1..20: note = Seed: SATGFKQSSKALQRPVASDF
SATGWKQMSNALCRPVASDF

SEQ ID NO: 19131 - protein, 20 aa, synthetic construct
  source 1..20: note = Seed: SATGFKQSSKALQRPVASDF
SATGWKQMSNALFRPVASDF

SEQ ID NO: 19132 - protein, 20 aa, synthetic construct
  source 1..20: note = Seed: SATGFKQSSKALQRPVASDF
SATGWKQMSNALGRPVASDF

SEQ ID NO: 19133 - protein, 20 aa, synthetic construct
  source 1..20: note = Seed: SATGFKQSSKALQRPVASDF
SATGWKQMSNALHRPVASDF

SEQ ID NO: 19134 - protein, 20 aa, synthetic construct
  source 1..20: note = Seed: SATGFKQSSKALQRPVASDF
SATGWKQMSNALIRPVASDF

SEQ ID NO: 19135 - protein, 20 aa, synthetic construct
  source 1..20: note = Seed: SATGFKQSSKALQRPVASDF
SATGWKQMSNALLRPVASDF

SEQ ID NO: 19136 - protein, 20 aa, synthetic construct
  source 1..20: note = Seed: SATGFKQSSKALQRPVASDF
SATGWKQMSNALMRPVASDF

SEQ ID NO: 19137 - protein, 20 aa, synthetic construct
  source 1..20: note = Seed: SATGFKQSSKALQRPVASDF
SATGWKQMSNALNRPVASDF

SEQ ID NO: 19138 - protein, 20 aa, synthetic construct
  source 1..20: note = Seed: SATGFKQSSKALQRPVASDF
SATGWKQMSNALQRPVASDF

SEQ ID NO: 19139 - protein, 20 aa, synthetic construct
  source 1..20: note = Seed: SATGFKQSSKALQRPVASDF
SATGWKQMSNALSRPVASDF

SEQ ID NO: 19140 - protein, 20 aa, synthetic construct
  source 1..20: note = Seed: SATGFKQSSKALQRPVASDF
SATGWKQMSNALTRPVASDF

SEQ ID NO: 19141 - protein, 20 aa, synthetic construct
  source 1..20: note = Seed: SATGFKQSSKALQRPVASDF
SATGWKQMSNALVRPVASDF

SEQ ID NO: 19142 - protein, 20 aa, synthetic construct
  source 1..20: note = Seed: SATGFKQSSKALQRPVASDF
SATGWKQMSPALARPVASDF

SEQ ID NO: 19143 - protein, 20 aa, synthetic construct
  source 1..20: note = Seed: SATGFKQSSKALQRPVASDF
SATGWKQMSPALCRPVASDF

SEQ ID NO: 19144 - protein, 20 aa, synthetic construct
  source 1..20: note = Seed: SATGFKQSSKALQRPVASDF
SATGWKQMSPALDRPVASDF

SEQ ID NO: 19145 - protein, 20 aa, synthetic construct
  source 1..20: note = Seed: SATGFKQSSKALQRPVASDF
SATGWKQMSPALERPVASDF

SEQ ID NO: 19146 - protein, 20 aa, synthetic construct
  source 1..20: note = Seed: SATGFKQSSKALQRPVASDF
SATGWKQMSPALFRPVASDF

SEQ ID NO: 19147 - protein, 20 aa, synthetic construct
  source 1..20: note = Seed: SATGFKQSSKALQRPVASDF
SATGWKQMSPALGRPVASDF

SEQ ID NO: 19148 - protein, 20 aa, synthetic construct
  source 1..20: note = Seed: SATGFKQSSKALQRPVASDF
SATGWKQMSPALHRPVASDF

SEQ ID NO: 19149 - protein, 20 aa, synthetic construct
  source 1..20: note = Seed: SATGFKQSSKALQRPVASDF
SATGWKQMSPALIRPVASDF

SEQ ID NO: 19150 - protein, 20 aa, synthetic construct
  source 1..20: note = Seed: SATGFKQSSKALQRPVASDF
SATGWKQMSPALLRPVASDF

SEQ ID NO: 19151 - protein, 20 aa, synthetic construct
  source 1..20: note = Seed: SATGFKQSSKALQRPVASDF
SATGWKQMSPALMRPVASDF

SEQ ID NO: 19152 - protein, 20 aa, synthetic construct
  source 1..20: note = Seed: SATGFKQSSKALQRPVASDF
SATGWKQMSPALNRPVASDF

SEQ ID NO: 19153 - protein, 20 aa, synthetic construct
  source 1..20: note = Seed: SATGFKQSSKALQRPVASDF
SATGWKQMSPALPRPVASDF

SEQ ID NO: 19154 - protein, 20 aa, synthetic construct
  source 1..20: note = Seed: SATGFKQSSKALQRPVASDF
SATGWKQMSPALQRPVASDF

SEQ ID NO: 19155 - protein, 20 aa, synthetic construct
  source 1..20: note = Seed: SATGFKQSSKALQRPVASDF
SATGWKQMSPALSRPVASDF

SEQ ID NO: 19156 - protein, 20 aa, synthetic construct
  source 1..20: note = Seed: SATGFKQSSKALQRPVASDF
SATGWKQMSPALTRPVASDF

SEQ ID NO: 19157 - protein, 20 aa, synthetic construct
  source 1..20: note = Seed: SATGFKQSSKALQRPVASDF
SATGWKQMSPALVRPVASDF

SEQ ID NO: 19158 - protein, 20 aa, synthetic construct
  source 1..20: note = Seed: SATGFKQSSKALQRPVASDF
SATGWKQMSPALWRPVASDF

SEQ ID NO: 19159 - protein, 20 aa, synthetic construct
  source 1..20: note = Seed: SATGFKQSSKALQRPVASDF
SATGWKQMSPALYRPVASDF

SEQ ID NO: 19160 - protein, 20 aa, synthetic construct
  source 1..20: note = Seed: SATGFKQSSKALQRPVASDF
SATGWKQMSQALARPVASDF

SEQ ID NO: 19161 - protein, 20 aa, synthetic construct
  source 1..20: note = Seed: SATGFKQSSKALQRPVASDF
SATGWKQMSQALGRPVASDF

SEQ ID NO: 19162 - protein, 20 aa, synthetic construct
  source 1..20: note = Seed: SATGFKQSSKALQRPVASDF
SATGWKQMSQALIRPVASDF

SEQ ID NO: 19163 - protein, 20 aa, synthetic construct
  source 1..20: note = Seed: SATGFKQSSKALQRPVASDF
SATGWKQMSQALLRPVASDF

SEQ ID NO: 19164 - protein, 20 aa, synthetic construct
  source 1..20: note = Seed: SATGFKQSSKALQRPVASDF
SATGWKQMSQALMRPVASDF

SEQ ID NO: 19165 - protein, 20 aa, synthetic construct
  source 1..20: note = Seed: SATGFKQSSKALQRPVASDF
SATGWKQMSQALNRPVASDF

SEQ ID NO: 19166 - protein, 20 aa, synthetic construct
  source 1..20: note = Seed: SATGFKQSSKALQRPVASDF
SATGWKQMSQALSRPVASDF

SEQ ID NO: 19167 - protein, 20 aa, synthetic construct
  source 1..20: note = Seed: SATGFKQSSKALQRPVASDF
SATGWKQMSQALVRPVASDF

SEQ ID NO: 19168 - protein, 20 aa, synthetic construct
  source 1..20: note = Seed: SATGFKQSSKALQRPVASDF
SATGWKQMSRALARPVASDF

SEQ ID NO: 19169 - protein, 20 aa, synthetic construct
  source 1..20: note = Seed: SATGFKQSSKALQRPVASDF
SATGWKQMSRALGRPVASDF

SEQ ID NO: 19170 - protein, 20 aa, synthetic construct
  source 1..20: note = Seed: SATGFKQSSKALQRPVASDF
SATGWKQMSRALHRPVASDF

SEQ ID NO: 19171 - protein, 20 aa, synthetic construct
  source 1..20: note = Seed: SATGFKQSSKALQRPVASDF
SATGWKQMSRALIRPVASDF

SEQ ID NO: 19172 - protein, 20 aa, synthetic construct
  source 1..20: note = Seed: SATGFKQSSKALQRPVASDF
SATGWKQMSRALKRPVASDF

SEQ ID NO: 19173 - protein, 20 aa, synthetic construct
  source 1..20: note = Seed: SATGFKQSSKALQRPVASDF
SATGWKQMSRALLRPVASDF

SEQ ID NO: 19174 - protein, 20 aa, synthetic construct
  source 1..20: note = Seed: SATGFKQSSKALQRPVASDF
SATGWKQMSRALMRPVASDF

SEQ ID NO: 19175 - protein, 20 aa, synthetic construct
  source 1..20: note = Seed: SATGFKQSSKALQRPVASDF
SATGWKQMSRALNRPVASDF

SEQ ID NO: 19176 - protein, 20 aa, synthetic construct
  source 1..20: note = Seed: SATGFKQSSKALQRPVASDF
SATGWKQMSRALPRPVASDF

SEQ ID NO: 19177 - protein, 20 aa, synthetic construct
  source 1..20: note = Seed: SATGFKQSSKALQRPVASDF
SATGWKQMSRALQRPVASDF

SEQ ID NO: 19178 - protein, 20 aa, synthetic construct
  source 1..20: note = Seed: SATGFKQSSKALQRPVASDF
SATGWKQMSRALRRPVASDF

SEQ ID NO: 19179 - protein, 20 aa, synthetic construct
  source 1..20: note = Seed: SATGFKQSSKALQRPVASDF
SATGWKQMSRALSRPVASDF

SEQ ID NO: 19180 - protein, 20 aa, synthetic construct
  source 1..20: note = Seed: SATGFKQSSKALQRPVASDF
SATGWKQMSRALTRPVASDF

SEQ ID NO: 19181 - protein, 20 aa, synthetic construct
  source 1..20: note = Seed: SATGFKQSSKALQRPVASDF
SATGWKQMSRALVRPVASDF

SEQ ID NO: 19182 - protein, 20 aa, synthetic construct
  source 1..20: note = Seed: SATGFKQSSKALQRPVASDF
SATGWKQMSRALYRPVASDF

SEQ ID NO: 19183 - protein, 20 aa, synthetic construct
  source 1..20: note = Seed: SATGFKQSSKALQRPVASDF
SATGWKQMSSALARPVASDF

SEQ ID NO: 19184 - protein, 20 aa, synthetic construct
  source 1..20: note = Seed: SATGFKQSSKALQRPVASDF
SATGWKQMSSALCRPVASDF

SEQ ID NO: 19185 - protein, 20 aa, synthetic construct
  source 1..20: note = Seed: SATGFKQSSKALQRPVASDF
SATGWKQMSSALDRPVASDF

SEQ ID NO: 19186 - protein, 20 aa, synthetic construct
  source 1..20: note = Seed: SATGFKQSSKALQRPVASDF
SATGWKQMSSALERPVASDF

SEQ ID NO: 19187 - protein, 20 aa, synthetic construct
  source 1..20: note = Seed: SATGFKQSSKALQRPVASDF
SATGWKQMSSALFRPVASDF

SEQ ID NO: 19188 - protein, 20 aa, synthetic construct
  source 1..20: note = Seed: SATGFKQSSKALQRPVASDF
SATGWKQMSSALGRPVASDF

SEQ ID NO: 19189 - protein, 20 aa, synthetic construct
  source 1..20: note = Seed: SATGFKQSSKALQRPVASDF
SATGWKQMSSALHRPVASDF

SEQ ID NO: 19190 - protein, 20 aa, synthetic construct
  source 1..20: note = Seed: SATGFKQSSKALQRPVASDF
SATGWKQMSSALIRPVASDF

SEQ ID NO: 19191 - protein, 20 aa, synthetic construct
  source 1..20: note = Seed: SATGFKQSSKALQRPVASDF
SATGWKQMSSALLRPVASDF

SEQ ID NO: 19192 - protein, 20 aa, synthetic construct
  source 1..20: note = Seed: SATGFKQSSKALQRPVASDF
SATGWKQMSSALMRPVASDF

SEQ ID NO: 19193 - protein, 20 aa, synthetic construct
  source 1..20: note = Seed: SATGFKQSSKALQRPVASDF
SATGWKQMSSALNRPVASDF

SEQ ID NO: 19194 - protein, 20 aa, synthetic construct
  source 1..20: note = Seed: SATGFKQSSKALQRPVASDF
SATGWKQMSSALPRPVASDF

SEQ ID NO: 19195 - protein, 20 aa, synthetic construct
  source 1..20: note = Seed: SATGFKQSSKALQRPVASDF
SATGWKQMSSALQRPVASDF

SEQ ID NO: 19196 - protein, 20 aa, synthetic construct
  source 1..20: note = Seed: SATGFKQSSKALQRPVASDF
SATGWKQMSSALRRPVASDF

SEQ ID NO: 19197 - protein, 20 aa, synthetic construct
  source 1..20: note = Seed: SATGFKQSSKALQRPVASDF
SATGWKQMSSALSRPVASDF

SEQ ID NO: 19198 - protein, 20 aa, synthetic construct
  source 1..20: note = Seed: SATGFKQSSKALQRPVASDF
SATGWKQMSSALTRPVASDF

SEQ ID NO: 19199 - protein, 20 aa, synthetic construct
  source 1..20: note = Seed: SATGFKQSSKALQRPVASDF
SATGWKQMSSALVRPVASDF

SEQ ID NO: 19200 - protein, 20 aa, synthetic construct
  source 1..20: note = Seed: SATGFKQSSKALQRPVASDF
SATGWKQMSSALYRPVASDF

SEQ ID NO: 19201 - protein, 20 aa, synthetic construct
  source 1..20: note = Seed: SATGFKQSSKALQRPVASDF
SATGWKQMSTALARPVASDF

SEQ ID NO: 19202 - protein, 20 aa, synthetic construct
  source 1..20: note = Seed: SATGFKQSSKALQRPVASDF
SATGWKQMSTALCRPVASDF

SEQ ID NO: 19203 - protein, 20 aa, synthetic construct
  source 1..20: note = Seed: SATGFKQSSKALQRPVASDF
SATGWKQMSTALDRPVASDF

SEQ ID NO: 19204 - protein, 20 aa, synthetic construct
  source 1..20: note = Seed: SATGFKQSSKALQRPVASDF
SATGWKQMSTALERPVASDF

SEQ ID NO: 19205 - protein, 20 aa, synthetic construct
  source 1..20: note = Seed: SATGFKQSSKALQRPVASDF
SATGWKQMSTALFRPVASDF

SEQ ID NO: 19206 - protein, 20 aa, synthetic construct
  source 1..20: note = Seed: SATGFKQSSKALQRPVASDF
SATGWKQMSTALGRPVASDF

SEQ ID NO: 19207 - protein, 20 aa, synthetic construct
  source 1..20: note = Seed: SATGFKQSSKALQRPVASDF
SATGWKQMSTALHRPVASDF

SEQ ID NO: 19208 - protein, 20 aa, synthetic construct
  source 1..20: note = Seed: SATGFKQSSKALQRPVASDF
SATGWKQMSTALIRPVASDF

SEQ ID NO: 19209 - protein, 20 aa, synthetic construct
  source 1..20: note = Seed: SATGFKQSSKALQRPVASDF
SATGWKQMSTALLRPVASDF

SEQ ID NO: 19210 - protein, 20 aa, synthetic construct
  source 1..20: note = Seed: SATGFKQSSKALQRPVASDF
SATGWKQMSTALMRPVASDF

SEQ ID NO: 19211 - protein, 20 aa, synthetic construct
  source 1..20: note = Seed: SATGFKQSSKALQRPVASDF
SATGWKQMSTALNRPVASDF

SEQ ID NO: 19212 - protein, 20 aa, synthetic construct
  source 1..20: note = Seed: SATGFKQSSKALQRPVASDF
SATGWKQMSTALPRPVASDF

SEQ ID NO: 19213 - protein, 20 aa, synthetic construct
  source 1..20: note = Seed: SATGFKQSSKALQRPVASDF
SATGWKQMSTALQRPVASDF

SEQ ID NO: 19214 - protein, 20 aa, synthetic construct
  source 1..20: note = Seed: SATGFKQSSKALQRPVASDF
SATGWKQMSTALSRPVASDF

SEQ ID NO: 19215 - protein, 20 aa, synthetic construct
  source 1..20: note = Seed: SATGFKQSSKALQRPVASDF
SATGWKQMSTALTRPVASDF

SEQ ID NO: 19216 - protein, 20 aa, synthetic construct
  source 1..20: note = Seed: SATGFKQSSKALQRPVASDF
SATGWKQMSTALVRPVASDF

SEQ ID NO: 19217 - protein, 20 aa, synthetic construct
  source 1..20: note = Seed: SATGFKQSSKALQRPVASDF
SATGWKQMSTALYRPVASDF

SEQ ID NO: 19218 - protein, 20 aa, synthetic construct
  source 1..20: note = Seed: SATGFKQSSKALQRPVASDF
SATGWKQMSVALARPVASDF

SEQ ID NO: 19219 - protein, 20 aa, synthetic construct
  source 1..20: note = Seed: SATGFKQSSKALQRPVASDF
SATGWKQMSVALCRPVASDF

SEQ ID NO: 19220 - protein, 20 aa, synthetic construct
  source 1..20: note = Seed: SATGFKQSSKALQRPVASDF
SATGWKQMSVALDRPVASDF

SEQ ID NO: 19221 - protein, 20 aa, synthetic construct
  source 1..20: note = Seed: SATGFKQSSKALQRPVASDF
SATGWKQMSVALERPVASDF

SEQ ID NO: 19222 - protein, 20 aa, synthetic construct
  source 1..20: note = Seed: SATGFKQSSKALQRPVASDF
SATGWKQMSVALFRPVASDF

SEQ ID NO: 19223 - protein, 20 aa, synthetic construct
  source 1..20: note = Seed: SATGFKQSSKALQRPVASDF
SATGWKQMSVALGRPVASDF

SEQ ID NO: 19224 - protein, 20 aa, synthetic construct
  source 1..20: note = Seed: SATGFKQSSKALQRPVASDF
SATGWKQMSVALHRPVASDF

SEQ ID NO: 19225 - protein, 20 aa, synthetic construct
  source 1..20: note = Seed: SATGFKQSSKALQRPVASDF
SATGWKQMSVALIRPVASDF

SEQ ID NO: 19226 - protein, 20 aa, synthetic construct
  source 1..20: note = Seed: SATGFKQSSKALQRPVASDF
SATGWKQMSVALKRPVASDF

SEQ ID NO: 19227 - protein, 20 aa, synthetic construct
  source 1..20: note = Seed: SATGFKQSSKALQRPVASDF
SATGWKQMSVALLRPVASDF

SEQ ID NO: 19228 - protein, 20 aa, synthetic construct
  source 1..20: note = Seed: SATGFKQSSKALQRPVASDF
SATGWKQMSVALMRPVASDF

SEQ ID NO: 19229 - protein, 20 aa, synthetic construct
  source 1..20: note = Seed: SATGFKQSSKALQRPVASDF
SATGWKQMSVALNRPVASDF

SEQ ID NO: 19230 - protein, 20 aa, synthetic construct
  source 1..20: note = Seed: SATGFKQSSKALQRPVASDF
SATGWKQMSVALPRPVASDF

SEQ ID NO: 19231 - protein, 20 aa, synthetic construct
  source 1..20: note = Seed: SATGFKQSSKALQRPVASDF
SATGWKQMSVALQRPVASDF

SEQ ID NO: 19232 - protein, 20 aa, synthetic construct
  source 1..20: note = Seed: SATGFKQSSKALQRPVASDF
SATGWKQMSVALRRPVASDF

SEQ ID NO: 19233 - protein, 20 aa, synthetic construct
  source 1..20: note = Seed: SATGFKQSSKALQRPVASDF
SATGWKQMSVALSRPVASDF

SEQ ID NO: 19234 - protein, 20 aa, synthetic construct
  source 1..20: note = Seed: SATGFKQSSKALQRPVASDF
SATGWKQMSVALTRPVASDF

SEQ ID NO: 19235 - protein, 20 aa, synthetic construct
  source 1..20: note = Seed: SATGFKQSSKALQRPVASDF
SATGWKQMSVALVRPVASDF

SEQ ID NO: 19236 - protein, 20 aa, synthetic construct
  source 1..20: note = Seed: SATGFKQSSKALQRPVASDF
SATGWKQMSVALYRPVASDF

SEQ ID NO: 19237 - protein, 20 aa, synthetic construct
  source 1..20: note = Seed: SATGFKQSSKALQRPVASDF
SATGWKQNSAALARPVASDF

SEQ ID NO: 19238 - protein, 20 aa, synthetic construct
  source 1..20: note = Seed: SATGFKQSSKALQRPVASDF
SATGWKQNSAALIRPVASDF

SEQ ID NO: 19239 - protein, 20 aa, synthetic construct
  source 1..20: note = Seed: SATGFKQSSKALQRPVASDF
SATGWKQNSAALLRPVASDF

SEQ ID NO: 19240 - protein, 20 aa, synthetic construct
  source 1..20: note = Seed: SATGFKQSSKALQRPVASDF
SATGWKQNSAALMRPVASDF

SEQ ID NO: 19241 - protein, 20 aa, synthetic construct
  source 1..20: note = Seed: SATGFKQSSKALQRPVASDF
SATGWKQNSAALSRPVASDF

SEQ ID NO: 19242 - protein, 20 aa, synthetic construct
  source 1..20: note = Seed: SATGFKQSSKALQRPVASDF
SATGWKQNSAALTRPVASDF

SEQ ID NO: 19243 - protein, 20 aa, synthetic construct
  source 1..20: note = Seed: SATGFKQSSKALQRPVASDF
SATGWKQNSAALVRPVASDF

SEQ ID NO: 19244 - protein, 20 aa, synthetic construct
  source 1..20: note = Seed: SATGFKQSSKALQRPVASDF
SATGWKQNSFALIRPVASDF

SEQ ID NO: 19245 - protein, 20 aa, synthetic construct
  source 1..20: note = Seed: SATGFKQSSKALQRPVASDF
SATGWKQNSGALARPVASDF

SEQ ID NO: 19246 - protein, 20 aa, synthetic construct
  source 1..20: note = Seed: SATGFKQSSKALQRPVASDF
SATGWKQNSGALIRPVASDF

SEQ ID NO: 19247 - protein, 20 aa, synthetic construct
  source 1..20: note = Seed: SATGFKQSSKALQRPVASDF
SATGWKQNSGALLRPVASDF

SEQ ID NO: 19248 - protein, 20 aa, synthetic construct
  source 1..20: note = Seed: SATGFKQSSKALQRPVASDF
SATGWKQNSGALVRPVASDF

SEQ ID NO: 19249 - protein, 20 aa, synthetic construct
  source 1..20: note = Seed: SATGFKQSSKALQRPVASDF
SATGWKQNSIALSRPVASDF

SEQ ID NO: 19250 - protein, 20 aa, synthetic construct
  source 1..20: note = Seed: SATGFKQSSKALQRPVASDF
SATGWKQNSIALVRPVASDF

SEQ ID NO: 19251 - protein, 20 aa, synthetic construct
  source 1..20: note = Seed: SATGFKQSSKALQRPVASDF
SATGWKQNSLALVRPVASDF

SEQ ID NO: 19252 - protein, 20 aa, synthetic construct
  source 1..20: note = Seed: SATGFKQSSKALQRPVASDF
SATGWKQNSMALIRPVASDF

SEQ ID NO: 19253 - protein, 20 aa, synthetic construct
  source 1..20: note = Seed: SATGFKQSSKALQRPVASDF
SATGWKQNSPALIRPVASDF

SEQ ID NO: 19254 - protein, 20 aa, synthetic construct
  source 1..20: note = Seed: SATGFKQSSKALQRPVASDF
SATGWKQNSPALLRPVASDF

SEQ ID NO: 19255 - protein, 20 aa, synthetic construct
  source 1..20: note = Seed: SATGFKQSSKALQRPVASDF
SATGWKQNSPALVRPVASDF

SEQ ID NO: 19256 - protein, 20 aa, synthetic construct
  source 1..20: note = Seed: SATGFKQSSKALQRPVASDF
SATGWKQNSSALARPVASDF

SEQ ID NO: 19257 - protein, 20 aa, synthetic construct
  source 1..20: note = Seed: SATGFKQSSKALQRPVASDF
SATGWKQNSSALIRPVASDF

SEQ ID NO: 19258 - protein, 20 aa, synthetic construct
  source 1..20: note = Seed: SATGFKQSSKALQRPVASDF
SATGWKQNSSALLRPVASDF

SEQ ID NO: 19259 - protein, 20 aa, synthetic construct
  source 1..20: note = Seed: SATGFKQSSKALQRPVASDF
SATGWKQNSSALVRPVASDF

SEQ ID NO: 19260 - protein, 20 aa, synthetic construct
  source 1..20: note = Seed: SATGFKQSSKALQRPVASDF
SATGWKQNSVALARPVASDF

SEQ ID NO: 19261 - protein, 20 aa, synthetic construct
  source 1..20: note = Seed: SATGFKQSSKALQRPVASDF
SATGWKQNSVALIRPVASDF

SEQ ID NO: 19262 - protein, 20 aa, synthetic construct
  source 1..20: note = Seed: SATGFKQSSKALQRPVASDF
SATGWKQNSVALQRPVASDF

SEQ ID NO: 19263 - protein, 20 aa, synthetic construct
  source 1..20: note = Seed: SATGFKQSSKALQRPVASDF
SATGWKQNSVALSRPVASDF

SEQ ID NO: 19264 - protein, 20 aa, synthetic construct
  source 1..20: note = Seed: SATGFKQSSKALQRPVASDF
SATGWKQNSVALVRPVASDF

SEQ ID NO: 19265 - protein, 20 aa, synthetic construct
  source 1..20: note = Seed: SATGFKQSSKALQRPVASDF
SATGWKQQSAALARPVASDF

SEQ ID NO: 19266 - protein, 20 aa, synthetic construct
  source 1..20: note = Seed: SATGFKQSSKALQRPVASDF
SATGWKQQSAALCRPVASDF

SEQ ID NO: 19267 - protein, 20 aa, synthetic construct
  source 1..20: note = Seed: SATGFKQSSKALQRPVASDF
SATGWKQQSAALGRPVASDF

SEQ ID NO: 19268 - protein, 20 aa, synthetic construct
  source 1..20: note = Seed: SATGFKQSSKALQRPVASDF
SATGWKQQSAALIRPVASDF

SEQ ID NO: 19269 - protein, 20 aa, synthetic construct
  source 1..20: note = Seed: SATGFKQSSKALQRPVASDF
SATGWKQQSAALLRPVASDF

SEQ ID NO: 19270 - protein, 20 aa, synthetic construct
  source 1..20: note = Seed: SATGFKQSSKALQRPVASDF
SATGWKQQSAALMRPVASDF

SEQ ID NO: 19271 - protein, 20 aa, synthetic construct
  source 1..20: note = Seed: SATGFKQSSKALQRPVASDF
SATGWKQQSAALNRPVASDF

SEQ ID NO: 19272 - protein, 20 aa, synthetic construct
  source 1..20: note = Seed: SATGFKQSSKALQRPVASDF
SATGWKQQSAALSRPVASDF

SEQ ID NO: 19273 - protein, 20 aa, synthetic construct
  source 1..20: note = Seed: SATGFKQSSKALQRPVASDF
SATGWKQQSAALTRPVASDF

SEQ ID NO: 19274 - protein, 20 aa, synthetic construct
  source 1..20: note = Seed: SATGFKQSSKALQRPVASDF
SATGWKQQSAALVRPVASDF

SEQ ID NO: 19275 - protein, 20 aa, synthetic construct
  source 1..20: note = Seed: SATGFKQSSKALQRPVASDF
SATGWKQQSGALARPVASDF

SEQ ID NO: 19276 - protein, 20 aa, synthetic construct
  source 1..20: note = Seed: SATGFKQSSKALQRPVASDF
SATGWKQQSGALIRPVASDF

SEQ ID NO: 19277 - protein, 20 aa, synthetic construct
  source 1..20: note = Seed: SATGFKQSSKALQRPVASDF
SATGWKQQSGALLRPVASDF

SEQ ID NO: 19278 - protein, 20 aa, synthetic construct
  source 1..20: note = Seed: SATGFKQSSKALQRPVASDF
SATGWKQQSGALMRPVASDF

SEQ ID NO: 19279 - protein, 20 aa, synthetic construct
  source 1..20: note = Seed: SATGFKQSSKALQRPVASDF
SATGWKQQSGALSRPVASDF

SEQ ID NO: 19280 - protein, 20 aa, synthetic construct
  source 1..20: note = Seed: SATGFKQSSKALQRPVASDF
SATGWKQQSGALTRPVASDF

SEQ ID NO: 19281 - protein, 20 aa, synthetic construct
  source 1..20: note = Seed: SATGFKQSSKALQRPVASDF
SATGWKQQSGALVRPVASDF

SEQ ID NO: 19282 - protein, 20 aa, synthetic construct
  source 1..20: note = Seed: SATGFKQSSKALQRPVASDF
SATGWKQQSIALARPVASDF

SEQ ID NO: 19283 - protein, 20 aa, synthetic construct
  source 1..20: note = Seed: SATGFKQSSKALQRPVASDF
SATGWKQQSIALGRPVASDF

SEQ ID NO: 19284 - protein, 20 aa, synthetic construct
  source 1..20: note = Seed: SATGFKQSSKALQRPVASDF
SATGWKQQSIALHRPVASDF

SEQ ID NO: 19285 - protein, 20 aa, synthetic construct
  source 1..20: note = Seed: SATGFKQSSKALQRPVASDF
SATGWKQQSIALIRPVASDF

SEQ ID NO: 19286 - protein, 20 aa, synthetic construct
  source 1..20: note = Seed: SATGFKQSSKALQRPVASDF
SATGWKQQSIALNRPVASDF

SEQ ID NO: 19287 - protein, 20 aa, synthetic construct
  source 1..20: note = Seed: SATGFKQSSKALQRPVASDF
SATGWKQQSIALQRPVASDF

SEQ ID NO: 19288 - protein, 20 aa, synthetic construct
  source 1..20: note = Seed: SATGFKQSSKALQRPVASDF
SATGWKQQSIALSRPVASDF

SEQ ID NO: 19289 - protein, 20 aa, synthetic construct
  source 1..20: note = Seed: SATGFKQSSKALQRPVASDF
SATGWKQQSIALTRPVASDF

SEQ ID NO: 19290 - protein, 20 aa, synthetic construct
  source 1..20: note = Seed: SATGFKQSSKALQRPVASDF
SATGWKQQSIALVRPVASDF

SEQ ID NO: 19291 - protein, 20 aa, synthetic construct
  source 1..20: note = Seed: SATGFKQSSKALQRPVASDF
SATGWKQQSLALARPVASDF

SEQ ID NO: 19292 - protein, 20 aa, synthetic construct
  source 1..20: note = Seed: SATGFKQSSKALQRPVASDF
SATGWKQQSLALNRPVASDF

SEQ ID NO: 19293 - protein, 20 aa, synthetic construct
  source 1..20: note = Seed: SATGFKQSSKALQRPVASDF
SATGWKQQSLALSRPVASDF

SEQ ID NO: 19294 - protein, 20 aa, synthetic construct
  source 1..20: note = Seed: SATGFKQSSKALQRPVASDF
SATGWKQQSLALTRPVASDF

SEQ ID NO: 19295 - protein, 20 aa, synthetic construct
  source 1..20: note = Seed: SATGFKQSSKALQRPVASDF
SATGWKQQSLALVRPVASDF

SEQ ID NO: 19296 - protein, 20 aa, synthetic construct
  source 1..20: note = Seed: SATGFKQSSKALQRPVASDF
SATGWKQQSMALARPVASDF

SEQ ID NO: 19297 - protein, 20 aa, synthetic construct
  source 1..20: note = Seed: SATGFKQSSKALQRPVASDF
SATGWKQQSMALIRPVASDF

SEQ ID NO: 19298 - protein, 20 aa, synthetic construct
  source 1..20: note = Seed: SATGFKQSSKALQRPVASDF
SATGWKQQSMALNRPVASDF

SEQ ID NO: 19299 - protein, 20 aa, synthetic construct
  source 1..20: note = Seed: SATGFKQSSKALQRPVASDF
SATGWKQQSMALSRPVASDF

SEQ ID NO: 19300 - protein, 20 aa, synthetic construct
  source 1..20: note = Seed: SATGFKQSSKALQRPVASDF
SATGWKQQSMALTRPVASDF

SEQ ID NO: 19301 - protein, 20 aa, synthetic construct
  source 1..20: note = Seed: SATGFKQSSKALQRPVASDF
SATGWKQQSMALVRPVASDF

SEQ ID NO: 19302 - protein, 20 aa, synthetic construct
  source 1..20: note = Seed: SATGFKQSSKALQRPVASDF
SATGWKQQSNALARPVASDF

SEQ ID NO: 19303 - protein, 20 aa, synthetic construct
  source 1..20: note = Seed: SATGFKQSSKALQRPVASDF
SATGWKQQSNALIRPVASDF

SEQ ID NO: 19304 - protein, 20 aa, synthetic construct
  source 1..20: note = Seed: SATGFKQSSKALQRPVASDF
SATGWKQQSNALLRPVASDF

SEQ ID NO: 19305 - protein, 20 aa, synthetic construct
  source 1..20: note = Seed: SATGFKQSSKALQRPVASDF
SATGWKQQSNALVRPVASDF

SEQ ID NO: 19306 - protein, 20 aa, synthetic construct
  source 1..20: note = Seed: SATGFKQSSKALQRPVASDF
SATGWKQQSPALARPVASDF

SEQ ID NO: 19307 - protein, 20 aa, synthetic construct
  source 1..20: note = Seed: SATGFKQSSKALQRPVASDF
SATGWKQQSPALIRPVASDF

SEQ ID NO: 19308 - protein, 20 aa, synthetic construct
  source 1..20: note = Seed: SATGFKQSSKALQRPVASDF
SATGWKQQSPALLRPVASDF

SEQ ID NO: 19309 - protein, 20 aa, synthetic construct
  source 1..20: note = Seed: SATGFKQSSKALQRPVASDF
SATGWKQQSPALMRPVASDF

SEQ ID NO: 19310 - protein, 20 aa, synthetic construct
  source 1..20: note = Seed: SATGFKQSSKALQRPVASDF
SATGWKQQSPALNRPVASDF

SEQ ID NO: 19311 - protein, 20 aa, synthetic construct
  source 1..20: note = Seed: SATGFKQSSKALQRPVASDF
SATGWKQQSPALSRPVASDF

SEQ ID NO: 19312 - protein, 20 aa, synthetic construct
  source 1..20: note = Seed: SATGFKQSSKALQRPVASDF
SATGWKQQSPALTRPVASDF

SEQ ID NO: 19313 - protein, 20 aa, synthetic construct
  source 1..20: note = Seed: SATGFKQSSKALQRPVASDF
SATGWKQQSPALVRPVASDF

SEQ ID NO: 19314 - protein, 20 aa, synthetic construct
  source 1..20: note = Seed: SATGFKQSSKALQRPVASDF
SATGWKQQSSALARPVASDF

SEQ ID NO: 19315 - protein, 20 aa, synthetic construct
  source 1..20: note = Seed: SATGFKQSSKALQRPVASDF
SATGWKQQSSALGRPVASDF

SEQ ID NO: 19316 - protein, 20 aa, synthetic construct
  source 1..20: note = Seed: SATGFKQSSKALQRPVASDF
SATGWKQQSSALIRPVASDF

SEQ ID NO: 19317 - protein, 20 aa, synthetic construct
  source 1..20: note = Seed: SATGFKQSSKALQRPVASDF
SATGWKQQSSALLRPVASDF

SEQ ID NO: 19318 - protein, 20 aa, synthetic construct
  source 1..20: note = Seed: SATGFKQSSKALQRPVASDF
SATGWKQQSSALMRPVASDF

SEQ ID NO: 19319 - protein, 20 aa, synthetic construct
  source 1..20: note = Seed: SATGFKQSSKALQRPVASDF
SATGWKQQSSALNRPVASDF

SEQ ID NO: 19320 - protein, 20 aa, synthetic construct
  source 1..20: note = Seed: SATGFKQSSKALQRPVASDF
SATGWKQQSSALSRPVASDF

SEQ ID NO: 19321 - protein, 20 aa, synthetic construct
  source 1..20: note = Seed: SATGFKQSSKALQRPVASDF
SATGWKQQSSALTRPVASDF

SEQ ID NO: 19322 - protein, 20 aa, synthetic construct
  source 1..20: note = Seed: SATGFKQSSKALQRPVASDF
SATGWKQQSSALVRPVASDF

SEQ ID NO: 19323 - protein, 20 aa, synthetic construct
  source 1..20: note = Seed: SATGFKQSSKALQRPVASDF
SATGWKQQSTALARPVASDF

SEQ ID NO: 19324 - protein, 20 aa, synthetic construct
  source 1..20: note = Seed: SATGFKQSSKALQRPVASDF
SATGWKQQSTALIRPVASDF

SEQ ID NO: 19325 - protein, 20 aa, synthetic construct
  source 1..20: note = Seed: SATGFKQSSKALQRPVASDF
SATGWKQQSTALLRPVASDF

SEQ ID NO: 19326 - protein, 20 aa, synthetic construct
  source 1..20: note = Seed: SATGFKQSSKALQRPVASDF
SATGWKQQSTALMRPVASDF

SEQ ID NO: 19327 - protein, 20 aa, synthetic construct
  source 1..20: note = Seed: SATGFKQSSKALQRPVASDF
SATGWKQQSTALNRPVASDF

SEQ ID NO: 19328 - protein, 20 aa, synthetic construct
  source 1..20: note = Seed: SATGFKQSSKALQRPVASDF
SATGWKQQSTALSRPVASDF

SEQ ID NO: 19329 - protein, 20 aa, synthetic construct
  source 1..20: note = Seed: SATGFKQSSKALQRPVASDF
SATGWKQQSTALTRPVASDF

SEQ ID NO: 19330 - protein, 20 aa, synthetic construct
  source 1..20: note = Seed: SATGFKQSSKALQRPVASDF
SATGWKQQSTALVRPVASDF

SEQ ID NO: 19331 - protein, 20 aa, synthetic construct
  source 1..20: note = Seed: SATGFKQSSKALQRPVASDF
SATGWKQQSVALARPVASDF

SEQ ID NO: 19332 - protein, 20 aa, synthetic construct
  source 1..20: note = Seed: SATGFKQSSKALQRPVASDF
SATGWKQQSVALFRPVASDF

SEQ ID NO: 19333 - protein, 20 aa, synthetic construct
  source 1..20: note = Seed: SATGFKQSSKALQRPVASDF
SATGWKQQSVALGRPVASDF

SEQ ID NO: 19334 - protein, 20 aa, synthetic construct
  source 1..20: note = Seed: SATGFKQSSKALQRPVASDF
SATGWKQQSVALHRPVASDF

SEQ ID NO: 19335 - protein, 20 aa, synthetic construct
  source 1..20: note = Seed: SATGFKQSSKALQRPVASDF
SATGWKQQSVALIRPVASDF

SEQ ID NO: 19336 - protein, 20 aa, synthetic construct
  source 1..20: note = Seed: SATGFKQSSKALQRPVASDF
SATGWKQQSVALLRPVASDF

SEQ ID NO: 19337 - protein, 20 aa, synthetic construct
  source 1..20: note = Seed: SATGFKQSSKALQRPVASDF
SATGWKQQSVALMRPVASDF

SEQ ID NO: 19338 - protein, 20 aa, synthetic construct
  source 1..20: note = Seed: SATGFKQSSKALQRPVASDF
SATGWKQQSVALNRPVASDF

SEQ ID NO: 19339 - protein, 20 aa, synthetic construct
  source 1..20: note = Seed: SATGFKQSSKALQRPVASDF
SATGWKQQSVALQRPVASDF

SEQ ID NO: 19340 - protein, 20 aa, synthetic construct
  source 1..20: note = Seed: SATGFKQSSKALQRPVASDF
SATGWKQQSVALSRPVASDF

SEQ ID NO: 19341 - protein, 20 aa, synthetic construct
  source 1..20: note = Seed: SATGFKQSSKALQRPVASDF
SATGWKQQSVALTRPVASDF

SEQ ID NO: 19342 - protein, 20 aa, synthetic construct
  source 1..20: note = Seed: SATGFKQSSKALQRPVASDF
SATGWKQQSVALVRPVASDF

SEQ ID NO: 19343 - protein, 20 aa, synthetic construct
  source 1..20: note = Seed: SATGFKQSSKALQRPVASDF
SATGWKQRSIALARPVASDF

SEQ ID NO: 19344 - protein, 20 aa, synthetic construct
  source 1..20: note = Seed: SATGFKQSSKALQRPVASDF
SATGWKQSSAALARPVASDF

SEQ ID NO: 19345 - protein, 20 aa, synthetic construct
  source 1..20: note = Seed: SATGFKQSSKALQRPVASDF
SATGWKQSSAALGRPVASDF

SEQ ID NO: 19346 - protein, 20 aa, synthetic construct
  source 1..20: note = Seed: SATGFKQSSKALQRPVASDF
SATGWKQSSAALIRPVASDF

SEQ ID NO: 19347 - protein, 20 aa, synthetic construct
  source 1..20: note = Seed: SATGFKQSSKALQRPVASDF
SATGWKQSSAALLRPVASDF

SEQ ID NO: 19348 - protein, 20 aa, synthetic construct
  source 1..20: note = Seed: SATGFKQSSKALQRPVASDF
SATGWKQSSAALMRPVASDF

SEQ ID NO: 19349 - protein, 20 aa, synthetic construct
  source 1..20: note = Seed: SATGFKQSSKALQRPVASDF
SATGWKQSSAALNRPVASDF

SEQ ID NO: 19350 - protein, 20 aa, synthetic construct
  source 1..20: note = Seed: SATGFKQSSKALQRPVASDF
SATGWKQSSAALSRPVASDF

SEQ ID NO: 19351 - protein, 20 aa, synthetic construct
  source 1..20: note = Seed: SATGFKQSSKALQRPVASDF
SATGWKQSSAALTRPVASDF

SEQ ID NO: 19352 - protein, 20 aa, synthetic construct
  source 1..20: note = Seed: SATGFKQSSKALQRPVASDF
SATGWKQSSAALVRPVASDF

SEQ ID NO: 19353 - protein, 20 aa, synthetic construct
  source 1..20: note = Seed: SATGFKQSSKALQRPVASDF
SATGWKQSSFALARPVASDF

SEQ ID NO: 19354 - protein, 20 aa, synthetic construct
  source 1..20: note = Seed: SATGFKQSSKALQRPVASDF
SATGWKQSSFALERPVASDF

SEQ ID NO: 19355 - protein, 20 aa, synthetic construct
  source 1..20: note = Seed: SATGFKQSSKALQRPVASDF
SATGWKQSSFALFRPVASDF

SEQ ID NO: 19356 - protein, 20 aa, synthetic construct
  source 1..20: note = Seed: SATGFKQSSKALQRPVASDF
SATGWKQSSFALIRPVASDF

SEQ ID NO: 19357 - protein, 20 aa, synthetic construct
  source 1..20: note = Seed: SATGFKQSSKALQRPVASDF
SATGWKQSSFALLRPVASDF

SEQ ID NO: 19358 - protein, 20 aa, synthetic construct
  source 1..20: note = Seed: SATGFKQSSKALQRPVASDF
SATGWKQSSFALMRPVASDF

SEQ ID NO: 19359 - protein, 20 aa, synthetic construct
  source 1..20: note = Seed: SATGFKQSSKALQRPVASDF
SATGWKQSSFALVRPVASDF

SEQ ID NO: 19360 - protein, 20 aa, synthetic construct
  source 1..20: note = Seed: SATGFKQSSKALQRPVASDF
SATGWKQSSGALARPVASDF

SEQ ID NO: 19361 - protein, 20 aa, synthetic construct
  source 1..20: note = Seed: SATGFKQSSKALQRPVASDF
SATGWKQSSGALIRPVASDF

SEQ ID NO: 19362 - protein, 20 aa, synthetic construct
  source 1..20: note = Seed: SATGFKQSSKALQRPVASDF
SATGWKQSSGALLRPVASDF

SEQ ID NO: 19363 - protein, 20 aa, synthetic construct
  source 1..20: note = Seed: SATGFKQSSKALQRPVASDF
SATGWKQSSGALMRPVASDF

SEQ ID NO: 19364 - protein, 20 aa, synthetic construct
  source 1..20: note = Seed: SATGFKQSSKALQRPVASDF
SATGWKQSSGALVRPVASDF

SEQ ID NO: 19365 - protein, 20 aa, synthetic construct
  source 1..20: note = Seed: SATGFKQSSKALQRPVASDF
SATGWKQSSIALHRPVASDF

SEQ ID NO: 19366 - protein, 20 aa, synthetic construct
  source 1..20: note = Seed: SATGFKQSSKALQRPVASDF
SATGWKQSSIALNRPVASDF

SEQ ID NO: 19367 - protein, 20 aa, synthetic construct
  source 1..20: note = Seed: SATGFKQSSKALQRPVASDF
SATGWKQSSIALSRPVASDF

SEQ ID NO: 19368 - protein, 20 aa, synthetic construct
  source 1..20: note = Seed: SATGFKQSSKALQRPVASDF
SATGWKQSSIALTRPVASDF

SEQ ID NO: 19369 - protein, 20 aa, synthetic construct
  source 1..20: note = Seed: SATGFKQSSKALQRPVASDF
SATGWKQSSIALVRPVASDF

SEQ ID NO: 19370 - protein, 20 aa, synthetic construct
  source 1..20: note = Seed: SATGFKQSSKALQRPVASDF
SATGWKQSSKALARPVASDF

SEQ ID NO: 19371 - protein, 20 aa, synthetic construct
  source 1..20: note = Seed: SATGFKQSSKALQRPVASDF
SATGWKQSSLALNRPVASDF

SEQ ID NO: 19372 - protein, 20 aa, synthetic construct
  source 1..20: note = Seed: SATGFKQSSKALQRPVASDF
SATGWKQSSLALSRPVASDF

SEQ ID NO: 19373 - protein, 20 aa, synthetic construct
  source 1..20: note = Seed: SATGFKQSSKALQRPVASDF
SATGWKQSSMALSRPVASDF

SEQ ID NO: 19374 - protein, 20 aa, synthetic construct
  source 1..20: note = Seed: SATGFKQSSKALQRPVASDF
SATGWKQSSPALARPVASDF

SEQ ID NO: 19375 - protein, 20 aa, synthetic construct
  source 1..20: note = Seed: SATGFKQSSKALQRPVASDF
SATGWKQSSPALIRPVASDF

SEQ ID NO: 19376 - protein, 20 aa, synthetic construct
  source 1..20: note = Seed: SATGFKQSSKALQRPVASDF
SATGWKQSSPALLRPVASDF

SEQ ID NO: 19377 - protein, 20 aa, synthetic construct
  source 1..20: note = Seed: SATGFKQSSKALQRPVASDF
SATGWKQSSPALMRPVASDF

SEQ ID NO: 19378 - protein, 20 aa, synthetic construct
  source 1..20: note = Seed: SATGFKQSSKALQRPVASDF
SATGWKQSSPALNRPVASDF

SEQ ID NO: 19379 - protein, 20 aa, synthetic construct
  source 1..20: note = Seed: SATGFKQSSKALQRPVASDF
SATGWKQSSPALSRPVASDF

SEQ ID NO: 19380 - protein, 20 aa, synthetic construct
  source 1..20: note = Seed: SATGFKQSSKALQRPVASDF
SATGWKQSSPALVRPVASDF

SEQ ID NO: 19381 - protein, 20 aa, synthetic construct
  source 1..20: note = Seed: SATGFKQSSKALQRPVASDF
SATGWKQSSSALARPVASDF

SEQ ID NO: 19382 - protein, 20 aa, synthetic construct
  source 1..20: note = Seed: SATGFKQSSKALQRPVASDF
SATGWKQSSSALIRPVASDF

SEQ ID NO: 19383 - protein, 20 aa, synthetic construct
  source 1..20: note = Seed: SATGFKQSSKALQRPVASDF
SATGWKQSSSALLRPVASDF

SEQ ID NO: 19384 - protein, 20 aa, synthetic construct
  source 1..20: note = Seed: SATGFKQSSKALQRPVASDF
SATGWKQSSSALMRPVASDF

SEQ ID NO: 19385 - protein, 20 aa, synthetic construct
  source 1..20: note = Seed: SATGFKQSSKALQRPVASDF
SATGWKQSSSALNRPVASDF

SEQ ID NO: 19386 - protein, 20 aa, synthetic construct
  source 1..20: note = Seed: SATGFKQSSKALQRPVASDF
SATGWKQSSSALSRPVASDF

SEQ ID NO: 19387 - protein, 20 aa, synthetic construct
  source 1..20: note = Seed: SATGFKQSSKALQRPVASDF
SATGWKQSSSALTRPVASDF

SEQ ID NO: 19388 - protein, 20 aa, synthetic construct
  source 1..20: note = Seed: SATGFKQSSKALQRPVASDF
SATGWKQSSSALVRPVASDF

SEQ ID NO: 19389 - protein, 20 aa, synthetic construct
  source 1..20: note = Seed: SATGFKQSSKALQRPVASDF
SATGWKQSSTALARPVASDF

SEQ ID NO: 19390 - protein, 20 aa, synthetic construct
  source 1..20: note = Seed: SATGFKQSSKALQRPVASDF
SATGWKQSSTALIRPVASDF

SEQ ID NO: 19391 - protein, 20 aa, synthetic construct
  source 1..20: note = Seed: SATGFKQSSKALQRPVASDF
SATGWKQSSTALLRPVASDF

SEQ ID NO: 19392 - protein, 20 aa, synthetic construct
  source 1..20: note = Seed: SATGFKQSSKALQRPVASDF
SATGWKQSSTALNRPVASDF

SEQ ID NO: 19393 - protein, 20 aa, synthetic construct
  source 1..20: note = Seed: SATGFKQSSKALQRPVASDF
SATGWKQSSTALSRPVASDF

SEQ ID NO: 19394 - protein, 20 aa, synthetic construct
  source 1..20: note = Seed: SATGFKQSSKALQRPVASDF
SATGWKQSSTALVRPVASDF

SEQ ID NO: 19395 - protein, 20 aa, synthetic construct
  source 1..20: note = Seed: SATGFKQSSKALQRPVASDF
SATGWKQSSVALARPVASDF

SEQ ID NO: 19396 - protein, 20 aa, synthetic construct
  source 1..20: note = Seed: SATGFKQSSKALQRPVASDF
SATGWKQSSVALIRPVASDF

SEQ ID NO: 19397 - protein, 20 aa, synthetic construct
  source 1..20: note = Seed: SATGFKQSSKALQRPVASDF
SATGWKQSSVALNRPVASDF

SEQ ID NO: 19398 - protein, 20 aa, synthetic construct
  source 1..20: note = Seed: SATGFKQSSKALQRPVASDF
SATGWKQSSVALQRPVASDF

SEQ ID NO: 19399 - protein, 20 aa, synthetic construct
  source 1..20: note = Seed: SATGFKQSSKALQRPVASDF
SATGWKQSSVALSRPVASDF

SEQ ID NO: 19400 - protein, 20 aa, synthetic construct
  source 1..20: note = Seed: SATGFKQSSKALQRPVASDF
SATGWKQSSVALTRPVASDF

SEQ ID NO: 19401 - protein, 20 aa, synthetic construct
  source 1..20: note = Seed: SATGFKQSSKALQRPVASDF
SATGWKQSSVALVRPVASDF

SEQ ID NO: 19402 - protein, 20 aa, synthetic construct
  source 1..20: note = Seed: SATGFKQSSKALQRPVASDF
SATGWKQTSAALARPVASDF

SEQ ID NO: 19403 - protein, 20 aa, synthetic construct
  source 1..20: note = Seed: SATGFKQSSKALQRPVASDF
SATGWKQTSAALIRPVASDF

SEQ ID NO: 19404 - protein, 20 aa, synthetic construct
  source 1..20: note = Seed: SATGFKQSSKALQRPVASDF
SATGWKQTSAALLRPVASDF

SEQ ID NO: 19405 - protein, 20 aa, synthetic construct
  source 1..20: note = Seed: SATGFKQSSKALQRPVASDF
SATGWKQTSAALMRPVASDF

SEQ ID NO: 19406 - protein, 20 aa, synthetic construct
  source 1..20: note = Seed: SATGFKQSSKALQRPVASDF
SATGWKQTSAALNRPVASDF

SEQ ID NO: 19407 - protein, 20 aa, synthetic construct
  source 1..20: note = Seed: SATGFKQSSKALQRPVASDF
SATGWKQTSAALSRPVASDF

SEQ ID NO: 19408 - protein, 20 aa, synthetic construct
  source 1..20: note = Seed: SATGFKQSSKALQRPVASDF
SATGWKQTSAALTRPVASDF

SEQ ID NO: 19409 - protein, 20 aa, synthetic construct
  source 1..20: note = Seed: SATGFKQSSKALQRPVASDF
SATGWKQTSAALVRPVASDF

SEQ ID NO: 19410 - protein, 20 aa, synthetic construct
  source 1..20: note = Seed: SATGFKQSSKALQRPVASDF
SATGWKQTSFALARPVASDF

SEQ ID NO: 19411 - protein, 20 aa, synthetic construct
  source 1..20: note = Seed: SATGFKQSSKALQRPVASDF
SATGWKQTSFALDRPVASDF

SEQ ID NO: 19412 - protein, 20 aa, synthetic construct
  source 1..20: note = Seed: SATGFKQSSKALQRPVASDF
SATGWKQTSFALERPVASDF

SEQ ID NO: 19413 - protein, 20 aa, synthetic construct
  source 1..20: note = Seed: SATGFKQSSKALQRPVASDF
SATGWKQTSFALFRPVASDF

SEQ ID NO: 19414 - protein, 20 aa, synthetic construct
  source 1..20: note = Seed: SATGFKQSSKALQRPVASDF
SATGWKQTSFALIRPVASDF

SEQ ID NO: 19415 - protein, 20 aa, synthetic construct
  source 1..20: note = Seed: SATGFKQSSKALQRPVASDF
SATGWKQTSFALLRPVASDF

SEQ ID NO: 19416 - protein, 20 aa, synthetic construct
  source 1..20: note = Seed: SATGFKQSSKALQRPVASDF
SATGWKQTSFALMRPVASDF

SEQ ID NO: 19417 - protein, 20 aa, synthetic construct
  source 1..20: note = Seed: SATGFKQSSKALQRPVASDF
SATGWKQTSFALNRPVASDF

SEQ ID NO: 19418 - protein, 20 aa, synthetic construct
  source 1..20: note = Seed: SATGFKQSSKALQRPVASDF
SATGWKQTSFALSRPVASDF

SEQ ID NO: 19419 - protein, 20 aa, synthetic construct
  source 1..20: note = Seed: SATGFKQSSKALQRPVASDF
SATGWKQTSFALTRPVASDF

SEQ ID NO: 19420 - protein, 20 aa, synthetic construct
  source 1..20: note = Seed: SATGFKQSSKALQRPVASDF
SATGWKQTSFALVRPVASDF

SEQ ID NO: 19421 - protein, 20 aa, synthetic construct
  source 1..20: note = Seed: SATGFKQSSKALQRPVASDF
SATGWKQTSGALARPVASDF

SEQ ID NO: 19422 - protein, 20 aa, synthetic construct
  source 1..20: note = Seed: SATGFKQSSKALQRPVASDF
SATGWKQTSGALIRPVASDF

SEQ ID NO: 19423 - protein, 20 aa, synthetic construct
  source 1..20: note = Seed: SATGFKQSSKALQRPVASDF
SATGWKQTSGALLRPVASDF

SEQ ID NO: 19424 - protein, 20 aa, synthetic construct
  source 1..20: note = Seed: SATGFKQSSKALQRPVASDF
SATGWKQTSGALVRPVASDF

SEQ ID NO: 19425 - protein, 20 aa, synthetic construct
  source 1..20: note = Seed: SATGFKQSSKALQRPVASDF
SATGWKQTSIALHRPVASDF

SEQ ID NO: 19426 - protein, 20 aa, synthetic construct
  source 1..20: note = Seed: SATGFKQSSKALQRPVASDF
SATGWKQTSIALNRPVASDF

SEQ ID NO: 19427 - protein, 20 aa, synthetic construct
  source 1..20: note = Seed: SATGFKQSSKALQRPVASDF
SATGWKQTSIALSRPVASDF

SEQ ID NO: 19428 - protein, 20 aa, synthetic construct
  source 1..20: note = Seed: SATGFKQSSKALQRPVASDF
SATGWKQTSIALTRPVASDF

SEQ ID NO: 19429 - protein, 20 aa, synthetic construct
  source 1..20: note = Seed: SATGFKQSSKALQRPVASDF
SATGWKQTSIALVRPVASDF

SEQ ID NO: 19430 - protein, 20 aa, synthetic construct
  source 1..20: note = Seed: SATGFKQSSKALQRPVASDF
SATGWKQTSKALARPVASDF

SEQ ID NO: 19431 - protein, 20 aa, synthetic construct
  source 1..20: note = Seed: SATGFKQSSKALQRPVASDF
SATGWKQTSKALSRPVASDF

SEQ ID NO: 19432 - protein, 20 aa, synthetic construct
  source 1..20: note = Seed: SATGFKQSSKALQRPVASDF
SATGWKQTSLALSRPVASDF

SEQ ID NO: 19433 - protein, 20 aa, synthetic construct
  source 1..20: note = Seed: SATGFKQSSKALQRPVASDF
SATGWKQTSMALIRPVASDF

SEQ ID NO: 19434 - protein, 20 aa, synthetic construct
  source 1..20: note = Seed: SATGFKQSSKALQRPVASDF
SATGWKQTSMALSRPVASDF

SEQ ID NO: 19435 - protein, 20 aa, synthetic construct
  source 1..20: note = Seed: SATGFKQSSKALQRPVASDF
SATGWKQTSPALARPVASDF

SEQ ID NO: 19436 - protein, 20 aa, synthetic construct
  source 1..20: note = Seed: SATGFKQSSKALQRPVASDF
SATGWKQTSPALIRPVASDF

SEQ ID NO: 19437 - protein, 20 aa, synthetic construct
  source 1..20: note = Seed: SATGFKQSSKALQRPVASDF
SATGWKQTSPALLRPVASDF

SEQ ID NO: 19438 - protein, 20 aa, synthetic construct
  source 1..20: note = Seed: SATGFKQSSKALQRPVASDF
SATGWKQTSPALSRPVASDF

SEQ ID NO: 19439 - protein, 20 aa, synthetic construct
  source 1..20: note = Seed: SATGFKQSSKALQRPVASDF
SATGWKQTSPALVRPVASDF

SEQ ID NO: 19440 - protein, 20 aa, synthetic construct
  source 1..20: note = Seed: SATGFKQSSKALQRPVASDF
SATGWKQTSRALARPVASDF

SEQ ID NO: 19441 - protein, 20 aa, synthetic construct
  source 1..20: note = Seed: SATGFKQSSKALQRPVASDF
SATGWKQTSRALSRPVASDF

SEQ ID NO: 19442 - protein, 20 aa, synthetic construct
  source 1..20: note = Seed: SATGFKQSSKALQRPVASDF
SATGWKQTSSALARPVASDF

SEQ ID NO: 19443 - protein, 20 aa, synthetic construct
  source 1..20: note = Seed: SATGFKQSSKALQRPVASDF
SATGWKQTSSALIRPVASDF

SEQ ID NO: 19444 - protein, 20 aa, synthetic construct
  source 1..20: note = Seed: SATGFKQSSKALQRPVASDF
SATGWKQTSSALLRPVASDF

SEQ ID NO: 19445 - protein, 20 aa, synthetic construct
  source 1..20: note = Seed: SATGFKQSSKALQRPVASDF
SATGWKQTSSALSRPVASDF

SEQ ID NO: 19446 - protein, 20 aa, synthetic construct
  source 1..20: note = Seed: SATGFKQSSKALQRPVASDF
SATGWKQTSSALVRPVASDF

SEQ ID NO: 19447 - protein, 20 aa, synthetic construct
  source 1..20: note = Seed: SATGFKQSSKALQRPVASDF
SATGWKQTSTALARPVASDF

SEQ ID NO: 19448 - protein, 20 aa, synthetic construct
  source 1..20: note = Seed: SATGFKQSSKALQRPVASDF
SATGWKQTSTALNRPVASDF

SEQ ID NO: 19449 - protein, 20 aa, synthetic construct
  source 1..20: note = Seed: SATGFKQSSKALQRPVASDF
SATGWKQTSTALSRPVASDF

SEQ ID NO: 19450 - protein, 20 aa, synthetic construct
  source 1..20: note = Seed: SATGFKQSSKALQRPVASDF
SATGWKQTSVALARPVASDF

SEQ ID NO: 19451 - protein, 20 aa, synthetic construct
  source 1..20: note = Seed: SATGFKQSSKALQRPVASDF
SATGWKQTSVALIRPVASDF

SEQ ID NO: 19452 - protein, 20 aa, synthetic construct
  source 1..20: note = Seed: SATGFKQSSKALQRPVASDF
SATGWKQTSVALLRPVASDF

SEQ ID NO: 19453 - protein, 20 aa, synthetic construct
  source 1..20: note = Seed: SATGFKQSSKALQRPVASDF
SATGWKQTSVALNRPVASDF

SEQ ID NO: 19454 - protein, 20 aa, synthetic construct
  source 1..20: note = Seed: SATGFKQSSKALQRPVASDF
SATGWKQTSVALQRPVASDF

SEQ ID NO: 19455 - protein, 20 aa, synthetic construct
  source 1..20: note = Seed: SATGFKQSSKALQRPVASDF
SATGWKQTSVALSRPVASDF

SEQ ID NO: 19456 - protein, 20 aa, synthetic construct
  source 1..20: note = Seed: SATGFKQSSKALQRPVASDF
SATGWKQTSVALTRPVASDF

SEQ ID NO: 19457 - protein, 20 aa, synthetic construct
  source 1..20: note = Seed: SATGFKQSSKALQRPVASDF
SATGWKQTSVALVRPVASDF

SEQ ID NO: 19458 - protein, 20 aa, synthetic construct
  source 1..20: note = Seed: SATGFKQSSKALQRPVASDF
SATGWKQVSAALARPVASDF

SEQ ID NO: 19459 - protein, 20 aa, synthetic construct
  source 1..20: note = Seed: SATGFKQSSKALQRPVASDF
SATGWKQVSAALGRPVASDF

SEQ ID NO: 19460 - protein, 20 aa, synthetic construct
  source 1..20: note = Seed: SATGFKQSSKALQRPVASDF
SATGWKQVSAALHRPVASDF

SEQ ID NO: 19461 - protein, 20 aa, synthetic construct
  source 1..20: note = Seed: SATGFKQSSKALQRPVASDF
SATGWKQVSAALIRPVASDF

SEQ ID NO: 19462 - protein, 20 aa, synthetic construct
  source 1..20: note = Seed: SATGFKQSSKALQRPVASDF
SATGWKQVSAALLRPVASDF

SEQ ID NO: 19463 - protein, 20 aa, synthetic construct
  source 1..20: note = Seed: SATGFKQSSKALQRPVASDF
SATGWKQVSAALMRPVASDF

SEQ ID NO: 19464 - protein, 20 aa, synthetic construct
  source 1..20: note = Seed: SATGFKQSSKALQRPVASDF
SATGWKQVSAALNRPVASDF

SEQ ID NO: 19465 - protein, 20 aa, synthetic construct
  source 1..20: note = Seed: SATGFKQSSKALQRPVASDF
SATGWKQVSAALPRPVASDF

SEQ ID NO: 19466 - protein, 20 aa, synthetic construct
  source 1..20: note = Seed: SATGFKQSSKALQRPVASDF
SATGWKQVSAALQRPVASDF

SEQ ID NO: 19467 - protein, 20 aa, synthetic construct
  source 1..20: note = Seed: SATGFKQSSKALQRPVASDF
SATGWKQVSAALSRPVASDF

SEQ ID NO: 19468 - protein, 20 aa, synthetic construct
  source 1..20: note = Seed: SATGFKQSSKALQRPVASDF
SATGWKQVSAALTRPVASDF

SEQ ID NO: 19469 - protein, 20 aa, synthetic construct
  source 1..20: note = Seed: SATGFKQSSKALQRPVASDF
SATGWKQVSAALVRPVASDF

SEQ ID NO: 19470 - protein, 20 aa, synthetic construct
  source 1..20: note = Seed: SATGFKQSSKALQRPVASDF
SATGWKQVSFALARPVASDF

SEQ ID NO: 19471 - protein, 20 aa, synthetic construct
  source 1..20: note = Seed: SATGFKQSSKALQRPVASDF
SATGWKQVSFALERPVASDF

SEQ ID NO: 19472 - protein, 20 aa, synthetic construct
  source 1..20: note = Seed: SATGFKQSSKALQRPVASDF
SATGWKQVSFALIRPVASDF

SEQ ID NO: 19473 - protein, 20 aa, synthetic construct
  source 1..20: note = Seed: SATGFKQSSKALQRPVASDF
SATGWKQVSFALLRPVASDF

SEQ ID NO: 19474 - protein, 20 aa, synthetic construct
  source 1..20: note = Seed: SATGFKQSSKALQRPVASDF
SATGWKQVSFALMRPVASDF

SEQ ID NO: 19475 - protein, 20 aa, synthetic construct
  source 1..20: note = Seed: SATGFKQSSKALQRPVASDF
SATGWKQVSFALSRPVASDF

SEQ ID NO: 19476 - protein, 20 aa, synthetic construct
  source 1..20: note = Seed: SATGFKQSSKALQRPVASDF
SATGWKQVSFALTRPVASDF

SEQ ID NO: 19477 - protein, 20 aa, synthetic construct
  source 1..20: note = Seed: SATGFKQSSKALQRPVASDF
SATGWKQVSFALVRPVASDF

SEQ ID NO: 19478 - protein, 20 aa, synthetic construct
  source 1..20: note = Seed: SATGFKQSSKALQRPVASDF
SATGWKQVSGALARPVASDF

SEQ ID NO: 19479 - protein, 20 aa, synthetic construct
  source 1..20: note = Seed: SATGFKQSSKALQRPVASDF
SATGWKQVSGALGRPVASDF

SEQ ID NO: 19480 - protein, 20 aa, synthetic construct
  source 1..20: note = Seed: SATGFKQSSKALQRPVASDF
SATGWKQVSGALIRPVASDF

SEQ ID NO: 19481 - protein, 20 aa, synthetic construct
  source 1..20: note = Seed: SATGFKQSSKALQRPVASDF
SATGWKQVSGALLRPVASDF

SEQ ID NO: 19482 - protein, 20 aa, synthetic construct
  source 1..20: note = Seed: SATGFKQSSKALQRPVASDF
SATGWKQVSGALMRPVASDF

SEQ ID NO: 19483 - protein, 20 aa, synthetic construct
  source 1..20: note = Seed: SATGFKQSSKALQRPVASDF
SATGWKQVSGALNRPVASDF

SEQ ID NO: 19484 - protein, 20 aa, synthetic construct
  source 1..20: note = Seed: SATGFKQSSKALQRPVASDF
SATGWKQVSGALSRPVASDF

SEQ ID NO: 19485 - protein, 20 aa, synthetic construct
  source 1..20: note = Seed: SATGFKQSSKALQRPVASDF
SATGWKQVSGALTRPVASDF

SEQ ID NO: 19486 - protein, 20 aa, synthetic construct
  source 1..20: note = Seed: SATGFKQSSKALQRPVASDF
SATGWKQVSGALVRPVASDF

SEQ ID NO: 19487 - protein, 20 aa, synthetic construct
  source 1..20: note = Seed: SATGFKQSSKALQRPVASDF
SATGWKQVSHALARPVASDF

SEQ ID NO: 19488 - protein, 20 aa, synthetic construct
  source 1..20: note = Seed: SATGFKQSSKALQRPVASDF
SATGWKQVSHALVRPVASDF

SEQ ID NO: 19489 - protein, 20 aa, synthetic construct
  source 1..20: note = Seed: SATGFKQSSKALQRPVASDF
SATGWKQVSIALARPVASDF

SEQ ID NO: 19490 - protein, 20 aa, synthetic construct
  source 1..20: note = Seed: SATGFKQSSKALQRPVASDF
SATGWKQVSIALGRPVASDF

SEQ ID NO: 19491 - protein, 20 aa, synthetic construct
  source 1..20: note = Seed: SATGFKQSSKALQRPVASDF
SATGWKQVSIALHRPVASDF

SEQ ID NO: 19492 - protein, 20 aa, synthetic construct
  source 1..20: note = Seed: SATGFKQSSKALQRPVASDF
SATGWKQVSIALNRPVASDF

SEQ ID NO: 19493 - protein, 20 aa, synthetic construct
  source 1..20: note = Seed: SATGFKQSSKALQRPVASDF
SATGWKQVSIALSRPVASDF

SEQ ID NO: 19494 - protein, 20 aa, synthetic construct
  source 1..20: note = Seed: SATGFKQSSKALQRPVASDF
SATGWKQVSIALTRPVASDF

SEQ ID NO: 19495 - protein, 20 aa, synthetic construct
  source 1..20: note = Seed: SATGFKQSSKALQRPVASDF
SATGWKQVSIALVRPVASDF

SEQ ID NO: 19496 - protein, 20 aa, synthetic construct
  source 1..20: note = Seed: SATGFKQSSKALQRPVASDF
SATGWKQVSKALARPVASDF

SEQ ID NO: 19497 - protein, 20 aa, synthetic construct
  source 1..20: note = Seed: SATGFKQSSKALQRPVASDF
SATGWKQVSKALGRPVASDF

SEQ ID NO: 19498 - protein, 20 aa, synthetic construct
  source 1..20: note = Seed: SATGFKQSSKALQRPVASDF
SATGWKQVSKALHRPVASDF

SEQ ID NO: 19499 - protein, 20 aa, synthetic construct
  source 1..20: note = Seed: SATGFKQSSKALQRPVASDF
SATGWKQVSKALKRPVASDF

SEQ ID NO: 19500 - protein, 20 aa, synthetic construct
  source 1..20: note = Seed: SATGFKQSSKALQRPVASDF
SATGWKQVSKALNRPVASDF

SEQ ID NO: 19501 - protein, 20 aa, synthetic construct
  source 1..20: note = Seed: SATGFKQSSKALQRPVASDF
SATGWKQVSKALQRPVASDF

SEQ ID NO: 19502 - protein, 20 aa, synthetic construct
  source 1..20: note = Seed: SATGFKQSSKALQRPVASDF
SATGWKQVSKALRRPVASDF

SEQ ID NO: 19503 - protein, 20 aa, synthetic construct
  source 1..20: note = Seed: SATGFKQSSKALQRPVASDF
SATGWKQVSKALSRPVASDF

SEQ ID NO: 19504 - protein, 20 aa, synthetic construct
  source 1..20: note = Seed: SATGFKQSSKALQRPVASDF
SATGWKQVSKALTRPVASDF

SEQ ID NO: 19505 - protein, 20 aa, synthetic construct
  source 1..20: note = Seed: SATGFKQSSKALQRPVASDF
SATGWKQVSLALGRPVASDF

SEQ ID NO: 19506 - protein, 20 aa, synthetic construct
  source 1..20: note = Seed: SATGFKQSSKALQRPVASDF
SATGWKQVSLALHRPVASDF

SEQ ID NO: 19507 - protein, 20 aa, synthetic construct
  source 1..20: note = Seed: SATGFKQSSKALQRPVASDF
SATGWKQVSLALNRPVASDF

SEQ ID NO: 19508 - protein, 20 aa, synthetic construct
  source 1..20: note = Seed: SATGFKQSSKALQRPVASDF
SATGWKQVSLALSRPVASDF

SEQ ID NO: 19509 - protein, 20 aa, synthetic construct
  source 1..20: note = Seed: SATGFKQSSKALQRPVASDF
SATGWKQVSMALGRPVASDF

SEQ ID NO: 19510 - protein, 20 aa, synthetic construct
  source 1..20: note = Seed: SATGFKQSSKALQRPVASDF
SATGWKQVSMALHRPVASDF

SEQ ID NO: 19511 - protein, 20 aa, synthetic construct
  source 1..20: note = Seed: SATGFKQSSKALQRPVASDF
SATGWKQVSMALNRPVASDF

SEQ ID NO: 19512 - protein, 20 aa, synthetic construct
  source 1..20: note = Seed: SATGFKQSSKALQRPVASDF
SATGWKQVSMALSRPVASDF

SEQ ID NO: 19513 - protein, 20 aa, synthetic construct
  source 1..20: note = Seed: SATGFKQSSKALQRPVASDF
SATGWKQVSNALARPVASDF

SEQ ID NO: 19514 - protein, 20 aa, synthetic construct
  source 1..20: note = Seed: SATGFKQSSKALQRPVASDF
SATGWKQVSNALIRPVASDF

SEQ ID NO: 19515 - protein, 20 aa, synthetic construct
  source 1..20: note = Seed: SATGFKQSSKALQRPVASDF
SATGWKQVSNALLRPVASDF

SEQ ID NO: 19516 - protein, 20 aa, synthetic construct
  source 1..20: note = Seed: SATGFKQSSKALQRPVASDF
SATGWKQVSNALNRPVASDF

SEQ ID NO: 19517 - protein, 20 aa, synthetic construct
  source 1..20: note = Seed: SATGFKQSSKALQRPVASDF
SATGWKQVSNALSRPVASDF

SEQ ID NO: 19518 - protein, 20 aa, synthetic construct
  source 1..20: note = Seed: SATGFKQSSKALQRPVASDF
SATGWKQVSNALVRPVASDF

SEQ ID NO: 19519 - protein, 20 aa, synthetic construct
  source 1..20: note = Seed: SATGFKQSSKALQRPVASDF
SATGWKQVSPALARPVASDF

SEQ ID NO: 19520 - protein, 20 aa, synthetic construct
  source 1..20: note = Seed: SATGFKQSSKALQRPVASDF
SATGWKQVSPALGRPVASDF

SEQ ID NO: 19521 - protein, 20 aa, synthetic construct
  source 1..20: note = Seed: SATGFKQSSKALQRPVASDF
SATGWKQVSPALHRPVASDF

SEQ ID NO: 19522 - protein, 20 aa, synthetic construct
  source 1..20: note = Seed: SATGFKQSSKALQRPVASDF
SATGWKQVSPALIRPVASDF

SEQ ID NO: 19523 - protein, 20 aa, synthetic construct
  source 1..20: note = Seed: SATGFKQSSKALQRPVASDF
SATGWKQVSPALLRPVASDF

SEQ ID NO: 19524 - protein, 20 aa, synthetic construct
  source 1..20: note = Seed: SATGFKQSSKALQRPVASDF
SATGWKQVSPALMRPVASDF

SEQ ID NO: 19525 - protein, 20 aa, synthetic construct
  source 1..20: note = Seed: SATGFKQSSKALQRPVASDF
SATGWKQVSPALNRPVASDF

SEQ ID NO: 19526 - protein, 20 aa, synthetic construct
  source 1..20: note = Seed: SATGFKQSSKALQRPVASDF
SATGWKQVSPALQRPVASDF

SEQ ID NO: 19527 - protein, 20 aa, synthetic construct
  source 1..20: note = Seed: SATGFKQSSKALQRPVASDF
SATGWKQVSPALSRPVASDF

SEQ ID NO: 19528 - protein, 20 aa, synthetic construct
  source 1..20: note = Seed: SATGFKQSSKALQRPVASDF
SATGWKQVSPALTRPVASDF

SEQ ID NO: 19529 - protein, 20 aa, synthetic construct
  source 1..20: note = Seed: SATGFKQSSKALQRPVASDF
SATGWKQVSPALVRPVASDF

SEQ ID NO: 19530 - protein, 20 aa, synthetic construct
  source 1..20: note = Seed: SATGFKQSSKALQRPVASDF
SATGWKQVSRALARPVASDF

SEQ ID NO: 19531 - protein, 20 aa, synthetic construct
  source 1..20: note = Seed: SATGFKQSSKALQRPVASDF
SATGWKQVSRALGRPVASDF

SEQ ID NO: 19532 - protein, 20 aa, synthetic construct
  source 1..20: note = Seed: SATGFKQSSKALQRPVASDF
SATGWKQVSRALHRPVASDF

SEQ ID NO: 19533 - protein, 20 aa, synthetic construct
  source 1..20: note = Seed: SATGFKQSSKALQRPVASDF
SATGWKQVSRALKRPVASDF

SEQ ID NO: 19534 - protein, 20 aa, synthetic construct
  source 1..20: note = Seed: SATGFKQSSKALQRPVASDF
SATGWKQVSRALMRPVASDF

SEQ ID NO: 19535 - protein, 20 aa, synthetic construct
  source 1..20: note = Seed: SATGFKQSSKALQRPVASDF
SATGWKQVSRALNRPVASDF

SEQ ID NO: 19536 - protein, 20 aa, synthetic construct
  source 1..20: note = Seed: SATGFKQSSKALQRPVASDF
SATGWKQVSRALQRPVASDF

SEQ ID NO: 19537 - protein, 20 aa, synthetic construct
  source 1..20: note = Seed: SATGFKQSSKALQRPVASDF
SATGWKQVSRALRRPVASDF

SEQ ID NO: 19538 - protein, 20 aa, synthetic construct
  source 1..20: note = Seed: SATGFKQSSKALQRPVASDF
SATGWKQVSRALSRPVASDF

SEQ ID NO: 19539 - protein, 20 aa, synthetic construct
  source 1..20: note = Seed: SATGFKQSSKALQRPVASDF
SATGWKQVSRALTRPVASDF

SEQ ID NO: 19540 - protein, 20 aa, synthetic construct
  source 1..20: note = Seed: SATGFKQSSKALQRPVASDF
SATGWKQVSRALVRPVASDF

SEQ ID NO: 19541 - protein, 20 aa, synthetic construct
  source 1..20: note = Seed: SATGFKQSSKALQRPVASDF
SATGWKQVSSALARPVASDF

SEQ ID NO: 19542 - protein, 20 aa, synthetic construct
  source 1..20: note = Seed: SATGFKQSSKALQRPVASDF
SATGWKQVSSALGRPVASDF

SEQ ID NO: 19543 - protein, 20 aa, synthetic construct
  source 1..20: note = Seed: SATGFKQSSKALQRPVASDF
SATGWKQVSSALIRPVASDF

SEQ ID NO: 19544 - protein, 20 aa, synthetic construct
  source 1..20: note = Seed: SATGFKQSSKALQRPVASDF
SATGWKQVSSALLRPVASDF

SEQ ID NO: 19545 - protein, 20 aa, synthetic construct
  source 1..20: note = Seed: SATGFKQSSKALQRPVASDF
SATGWKQVSSALMRPVASDF

SEQ ID NO: 19546 - protein, 20 aa, synthetic construct
  source 1..20: note = Seed: SATGFKQSSKALQRPVASDF
SATGWKQVSSALNRPVASDF

SEQ ID NO: 19547 - protein, 20 aa, synthetic construct
  source 1..20: note = Seed: SATGFKQSSKALQRPVASDF
SATGWKQVSSALSRPVASDF

SEQ ID NO: 19548 - protein, 20 aa, synthetic construct
  source 1..20: note = Seed: SATGFKQSSKALQRPVASDF
SATGWKQVSSALTRPVASDF

SEQ ID NO: 19549 - protein, 20 aa, synthetic construct
  source 1..20: note = Seed: SATGFKQSSKALQRPVASDF
SATGWKQVSSALVRPVASDF

SEQ ID NO: 19550 - protein, 20 aa, synthetic construct
  source 1..20: note = Seed: SATGFKQSSKALQRPVASDF
SATGWKQVSTALARPVASDF

SEQ ID NO: 19551 - protein, 20 aa, synthetic construct
  source 1..20: note = Seed: SATGFKQSSKALQRPVASDF
SATGWKQVSTALGRPVASDF

SEQ ID NO: 19552 - protein, 20 aa, synthetic construct
  source 1..20: note = Seed: SATGFKQSSKALQRPVASDF
SATGWKQVSTALHRPVASDF

SEQ ID NO: 19553 - protein, 20 aa, synthetic construct
  source 1..20: note = Seed: SATGFKQSSKALQRPVASDF
SATGWKQVSTALIRPVASDF

SEQ ID NO: 19554 - protein, 20 aa, synthetic construct
  source 1..20: note = Seed: SATGFKQSSKALQRPVASDF
SATGWKQVSTALLRPVASDF

SEQ ID NO: 19555 - protein, 20 aa, synthetic construct
  source 1..20: note = Seed: SATGFKQSSKALQRPVASDF
SATGWKQVSTALMRPVASDF

SEQ ID NO: 19556 - protein, 20 aa, synthetic construct
  source 1..20: note = Seed: SATGFKQSSKALQRPVASDF
SATGWKQVSTALNRPVASDF

SEQ ID NO: 19557 - protein, 20 aa, synthetic construct
  source 1..20: note = Seed: SATGFKQSSKALQRPVASDF
SATGWKQVSTALQRPVASDF

SEQ ID NO: 19558 - protein, 20 aa, synthetic construct
  source 1..20: note = Seed: SATGFKQSSKALQRPVASDF
SATGWKQVSTALSRPVASDF

SEQ ID NO: 19559 - protein, 20 aa, synthetic construct
  source 1..20: note = Seed: SATGFKQSSKALQRPVASDF
SATGWKQVSTALTRPVASDF

SEQ ID NO: 19560 - protein, 20 aa, synthetic construct
  source 1..20: note = Seed: SATGFKQSSKALQRPVASDF
SATGWKQVSTALVRPVASDF

SEQ ID NO: 19561 - protein, 20 aa, synthetic construct
  source 1..20: note = Seed: SATGFKQSSKALQRPVASDF
SATGWKQVSVALARPVASDF

SEQ ID NO: 19562 - protein, 20 aa, synthetic construct
  source 1..20: note = Seed: SATGFKQSSKALQRPVASDF
SATGWKQVSVALFRPVASDF

SEQ ID NO: 19563 - protein, 20 aa, synthetic construct
  source 1..20: note = Seed: SATGFKQSSKALQRPVASDF
SATGWKQVSVALGRPVASDF

SEQ ID NO: 19564 - protein, 20 aa, synthetic construct
  source 1..20: note = Seed: SATGFKQSSKALQRPVASDF
SATGWKQVSVALHRPVASDF

SEQ ID NO: 19565 - protein, 20 aa, synthetic construct
  source 1..20: note = Seed: SATGFKQSSKALQRPVASDF
SATGWKQVSVALIRPVASDF

SEQ ID NO: 19566 - protein, 20 aa, synthetic construct
  source 1..20: note = Seed: SATGFKQSSKALQRPVASDF
SATGWKQVSVALLRPVASDF

SEQ ID NO: 19567 - protein, 20 aa, synthetic construct
  source 1..20: note = Seed: SATGFKQSSKALQRPVASDF
SATGWKQVSVALMRPVASDF

SEQ ID NO: 19568 - protein, 20 aa, synthetic construct
  source 1..20: note = Seed: SATGFKQSSKALQRPVASDF
SATGWKQVSVALNRPVASDF

SEQ ID NO: 19569 - protein, 20 aa, synthetic construct
  source 1..20: note = Seed: SATGFKQSSKALQRPVASDF
SATGWKQVSVALPRPVASDF

SEQ ID NO: 19570 - protein, 20 aa, synthetic construct
  source 1..20: note = Seed: SATGFKQSSKALQRPVASDF
SATGWKQVSVALQRPVASDF

SEQ ID NO: 19571 - protein, 20 aa, synthetic construct
  source 1..20: note = Seed: SATGFKQSSKALQRPVASDF
SATGWKQVSVALSRPVASDF

SEQ ID NO: 19572 - protein, 20 aa, synthetic construct
  source 1..20: note = Seed: SATGFKQSSKALQRPVASDF
SATGWKQVSVALTRPVASDF

SEQ ID NO: 19573 - protein, 20 aa, synthetic construct
  source 1..20: note = Seed: SATGFKQSSKALQRPVASDF
SATGWKQVSVALVRPVASDF

SEQ ID NO: 19574 - protein, 20 aa, synthetic construct
  source 1..20: note = Seed: SATGFKQSSKALQRPVASDF
SATGWKQVSYALIRPVASDF

SEQ ID NO: 19575 - protein, 20 aa, synthetic construct
  source 1..20: note = Seed: SATGFKQSSKALQRPVASDF
SATGWKQWSAALGRPVASDF

SEQ ID NO: 19576 - protein, 20 aa, synthetic construct
  source 1..20: note = Seed: SATGFKQSSKALQRPVASDF
SATGWKQWSAALIRPVASDF

SEQ ID NO: 19577 - protein, 20 aa, synthetic construct
  source 1..20: note = Seed: SATGFKQSSKALQRPVASDF
SATGWKQWSAALLRPVASDF

SEQ ID NO: 19578 - protein, 20 aa, synthetic construct
  source 1..20: note = Seed: SATGFKQSSKALQRPVASDF
SATGWKQWSAALMRPVASDF

SEQ ID NO: 19579 - protein, 20 aa, synthetic construct
  source 1..20: note = Seed: SATGFKQSSKALQRPVASDF
SATGWKQWSAALNRPVASDF

SEQ ID NO: 19580 - protein, 20 aa, synthetic construct
  source 1..20: note = Seed: SATGFKQSSKALQRPVASDF
SATGWKQWSAALSRPVASDF

SEQ ID NO: 19581 - protein, 20 aa, synthetic construct
  source 1..20: note = Seed: SATGFKQSSKALQRPVASDF
SATGWKQWSAALVRPVASDF

SEQ ID NO: 19582 - protein, 20 aa, synthetic construct
  source 1..20: note = Seed: SATGFKQSSKALQRPVASDF
SATGWKQWSFALVRPVASDF

SEQ ID NO: 19583 - protein, 20 aa, synthetic construct
  source 1..20: note = Seed: SATGFKQSSKALQRPVASDF
SATGWKQWSGALIRPVASDF

SEQ ID NO: 19584 - protein, 20 aa, synthetic construct
  source 1..20: note = Seed: SATGFKQSSKALQRPVASDF
SATGWKQWSGALTRPVASDF

SEQ ID NO: 19585 - protein, 20 aa, synthetic construct
  source 1..20: note = Seed: SATGFKQSSKALQRPVASDF
SATGWKQWSGALVRPVASDF

SEQ ID NO: 19586 - protein, 20 aa, synthetic construct
  source 1..20: note = Seed: SATGFKQSSKALQRPVASDF
SATGWKQWSIALHRPVASDF

SEQ ID NO: 19587 - protein, 20 aa, synthetic construct
  source 1..20: note = Seed: SATGFKQSSKALQRPVASDF
SATGWKQWSKALKRPVASDF

SEQ ID NO: 19588 - protein, 20 aa, synthetic construct
  source 1..20: note = Seed: SATGFKQSSKALQRPVASDF
SATGWKQWSKALRRPVASDF

SEQ ID NO: 19589 - protein, 20 aa, synthetic construct
  source 1..20: note = Seed: SATGFKQSSKALQRPVASDF
SATGWKQWSLALMRPVASDF

SEQ ID NO: 19590 - protein, 20 aa, synthetic construct
  source 1..20: note = Seed: SATGFKQSSKALQRPVASDF
SATGWKQWSLALVRPVASDF

SEQ ID NO: 19591 - protein, 20 aa, synthetic construct
  source 1..20: note = Seed: SATGFKQSSKALQRPVASDF
SATGWKQWSNALVRPVASDF

SEQ ID NO: 19592 - protein, 20 aa, synthetic construct
  source 1..20: note = Seed: SATGFKQSSKALQRPVASDF
SATGWKQWSPALARPVASDF

SEQ ID NO: 19593 - protein, 20 aa, synthetic construct
  source 1..20: note = Seed: SATGFKQSSKALQRPVASDF
SATGWKQWSPALIRPVASDF

SEQ ID NO: 19594 - protein, 20 aa, synthetic construct
  source 1..20: note = Seed: SATGFKQSSKALQRPVASDF
SATGWKQWSPALLRPVASDF

SEQ ID NO: 19595 - protein, 20 aa, synthetic construct
  source 1..20: note = Seed: SATGFKQSSKALQRPVASDF
SATGWKQWSPALMRPVASDF

SEQ ID NO: 19596 - protein, 20 aa, synthetic construct
  source 1..20: note = Seed: SATGFKQSSKALQRPVASDF
SATGWKQWSPALNRPVASDF

SEQ ID NO: 19597 - protein, 20 aa, synthetic construct
  source 1..20: note = Seed: SATGFKQSSKALQRPVASDF
SATGWKQWSPALSRPVASDF

SEQ ID NO: 19598 - protein, 20 aa, synthetic construct
  source 1..20: note = Seed: SATGFKQSSKALQRPVASDF
SATGWKQWSPALVRPVASDF

SEQ ID NO: 19599 - protein, 20 aa, synthetic construct
  source 1..20: note = Seed: SATGFKQSSKALQRPVASDF
SATGWKQWSRALKRPVASDF

SEQ ID NO: 19600 - protein, 20 aa, synthetic construct
  source 1..20: note = Seed: SATGFKQSSKALQRPVASDF
SATGWKQWSRALRRPVASDF

SEQ ID NO: 19601 - protein, 20 aa, synthetic construct
  source 1..20: note = Seed: SATGFKQSSKALQRPVASDF
SATGWKQWSSALIRPVASDF

SEQ ID NO: 19602 - protein, 20 aa, synthetic construct
  source 1..20: note = Seed: SATGFKQSSKALQRPVASDF
SATGWKQWSSALLRPVASDF

SEQ ID NO: 19603 - protein, 20 aa, synthetic construct
  source 1..20: note = Seed: SATGFKQSSKALQRPVASDF
SATGWKQWSSALMRPVASDF

SEQ ID NO: 19604 - protein, 20 aa, synthetic construct
  source 1..20: note = Seed: SATGFKQSSKALQRPVASDF
SATGWKQWSSALNRPVASDF

SEQ ID NO: 19605 - protein, 20 aa, synthetic construct
  source 1..20: note = Seed: SATGFKQSSKALQRPVASDF
SATGWKQWSSALVRPVASDF

SEQ ID NO: 19606 - protein, 20 aa, synthetic construct
  source 1..20: note = Seed: SATGFKQSSKALQRPVASDF
SATGWKQWSTALGRPVASDF

SEQ ID NO: 19607 - protein, 20 aa, synthetic construct
  source 1..20: note = Seed: SATGFKQSSKALQRPVASDF
SATGWKQWSTALIRPVASDF

SEQ ID NO: 19608 - protein, 20 aa, synthetic construct
  source 1..20: note = Seed: SATGFKQSSKALQRPVASDF
SATGWKQWSTALMRPVASDF

SEQ ID NO: 19609 - protein, 20 aa, synthetic construct
  source 1..20: note = Seed: SATGFKQSSKALQRPVASDF
SATGWKQWSTALNRPVASDF

SEQ ID NO: 19610 - protein, 20 aa, synthetic construct
  source 1..20: note = Seed: SATGFKQSSKALQRPVASDF
SATGWKQWSTALSRPVASDF

SEQ ID NO: 19611 - protein, 20 aa, synthetic construct
  source 1..20: note = Seed: SATGFKQSSKALQRPVASDF
SATGWKQWSTALVRPVASDF

SEQ ID NO: 19612 - protein, 20 aa, synthetic construct
  source 1..20: note = Seed: SATGFKQSSKALQRPVASDF
SATGWKQWSVALERPVASDF

SEQ ID NO: 19613 - protein, 20 aa, synthetic construct
  source 1..20: note = Seed: SATGFKQSSKALQRPVASDF
SATGWKQWSVALGRPVASDF

SEQ ID NO: 19614 - protein, 20 aa, synthetic construct
  source 1..20: note = Seed: SATGFKQSSKALQRPVASDF
SATGWKQWSVALHRPVASDF

SEQ ID NO: 19615 - protein, 20 aa, synthetic construct
  source 1..20: note = Seed: SATGFKQSSKALQRPVASDF
SATGWKQWSVALLRPVASDF

SEQ ID NO: 19616 - protein, 20 aa, synthetic construct
  source 1..20: note = Seed: SATGFKQSSKALQRPVASDF
SATGWKQWSVALMRPVASDF

SEQ ID NO: 19617 - protein, 20 aa, synthetic construct
  source 1..20: note = Seed: SATGFKQSSKALQRPVASDF
SATGWKQWSVALNRPVASDF

SEQ ID NO: 19618 - protein, 20 aa, synthetic construct
  source 1..20: note = Seed: SATGFKQSSKALQRPVASDF
SATGWKQWSVALQRPVASDF

SEQ ID NO: 19619 - protein, 20 aa, synthetic construct
  source 1..20: note = Seed: SATGFKQSSKALQRPVASDF
SATGWKQYSAALLRPVASDF

SEQ ID NO: 19620 - protein, 20 aa, synthetic construct
  source 1..20: note = Seed: SATGFKQSSKALQRPVASDF
SATGWKQYSAALMRPVASDF

SEQ ID NO: 19621 - protein, 20 aa, synthetic construct
  source 1..20: note = Seed: SATGFKQSSKALQRPVASDF
SATGWKQYSGALIRPVASDF

SEQ ID NO: 19622 - protein, 20 aa, synthetic construct
  source 1..20: note = Seed: SATGFKQSSKALQRPVASDF
SATGWKQYSKALKRPVASDF

SEQ ID NO: 19623 - protein, 20 aa, synthetic construct
  source 1..20: note = Seed: SATGFKQSSKALQRPVASDF
SATGWKQYSKALRRPVASDF

SEQ ID NO: 19624 - protein, 20 aa, synthetic construct
  source 1..20: note = Seed: SATGFKQSSKALQRPVASDF
SATGWKQYSRALARPVASDF

SEQ ID NO: 19625 - protein, 20 aa, synthetic construct
  source 1..20: note = Seed: SATGFKQSSKALQRPVASDF
SATGWKQYSRALRRPVASDF

SEQ ID NO: 19626 - protein, 20 aa, synthetic construct
  source 1..20: note = Seed: SATGFKQSSKALQRPVASDF
SATGWKQYSSALARPVASDF

SEQ ID NO: 19627 - protein, 20 aa, synthetic construct
  source 1..20: note = Seed: SATGFKQSSKALQRPVASDF
SATGWKQYSSALGRPVASDF

SEQ ID NO: 19628 - protein, 20 aa, synthetic construct
  source 1..20: note = Seed: SATGFKQSSKALQRPVASDF
SATGWKQYSSALLRPVASDF

SEQ ID NO: 19629 - protein, 20 aa, synthetic construct
  source 1..20: note = Seed: SATGFKQSSKALQRPVASDF
SATGWKQYSTALARPVASDF

SEQ ID NO: 19630 - protein, 20 aa, synthetic construct
  source 1..20: note = Seed: SATGFKQSSKALQRPVASDF
SATGYKQASAALARPVASDF

SEQ ID NO: 19631 - protein, 20 aa, synthetic construct
  source 1..20: note = Seed: SATGFKQSSKALQRPVASDF
SATGYKQASAALCRPVASDF

SEQ ID NO: 19632 - protein, 20 aa, synthetic construct
  source 1..20: note = Seed: SATGFKQSSKALQRPVASDF
SATGYKQASAALDRPVASDF

SEQ ID NO: 19633 - protein, 20 aa, synthetic construct
  source 1..20: note = Seed: SATGFKQSSKALQRPVASDF
SATGYKQASAALERPVASDF

SEQ ID NO: 19634 - protein, 20 aa, synthetic construct
  source 1..20: note = Seed: SATGFKQSSKALQRPVASDF
SATGYKQASAALFRPVASDF

SEQ ID NO: 19635 - protein, 20 aa, synthetic construct
  source 1..20: note = Seed: SATGFKQSSKALQRPVASDF
SATGYKQASAALGRPVASDF

SEQ ID NO: 19636 - protein, 20 aa, synthetic construct
  source 1..20: note = Seed: SATGFKQSSKALQRPVASDF
SATGYKQASAALHRPVASDF

SEQ ID NO: 19637 - protein, 20 aa, synthetic construct
  source 1..20: note = Seed: SATGFKQSSKALQRPVASDF
SATGYKQASAALIRPVASDF

SEQ ID NO: 19638 - protein, 20 aa, synthetic construct
  source 1..20: note = Seed: SATGFKQSSKALQRPVASDF
SATGYKQASAALKRPVASDF

SEQ ID NO: 19639 - protein, 20 aa, synthetic construct
  source 1..20: note = Seed: SATGFKQSSKALQRPVASDF
SATGYKQASAALLRPVASDF

SEQ ID NO: 19640 - protein, 20 aa, synthetic construct
  source 1..20: note = Seed: SATGFKQSSKALQRPVASDF
SATGYKQASAALMRPVASDF

SEQ ID NO: 19641 - protein, 20 aa, synthetic construct
  source 1..20: note = Seed: SATGFKQSSKALQRPVASDF
SATGYKQASAALNRPVASDF

SEQ ID NO: 19642 - protein, 20 aa, synthetic construct
  source 1..20: note = Seed: SATGFKQSSKALQRPVASDF
SATGYKQASAALPRPVASDF

SEQ ID NO: 19643 - protein, 20 aa, synthetic construct
  source 1..20: note = Seed: SATGFKQSSKALQRPVASDF
SATGYKQASAALQRPVASDF

SEQ ID NO: 19644 - protein, 20 aa, synthetic construct
  source 1..20: note = Seed: SATGFKQSSKALQRPVASDF
SATGYKQASAALRRPVASDF

SEQ ID NO: 19645 - protein, 20 aa, synthetic construct
  source 1..20: note = Seed: SATGFKQSSKALQRPVASDF
SATGYKQASAALSRPVASDF

SEQ ID NO: 19646 - protein, 20 aa, synthetic construct
  source 1..20: note = Seed: SATGFKQSSKALQRPVASDF
SATGYKQASAALTRPVASDF

SEQ ID NO: 19647 - protein, 20 aa, synthetic construct
  source 1..20: note = Seed: SATGFKQSSKALQRPVASDF
SATGYKQASAALVRPVASDF

SEQ ID NO: 19648 - protein, 20 aa, synthetic construct
  source 1..20: note = Seed: SATGFKQSSKALQRPVASDF
SATGYKQASAALWRPVASDF

SEQ ID NO: 19649 - protein, 20 aa, synthetic construct
  source 1..20: note = Seed: SATGFKQSSKALQRPVASDF
SATGYKQASAALYRPVASDF

SEQ ID NO: 19650 - protein, 20 aa, synthetic construct
  source 1..20: note = Seed: SATGFKQSSKALQRPVASDF
SATGYKQASCALARPVASDF

SEQ ID NO: 19651 - protein, 20 aa, synthetic construct
  source 1..20: note = Seed: SATGFKQSSKALQRPVASDF
SATGYKQASCALIRPVASDF

SEQ ID NO: 19652 - protein, 20 aa, synthetic construct
  source 1..20: note = Seed: SATGFKQSSKALQRPVASDF
SATGYKQASCALLRPVASDF

SEQ ID NO: 19653 - protein, 20 aa, synthetic construct
  source 1..20: note = Seed: SATGFKQSSKALQRPVASDF
SATGYKQASCALMRPVASDF

SEQ ID NO: 19654 - protein, 20 aa, synthetic construct
  source 1..20: note = Seed: SATGFKQSSKALQRPVASDF
SATGYKQASCALNRPVASDF

SEQ ID NO: 19655 - protein, 20 aa, synthetic construct
  source 1..20: note = Seed: SATGFKQSSKALQRPVASDF
SATGYKQASCALSRPVASDF

SEQ ID NO: 19656 - protein, 20 aa, synthetic construct
  source 1..20: note = Seed: SATGFKQSSKALQRPVASDF
SATGYKQASCALVRPVASDF

SEQ ID NO: 19657 - protein, 20 aa, synthetic construct
  source 1..20: note = Seed: SATGFKQSSKALQRPVASDF
SATGYKQASEALARPVASDF

SEQ ID NO: 19658 - protein, 20 aa, synthetic construct
  source 1..20: note = Seed: SATGFKQSSKALQRPVASDF
SATGYKQASEALLRPVASDF

SEQ ID NO: 19659 - protein, 20 aa, synthetic construct
  source 1..20: note = Seed: SATGFKQSSKALQRPVASDF
SATGYKQASEALSRPVASDF

SEQ ID NO: 19660 - protein, 20 aa, synthetic construct
  source 1..20: note = Seed: SATGFKQSSKALQRPVASDF
SATGYKQASEALVRPVASDF

SEQ ID NO: 19661 - protein, 20 aa, synthetic construct
  source 1..20: note = Seed: SATGFKQSSKALQRPVASDF
SATGYKQASFALARPVASDF

SEQ ID NO: 19662 - protein, 20 aa, synthetic construct
  source 1..20: note = Seed: SATGFKQSSKALQRPVASDF
SATGYKQASFALDRPVASDF

SEQ ID NO: 19663 - protein, 20 aa, synthetic construct
  source 1..20: note = Seed: SATGFKQSSKALQRPVASDF
SATGYKQASFALERPVASDF

SEQ ID NO: 19664 - protein, 20 aa, synthetic construct
  source 1..20: note = Seed: SATGFKQSSKALQRPVASDF
SATGYKQASFALFRPVASDF

SEQ ID NO: 19665 - protein, 20 aa, synthetic construct
  source 1..20: note = Seed: SATGFKQSSKALQRPVASDF
SATGYKQASFALIRPVASDF

SEQ ID NO: 19666 - protein, 20 aa, synthetic construct
  source 1..20: note = Seed: SATGFKQSSKALQRPVASDF
SATGYKQASFALLRPVASDF

SEQ ID NO: 19667 - protein, 20 aa, synthetic construct
  source 1..20: note = Seed: SATGFKQSSKALQRPVASDF
SATGYKQASFALMRPVASDF

SEQ ID NO: 19668 - protein, 20 aa, synthetic construct
  source 1..20: note = Seed: SATGFKQSSKALQRPVASDF
SATGYKQASFALSRPVASDF

SEQ ID NO: 19669 - protein, 20 aa, synthetic construct
  source 1..20: note = Seed: SATGFKQSSKALQRPVASDF
SATGYKQASFALTRPVASDF

SEQ ID NO: 19670 - protein, 20 aa, synthetic construct
  source 1..20: note = Seed: SATGFKQSSKALQRPVASDF
SATGYKQASFALVRPVASDF

SEQ ID NO: 19671 - protein, 20 aa, synthetic construct
  source 1..20: note = Seed: SATGFKQSSKALQRPVASDF
SATGYKQASGALARPVASDF

SEQ ID NO: 19672 - protein, 20 aa, synthetic construct
  source 1..20: note = Seed: SATGFKQSSKALQRPVASDF
SATGYKQASGALCRPVASDF

SEQ ID NO: 19673 - protein, 20 aa, synthetic construct
  source 1..20: note = Seed: SATGFKQSSKALQRPVASDF
SATGYKQASGALDRPVASDF

SEQ ID NO: 19674 - protein, 20 aa, synthetic construct
  source 1..20: note = Seed: SATGFKQSSKALQRPVASDF
SATGYKQASGALERPVASDF

SEQ ID NO: 19675 - protein, 20 aa, synthetic construct
  source 1..20: note = Seed: SATGFKQSSKALQRPVASDF
SATGYKQASGALFRPVASDF

SEQ ID NO: 19676 - protein, 20 aa, synthetic construct
  source 1..20: note = Seed: SATGFKQSSKALQRPVASDF
SATGYKQASGALGRPVASDF

SEQ ID NO: 19677 - protein, 20 aa, synthetic construct
  source 1..20: note = Seed: SATGFKQSSKALQRPVASDF
SATGYKQASGALHRPVASDF

SEQ ID NO: 19678 - protein, 20 aa, synthetic construct
  source 1..20: note = Seed: SATGFKQSSKALQRPVASDF
SATGYKQASGALIRPVASDF

SEQ ID NO: 19679 - protein, 20 aa, synthetic construct
  source 1..20: note = Seed: SATGFKQSSKALQRPVASDF
SATGYKQASGALLRPVASDF

SEQ ID NO: 19680 - protein, 20 aa, synthetic construct
  source 1..20: note = Seed: SATGFKQSSKALQRPVASDF
SATGYKQASGALMRPVASDF

SEQ ID NO: 19681 - protein, 20 aa, synthetic construct
  source 1..20: note = Seed: SATGFKQSSKALQRPVASDF
SATGYKQASGALNRPVASDF

SEQ ID NO: 19682 - protein, 20 aa, synthetic construct
  source 1..20: note = Seed: SATGFKQSSKALQRPVASDF
SATGYKQASGALPRPVASDF

SEQ ID NO: 19683 - protein, 20 aa, synthetic construct
  source 1..20: note = Seed: SATGFKQSSKALQRPVASDF
SATGYKQASGALQRPVASDF

SEQ ID NO: 19684 - protein, 20 aa, synthetic construct
  source 1..20: note = Seed: SATGFKQSSKALQRPVASDF
SATGYKQASGALSRPVASDF

SEQ ID NO: 19685 - protein, 20 aa, synthetic construct
  source 1..20: note = Seed: SATGFKQSSKALQRPVASDF
SATGYKQASGALTRPVASDF

SEQ ID NO: 19686 - protein, 20 aa, synthetic construct
  source 1..20: note = Seed: SATGFKQSSKALQRPVASDF
SATGYKQASGALVRPVASDF

SEQ ID NO: 19687 - protein, 20 aa, synthetic construct
  source 1..20: note = Seed: SATGFKQSSKALQRPVASDF
SATGYKQASGALWRPVASDF

SEQ ID NO: 19688 - protein, 20 aa, synthetic construct
  source 1..20: note = Seed: SATGFKQSSKALQRPVASDF
SATGYKQASGALYRPVASDF

SEQ ID NO: 19689 - protein, 20 aa, synthetic construct
  source 1..20: note = Seed: SATGFKQSSKALQRPVASDF
SATGYKQASHALARPVASDF

SEQ ID NO: 19690 - protein, 20 aa, synthetic construct
  source 1..20: note = Seed: SATGFKQSSKALQRPVASDF
SATGYKQASHALIRPVASDF

SEQ ID NO: 19691 - protein, 20 aa, synthetic construct
  source 1..20: note = Seed: SATGFKQSSKALQRPVASDF
SATGYKQASHALLRPVASDF

SEQ ID NO: 19692 - protein, 20 aa, synthetic construct
  source 1..20: note = Seed: SATGFKQSSKALQRPVASDF
SATGYKQASHALMRPVASDF

SEQ ID NO: 19693 - protein, 20 aa, synthetic construct
  source 1..20: note = Seed: SATGFKQSSKALQRPVASDF
SATGYKQASHALNRPVASDF

SEQ ID NO: 19694 - protein, 20 aa, synthetic construct
  source 1..20: note = Seed: SATGFKQSSKALQRPVASDF
SATGYKQASHALSRPVASDF

SEQ ID NO: 19695 - protein, 20 aa, synthetic construct
  source 1..20: note = Seed: SATGFKQSSKALQRPVASDF
SATGYKQASHALVRPVASDF

SEQ ID NO: 19696 - protein, 20 aa, synthetic construct
  source 1..20: note = Seed: SATGFKQSSKALQRPVASDF
SATGYKQASIALARPVASDF

SEQ ID NO: 19697 - protein, 20 aa, synthetic construct
  source 1..20: note = Seed: SATGFKQSSKALQRPVASDF
SATGYKQASIALCRPVASDF

SEQ ID NO: 19698 - protein, 20 aa, synthetic construct
  source 1..20: note = Seed: SATGFKQSSKALQRPVASDF
SATGYKQASIALDRPVASDF

SEQ ID NO: 19699 - protein, 20 aa, synthetic construct
  source 1..20: note = Seed: SATGFKQSSKALQRPVASDF
SATGYKQASIALERPVASDF

SEQ ID NO: 19700 - protein, 20 aa, synthetic construct
  source 1..20: note = Seed: SATGFKQSSKALQRPVASDF
SATGYKQASIALFRPVASDF

SEQ ID NO: 19701 - protein, 20 aa, synthetic construct
  source 1..20: note = Seed: SATGFKQSSKALQRPVASDF
SATGYKQASIALGRPVASDF

SEQ ID NO: 19702 - protein, 20 aa, synthetic construct
  source 1..20: note = Seed: SATGFKQSSKALQRPVASDF
SATGYKQASIALHRPVASDF

SEQ ID NO: 19703 - protein, 20 aa, synthetic construct
  source 1..20: note = Seed: SATGFKQSSKALQRPVASDF
SATGYKQASIALIRPVASDF

SEQ ID NO: 19704 - protein, 20 aa, synthetic construct
  source 1..20: note = Seed: SATGFKQSSKALQRPVASDF
SATGYKQASIALKRPVASDF

SEQ ID NO: 19705 - protein, 20 aa, synthetic construct
  source 1..20: note = Seed: SATGFKQSSKALQRPVASDF
SATGYKQASIALNRPVASDF

SEQ ID NO: 19706 - protein, 20 aa, synthetic construct
  source 1..20: note = Seed: SATGFKQSSKALQRPVASDF
SATGYKQASIALPRPVASDF

SEQ ID NO: 19707 - protein, 20 aa, synthetic construct
  source 1..20: note = Seed: SATGFKQSSKALQRPVASDF
SATGYKQASIALQRPVASDF

SEQ ID NO: 19708 - protein, 20 aa, synthetic construct
  source 1..20: note = Seed: SATGFKQSSKALQRPVASDF
SATGYKQASIALRRPVASDF

SEQ ID NO: 19709 - protein, 20 aa, synthetic construct
  source 1..20: note = Seed: SATGFKQSSKALQRPVASDF
SATGYKQASIALSRPVASDF

SEQ ID NO: 19710 - protein, 20 aa, synthetic construct
  source 1..20: note = Seed: SATGFKQSSKALQRPVASDF
SATGYKQASIALTRPVASDF

SEQ ID NO: 19711 - protein, 20 aa, synthetic construct
  source 1..20: note = Seed: SATGFKQSSKALQRPVASDF
SATGYKQASIALVRPVASDF

SEQ ID NO: 19712 - protein, 20 aa, synthetic construct
  source 1..20: note = Seed: SATGFKQSSKALQRPVASDF
SATGYKQASIALYRPVASDF

SEQ ID NO: 19713 - protein, 20 aa, synthetic construct
  source 1..20: note = Seed: SATGFKQSSKALQRPVASDF
SATGYKQASKALARPVASDF

SEQ ID NO: 19714 - protein, 20 aa, synthetic construct
  source 1..20: note = Seed: SATGFKQSSKALQRPVASDF
SATGYKQASKALGRPVASDF

SEQ ID NO: 19715 - protein, 20 aa, synthetic construct
  source 1..20: note = Seed: SATGFKQSSKALQRPVASDF
SATGYKQASKALHRPVASDF

SEQ ID NO: 19716 - protein, 20 aa, synthetic construct
  source 1..20: note = Seed: SATGFKQSSKALQRPVASDF
SATGYKQASKALIRPVASDF

SEQ ID NO: 19717 - protein, 20 aa, synthetic construct
  source 1..20: note = Seed: SATGFKQSSKALQRPVASDF
SATGYKQASKALKRPVASDF

SEQ ID NO: 19718 - protein, 20 aa, synthetic construct
  source 1..20: note = Seed: SATGFKQSSKALQRPVASDF
SATGYKQASKALLRPVASDF

SEQ ID NO: 19719 - protein, 20 aa, synthetic construct
  source 1..20: note = Seed: SATGFKQSSKALQRPVASDF
SATGYKQASKALMRPVASDF

SEQ ID NO: 19720 - protein, 20 aa, synthetic construct
  source 1..20: note = Seed: SATGFKQSSKALQRPVASDF
SATGYKQASKALNRPVASDF

SEQ ID NO: 19721 - protein, 20 aa, synthetic construct
  source 1..20: note = Seed: SATGFKQSSKALQRPVASDF
SATGYKQASKALPRPVASDF

SEQ ID NO: 19722 - protein, 20 aa, synthetic construct
  source 1..20: note = Seed: SATGFKQSSKALQRPVASDF
SATGYKQASKALQRPVASDF

SEQ ID NO: 19723 - protein, 20 aa, synthetic construct
  source 1..20: note = Seed: SATGFKQSSKALQRPVASDF
SATGYKQASKALRRPVASDF

SEQ ID NO: 19724 - protein, 20 aa, synthetic construct
  source 1..20: note = Seed: SATGFKQSSKALQRPVASDF
SATGYKQASKALSRPVASDF

SEQ ID NO: 19725 - protein, 20 aa, synthetic construct
  source 1..20: note = Seed: SATGFKQSSKALQRPVASDF
SATGYKQASKALTRPVASDF

SEQ ID NO: 19726 - protein, 20 aa, synthetic construct
  source 1..20: note = Seed: SATGFKQSSKALQRPVASDF
SATGYKQASKALVRPVASDF

SEQ ID NO: 19727 - protein, 20 aa, synthetic construct
  source 1..20: note = Seed: SATGFKQSSKALQRPVASDF
SATGYKQASLALARPVASDF

SEQ ID NO: 19728 - protein, 20 aa, synthetic construct
  source 1..20: note = Seed: SATGFKQSSKALQRPVASDF
SATGYKQASLALCRPVASDF

SEQ ID NO: 19729 - protein, 20 aa, synthetic construct
  source 1..20: note = Seed: SATGFKQSSKALQRPVASDF
SATGYKQASLALDRPVASDF

SEQ ID NO: 19730 - protein, 20 aa, synthetic construct
  source 1..20: note = Seed: SATGFKQSSKALQRPVASDF
SATGYKQASLALGRPVASDF

SEQ ID NO: 19731 - protein, 20 aa, synthetic construct
  source 1..20: note = Seed: SATGFKQSSKALQRPVASDF
SATGYKQASLALHRPVASDF

SEQ ID NO: 19732 - protein, 20 aa, synthetic construct
  source 1..20: note = Seed: SATGFKQSSKALQRPVASDF
SATGYKQASLALIRPVASDF

SEQ ID NO: 19733 - protein, 20 aa, synthetic construct
  source 1..20: note = Seed: SATGFKQSSKALQRPVASDF
SATGYKQASLALNRPVASDF

SEQ ID NO: 19734 - protein, 20 aa, synthetic construct
  source 1..20: note = Seed: SATGFKQSSKALQRPVASDF
SATGYKQASLALPRPVASDF

SEQ ID NO: 19735 - protein, 20 aa, synthetic construct
  source 1..20: note = Seed: SATGFKQSSKALQRPVASDF
SATGYKQASLALQRPVASDF

SEQ ID NO: 19736 - protein, 20 aa, synthetic construct
  source 1..20: note = Seed: SATGFKQSSKALQRPVASDF
SATGYKQASLALSRPVASDF

SEQ ID NO: 19737 - protein, 20 aa, synthetic construct
  source 1..20: note = Seed: SATGFKQSSKALQRPVASDF
SATGYKQASLALTRPVASDF

SEQ ID NO: 19738 - protein, 20 aa, synthetic construct
  source 1..20: note = Seed: SATGFKQSSKALQRPVASDF
SATGYKQASLALVRPVASDF

SEQ ID NO: 19739 - protein, 20 aa, synthetic construct
  source 1..20: note = Seed: SATGFKQSSKALQRPVASDF
SATGYKQASMALARPVASDF

SEQ ID NO: 19740 - protein, 20 aa, synthetic construct
  source 1..20: note = Seed: SATGFKQSSKALQRPVASDF
SATGYKQASMALERPVASDF

SEQ ID NO: 19741 - protein, 20 aa, synthetic construct
  source 1..20: note = Seed: SATGFKQSSKALQRPVASDF
SATGYKQASMALGRPVASDF

SEQ ID NO: 19742 - protein, 20 aa, synthetic construct
  source 1..20: note = Seed: SATGFKQSSKALQRPVASDF
SATGYKQASMALHRPVASDF

SEQ ID NO: 19743 - protein, 20 aa, synthetic construct
  source 1..20: note = Seed: SATGFKQSSKALQRPVASDF
SATGYKQASMALIRPVASDF

SEQ ID NO: 19744 - protein, 20 aa, synthetic construct
  source 1..20: note = Seed: SATGFKQSSKALQRPVASDF
SATGYKQASMALLRPVASDF

SEQ ID NO: 19745 - protein, 20 aa, synthetic construct
  source 1..20: note = Seed: SATGFKQSSKALQRPVASDF
SATGYKQASMALNRPVASDF

SEQ ID NO: 19746 - protein, 20 aa, synthetic construct
  source 1..20: note = Seed: SATGFKQSSKALQRPVASDF
SATGYKQASMALPRPVASDF

SEQ ID NO: 19747 - protein, 20 aa, synthetic construct
  source 1..20: note = Seed: SATGFKQSSKALQRPVASDF
SATGYKQASMALQRPVASDF

SEQ ID NO: 19748 - protein, 20 aa, synthetic construct
  source 1..20: note = Seed: SATGFKQSSKALQRPVASDF
SATGYKQASMALSRPVASDF

SEQ ID NO: 19749 - protein, 20 aa, synthetic construct
  source 1..20: note = Seed: SATGFKQSSKALQRPVASDF
SATGYKQASMALTRPVASDF

SEQ ID NO: 19750 - protein, 20 aa, synthetic construct
  source 1..20: note = Seed: SATGFKQSSKALQRPVASDF
SATGYKQASMALVRPVASDF

SEQ ID NO: 19751 - protein, 20 aa, synthetic construct
  source 1..20: note = Seed: SATGFKQSSKALQRPVASDF
SATGYKQASNALARPVASDF

SEQ ID NO: 19752 - protein, 20 aa, synthetic construct
  source 1..20: note = Seed: SATGFKQSSKALQRPVASDF
SATGYKQASNALCRPVASDF

SEQ ID NO: 19753 - protein, 20 aa, synthetic construct
  source 1..20: note = Seed: SATGFKQSSKALQRPVASDF
SATGYKQASNALFRPVASDF

SEQ ID NO: 19754 - protein, 20 aa, synthetic construct
  source 1..20: note = Seed: SATGFKQSSKALQRPVASDF
SATGYKQASNALGRPVASDF

SEQ ID NO: 19755 - protein, 20 aa, synthetic construct
  source 1..20: note = Seed: SATGFKQSSKALQRPVASDF
SATGYKQASNALHRPVASDF

SEQ ID NO: 19756 - protein, 20 aa, synthetic construct
  source 1..20: note = Seed: SATGFKQSSKALQRPVASDF
SATGYKQASNALIRPVASDF

SEQ ID NO: 19757 - protein, 20 aa, synthetic construct
  source 1..20: note = Seed: SATGFKQSSKALQRPVASDF
SATGYKQASNALLRPVASDF

SEQ ID NO: 19758 - protein, 20 aa, synthetic construct
  source 1..20: note = Seed: SATGFKQSSKALQRPVASDF
SATGYKQASNALMRPVASDF

SEQ ID NO: 19759 - protein, 20 aa, synthetic construct
  source 1..20: note = Seed: SATGFKQSSKALQRPVASDF
SATGYKQASNALNRPVASDF

SEQ ID NO: 19760 - protein, 20 aa, synthetic construct
  source 1..20: note = Seed: SATGFKQSSKALQRPVASDF
SATGYKQASNALPRPVASDF

SEQ ID NO: 19761 - protein, 20 aa, synthetic construct
  source 1..20: note = Seed: SATGFKQSSKALQRPVASDF
SATGYKQASNALQRPVASDF

SEQ ID NO: 19762 - protein, 20 aa, synthetic construct
  source 1..20: note = Seed: SATGFKQSSKALQRPVASDF
SATGYKQASNALSRPVASDF

SEQ ID NO: 19763 - protein, 20 aa, synthetic construct
  source 1..20: note = Seed: SATGFKQSSKALQRPVASDF
SATGYKQASNALTRPVASDF

SEQ ID NO: 19764 - protein, 20 aa, synthetic construct
  source 1..20: note = Seed: SATGFKQSSKALQRPVASDF
SATGYKQASNALVRPVASDF

SEQ ID NO: 19765 - protein, 20 aa, synthetic construct
  source 1..20: note = Seed: SATGFKQSSKALQRPVASDF
SATGYKQASPALARPVASDF

SEQ ID NO: 19766 - protein, 20 aa, synthetic construct
  source 1..20: note = Seed: SATGFKQSSKALQRPVASDF
SATGYKQASPALCRPVASDF

SEQ ID NO: 19767 - protein, 20 aa, synthetic construct
  source 1..20: note = Seed: SATGFKQSSKALQRPVASDF
SATGYKQASPALDRPVASDF

SEQ ID NO: 19768 - protein, 20 aa, synthetic construct
  source 1..20: note = Seed: SATGFKQSSKALQRPVASDF
SATGYKQASPALERPVASDF

SEQ ID NO: 19769 - protein, 20 aa, synthetic construct
  source 1..20: note = Seed: SATGFKQSSKALQRPVASDF
SATGYKQASPALFRPVASDF

SEQ ID NO: 19770 - protein, 20 aa, synthetic construct
  source 1..20: note = Seed: SATGFKQSSKALQRPVASDF
SATGYKQASPALGRPVASDF

SEQ ID NO: 19771 - protein, 20 aa, synthetic construct
  source 1..20: note = Seed: SATGFKQSSKALQRPVASDF
SATGYKQASPALHRPVASDF

SEQ ID NO: 19772 - protein, 20 aa, synthetic construct
  source 1..20: note = Seed: SATGFKQSSKALQRPVASDF
SATGYKQASPALIRPVASDF

SEQ ID NO: 19773 - protein, 20 aa, synthetic construct
  source 1..20: note = Seed: SATGFKQSSKALQRPVASDF
SATGYKQASPALKRPVASDF

SEQ ID NO: 19774 - protein, 20 aa, synthetic construct
  source 1..20: note = Seed: SATGFKQSSKALQRPVASDF
SATGYKQASPALLRPVASDF

SEQ ID NO: 19775 - protein, 20 aa, synthetic construct
  source 1..20: note = Seed: SATGFKQSSKALQRPVASDF
SATGYKQASPALMRPVASDF

SEQ ID NO: 19776 - protein, 20 aa, synthetic construct
  source 1..20: note = Seed: SATGFKQSSKALQRPVASDF
SATGYKQASPALNRPVASDF

SEQ ID NO: 19777 - protein, 20 aa, synthetic construct
  source 1..20: note = Seed: SATGFKQSSKALQRPVASDF
SATGYKQASPALPRPVASDF

SEQ ID NO: 19778 - protein, 20 aa, synthetic construct
  source 1..20: note = Seed: SATGFKQSSKALQRPVASDF
SATGYKQASPALQRPVASDF

SEQ ID NO: 19779 - protein, 20 aa, synthetic construct
  source 1..20: note = Seed: SATGFKQSSKALQRPVASDF
SATGYKQASPALRRPVASDF

SEQ ID NO: 19780 - protein, 20 aa, synthetic construct
  source 1..20: note = Seed: SATGFKQSSKALQRPVASDF
SATGYKQASPALSRPVASDF

SEQ ID NO: 19781 - protein, 20 aa, synthetic construct
  source 1..20: note = Seed: SATGFKQSSKALQRPVASDF
SATGYKQASPALTRPVASDF

SEQ ID NO: 19782 - protein, 20 aa, synthetic construct
  source 1..20: note = Seed: SATGFKQSSKALQRPVASDF
SATGYKQASPALVRPVASDF

SEQ ID NO: 19783 - protein, 20 aa, synthetic construct
  source 1..20: note = Seed: SATGFKQSSKALQRPVASDF
SATGYKQASPALWRPVASDF

SEQ ID NO: 19784 - protein, 20 aa, synthetic construct
  source 1..20: note = Seed: SATGFKQSSKALQRPVASDF
SATGYKQASPALYRPVASDF

SEQ ID NO: 19785 - protein, 20 aa, synthetic construct
  source 1..20: note = Seed: SATGFKQSSKALQRPVASDF
SATGYKQASQALARPVASDF

SEQ ID NO: 19786 - protein, 20 aa, synthetic construct
  source 1..20: note = Seed: SATGFKQSSKALQRPVASDF
SATGYKQASQALIRPVASDF

SEQ ID NO: 19787 - protein, 20 aa, synthetic construct
  source 1..20: note = Seed: SATGFKQSSKALQRPVASDF
SATGYKQASQALLRPVASDF

SEQ ID NO: 19788 - protein, 20 aa, synthetic construct
  source 1..20: note = Seed: SATGFKQSSKALQRPVASDF
SATGYKQASQALMRPVASDF

SEQ ID NO: 19789 - protein, 20 aa, synthetic construct
  source 1..20: note = Seed: SATGFKQSSKALQRPVASDF
SATGYKQASQALNRPVASDF

SEQ ID NO: 19790 - protein, 20 aa, synthetic construct
  source 1..20: note = Seed: SATGFKQSSKALQRPVASDF
SATGYKQASQALSRPVASDF

SEQ ID NO: 19791 - protein, 20 aa, synthetic construct
  source 1..20: note = Seed: SATGFKQSSKALQRPVASDF
SATGYKQASQALTRPVASDF

SEQ ID NO: 19792 - protein, 20 aa, synthetic construct
  source 1..20: note = Seed: SATGFKQSSKALQRPVASDF
SATGYKQASQALVRPVASDF

SEQ ID NO: 19793 - protein, 20 aa, synthetic construct
  source 1..20: note = Seed: SATGFKQSSKALQRPVASDF
SATGYKQASRALARPVASDF

SEQ ID NO: 19794 - protein, 20 aa, synthetic construct
  source 1..20: note = Seed: SATGFKQSSKALQRPVASDF
SATGYKQASRALGRPVASDF

SEQ ID NO: 19795 - protein, 20 aa, synthetic construct
  source 1..20: note = Seed: SATGFKQSSKALQRPVASDF
SATGYKQASRALHRPVASDF

SEQ ID NO: 19796 - protein, 20 aa, synthetic construct
  source 1..20: note = Seed: SATGFKQSSKALQRPVASDF
SATGYKQASRALIRPVASDF

SEQ ID NO: 19797 - protein, 20 aa, synthetic construct
  source 1..20: note = Seed: SATGFKQSSKALQRPVASDF
SATGYKQASRALKRPVASDF

SEQ ID NO: 19798 - protein, 20 aa, synthetic construct
  source 1..20: note = Seed: SATGFKQSSKALQRPVASDF
SATGYKQASRALLRPVASDF

SEQ ID NO: 19799 - protein, 20 aa, synthetic construct
  source 1..20: note = Seed: SATGFKQSSKALQRPVASDF
SATGYKQASRALMRPVASDF

SEQ ID NO: 19800 - protein, 20 aa, synthetic construct
  source 1..20: note = Seed: SATGFKQSSKALQRPVASDF
SATGYKQASRALNRPVASDF

SEQ ID NO: 19801 - protein, 20 aa, synthetic construct
  source 1..20: note = Seed: SATGFKQSSKALQRPVASDF
SATGYKQASRALPRPVASDF

SEQ ID NO: 19802 - protein, 20 aa, synthetic construct
  source 1..20: note = Seed: SATGFKQSSKALQRPVASDF
SATGYKQASRALQRPVASDF

SEQ ID NO: 19803 - protein, 20 aa, synthetic construct
  source 1..20: note = Seed: SATGFKQSSKALQRPVASDF
SATGYKQASRALRRPVASDF

SEQ ID NO: 19804 - protein, 20 aa, synthetic construct
  source 1..20: note = Seed: SATGFKQSSKALQRPVASDF
SATGYKQASRALSRPVASDF

SEQ ID NO: 19805 - protein, 20 aa, synthetic construct
  source 1..20: note = Seed: SATGFKQSSKALQRPVASDF
SATGYKQASRALTRPVASDF

SEQ ID NO: 19806 - protein, 20 aa, synthetic construct
  source 1..20: note = Seed: SATGFKQSSKALQRPVASDF
SATGYKQASRALVRPVASDF

SEQ ID NO: 19807 - protein, 20 aa, synthetic construct
  source 1..20: note = Seed: SATGFKQSSKALQRPVASDF
SATGYKQASRALWRPVASDF

SEQ ID NO: 19808 - protein, 20 aa, synthetic construct
  source 1..20: note = Seed: SATGFKQSSKALQRPVASDF
SATGYKQASRALYRPVASDF

SEQ ID NO: 19809 - protein, 20 aa, synthetic construct
  source 1..20: note = Seed: SATGFKQSSKALQRPVASDF
SATGYKQASSALARPVASDF

SEQ ID NO: 19810 - protein, 20 aa, synthetic construct
  source 1..20: note = Seed: SATGFKQSSKALQRPVASDF
SATGYKQASSALCRPVASDF

SEQ ID NO: 19811 - protein, 20 aa, synthetic construct
  source 1..20: note = Seed: SATGFKQSSKALQRPVASDF
SATGYKQASSALDRPVASDF

SEQ ID NO: 19812 - protein, 20 aa, synthetic construct
  source 1..20: note = Seed: SATGFKQSSKALQRPVASDF
SATGYKQASSALERPVASDF

SEQ ID NO: 19813 - protein, 20 aa, synthetic construct
  source 1..20: note = Seed: SATGFKQSSKALQRPVASDF
SATGYKQASSALFRPVASDF

SEQ ID NO: 19814 - protein, 20 aa, synthetic construct
  source 1..20: note = Seed: SATGFKQSSKALQRPVASDF
SATGYKQASSALGRPVASDF

SEQ ID NO: 19815 - protein, 20 aa, synthetic construct
  source 1..20: note = Seed: SATGFKQSSKALQRPVASDF
SATGYKQASSALHRPVASDF

SEQ ID NO: 19816 - protein, 20 aa, synthetic construct
  source 1..20: note = Seed: SATGFKQSSKALQRPVASDF
SATGYKQASSALIRPVASDF

SEQ ID NO: 19817 - protein, 20 aa, synthetic construct
  source 1..20: note = Seed: SATGFKQSSKALQRPVASDF
SATGYKQASSALKRPVASDF

SEQ ID NO: 19818 - protein, 20 aa, synthetic construct
  source 1..20: note = Seed: SATGFKQSSKALQRPVASDF
SATGYKQASSALLRPVASDF

SEQ ID NO: 19819 - protein, 20 aa, synthetic construct
  source 1..20: note = Seed: SATGFKQSSKALQRPVASDF
SATGYKQASSALMRPVASDF

SEQ ID NO: 19820 - protein, 20 aa, synthetic construct
  source 1..20: note = Seed: SATGFKQSSKALQRPVASDF
SATGYKQASSALNRPVASDF

SEQ ID NO: 19821 - protein, 20 aa, synthetic construct
  source 1..20: note = Seed: SATGFKQSSKALQRPVASDF
SATGYKQASSALPRPVASDF

SEQ ID NO: 19822 - protein, 20 aa, synthetic construct
  source 1..20: note = Seed: SATGFKQSSKALQRPVASDF
SATGYKQASSALQRPVASDF

SEQ ID NO: 19823 - protein, 20 aa, synthetic construct
  source 1..20: note = Seed: SATGFKQSSKALQRPVASDF
SATGYKQASSALRRPVASDF

SEQ ID NO: 19824 - protein, 20 aa, synthetic construct
  source 1..20: note = Seed: SATGFKQSSKALQRPVASDF
SATGYKQASSALSRPVASDF

SEQ ID NO: 19825 - protein, 20 aa, synthetic construct
  source 1..20: note = Seed: SATGFKQSSKALQRPVASDF
SATGYKQASSALTRPVASDF

SEQ ID NO: 19826 - protein, 20 aa, synthetic construct
  source 1..20: note = Seed: SATGFKQSSKALQRPVASDF
SATGYKQASSALVRPVASDF

SEQ ID NO: 19827 - protein, 20 aa, synthetic construct
  source 1..20: note = Seed: SATGFKQSSKALQRPVASDF
SATGYKQASSALWRPVASDF

SEQ ID NO: 19828 - protein, 20 aa, synthetic construct
  source 1..20: note = Seed: SATGFKQSSKALQRPVASDF
SATGYKQASSALYRPVASDF

SEQ ID NO: 19829 - protein, 20 aa, synthetic construct
  source 1..20: note = Seed: SATGFKQSSKALQRPVASDF
SATGYKQASTALARPVASDF

SEQ ID NO: 19830 - protein, 20 aa, synthetic construct
  source 1..20: note = Seed: SATGFKQSSKALQRPVASDF
SATGYKQASTALCRPVASDF

SEQ ID NO: 19831 - protein, 20 aa, synthetic construct
  source 1..20: note = Seed: SATGFKQSSKALQRPVASDF
SATGYKQASTALDRPVASDF

SEQ ID NO: 19832 - protein, 20 aa, synthetic construct
  source 1..20: note = Seed: SATGFKQSSKALQRPVASDF
SATGYKQASTALERPVASDF

SEQ ID NO: 19833 - protein, 20 aa, synthetic construct
  source 1..20: note = Seed: SATGFKQSSKALQRPVASDF
SATGYKQASTALFRPVASDF

SEQ ID NO: 19834 - protein, 20 aa, synthetic construct
  source 1..20: note = Seed: SATGFKQSSKALQRPVASDF
SATGYKQASTALGRPVASDF

SEQ ID NO: 19835 - protein, 20 aa, synthetic construct
  source 1..20: note = Seed: SATGFKQSSKALQRPVASDF
SATGYKQASTALHRPVASDF

SEQ ID NO: 19836 - protein, 20 aa, synthetic construct
  source 1..20: note = Seed: SATGFKQSSKALQRPVASDF
SATGYKQASTALIRPVASDF

SEQ ID NO: 19837 - protein, 20 aa, synthetic construct
  source 1..20: note = Seed: SATGFKQSSKALQRPVASDF
SATGYKQASTALLRPVASDF

SEQ ID NO: 19838 - protein, 20 aa, synthetic construct
  source 1..20: note = Seed: SATGFKQSSKALQRPVASDF
SATGYKQASTALMRPVASDF

SEQ ID NO: 19839 - protein, 20 aa, synthetic construct
  source 1..20: note = Seed: SATGFKQSSKALQRPVASDF
SATGYKQASTALNRPVASDF

SEQ ID NO: 19840 - protein, 20 aa, synthetic construct
  source 1..20: note = Seed: SATGFKQSSKALQRPVASDF
SATGYKQASTALPRPVASDF

SEQ ID NO: 19841 - protein, 20 aa, synthetic construct
  source 1..20: note = Seed: SATGFKQSSKALQRPVASDF
SATGYKQASTALQRPVASDF

SEQ ID NO: 19842 - protein, 20 aa, synthetic construct
  source 1..20: note = Seed: SATGFKQSSKALQRPVASDF
SATGYKQASTALSRPVASDF

SEQ ID NO: 19843 - protein, 20 aa, synthetic construct
  source 1..20: note = Seed: SATGFKQSSKALQRPVASDF
SATGYKQASTALTRPVASDF

SEQ ID NO: 19844 - protein, 20 aa, synthetic construct
  source 1..20: note = Seed: SATGFKQSSKALQRPVASDF
SATGYKQASTALVRPVASDF

SEQ ID NO: 19845 - protein, 20 aa, synthetic construct
  source 1..20: note = Seed: SATGFKQSSKALQRPVASDF
SATGYKQASTALWRPVASDF

SEQ ID NO: 19846 - protein, 20 aa, synthetic construct
  source 1..20: note = Seed: SATGFKQSSKALQRPVASDF
SATGYKQASTALYRPVASDF

SEQ ID NO: 19847 - protein, 20 aa, synthetic construct
  source 1..20: note = Seed: SATGFKQSSKALQRPVASDF
SATGYKQASVALARPVASDF

SEQ ID NO: 19848 - protein, 20 aa, synthetic construct
  source 1..20: note = Seed: SATGFKQSSKALQRPVASDF
SATGYKQASVALCRPVASDF

SEQ ID NO: 19849 - protein, 20 aa, synthetic construct
  source 1..20: note = Seed: SATGFKQSSKALQRPVASDF
SATGYKQASVALDRPVASDF

SEQ ID NO: 19850 - protein, 20 aa, synthetic construct
  source 1..20: note = Seed: SATGFKQSSKALQRPVASDF
SATGYKQASVALERPVASDF

SEQ ID NO: 19851 - protein, 20 aa, synthetic construct
  source 1..20: note = Seed: SATGFKQSSKALQRPVASDF
SATGYKQASVALFRPVASDF

SEQ ID NO: 19852 - protein, 20 aa, synthetic construct
  source 1..20: note = Seed: SATGFKQSSKALQRPVASDF
SATGYKQASVALGRPVASDF

SEQ ID NO: 19853 - protein, 20 aa, synthetic construct
  source 1..20: note = Seed: SATGFKQSSKALQRPVASDF
SATGYKQASVALHRPVASDF

SEQ ID NO: 19854 - protein, 20 aa, synthetic construct
  source 1..20: note = Seed: SATGFKQSSKALQRPVASDF
SATGYKQASVALIRPVASDF

SEQ ID NO: 19855 - protein, 20 aa, synthetic construct
  source 1..20: note = Seed: SATGFKQSSKALQRPVASDF
SATGYKQASVALKRPVASDF

SEQ ID NO: 19856 - protein, 20 aa, synthetic construct
  source 1..20: note = Seed: SATGFKQSSKALQRPVASDF
SATGYKQASVALLRPVASDF

SEQ ID NO: 19857 - protein, 20 aa, synthetic construct
  source 1..20: note = Seed: SATGFKQSSKALQRPVASDF
SATGYKQASVALMRPVASDF

SEQ ID NO: 19858 - protein, 20 aa, synthetic construct
  source 1..20: note = Seed: SATGFKQSSKALQRPVASDF
SATGYKQASVALNRPVASDF

SEQ ID NO: 19859 - protein, 20 aa, synthetic construct
  source 1..20: note = Seed: SATGFKQSSKALQRPVASDF
SATGYKQASVALPRPVASDF

SEQ ID NO: 19860 - protein, 20 aa, synthetic construct
  source 1..20: note = Seed: SATGFKQSSKALQRPVASDF
SATGYKQASVALQRPVASDF

SEQ ID NO: 19861 - protein, 20 aa, synthetic construct
  source 1..20: note = Seed: SATGFKQSSKALQRPVASDF
SATGYKQASVALRRPVASDF

SEQ ID NO: 19862 - protein, 20 aa, synthetic construct
  source 1..20: note = Seed: SATGFKQSSKALQRPVASDF
SATGYKQASVALSRPVASDF

SEQ ID NO: 19863 - protein, 20 aa, synthetic construct
  source 1..20: note = Seed: SATGFKQSSKALQRPVASDF
SATGYKQASVALTRPVASDF

SEQ ID NO: 19864 - protein, 20 aa, synthetic construct
  source 1..20: note = Seed: SATGFKQSSKALQRPVASDF
SATGYKQASVALVRPVASDF

SEQ ID NO: 19865 - protein, 20 aa, synthetic construct
  source 1..20: note = Seed: SATGFKQSSKALQRPVASDF
SATGYKQASVALWRPVASDF

SEQ ID NO: 19866 - protein, 20 aa, synthetic construct
  source 1..20: note = Seed: SATGFKQSSKALQRPVASDF
SATGYKQASVALYRPVASDF

SEQ ID NO: 19867 - protein, 20 aa, synthetic construct
  source 1..20: note = Seed: SATGFKQSSKALQRPVASDF
SATGYKQCSAALARPVASDF

SEQ ID NO: 19868 - protein, 20 aa, synthetic construct
  source 1..20: note = Seed: SATGFKQSSKALQRPVASDF
SATGYKQCSAALGRPVASDF

SEQ ID NO: 19869 - protein, 20 aa, synthetic construct
  source 1..20: note = Seed: SATGFKQSSKALQRPVASDF
SATGYKQCSAALIRPVASDF

SEQ ID NO: 19870 - protein, 20 aa, synthetic construct
  source 1..20: note = Seed: SATGFKQSSKALQRPVASDF
SATGYKQCSAALLRPVASDF

SEQ ID NO: 19871 - protein, 20 aa, synthetic construct
  source 1..20: note = Seed: SATGFKQSSKALQRPVASDF
SATGYKQCSAALMRPVASDF

SEQ ID NO: 19872 - protein, 20 aa, synthetic construct
  source 1..20: note = Seed: SATGFKQSSKALQRPVASDF
SATGYKQCSAALNRPVASDF

SEQ ID NO: 19873 - protein, 20 aa, synthetic construct
  source 1..20: note = Seed: SATGFKQSSKALQRPVASDF
SATGYKQCSAALSRPVASDF

SEQ ID NO: 19874 - protein, 20 aa, synthetic construct
  source 1..20: note = Seed: SATGFKQSSKALQRPVASDF
SATGYKQCSAALTRPVASDF

SEQ ID NO: 19875 - protein, 20 aa, synthetic construct
  source 1..20: note = Seed: SATGFKQSSKALQRPVASDF
SATGYKQCSAALVRPVASDF

SEQ ID NO: 19876 - protein, 20 aa, synthetic construct
  source 1..20: note = Seed: SATGFKQSSKALQRPVASDF
SATGYKQCSFALFRPVASDF

SEQ ID NO: 19877 - protein, 20 aa, synthetic construct
  source 1..20: note = Seed: SATGFKQSSKALQRPVASDF
SATGYKQCSGALARPVASDF

SEQ ID NO: 19878 - protein, 20 aa, synthetic construct
  source 1..20: note = Seed: SATGFKQSSKALQRPVASDF
SATGYKQCSGALIRPVASDF

SEQ ID NO: 19879 - protein, 20 aa, synthetic construct
  source 1..20: note = Seed: SATGFKQSSKALQRPVASDF
SATGYKQCSGALLRPVASDF

SEQ ID NO: 19880 - protein, 20 aa, synthetic construct
  source 1..20: note = Seed: SATGFKQSSKALQRPVASDF
SATGYKQCSGALMRPVASDF

SEQ ID NO: 19881 - protein, 20 aa, synthetic construct
  source 1..20: note = Seed: SATGFKQSSKALQRPVASDF
SATGYKQCSGALVRPVASDF

SEQ ID NO: 19882 - protein, 20 aa, synthetic construct
  source 1..20: note = Seed: SATGFKQSSKALQRPVASDF
SATGYKQCSHALARPVASDF

SEQ ID NO: 19883 - protein, 20 aa, synthetic construct
  source 1..20: note = Seed: SATGFKQSSKALQRPVASDF
SATGYKQCSIALARPVASDF

SEQ ID NO: 19884 - protein, 20 aa, synthetic construct
  source 1..20: note = Seed: SATGFKQSSKALQRPVASDF
SATGYKQCSIALGRPVASDF

SEQ ID NO: 19885 - protein, 20 aa, synthetic construct
  source 1..20: note = Seed: SATGFKQSSKALQRPVASDF
SATGYKQCSIALIRPVASDF

SEQ ID NO: 19886 - protein, 20 aa, synthetic construct
  source 1..20: note = Seed: SATGFKQSSKALQRPVASDF
SATGYKQCSIALNRPVASDF

SEQ ID NO: 19887 - protein, 20 aa, synthetic construct
  source 1..20: note = Seed: SATGFKQSSKALQRPVASDF
SATGYKQCSIALQRPVASDF

SEQ ID NO: 19888 - protein, 20 aa, synthetic construct
  source 1..20: note = Seed: SATGFKQSSKALQRPVASDF
SATGYKQCSIALSRPVASDF

SEQ ID NO: 19889 - protein, 20 aa, synthetic construct
  source 1..20: note = Seed: SATGFKQSSKALQRPVASDF
SATGYKQCSIALTRPVASDF

SEQ ID NO: 19890 - protein, 20 aa, synthetic construct
  source 1..20: note = Seed: SATGFKQSSKALQRPVASDF
SATGYKQCSIALVRPVASDF

SEQ ID NO: 19891 - protein, 20 aa, synthetic construct
  source 1..20: note = Seed: SATGFKQSSKALQRPVASDF
SATGYKQCSKALARPVASDF

SEQ ID NO: 19892 - protein, 20 aa, synthetic construct
  source 1..20: note = Seed: SATGFKQSSKALQRPVASDF
SATGYKQCSLALARPVASDF

SEQ ID NO: 19893 - protein, 20 aa, synthetic construct
  source 1..20: note = Seed: SATGFKQSSKALQRPVASDF
SATGYKQCSLALIRPVASDF

SEQ ID NO: 19894 - protein, 20 aa, synthetic construct
  source 1..20: note = Seed: SATGFKQSSKALQRPVASDF
SATGYKQCSLALQRPVASDF

SEQ ID NO: 19895 - protein, 20 aa, synthetic construct
  source 1..20: note = Seed: SATGFKQSSKALQRPVASDF
SATGYKQCSLALSRPVASDF

SEQ ID NO: 19896 - protein, 20 aa, synthetic construct
  source 1..20: note = Seed: SATGFKQSSKALQRPVASDF
SATGYKQCSLALTRPVASDF

SEQ ID NO: 19897 - protein, 20 aa, synthetic construct
  source 1..20: note = Seed: SATGFKQSSKALQRPVASDF
SATGYKQCSLALVRPVASDF

SEQ ID NO: 19898 - protein, 20 aa, synthetic construct
  source 1..20: note = Seed: SATGFKQSSKALQRPVASDF
SATGYKQCSMALARPVASDF

SEQ ID NO: 19899 - protein, 20 aa, synthetic construct
  source 1..20: note = Seed: SATGFKQSSKALQRPVASDF
SATGYKQCSMALIRPVASDF

SEQ ID NO: 19900 - protein, 20 aa, synthetic construct
  source 1..20: note = Seed: SATGFKQSSKALQRPVASDF
SATGYKQCSMALMRPVASDF

SEQ ID NO: 19901 - protein, 20 aa, synthetic construct
  source 1..20: note = Seed: SATGFKQSSKALQRPVASDF
SATGYKQCSMALSRPVASDF

SEQ ID NO: 19902 - protein, 20 aa, synthetic construct
  source 1..20: note = Seed: SATGFKQSSKALQRPVASDF
SATGYKQCSMALTRPVASDF

SEQ ID NO: 19903 - protein, 20 aa, synthetic construct
  source 1..20: note = Seed: SATGFKQSSKALQRPVASDF
SATGYKQCSMALVRPVASDF

SEQ ID NO: 19904 - protein, 20 aa, synthetic construct
  source 1..20: note = Seed: SATGFKQSSKALQRPVASDF
SATGYKQCSNALARPVASDF

SEQ ID NO: 19905 - protein, 20 aa, synthetic construct
  source 1..20: note = Seed: SATGFKQSSKALQRPVASDF
SATGYKQCSPALARPVASDF

SEQ ID NO: 19906 - protein, 20 aa, synthetic construct
  source 1..20: note = Seed: SATGFKQSSKALQRPVASDF
SATGYKQCSPALIRPVASDF

SEQ ID NO: 19907 - protein, 20 aa, synthetic construct
  source 1..20: note = Seed: SATGFKQSSKALQRPVASDF
SATGYKQCSPALLRPVASDF

SEQ ID NO: 19908 - protein, 20 aa, synthetic construct
  source 1..20: note = Seed: SATGFKQSSKALQRPVASDF
SATGYKQCSPALSRPVASDF

SEQ ID NO: 19909 - protein, 20 aa, synthetic construct
  source 1..20: note = Seed: SATGFKQSSKALQRPVASDF
SATGYKQCSPALVRPVASDF

SEQ ID NO: 19910 - protein, 20 aa, synthetic construct
  source 1..20: note = Seed: SATGFKQSSKALQRPVASDF
SATGYKQCSRALARPVASDF

SEQ ID NO: 19911 - protein, 20 aa, synthetic construct
  source 1..20: note = Seed: SATGFKQSSKALQRPVASDF
SATGYKQCSRALSRPVASDF

SEQ ID NO: 19912 - protein, 20 aa, synthetic construct
  source 1..20: note = Seed: SATGFKQSSKALQRPVASDF
SATGYKQCSSALARPVASDF

SEQ ID NO: 19913 - protein, 20 aa, synthetic construct
  source 1..20: note = Seed: SATGFKQSSKALQRPVASDF
SATGYKQCSSALIRPVASDF

SEQ ID NO: 19914 - protein, 20 aa, synthetic construct
  source 1..20: note = Seed: SATGFKQSSKALQRPVASDF
SATGYKQCSSALLRPVASDF

SEQ ID NO: 19915 - protein, 20 aa, synthetic construct
  source 1..20: note = Seed: SATGFKQSSKALQRPVASDF
SATGYKQCSSALMRPVASDF

SEQ ID NO: 19916 - protein, 20 aa, synthetic construct
  source 1..20: note = Seed: SATGFKQSSKALQRPVASDF
SATGYKQCSSALSRPVASDF

SEQ ID NO: 19917 - protein, 20 aa, synthetic construct
  source 1..20: note = Seed: SATGFKQSSKALQRPVASDF
SATGYKQCSSALTRPVASDF

SEQ ID NO: 19918 - protein, 20 aa, synthetic construct
  source 1..20: note = Seed: SATGFKQSSKALQRPVASDF
SATGYKQCSSALVRPVASDF

SEQ ID NO: 19919 - protein, 20 aa, synthetic construct
  source 1..20: note = Seed: SATGFKQSSKALQRPVASDF
SATGYKQCSTALARPVASDF

SEQ ID NO: 19920 - protein, 20 aa, synthetic construct
  source 1..20: note = Seed: SATGFKQSSKALQRPVASDF
SATGYKQCSTALIRPVASDF

SEQ ID NO: 19921 - protein, 20 aa, synthetic construct
  source 1..20: note = Seed: SATGFKQSSKALQRPVASDF
SATGYKQCSTALLRPVASDF

SEQ ID NO: 19922 - protein, 20 aa, synthetic construct
  source 1..20: note = Seed: SATGFKQSSKALQRPVASDF
SATGYKQCSTALVRPVASDF

SEQ ID NO: 19923 - protein, 20 aa, synthetic construct
  source 1..20: note = Seed: SATGFKQSSKALQRPVASDF
SATGYKQCSVALARPVASDF

SEQ ID NO: 19924 - protein, 20 aa, synthetic construct
  source 1..20: note = Seed: SATGFKQSSKALQRPVASDF
SATGYKQCSVALGRPVASDF

SEQ ID NO: 19925 - protein, 20 aa, synthetic construct
  source 1..20: note = Seed: SATGFKQSSKALQRPVASDF
SATGYKQCSVALIRPVASDF

SEQ ID NO: 19926 - protein, 20 aa, synthetic construct
  source 1..20: note = Seed: SATGFKQSSKALQRPVASDF
SATGYKQCSVALLRPVASDF

SEQ ID NO: 19927 - protein, 20 aa, synthetic construct
  source 1..20: note = Seed: SATGFKQSSKALQRPVASDF
SATGYKQCSVALMRPVASDF

SEQ ID NO: 19928 - protein, 20 aa, synthetic construct
  source 1..20: note = Seed: SATGFKQSSKALQRPVASDF
SATGYKQCSVALNRPVASDF

SEQ ID NO: 19929 - protein, 20 aa, synthetic construct
  source 1..20: note = Seed: SATGFKQSSKALQRPVASDF
SATGYKQCSVALSRPVASDF

SEQ ID NO: 19930 - protein, 20 aa, synthetic construct
  source 1..20: note = Seed: SATGFKQSSKALQRPVASDF
SATGYKQCSVALTRPVASDF

SEQ ID NO: 19931 - protein, 20 aa, synthetic construct
  source 1..20: note = Seed: SATGFKQSSKALQRPVASDF
SATGYKQCSVALVRPVASDF

SEQ ID NO: 19932 - protein, 20 aa, synthetic construct
  source 1..20: note = Seed: SATGFKQSSKALQRPVASDF
SATGYKQDSAALARPVASDF

SEQ ID NO: 19933 - protein, 20 aa, synthetic construct
  source 1..20: note = Seed: SATGFKQSSKALQRPVASDF
SATGYKQDSAALIRPVASDF

SEQ ID NO: 19934 - protein, 20 aa, synthetic construct
  source 1..20: note = Seed: SATGFKQSSKALQRPVASDF
SATGYKQDSAALLRPVASDF

SEQ ID NO: 19935 - protein, 20 aa, synthetic construct
  source 1..20: note = Seed: SATGFKQSSKALQRPVASDF
SATGYKQDSAALSRPVASDF

SEQ ID NO: 19936 - protein, 20 aa, synthetic construct
  source 1..20: note = Seed: SATGFKQSSKALQRPVASDF
SATGYKQDSAALVRPVASDF

SEQ ID NO: 19937 - protein, 20 aa, synthetic construct
  source 1..20: note = Seed: SATGFKQSSKALQRPVASDF
SATGYKQDSFALIRPVASDF

SEQ ID NO: 19938 - protein, 20 aa, synthetic construct
  source 1..20: note = Seed: SATGFKQSSKALQRPVASDF
SATGYKQDSFALLRPVASDF

SEQ ID NO: 19939 - protein, 20 aa, synthetic construct
  source 1..20: note = Seed: SATGFKQSSKALQRPVASDF
SATGYKQDSFALVRPVASDF

SEQ ID NO: 19940 - protein, 20 aa, synthetic construct
  source 1..20: note = Seed: SATGFKQSSKALQRPVASDF
SATGYKQDSIALARPVASDF

SEQ ID NO: 19941 - protein, 20 aa, synthetic construct
  source 1..20: note = Seed: SATGFKQSSKALQRPVASDF
SATGYKQDSIALSRPVASDF

SEQ ID NO: 19942 - protein, 20 aa, synthetic construct
  source 1..20: note = Seed: SATGFKQSSKALQRPVASDF
SATGYKQDSIALTRPVASDF

SEQ ID NO: 19943 - protein, 20 aa, synthetic construct
  source 1..20: note = Seed: SATGFKQSSKALQRPVASDF
SATGYKQDSIALVRPVASDF

SEQ ID NO: 19944 - protein, 20 aa, synthetic construct
  source 1..20: note = Seed: SATGFKQSSKALQRPVASDF
SATGYKQDSLALSRPVASDF

SEQ ID NO: 19945 - protein, 20 aa, synthetic construct
  source 1..20: note = Seed: SATGFKQSSKALQRPVASDF
SATGYKQDSVALARPVASDF

SEQ ID NO: 19946 - protein, 20 aa, synthetic construct
  source 1..20: note = Seed: SATGFKQSSKALQRPVASDF
SATGYKQDSVALIRPVASDF

SEQ ID NO: 19947 - protein, 20 aa, synthetic construct
  source 1..20: note = Seed: SATGFKQSSKALQRPVASDF
SATGYKQDSVALLRPVASDF

SEQ ID NO: 19948 - protein, 20 aa, synthetic construct
  source 1..20: note = Seed: SATGFKQSSKALQRPVASDF
SATGYKQDSVALSRPVASDF

SEQ ID NO: 19949 - protein, 20 aa, synthetic construct
  source 1..20: note = Seed: SATGFKQSSKALQRPVASDF
SATGYKQDSVALVRPVASDF

SEQ ID NO: 19950 - protein, 20 aa, synthetic construct
  source 1..20: note = Seed: SATGFKQSSKALQRPVASDF
SATGYKQESAALARPVASDF

SEQ ID NO: 19951 - protein, 20 aa, synthetic construct
  source 1..20: note = Seed: SATGFKQSSKALQRPVASDF
SATGYKQESAALFRPVASDF

SEQ ID NO: 19952 - protein, 20 aa, synthetic construct
  source 1..20: note = Seed: SATGFKQSSKALQRPVASDF
SATGYKQESAALGRPVASDF

SEQ ID NO: 19953 - protein, 20 aa, synthetic construct
  source 1..20: note = Seed: SATGFKQSSKALQRPVASDF
SATGYKQESAALHRPVASDF

SEQ ID NO: 19954 - protein, 20 aa, synthetic construct
  source 1..20: note = Seed: SATGFKQSSKALQRPVASDF
SATGYKQESAALIRPVASDF

SEQ ID NO: 19955 - protein, 20 aa, synthetic construct
  source 1..20: note = Seed: SATGFKQSSKALQRPVASDF
SATGYKQESAALLRPVASDF

SEQ ID NO: 19956 - protein, 20 aa, synthetic construct
  source 1..20: note = Seed: SATGFKQSSKALQRPVASDF
SATGYKQESAALMRPVASDF

SEQ ID NO: 19957 - protein, 20 aa, synthetic construct
  source 1..20: note = Seed: SATGFKQSSKALQRPVASDF
SATGYKQESAALNRPVASDF

SEQ ID NO: 19958 - protein, 20 aa, synthetic construct
  source 1..20: note = Seed: SATGFKQSSKALQRPVASDF
SATGYKQESAALQRPVASDF

SEQ ID NO: 19959 - protein, 20 aa, synthetic construct
  source 1..20: note = Seed: SATGFKQSSKALQRPVASDF
SATGYKQESAALSRPVASDF

SEQ ID NO: 19960 - protein, 20 aa, synthetic construct
  source 1..20: note = Seed: SATGFKQSSKALQRPVASDF
SATGYKQESAALTRPVASDF

SEQ ID NO: 19961 - protein, 20 aa, synthetic construct
  source 1..20: note = Seed: SATGFKQSSKALQRPVASDF
SATGYKQESAALVRPVASDF

SEQ ID NO: 19962 - protein, 20 aa, synthetic construct
  source 1..20: note = Seed: SATGFKQSSKALQRPVASDF
SATGYKQESFALARPVASDF

SEQ ID NO: 19963 - protein, 20 aa, synthetic construct
  source 1..20: note = Seed: SATGFKQSSKALQRPVASDF
SATGYKQESFALFRPVASDF

SEQ ID NO: 19964 - protein, 20 aa, synthetic construct
  source 1..20: note = Seed: SATGFKQSSKALQRPVASDF
SATGYKQESFALIRPVASDF

SEQ ID NO: 19965 - protein, 20 aa, synthetic construct
  source 1..20: note = Seed: SATGFKQSSKALQRPVASDF
SATGYKQESFALLRPVASDF

SEQ ID NO: 19966 - protein, 20 aa, synthetic construct
  source 1..20: note = Seed: SATGFKQSSKALQRPVASDF
SATGYKQESFALMRPVASDF

SEQ ID NO: 19967 - protein, 20 aa, synthetic construct
  source 1..20: note = Seed: SATGFKQSSKALQRPVASDF
SATGYKQESFALVRPVASDF

SEQ ID NO: 19968 - protein, 20 aa, synthetic construct
  source 1..20: note = Seed: SATGFKQSSKALQRPVASDF
SATGYKQESGALARPVASDF

SEQ ID NO: 19969 - protein, 20 aa, synthetic construct
  source 1..20: note = Seed: SATGFKQSSKALQRPVASDF
SATGYKQESGALGRPVASDF

SEQ ID NO: 19970 - protein, 20 aa, synthetic construct
  source 1..20: note = Seed: SATGFKQSSKALQRPVASDF
SATGYKQESGALIRPVASDF

SEQ ID NO: 19971 - protein, 20 aa, synthetic construct
  source 1..20: note = Seed: SATGFKQSSKALQRPVASDF
SATGYKQESGALLRPVASDF

SEQ ID NO: 19972 - protein, 20 aa, synthetic construct
  source 1..20: note = Seed: SATGFKQSSKALQRPVASDF
SATGYKQESGALMRPVASDF

SEQ ID NO: 19973 - protein, 20 aa, synthetic construct
  source 1..20: note = Seed: SATGFKQSSKALQRPVASDF
SATGYKQESGALSRPVASDF

SEQ ID NO: 19974 - protein, 20 aa, synthetic construct
  source 1..20: note = Seed: SATGFKQSSKALQRPVASDF
SATGYKQESGALTRPVASDF

SEQ ID NO: 19975 - protein, 20 aa, synthetic construct
  source 1..20: note = Seed: SATGFKQSSKALQRPVASDF
SATGYKQESGALVRPVASDF

SEQ ID NO: 19976 - protein, 20 aa, synthetic construct
  source 1..20: note = Seed: SATGFKQSSKALQRPVASDF
SATGYKQESIALARPVASDF

SEQ ID NO: 19977 - protein, 20 aa, synthetic construct
  source 1..20: note = Seed: SATGFKQSSKALQRPVASDF
SATGYKQESIALERPVASDF

SEQ ID NO: 19978 - protein, 20 aa, synthetic construct
  source 1..20: note = Seed: SATGFKQSSKALQRPVASDF
SATGYKQESIALGRPVASDF

SEQ ID NO: 19979 - protein, 20 aa, synthetic construct
  source 1..20: note = Seed: SATGFKQSSKALQRPVASDF
SATGYKQESIALHRPVASDF

SEQ ID NO: 19980 - protein, 20 aa, synthetic construct
  source 1..20: note = Seed: SATGFKQSSKALQRPVASDF
SATGYKQESIALIRPVASDF

SEQ ID NO: 19981 - protein, 20 aa, synthetic construct
  source 1..20: note = Seed: SATGFKQSSKALQRPVASDF
SATGYKQESIALNRPVASDF

SEQ ID NO: 19982 - protein, 20 aa, synthetic construct
  source 1..20: note = Seed: SATGFKQSSKALQRPVASDF
SATGYKQESIALQRPVASDF

SEQ ID NO: 19983 - protein, 20 aa, synthetic construct
  source 1..20: note = Seed: SATGFKQSSKALQRPVASDF
SATGYKQESIALSRPVASDF

SEQ ID NO: 19984 - protein, 20 aa, synthetic construct
  source 1..20: note = Seed: SATGFKQSSKALQRPVASDF
SATGYKQESIALTRPVASDF

SEQ ID NO: 19985 - protein, 20 aa, synthetic construct
  source 1..20: note = Seed: SATGFKQSSKALQRPVASDF
SATGYKQESIALVRPVASDF

SEQ ID NO: 19986 - protein, 20 aa, synthetic construct
  source 1..20: note = Seed: SATGFKQSSKALQRPVASDF
SATGYKQESLALARPVASDF

SEQ ID NO: 19987 - protein, 20 aa, synthetic construct
  source 1..20: note = Seed: SATGFKQSSKALQRPVASDF
SATGYKQESLALIRPVASDF

SEQ ID NO: 19988 - protein, 20 aa, synthetic construct
  source 1..20: note = Seed: SATGFKQSSKALQRPVASDF
SATGYKQESLALNRPVASDF

SEQ ID NO: 19989 - protein, 20 aa, synthetic construct
  source 1..20: note = Seed: SATGFKQSSKALQRPVASDF
SATGYKQESLALSRPVASDF

SEQ ID NO: 19990 - protein, 20 aa, synthetic construct
  source 1..20: note = Seed: SATGFKQSSKALQRPVASDF
SATGYKQESLALTRPVASDF

SEQ ID NO: 19991 - protein, 20 aa, synthetic construct
  source 1..20: note = Seed: SATGFKQSSKALQRPVASDF
SATGYKQESLALVRPVASDF

SEQ ID NO: 19992 - protein, 20 aa, synthetic construct
  source 1..20: note = Seed: SATGFKQSSKALQRPVASDF
SATGYKQESMALARPVASDF

SEQ ID NO: 19993 - protein, 20 aa, synthetic construct
  source 1..20: note = Seed: SATGFKQSSKALQRPVASDF
SATGYKQESMALIRPVASDF

SEQ ID NO: 19994 - protein, 20 aa, synthetic construct
  source 1..20: note = Seed: SATGFKQSSKALQRPVASDF
SATGYKQESMALNRPVASDF

SEQ ID NO: 19995 - protein, 20 aa, synthetic construct
  source 1..20: note = Seed: SATGFKQSSKALQRPVASDF
SATGYKQESMALSRPVASDF

SEQ ID NO: 19996 - protein, 20 aa, synthetic construct
  source 1..20: note = Seed: SATGFKQSSKALQRPVASDF
SATGYKQESMALTRPVASDF

SEQ ID NO: 19997 - protein, 20 aa, synthetic construct
  source 1..20: note = Seed: SATGFKQSSKALQRPVASDF
SATGYKQESMALVRPVASDF

SEQ ID NO: 19998 - protein, 20 aa, synthetic construct
  source 1..20: note = Seed: SATGFKQSSKALQRPVASDF
SATGYKQESNALARPVASDF

SEQ ID NO: 19999 - protein, 20 aa, synthetic construct
  source 1..20: note = Seed: SATGFKQSSKALQRPVASDF
SATGYKQESNALIRPVASDF

SEQ ID NO: 20000 - protein, 20 aa, synthetic construct
  source 1..20: note = Seed: SATGFKQSSKALQRPVASDF
SATGYKQESNALLRPVASDF

SEQ ID NO: 20001 - protein, 20 aa, synthetic construct
  source 1..20: note = Seed: SATGFKQSSKALQRPVASDF
SATGYKQESNALSRPVASDF

SEQ ID NO: 20002 - protein, 20 aa, synthetic construct
  source 1..20: note = Seed: SATGFKQSSKALQRPVASDF
SATGYKQESNALVRPVASDF

SEQ ID NO: 20003 - protein, 20 aa, synthetic construct
  source 1..20: note = Seed: SATGFKQSSKALQRPVASDF
SATGYKQESPALARPVASDF

SEQ ID NO: 20004 - protein, 20 aa, synthetic construct
  source 1..20: note = Seed: SATGFKQSSKALQRPVASDF
SATGYKQESPALGRPVASDF

SEQ ID NO: 20005 - protein, 20 aa, synthetic construct
  source 1..20: note = Seed: SATGFKQSSKALQRPVASDF
SATGYKQESPALIRPVASDF

SEQ ID NO: 20006 - protein, 20 aa, synthetic construct
  source 1..20: note = Seed: SATGFKQSSKALQRPVASDF
SATGYKQESPALLRPVASDF

SEQ ID NO: 20007 - protein, 20 aa, synthetic construct
  source 1..20: note = Seed: SATGFKQSSKALQRPVASDF
SATGYKQESPALMRPVASDF

SEQ ID NO: 20008 - protein, 20 aa, synthetic construct
  source 1..20: note = Seed: SATGFKQSSKALQRPVASDF
SATGYKQESPALNRPVASDF

SEQ ID NO: 20009 - protein, 20 aa, synthetic construct
  source 1..20: note = Seed: SATGFKQSSKALQRPVASDF
SATGYKQESPALSRPVASDF

SEQ ID NO: 20010 - protein, 20 aa, synthetic construct
  source 1..20: note = Seed: SATGFKQSSKALQRPVASDF
SATGYKQESPALTRPVASDF

SEQ ID NO: 20011 - protein, 20 aa, synthetic construct
  source 1..20: note = Seed: SATGFKQSSKALQRPVASDF
SATGYKQESPALVRPVASDF

SEQ ID NO: 20012 - protein, 20 aa, synthetic construct
  source 1..20: note = Seed: SATGFKQSSKALQRPVASDF
SATGYKQESSALARPVASDF

SEQ ID NO: 20013 - protein, 20 aa, synthetic construct
  source 1..20: note = Seed: SATGFKQSSKALQRPVASDF
SATGYKQESSALGRPVASDF

SEQ ID NO: 20014 - protein, 20 aa, synthetic construct
  source 1..20: note = Seed: SATGFKQSSKALQRPVASDF
SATGYKQESSALIRPVASDF

SEQ ID NO: 20015 - protein, 20 aa, synthetic construct
  source 1..20: note = Seed: SATGFKQSSKALQRPVASDF
SATGYKQESSALLRPVASDF

SEQ ID NO: 20016 - protein, 20 aa, synthetic construct
  source 1..20: note = Seed: SATGFKQSSKALQRPVASDF
SATGYKQESSALMRPVASDF

SEQ ID NO: 20017 - protein, 20 aa, synthetic construct
  source 1..20: note = Seed: SATGFKQSSKALQRPVASDF
SATGYKQESSALNRPVASDF

SEQ ID NO: 20018 - protein, 20 aa, synthetic construct
  source 1..20: note = Seed: SATGFKQSSKALQRPVASDF
SATGYKQESSALSRPVASDF

SEQ ID NO: 20019 - protein, 20 aa, synthetic construct
  source 1..20: note = Seed: SATGFKQSSKALQRPVASDF
SATGYKQESSALTRPVASDF

SEQ ID NO: 20020 - protein, 20 aa, synthetic construct
  source 1..20: note = Seed: SATGFKQSSKALQRPVASDF
SATGYKQESSALVRPVASDF

SEQ ID NO: 20021 - protein, 20 aa, synthetic construct
  source 1..20: note = Seed: SATGFKQSSKALQRPVASDF
SATGYKQESTALARPVASDF

SEQ ID NO: 20022 - protein, 20 aa, synthetic construct
  source 1..20: note = Seed: SATGFKQSSKALQRPVASDF
SATGYKQESTALIRPVASDF

SEQ ID NO: 20023 - protein, 20 aa, synthetic construct
  source 1..20: note = Seed: SATGFKQSSKALQRPVASDF
SATGYKQESTALLRPVASDF

SEQ ID NO: 20024 - protein, 20 aa, synthetic construct
  source 1..20: note = Seed: SATGFKQSSKALQRPVASDF
SATGYKQESTALMRPVASDF

SEQ ID NO: 20025 - protein, 20 aa, synthetic construct
  source 1..20: note = Seed: SATGFKQSSKALQRPVASDF
SATGYKQESTALNRPVASDF

SEQ ID NO: 20026 - protein, 20 aa, synthetic construct
  source 1..20: note = Seed: SATGFKQSSKALQRPVASDF
SATGYKQESTALSRPVASDF

SEQ ID NO: 20027 - protein, 20 aa, synthetic construct
  source 1..20: note = Seed: SATGFKQSSKALQRPVASDF
SATGYKQESTALTRPVASDF

SEQ ID NO: 20028 - protein, 20 aa, synthetic construct
  source 1..20: note = Seed: SATGFKQSSKALQRPVASDF
SATGYKQESTALVRPVASDF

SEQ ID NO: 20029 - protein, 20 aa, synthetic construct
  source 1..20: note = Seed: SATGFKQSSKALQRPVASDF
SATGYKQESVALARPVASDF

SEQ ID NO: 20030 - protein, 20 aa, synthetic construct
  source 1..20: note = Seed: SATGFKQSSKALQRPVASDF
SATGYKQESVALFRPVASDF

SEQ ID NO: 20031 - protein, 20 aa, synthetic construct
  source 1..20: note = Seed: SATGFKQSSKALQRPVASDF
SATGYKQESVALGRPVASDF

SEQ ID NO: 20032 - protein, 20 aa, synthetic construct
  source 1..20: note = Seed: SATGFKQSSKALQRPVASDF
SATGYKQESVALHRPVASDF

SEQ ID NO: 20033 - protein, 20 aa, synthetic construct
  source 1..20: note = Seed: SATGFKQSSKALQRPVASDF
SATGYKQESVALIRPVASDF

SEQ ID NO: 20034 - protein, 20 aa, synthetic construct
  source 1..20: note = Seed: SATGFKQSSKALQRPVASDF
SATGYKQESVALLRPVASDF

SEQ ID NO: 20035 - protein, 20 aa, synthetic construct
  source 1..20: note = Seed: SATGFKQSSKALQRPVASDF
SATGYKQESVALMRPVASDF

SEQ ID NO: 20036 - protein, 20 aa, synthetic construct
  source 1..20: note = Seed: SATGFKQSSKALQRPVASDF
SATGYKQESVALNRPVASDF

SEQ ID NO: 20037 - protein, 20 aa, synthetic construct
  source 1..20: note = Seed: SATGFKQSSKALQRPVASDF
SATGYKQESVALQRPVASDF

SEQ ID NO: 20038 - protein, 20 aa, synthetic construct
  source 1..20: note = Seed: SATGFKQSSKALQRPVASDF
SATGYKQESVALSRPVASDF

SEQ ID NO: 20039 - protein, 20 aa, synthetic construct
  source 1..20: note = Seed: SATGFKQSSKALQRPVASDF
SATGYKQESVALTRPVASDF

SEQ ID NO: 20040 - protein, 20 aa, synthetic construct
  source 1..20: note = Seed: SATGFKQSSKALQRPVASDF
SATGYKQESVALVRPVASDF

SEQ ID NO: 20041 - protein, 20 aa, synthetic construct
  source 1..20: note = Seed: SATGFKQSSKALQRPVASDF
SATGYKQFSAALARPVASDF

SEQ ID NO: 20042 - protein, 20 aa, synthetic construct
  source 1..20: note = Seed: SATGFKQSSKALQRPVASDF
SATGYKQFSAALCRPVASDF

SEQ ID NO: 20043 - protein, 20 aa, synthetic construct
  source 1..20: note = Seed: SATGFKQSSKALQRPVASDF
SATGYKQFSAALDRPVASDF

SEQ ID NO: 20044 - protein, 20 aa, synthetic construct
  source 1..20: note = Seed: SATGFKQSSKALQRPVASDF
SATGYKQFSAALERPVASDF

SEQ ID NO: 20045 - protein, 20 aa, synthetic construct
  source 1..20: note = Seed: SATGFKQSSKALQRPVASDF
SATGYKQFSAALFRPVASDF

SEQ ID NO: 20046 - protein, 20 aa, synthetic construct
  source 1..20: note = Seed: SATGFKQSSKALQRPVASDF
SATGYKQFSAALGRPVASDF

SEQ ID NO: 20047 - protein, 20 aa, synthetic construct
  source 1..20: note = Seed: SATGFKQSSKALQRPVASDF
SATGYKQFSAALHRPVASDF

SEQ ID NO: 20048 - protein, 20 aa, synthetic construct
  source 1..20: note = Seed: SATGFKQSSKALQRPVASDF
SATGYKQFSAALIRPVASDF

SEQ ID NO: 20049 - protein, 20 aa, synthetic construct
  source 1..20: note = Seed: SATGFKQSSKALQRPVASDF
SATGYKQFSAALKRPVASDF

SEQ ID NO: 20050 - protein, 20 aa, synthetic construct
  source 1..20: note = Seed: SATGFKQSSKALQRPVASDF
SATGYKQFSAALLRPVASDF

SEQ ID NO: 20051 - protein, 20 aa, synthetic construct
  source 1..20: note = Seed: SATGFKQSSKALQRPVASDF
SATGYKQFSAALMRPVASDF

SEQ ID NO: 20052 - protein, 20 aa, synthetic construct
  source 1..20: note = Seed: SATGFKQSSKALQRPVASDF
SATGYKQFSAALNRPVASDF

SEQ ID NO: 20053 - protein, 20 aa, synthetic construct
  source 1..20: note = Seed: SATGFKQSSKALQRPVASDF
SATGYKQFSAALQRPVASDF

SEQ ID NO: 20054 - protein, 20 aa, synthetic construct
  source 1..20: note = Seed: SATGFKQSSKALQRPVASDF
SATGYKQFSAALRRPVASDF

SEQ ID NO: 20055 - protein, 20 aa, synthetic construct
  source 1..20: note = Seed: SATGFKQSSKALQRPVASDF
SATGYKQFSAALSRPVASDF

SEQ ID NO: 20056 - protein, 20 aa, synthetic construct
  source 1..20: note = Seed: SATGFKQSSKALQRPVASDF
SATGYKQFSAALVRPVASDF

SEQ ID NO: 20057 - protein, 20 aa, synthetic construct
  source 1..20: note = Seed: SATGFKQSSKALQRPVASDF
SATGYKQFSAALWRPVASDF

SEQ ID NO: 20058 - protein, 20 aa, synthetic construct
  source 1..20: note = Seed: SATGFKQSSKALQRPVASDF
SATGYKQFSAALYRPVASDF

SEQ ID NO: 20059 - protein, 20 aa, synthetic construct
  source 1..20: note = Seed: SATGFKQSSKALQRPVASDF
SATGYKQFSCALLRPVASDF

SEQ ID NO: 20060 - protein, 20 aa, synthetic construct
  source 1..20: note = Seed: SATGFKQSSKALQRPVASDF
SATGYKQFSDALSRPVASDF

SEQ ID NO: 20061 - protein, 20 aa, synthetic construct
  source 1..20: note = Seed: SATGFKQSSKALQRPVASDF
SATGYKQFSEALGRPVASDF

SEQ ID NO: 20062 - protein, 20 aa, synthetic construct
  source 1..20: note = Seed: SATGFKQSSKALQRPVASDF
SATGYKQFSEALIRPVASDF

SEQ ID NO: 20063 - protein, 20 aa, synthetic construct
  source 1..20: note = Seed: SATGFKQSSKALQRPVASDF
SATGYKQFSEALLRPVASDF

SEQ ID NO: 20064 - protein, 20 aa, synthetic construct
  source 1..20: note = Seed: SATGFKQSSKALQRPVASDF
SATGYKQFSEALMRPVASDF

SEQ ID NO: 20065 - protein, 20 aa, synthetic construct
  source 1..20: note = Seed: SATGFKQSSKALQRPVASDF
SATGYKQFSEALNRPVASDF

SEQ ID NO: 20066 - protein, 20 aa, synthetic construct
  source 1..20: note = Seed: SATGFKQSSKALQRPVASDF
SATGYKQFSFALDRPVASDF

SEQ ID NO: 20067 - protein, 20 aa, synthetic construct
  source 1..20: note = Seed: SATGFKQSSKALQRPVASDF
SATGYKQFSFALERPVASDF

SEQ ID NO: 20068 - protein, 20 aa, synthetic construct
  source 1..20: note = Seed: SATGFKQSSKALQRPVASDF
SATGYKQFSFALNRPVASDF

SEQ ID NO: 20069 - protein, 20 aa, synthetic construct
  source 1..20: note = Seed: SATGFKQSSKALQRPVASDF
SATGYKQFSGALARPVASDF

SEQ ID NO: 20070 - protein, 20 aa, synthetic construct
  source 1..20: note = Seed: SATGFKQSSKALQRPVASDF
SATGYKQFSGALCRPVASDF

SEQ ID NO: 20071 - protein, 20 aa, synthetic construct
  source 1..20: note = Seed: SATGFKQSSKALQRPVASDF
SATGYKQFSGALFRPVASDF

SEQ ID NO: 20072 - protein, 20 aa, synthetic construct
  source 1..20: note = Seed: SATGFKQSSKALQRPVASDF
SATGYKQFSGALGRPVASDF

SEQ ID NO: 20073 - protein, 20 aa, synthetic construct
  source 1..20: note = Seed: SATGFKQSSKALQRPVASDF
SATGYKQFSGALHRPVASDF

SEQ ID NO: 20074 - protein, 20 aa, synthetic construct
  source 1..20: note = Seed: SATGFKQSSKALQRPVASDF
SATGYKQFSGALIRPVASDF

SEQ ID NO: 20075 - protein, 20 aa, synthetic construct
  source 1..20: note = Seed: SATGFKQSSKALQRPVASDF
SATGYKQFSGALLRPVASDF

SEQ ID NO: 20076 - protein, 20 aa, synthetic construct
  source 1..20: note = Seed: SATGFKQSSKALQRPVASDF
SATGYKQFSGALMRPVASDF

SEQ ID NO: 20077 - protein, 20 aa, synthetic construct
  source 1..20: note = Seed: SATGFKQSSKALQRPVASDF
SATGYKQFSGALNRPVASDF

SEQ ID NO: 20078 - protein, 20 aa, synthetic construct
  source 1..20: note = Seed: SATGFKQSSKALQRPVASDF
SATGYKQFSGALQRPVASDF

SEQ ID NO: 20079 - protein, 20 aa, synthetic construct
  source 1..20: note = Seed: SATGFKQSSKALQRPVASDF
SATGYKQFSGALSRPVASDF

SEQ ID NO: 20080 - protein, 20 aa, synthetic construct
  source 1..20: note = Seed: SATGFKQSSKALQRPVASDF
SATGYKQFSGALTRPVASDF

SEQ ID NO: 20081 - protein, 20 aa, synthetic construct
  source 1..20: note = Seed: SATGFKQSSKALQRPVASDF
SATGYKQFSGALVRPVASDF

SEQ ID NO: 20082 - protein, 20 aa, synthetic construct
  source 1..20: note = Seed: SATGFKQSSKALQRPVASDF
SATGYKQFSHALARPVASDF

SEQ ID NO: 20083 - protein, 20 aa, synthetic construct
  source 1..20: note = Seed: SATGFKQSSKALQRPVASDF
SATGYKQFSHALHRPVASDF

SEQ ID NO: 20084 - protein, 20 aa, synthetic construct
  source 1..20: note = Seed: SATGFKQSSKALQRPVASDF
SATGYKQFSHALLRPVASDF

SEQ ID NO: 20085 - protein, 20 aa, synthetic construct
  source 1..20: note = Seed: SATGFKQSSKALQRPVASDF
SATGYKQFSHALQRPVASDF

SEQ ID NO: 20086 - protein, 20 aa, synthetic construct
  source 1..20: note = Seed: SATGFKQSSKALQRPVASDF
SATGYKQFSHALRRPVASDF

SEQ ID NO: 20087 - protein, 20 aa, synthetic construct
  source 1..20: note = Seed: SATGFKQSSKALQRPVASDF
SATGYKQFSHALSRPVASDF

SEQ ID NO: 20088 - protein, 20 aa, synthetic construct
  source 1..20: note = Seed: SATGFKQSSKALQRPVASDF
SATGYKQFSHALTRPVASDF

SEQ ID NO: 20089 - protein, 20 aa, synthetic construct
  source 1..20: note = Seed: SATGFKQSSKALQRPVASDF
SATGYKQFSHALVRPVASDF

SEQ ID NO: 20090 - protein, 20 aa, synthetic construct
  source 1..20: note = Seed: SATGFKQSSKALQRPVASDF
SATGYKQFSIALARPVASDF

SEQ ID NO: 20091 - protein, 20 aa, synthetic construct
  source 1..20: note = Seed: SATGFKQSSKALQRPVASDF
SATGYKQFSIALDRPVASDF

SEQ ID NO: 20092 - protein, 20 aa, synthetic construct
  source 1..20: note = Seed: SATGFKQSSKALQRPVASDF
SATGYKQFSIALHRPVASDF

SEQ ID NO: 20093 - protein, 20 aa, synthetic construct
  source 1..20: note = Seed: SATGFKQSSKALQRPVASDF
SATGYKQFSIALNRPVASDF

SEQ ID NO: 20094 - protein, 20 aa, synthetic construct
  source 1..20: note = Seed: SATGFKQSSKALQRPVASDF
SATGYKQFSIALSRPVASDF

SEQ ID NO: 20095 - protein, 20 aa, synthetic construct
  source 1..20: note = Seed: SATGFKQSSKALQRPVASDF
SATGYKQFSKALARPVASDF

SEQ ID NO: 20096 - protein, 20 aa, synthetic construct
  source 1..20: note = Seed: SATGFKQSSKALQRPVASDF
SATGYKQFSKALGRPVASDF

SEQ ID NO: 20097 - protein, 20 aa, synthetic construct
  source 1..20: note = Seed: SATGFKQSSKALQRPVASDF
SATGYKQFSKALHRPVASDF

SEQ ID NO: 20098 - protein, 20 aa, synthetic construct
  source 1..20: note = Seed: SATGFKQSSKALQRPVASDF
SATGYKQFSKALIRPVASDF

SEQ ID NO: 20099 - protein, 20 aa, synthetic construct
  source 1..20: note = Seed: SATGFKQSSKALQRPVASDF
SATGYKQFSKALKRPVASDF

SEQ ID NO: 20100 - protein, 20 aa, synthetic construct
  source 1..20: note = Seed: SATGFKQSSKALQRPVASDF
SATGYKQFSKALLRPVASDF

SEQ ID NO: 20101 - protein, 20 aa, synthetic construct
  source 1..20: note = Seed: SATGFKQSSKALQRPVASDF
SATGYKQFSKALMRPVASDF

SEQ ID NO: 20102 - protein, 20 aa, synthetic construct
  source 1..20: note = Seed: SATGFKQSSKALQRPVASDF
SATGYKQFSKALNRPVASDF

SEQ ID NO: 20103 - protein, 20 aa, synthetic construct
  source 1..20: note = Seed: SATGFKQSSKALQRPVASDF
SATGYKQFSKALPRPVASDF

SEQ ID NO: 20104 - protein, 20 aa, synthetic construct
  source 1..20: note = Seed: SATGFKQSSKALQRPVASDF
SATGYKQFSKALQRPVASDF

SEQ ID NO: 20105 - protein, 20 aa, synthetic construct
  source 1..20: note = Seed: SATGFKQSSKALQRPVASDF
SATGYKQFSKALRRPVASDF

SEQ ID NO: 20106 - protein, 20 aa, synthetic construct
  source 1..20: note = Seed: SATGFKQSSKALQRPVASDF
SATGYKQFSKALSRPVASDF

SEQ ID NO: 20107 - protein, 20 aa, synthetic construct
  source 1..20: note = Seed: SATGFKQSSKALQRPVASDF
SATGYKQFSKALTRPVASDF

SEQ ID NO: 20108 - protein, 20 aa, synthetic construct
  source 1..20: note = Seed: SATGFKQSSKALQRPVASDF
SATGYKQFSKALVRPVASDF

SEQ ID NO: 20109 - protein, 20 aa, synthetic construct
  source 1..20: note = Seed: SATGFKQSSKALQRPVASDF
SATGYKQFSLALARPVASDF

SEQ ID NO: 20110 - protein, 20 aa, synthetic construct
  source 1..20: note = Seed: SATGFKQSSKALQRPVASDF
SATGYKQFSLALERPVASDF

SEQ ID NO: 20111 - protein, 20 aa, synthetic construct
  source 1..20: note = Seed: SATGFKQSSKALQRPVASDF
SATGYKQFSLALMRPVASDF

SEQ ID NO: 20112 - protein, 20 aa, synthetic construct
  source 1..20: note = Seed: SATGFKQSSKALQRPVASDF
SATGYKQFSLALSRPVASDF

SEQ ID NO: 20113 - protein, 20 aa, synthetic construct
  source 1..20: note = Seed: SATGFKQSSKALQRPVASDF
SATGYKQFSLALTRPVASDF

SEQ ID NO: 20114 - protein, 20 aa, synthetic construct
  source 1..20: note = Seed: SATGFKQSSKALQRPVASDF
SATGYKQFSMALRRPVASDF

SEQ ID NO: 20115 - protein, 20 aa, synthetic construct
  source 1..20: note = Seed: SATGFKQSSKALQRPVASDF
SATGYKQFSMALSRPVASDF

SEQ ID NO: 20116 - protein, 20 aa, synthetic construct
  source 1..20: note = Seed: SATGFKQSSKALQRPVASDF
SATGYKQFSNALARPVASDF

SEQ ID NO: 20117 - protein, 20 aa, synthetic construct
  source 1..20: note = Seed: SATGFKQSSKALQRPVASDF
SATGYKQFSNALGRPVASDF

SEQ ID NO: 20118 - protein, 20 aa, synthetic construct
  source 1..20: note = Seed: SATGFKQSSKALQRPVASDF
SATGYKQFSNALHRPVASDF

SEQ ID NO: 20119 - protein, 20 aa, synthetic construct
  source 1..20: note = Seed: SATGFKQSSKALQRPVASDF
SATGYKQFSNALIRPVASDF

SEQ ID NO: 20120 - protein, 20 aa, synthetic construct
  source 1..20: note = Seed: SATGFKQSSKALQRPVASDF
SATGYKQFSNALLRPVASDF

SEQ ID NO: 20121 - protein, 20 aa, synthetic construct
  source 1..20: note = Seed: SATGFKQSSKALQRPVASDF
SATGYKQFSNALMRPVASDF

SEQ ID NO: 20122 - protein, 20 aa, synthetic construct
  source 1..20: note = Seed: SATGFKQSSKALQRPVASDF
SATGYKQFSNALNRPVASDF

SEQ ID NO: 20123 - protein, 20 aa, synthetic construct
  source 1..20: note = Seed: SATGFKQSSKALQRPVASDF
SATGYKQFSNALQRPVASDF

SEQ ID NO: 20124 - protein, 20 aa, synthetic construct
  source 1..20: note = Seed: SATGFKQSSKALQRPVASDF
SATGYKQFSNALSRPVASDF

SEQ ID NO: 20125 - protein, 20 aa, synthetic construct
  source 1..20: note = Seed: SATGFKQSSKALQRPVASDF
SATGYKQFSNALTRPVASDF

SEQ ID NO: 20126 - protein, 20 aa, synthetic construct
  source 1..20: note = Seed: SATGFKQSSKALQRPVASDF
SATGYKQFSNALVRPVASDF

SEQ ID NO: 20127 - protein, 20 aa, synthetic construct
  source 1..20: note = Seed: SATGFKQSSKALQRPVASDF
SATGYKQFSPALARPVASDF

SEQ ID NO: 20128 - protein, 20 aa, synthetic construct
  source 1..20: note = Seed: SATGFKQSSKALQRPVASDF
SATGYKQFSPALCRPVASDF

SEQ ID NO: 20129 - protein, 20 aa, synthetic construct
  source 1..20: note = Seed: SATGFKQSSKALQRPVASDF
SATGYKQFSPALDRPVASDF

SEQ ID NO: 20130 - protein, 20 aa, synthetic construct
  source 1..20: note = Seed: SATGFKQSSKALQRPVASDF
SATGYKQFSPALERPVASDF

SEQ ID NO: 20131 - protein, 20 aa, synthetic construct
  source 1..20: note = Seed: SATGFKQSSKALQRPVASDF
SATGYKQFSPALFRPVASDF

SEQ ID NO: 20132 - protein, 20 aa, synthetic construct
  source 1..20: note = Seed: SATGFKQSSKALQRPVASDF
SATGYKQFSPALGRPVASDF

SEQ ID NO: 20133 - protein, 20 aa, synthetic construct
  source 1..20: note = Seed: SATGFKQSSKALQRPVASDF
SATGYKQFSPALHRPVASDF

SEQ ID NO: 20134 - protein, 20 aa, synthetic construct
  source 1..20: note = Seed: SATGFKQSSKALQRPVASDF
SATGYKQFSPALIRPVASDF

SEQ ID NO: 20135 - protein, 20 aa, synthetic construct
  source 1..20: note = Seed: SATGFKQSSKALQRPVASDF
SATGYKQFSPALLRPVASDF

SEQ ID NO: 20136 - protein, 20 aa, synthetic construct
  source 1..20: note = Seed: SATGFKQSSKALQRPVASDF
SATGYKQFSPALMRPVASDF

SEQ ID NO: 20137 - protein, 20 aa, synthetic construct
  source 1..20: note = Seed: SATGFKQSSKALQRPVASDF
SATGYKQFSPALNRPVASDF

SEQ ID NO: 20138 - protein, 20 aa, synthetic construct
  source 1..20: note = Seed: SATGFKQSSKALQRPVASDF
SATGYKQFSPALQRPVASDF

SEQ ID NO: 20139 - protein, 20 aa, synthetic construct
  source 1..20: note = Seed: SATGFKQSSKALQRPVASDF
SATGYKQFSPALSRPVASDF

SEQ ID NO: 20140 - protein, 20 aa, synthetic construct
  source 1..20: note = Seed: SATGFKQSSKALQRPVASDF
SATGYKQFSPALVRPVASDF

SEQ ID NO: 20141 - protein, 20 aa, synthetic construct
  source 1..20: note = Seed: SATGFKQSSKALQRPVASDF
SATGYKQFSPALWRPVASDF

SEQ ID NO: 20142 - protein, 20 aa, synthetic construct
  source 1..20: note = Seed: SATGFKQSSKALQRPVASDF
SATGYKQFSQALLRPVASDF

SEQ ID NO: 20143 - protein, 20 aa, synthetic construct
  source 1..20: note = Seed: SATGFKQSSKALQRPVASDF
SATGYKQFSRALARPVASDF

SEQ ID NO: 20144 - protein, 20 aa, synthetic construct
  source 1..20: note = Seed: SATGFKQSSKALQRPVASDF
SATGYKQFSRALGRPVASDF

SEQ ID NO: 20145 - protein, 20 aa, synthetic construct
  source 1..20: note = Seed: SATGFKQSSKALQRPVASDF
SATGYKQFSRALHRPVASDF

SEQ ID NO: 20146 - protein, 20 aa, synthetic construct
  source 1..20: note = Seed: SATGFKQSSKALQRPVASDF
SATGYKQFSRALIRPVASDF

SEQ ID NO: 20147 - protein, 20 aa, synthetic construct
  source 1..20: note = Seed: SATGFKQSSKALQRPVASDF
SATGYKQFSRALKRPVASDF

SEQ ID NO: 20148 - protein, 20 aa, synthetic construct
  source 1..20: note = Seed: SATGFKQSSKALQRPVASDF
SATGYKQFSRALLRPVASDF

SEQ ID NO: 20149 - protein, 20 aa, synthetic construct
  source 1..20: note = Seed: SATGFKQSSKALQRPVASDF
SATGYKQFSRALMRPVASDF

SEQ ID NO: 20150 - protein, 20 aa, synthetic construct
  source 1..20: note = Seed: SATGFKQSSKALQRPVASDF
SATGYKQFSRALNRPVASDF

SEQ ID NO: 20151 - protein, 20 aa, synthetic construct
  source 1..20: note = Seed: SATGFKQSSKALQRPVASDF
SATGYKQFSRALPRPVASDF

SEQ ID NO: 20152 - protein, 20 aa, synthetic construct
  source 1..20: note = Seed: SATGFKQSSKALQRPVASDF
SATGYKQFSRALQRPVASDF

SEQ ID NO: 20153 - protein, 20 aa, synthetic construct
  source 1..20: note = Seed: SATGFKQSSKALQRPVASDF
SATGYKQFSRALRRPVASDF

SEQ ID NO: 20154 - protein, 20 aa, synthetic construct
  source 1..20: note = Seed: SATGFKQSSKALQRPVASDF
SATGYKQFSRALSRPVASDF

SEQ ID NO: 20155 - protein, 20 aa, synthetic construct
  source 1..20: note = Seed: SATGFKQSSKALQRPVASDF
SATGYKQFSRALTRPVASDF

SEQ ID NO: 20156 - protein, 20 aa, synthetic construct
  source 1..20: note = Seed: SATGFKQSSKALQRPVASDF
SATGYKQFSRALVRPVASDF

SEQ ID NO: 20157 - protein, 20 aa, synthetic construct
  source 1..20: note = Seed: SATGFKQSSKALQRPVASDF
SATGYKQFSSALARPVASDF

SEQ ID NO: 20158 - protein, 20 aa, synthetic construct
  source 1..20: note = Seed: SATGFKQSSKALQRPVASDF
SATGYKQFSSALCRPVASDF

SEQ ID NO: 20159 - protein, 20 aa, synthetic construct
  source 1..20: note = Seed: SATGFKQSSKALQRPVASDF
SATGYKQFSSALDRPVASDF

SEQ ID NO: 20160 - protein, 20 aa, synthetic construct
  source 1..20: note = Seed: SATGFKQSSKALQRPVASDF
SATGYKQFSSALERPVASDF

SEQ ID NO: 20161 - protein, 20 aa, synthetic construct
  source 1..20: note = Seed: SATGFKQSSKALQRPVASDF
SATGYKQFSSALFRPVASDF

SEQ ID NO: 20162 - protein, 20 aa, synthetic construct
  source 1..20: note = Seed: SATGFKQSSKALQRPVASDF
SATGYKQFSSALGRPVASDF

SEQ ID NO: 20163 - protein, 20 aa, synthetic construct
  source 1..20: note = Seed: SATGFKQSSKALQRPVASDF
SATGYKQFSSALHRPVASDF

SEQ ID NO: 20164 - protein, 20 aa, synthetic construct
  source 1..20: note = Seed: SATGFKQSSKALQRPVASDF
SATGYKQFSSALIRPVASDF

SEQ ID NO: 20165 - protein, 20 aa, synthetic construct
  source 1..20: note = Seed: SATGFKQSSKALQRPVASDF
SATGYKQFSSALKRPVASDF

SEQ ID NO: 20166 - protein, 20 aa, synthetic construct
  source 1..20: note = Seed: SATGFKQSSKALQRPVASDF
SATGYKQFSSALLRPVASDF

SEQ ID NO: 20167 - protein, 20 aa, synthetic construct
  source 1..20: note = Seed: SATGFKQSSKALQRPVASDF
SATGYKQFSSALMRPVASDF

SEQ ID NO: 20168 - protein, 20 aa, synthetic construct
  source 1..20: note = Seed: SATGFKQSSKALQRPVASDF
SATGYKQFSSALNRPVASDF

SEQ ID NO: 20169 - protein, 20 aa, synthetic construct
  source 1..20: note = Seed: SATGFKQSSKALQRPVASDF
SATGYKQFSSALPRPVASDF

SEQ ID NO: 20170 - protein, 20 aa, synthetic construct
  source 1..20: note = Seed: SATGFKQSSKALQRPVASDF
SATGYKQFSSALQRPVASDF

SEQ ID NO: 20171 - protein, 20 aa, synthetic construct
  source 1..20: note = Seed: SATGFKQSSKALQRPVASDF
SATGYKQFSSALRRPVASDF

SEQ ID NO: 20172 - protein, 20 aa, synthetic construct
  source 1..20: note = Seed: SATGFKQSSKALQRPVASDF
SATGYKQFSSALSRPVASDF

SEQ ID NO: 20173 - protein, 20 aa, synthetic construct
  source 1..20: note = Seed: SATGFKQSSKALQRPVASDF
SATGYKQFSSALTRPVASDF

SEQ ID NO: 20174 - protein, 20 aa, synthetic construct
  source 1..20: note = Seed: SATGFKQSSKALQRPVASDF
SATGYKQFSSALVRPVASDF

SEQ ID NO: 20175 - protein, 20 aa, synthetic construct
  source 1..20: note = Seed: SATGFKQSSKALQRPVASDF
SATGYKQFSSALYRPVASDF

SEQ ID NO: 20176 - protein, 20 aa, synthetic construct
  source 1..20: note = Seed: SATGFKQSSKALQRPVASDF
SATGYKQFSTALARPVASDF

SEQ ID NO: 20177 - protein, 20 aa, synthetic construct
  source 1..20: note = Seed: SATGFKQSSKALQRPVASDF
SATGYKQFSTALCRPVASDF

SEQ ID NO: 20178 - protein, 20 aa, synthetic construct
  source 1..20: note = Seed: SATGFKQSSKALQRPVASDF
SATGYKQFSTALDRPVASDF

SEQ ID NO: 20179 - protein, 20 aa, synthetic construct
  source 1..20: note = Seed: SATGFKQSSKALQRPVASDF
SATGYKQFSTALERPVASDF

SEQ ID NO: 20180 - protein, 20 aa, synthetic construct
  source 1..20: note = Seed: SATGFKQSSKALQRPVASDF
SATGYKQFSTALFRPVASDF

SEQ ID NO: 20181 - protein, 20 aa, synthetic construct
  source 1..20: note = Seed: SATGFKQSSKALQRPVASDF
SATGYKQFSTALGRPVASDF

SEQ ID NO: 20182 - protein, 20 aa, synthetic construct
  source 1..20: note = Seed: SATGFKQSSKALQRPVASDF
SATGYKQFSTALHRPVASDF

SEQ ID NO: 20183 - protein, 20 aa, synthetic construct
  source 1..20: note = Seed: SATGFKQSSKALQRPVASDF
SATGYKQFSTALIRPVASDF

SEQ ID NO: 20184 - protein, 20 aa, synthetic construct
  source 1..20: note = Seed: SATGFKQSSKALQRPVASDF
SATGYKQFSTALKRPVASDF

SEQ ID NO: 20185 - protein, 20 aa, synthetic construct
  source 1..20: note = Seed: SATGFKQSSKALQRPVASDF
SATGYKQFSTALLRPVASDF

SEQ ID NO: 20186 - protein, 20 aa, synthetic construct
  source 1..20: note = Seed: SATGFKQSSKALQRPVASDF
SATGYKQFSTALMRPVASDF

SEQ ID NO: 20187 - protein, 20 aa, synthetic construct
  source 1..20: note = Seed: SATGFKQSSKALQRPVASDF
SATGYKQFSTALNRPVASDF

SEQ ID NO: 20188 - protein, 20 aa, synthetic construct
  source 1..20: note = Seed: SATGFKQSSKALQRPVASDF
SATGYKQFSTALQRPVASDF

SEQ ID NO: 20189 - protein, 20 aa, synthetic construct
  source 1..20: note = Seed: SATGFKQSSKALQRPVASDF
SATGYKQFSTALRRPVASDF

SEQ ID NO: 20190 - protein, 20 aa, synthetic construct
  source 1..20: note = Seed: SATGFKQSSKALQRPVASDF
SATGYKQFSTALSRPVASDF

SEQ ID NO: 20191 - protein, 20 aa, synthetic construct
  source 1..20: note = Seed: SATGFKQSSKALQRPVASDF
SATGYKQFSTALTRPVASDF

SEQ ID NO: 20192 - protein, 20 aa, synthetic construct
  source 1..20: note = Seed: SATGFKQSSKALQRPVASDF
SATGYKQFSTALVRPVASDF

SEQ ID NO: 20193 - protein, 20 aa, synthetic construct
  source 1..20: note = Seed: SATGFKQSSKALQRPVASDF
SATGYKQFSTALWRPVASDF

SEQ ID NO: 20194 - protein, 20 aa, synthetic construct
  source 1..20: note = Seed: SATGFKQSSKALQRPVASDF
SATGYKQFSTALYRPVASDF

SEQ ID NO: 20195 - protein, 20 aa, synthetic construct
  source 1..20: note = Seed: SATGFKQSSKALQRPVASDF
SATGYKQFSVALARPVASDF

SEQ ID NO: 20196 - protein, 20 aa, synthetic construct
  source 1..20: note = Seed: SATGFKQSSKALQRPVASDF
SATGYKQFSVALCRPVASDF

SEQ ID NO: 20197 - protein, 20 aa, synthetic construct
  source 1..20: note = Seed: SATGFKQSSKALQRPVASDF
SATGYKQFSVALDRPVASDF

SEQ ID NO: 20198 - protein, 20 aa, synthetic construct
  source 1..20: note = Seed: SATGFKQSSKALQRPVASDF
SATGYKQFSVALERPVASDF

SEQ ID NO: 20199 - protein, 20 aa, synthetic construct
  source 1..20: note = Seed: SATGFKQSSKALQRPVASDF
SATGYKQFSVALGRPVASDF

SEQ ID NO: 20200 - protein, 20 aa, synthetic construct
  source 1..20: note = Seed: SATGFKQSSKALQRPVASDF
SATGYKQFSVALHRPVASDF

SEQ ID NO: 20201 - protein, 20 aa, synthetic construct
  source 1..20: note = Seed: SATGFKQSSKALQRPVASDF
SATGYKQFSVALKRPVASDF

SEQ ID NO: 20202 - protein, 20 aa, synthetic construct
  source 1..20: note = Seed: SATGFKQSSKALQRPVASDF
SATGYKQFSVALLRPVASDF

SEQ ID NO: 20203 - protein, 20 aa, synthetic construct
  source 1..20: note = Seed: SATGFKQSSKALQRPVASDF
SATGYKQFSVALMRPVASDF

SEQ ID NO: 20204 - protein, 20 aa, synthetic construct
  source 1..20: note = Seed: SATGFKQSSKALQRPVASDF
SATGYKQFSVALNRPVASDF

SEQ ID NO: 20205 - protein, 20 aa, synthetic construct
  source 1..20: note = Seed: SATGFKQSSKALQRPVASDF
SATGYKQFSVALQRPVASDF

SEQ ID NO: 20206 - protein, 20 aa, synthetic construct
  source 1..20: note = Seed: SATGFKQSSKALQRPVASDF
SATGYKQFSVALRRPVASDF

SEQ ID NO: 20207 - protein, 20 aa, synthetic construct
  source 1..20: note = Seed: SATGFKQSSKALQRPVASDF
SATGYKQFSVALSRPVASDF

SEQ ID NO: 20208 - protein, 20 aa, synthetic construct
  source 1..20: note = Seed: SATGFKQSSKALQRPVASDF
SATGYKQFSVALVRPVASDF

SEQ ID NO: 20209 - protein, 20 aa, synthetic construct
  source 1..20: note = Seed: SATGFKQSSKALQRPVASDF
SATGYKQFSVALYRPVASDF

SEQ ID NO: 20210 - protein, 20 aa, synthetic construct
  source 1..20: note = Seed: SATGFKQSSKALQRPVASDF
SATGYKQGSAALARPVASDF

SEQ ID NO: 20211 - protein, 20 aa, synthetic construct
  source 1..20: note = Seed: SATGFKQSSKALQRPVASDF
SATGYKQGSAALFRPVASDF

SEQ ID NO: 20212 - protein, 20 aa, synthetic construct
  source 1..20: note = Seed: SATGFKQSSKALQRPVASDF
SATGYKQGSAALGRPVASDF

SEQ ID NO: 20213 - protein, 20 aa, synthetic construct
  source 1..20: note = Seed: SATGFKQSSKALQRPVASDF
SATGYKQGSAALIRPVASDF

SEQ ID NO: 20214 - protein, 20 aa, synthetic construct
  source 1..20: note = Seed: SATGFKQSSKALQRPVASDF
SATGYKQGSAALLRPVASDF

SEQ ID NO: 20215 - protein, 20 aa, synthetic construct
  source 1..20: note = Seed: SATGFKQSSKALQRPVASDF
SATGYKQGSAALMRPVASDF

SEQ ID NO: 20216 - protein, 20 aa, synthetic construct
  source 1..20: note = Seed: SATGFKQSSKALQRPVASDF
SATGYKQGSAALNRPVASDF

SEQ ID NO: 20217 - protein, 20 aa, synthetic construct
  source 1..20: note = Seed: SATGFKQSSKALQRPVASDF
SATGYKQGSAALSRPVASDF

SEQ ID NO: 20218 - protein, 20 aa, synthetic construct
  source 1..20: note = Seed: SATGFKQSSKALQRPVASDF
SATGYKQGSAALTRPVASDF

SEQ ID NO: 20219 - protein, 20 aa, synthetic construct
  source 1..20: note = Seed: SATGFKQSSKALQRPVASDF
SATGYKQGSAALVRPVASDF

SEQ ID NO: 20220 - protein, 20 aa, synthetic construct
  source 1..20: note = Seed: SATGFKQSSKALQRPVASDF
SATGYKQGSGALARPVASDF

SEQ ID NO: 20221 - protein, 20 aa, synthetic construct
  source 1..20: note = Seed: SATGFKQSSKALQRPVASDF
SATGYKQGSGALIRPVASDF

SEQ ID NO: 20222 - protein, 20 aa, synthetic construct
  source 1..20: note = Seed: SATGFKQSSKALQRPVASDF
SATGYKQGSGALLRPVASDF

SEQ ID NO: 20223 - protein, 20 aa, synthetic construct
  source 1..20: note = Seed: SATGFKQSSKALQRPVASDF
SATGYKQGSGALMRPVASDF

SEQ ID NO: 20224 - protein, 20 aa, synthetic construct
  source 1..20: note = Seed: SATGFKQSSKALQRPVASDF
SATGYKQGSGALSRPVASDF

SEQ ID NO: 20225 - protein, 20 aa, synthetic construct
  source 1..20: note = Seed: SATGFKQSSKALQRPVASDF
SATGYKQGSGALTRPVASDF

SEQ ID NO: 20226 - protein, 20 aa, synthetic construct
  source 1..20: note = Seed: SATGFKQSSKALQRPVASDF
SATGYKQGSGALVRPVASDF

SEQ ID NO: 20227 - protein, 20 aa, synthetic construct
  source 1..20: note = Seed: SATGFKQSSKALQRPVASDF
SATGYKQGSIALARPVASDF

SEQ ID NO: 20228 - protein, 20 aa, synthetic construct
  source 1..20: note = Seed: SATGFKQSSKALQRPVASDF
SATGYKQGSIALGRPVASDF

SEQ ID NO: 20229 - protein, 20 aa, synthetic construct
  source 1..20: note = Seed: SATGFKQSSKALQRPVASDF
SATGYKQGSIALHRPVASDF

SEQ ID NO: 20230 - protein, 20 aa, synthetic construct
  source 1..20: note = Seed: SATGFKQSSKALQRPVASDF
SATGYKQGSIALIRPVASDF

SEQ ID NO: 20231 - protein, 20 aa, synthetic construct
  source 1..20: note = Seed: SATGFKQSSKALQRPVASDF
SATGYKQGSIALNRPVASDF

SEQ ID NO: 20232 - protein, 20 aa, synthetic construct
  source 1..20: note = Seed: SATGFKQSSKALQRPVASDF
SATGYKQGSIALSRPVASDF

SEQ ID NO: 20233 - protein, 20 aa, synthetic construct
  source 1..20: note = Seed: SATGFKQSSKALQRPVASDF
SATGYKQGSIALTRPVASDF

SEQ ID NO: 20234 - protein, 20 aa, synthetic construct
  source 1..20: note = Seed: SATGFKQSSKALQRPVASDF
SATGYKQGSIALVRPVASDF

SEQ ID NO: 20235 - protein, 20 aa, synthetic construct
  source 1..20: note = Seed: SATGFKQSSKALQRPVASDF
SATGYKQGSLALIRPVASDF

SEQ ID NO: 20236 - protein, 20 aa, synthetic construct
  source 1..20: note = Seed: SATGFKQSSKALQRPVASDF
SATGYKQGSLALNRPVASDF

SEQ ID NO: 20237 - protein, 20 aa, synthetic construct
  source 1..20: note = Seed: SATGFKQSSKALQRPVASDF
SATGYKQGSLALSRPVASDF

SEQ ID NO: 20238 - protein, 20 aa, synthetic construct
  source 1..20: note = Seed: SATGFKQSSKALQRPVASDF
SATGYKQGSLALVRPVASDF

SEQ ID NO: 20239 - protein, 20 aa, synthetic construct
  source 1..20: note = Seed: SATGFKQSSKALQRPVASDF
SATGYKQGSMALIRPVASDF

SEQ ID NO: 20240 - protein, 20 aa, synthetic construct
  source 1..20: note = Seed: SATGFKQSSKALQRPVASDF
SATGYKQGSMALSRPVASDF

SEQ ID NO: 20241 - protein, 20 aa, synthetic construct
  source 1..20: note = Seed: SATGFKQSSKALQRPVASDF
SATGYKQGSMALVRPVASDF

SEQ ID NO: 20242 - protein, 20 aa, synthetic construct
  source 1..20: note = Seed: SATGFKQSSKALQRPVASDF
SATGYKQGSNALARPVASDF

SEQ ID NO: 20243 - protein, 20 aa, synthetic construct
  source 1..20: note = Seed: SATGFKQSSKALQRPVASDF
SATGYKQGSNALIRPVASDF

SEQ ID NO: 20244 - protein, 20 aa, synthetic construct
  source 1..20: note = Seed: SATGFKQSSKALQRPVASDF
SATGYKQGSNALLRPVASDF

SEQ ID NO: 20245 - protein, 20 aa, synthetic construct
  source 1..20: note = Seed: SATGFKQSSKALQRPVASDF
SATGYKQGSNALMRPVASDF

SEQ ID NO: 20246 - protein, 20 aa, synthetic construct
  source 1..20: note = Seed: SATGFKQSSKALQRPVASDF
SATGYKQGSNALVRPVASDF

SEQ ID NO: 20247 - protein, 20 aa, synthetic construct
  source 1..20: note = Seed: SATGFKQSSKALQRPVASDF
SATGYKQGSPALARPVASDF

SEQ ID NO: 20248 - protein, 20 aa, synthetic construct
  source 1..20: note = Seed: SATGFKQSSKALQRPVASDF
SATGYKQGSPALIRPVASDF

SEQ ID NO: 20249 - protein, 20 aa, synthetic construct
  source 1..20: note = Seed: SATGFKQSSKALQRPVASDF
SATGYKQGSPALLRPVASDF

SEQ ID NO: 20250 - protein, 20 aa, synthetic construct
  source 1..20: note = Seed: SATGFKQSSKALQRPVASDF
SATGYKQGSPALMRPVASDF

SEQ ID NO: 20251 - protein, 20 aa, synthetic construct
  source 1..20: note = Seed: SATGFKQSSKALQRPVASDF
SATGYKQGSPALSRPVASDF

SEQ ID NO: 20252 - protein, 20 aa, synthetic construct
  source 1..20: note = Seed: SATGFKQSSKALQRPVASDF
SATGYKQGSPALTRPVASDF

SEQ ID NO: 20253 - protein, 20 aa, synthetic construct
  source 1..20: note = Seed: SATGFKQSSKALQRPVASDF
SATGYKQGSPALVRPVASDF

SEQ ID NO: 20254 - protein, 20 aa, synthetic construct
  source 1..20: note = Seed: SATGFKQSSKALQRPVASDF
SATGYKQGSSALARPVASDF

SEQ ID NO: 20255 - protein, 20 aa, synthetic construct
  source 1..20: note = Seed: SATGFKQSSKALQRPVASDF
SATGYKQGSSALIRPVASDF

SEQ ID NO: 20256 - protein, 20 aa, synthetic construct
  source 1..20: note = Seed: SATGFKQSSKALQRPVASDF
SATGYKQGSSALLRPVASDF

SEQ ID NO: 20257 - protein, 20 aa, synthetic construct
  source 1..20: note = Seed: SATGFKQSSKALQRPVASDF
SATGYKQGSSALMRPVASDF

SEQ ID NO: 20258 - protein, 20 aa, synthetic construct
  source 1..20: note = Seed: SATGFKQSSKALQRPVASDF
SATGYKQGSSALNRPVASDF

SEQ ID NO: 20259 - protein, 20 aa, synthetic construct
  source 1..20: note = Seed: SATGFKQSSKALQRPVASDF
SATGYKQGSSALSRPVASDF

SEQ ID NO: 20260 - protein, 20 aa, synthetic construct
  source 1..20: note = Seed: SATGFKQSSKALQRPVASDF
SATGYKQGSSALTRPVASDF

SEQ ID NO: 20261 - protein, 20 aa, synthetic construct
  source 1..20: note = Seed: SATGFKQSSKALQRPVASDF
SATGYKQGSSALVRPVASDF

SEQ ID NO: 20262 - protein, 20 aa, synthetic construct
  source 1..20: note = Seed: SATGFKQSSKALQRPVASDF
SATGYKQGSTALARPVASDF

SEQ ID NO: 20263 - protein, 20 aa, synthetic construct
  source 1..20: note = Seed: SATGFKQSSKALQRPVASDF
SATGYKQGSTALIRPVASDF

SEQ ID NO: 20264 - protein, 20 aa, synthetic construct
  source 1..20: note = Seed: SATGFKQSSKALQRPVASDF
SATGYKQGSTALLRPVASDF

SEQ ID NO: 20265 - protein, 20 aa, synthetic construct
  source 1..20: note = Seed: SATGFKQSSKALQRPVASDF
SATGYKQGSTALMRPVASDF

SEQ ID NO: 20266 - protein, 20 aa, synthetic construct
  source 1..20: note = Seed: SATGFKQSSKALQRPVASDF
SATGYKQGSTALNRPVASDF

SEQ ID NO: 20267 - protein, 20 aa, synthetic construct
  source 1..20: note = Seed: SATGFKQSSKALQRPVASDF
SATGYKQGSTALSRPVASDF

SEQ ID NO: 20268 - protein, 20 aa, synthetic construct
  source 1..20: note = Seed: SATGFKQSSKALQRPVASDF
SATGYKQGSTALVRPVASDF

SEQ ID NO: 20269 - protein, 20 aa, synthetic construct
  source 1..20: note = Seed: SATGFKQSSKALQRPVASDF
SATGYKQGSVALARPVASDF

SEQ ID NO: 20270 - protein, 20 aa, synthetic construct
  source 1..20: note = Seed: SATGFKQSSKALQRPVASDF
SATGYKQGSVALIRPVASDF

SEQ ID NO: 20271 - protein, 20 aa, synthetic construct
  source 1..20: note = Seed: SATGFKQSSKALQRPVASDF
SATGYKQGSVALLRPVASDF

SEQ ID NO: 20272 - protein, 20 aa, synthetic construct
  source 1..20: note = Seed: SATGFKQSSKALQRPVASDF
SATGYKQGSVALMRPVASDF

SEQ ID NO: 20273 - protein, 20 aa, synthetic construct
  source 1..20: note = Seed: SATGFKQSSKALQRPVASDF
SATGYKQGSVALNRPVASDF

SEQ ID NO: 20274 - protein, 20 aa, synthetic construct
  source 1..20: note = Seed: SATGFKQSSKALQRPVASDF
SATGYKQGSVALQRPVASDF

SEQ ID NO: 20275 - protein, 20 aa, synthetic construct
  source 1..20: note = Seed: SATGFKQSSKALQRPVASDF
SATGYKQGSVALSRPVASDF

SEQ ID NO: 20276 - protein, 20 aa, synthetic construct
  source 1..20: note = Seed: SATGFKQSSKALQRPVASDF
SATGYKQGSVALTRPVASDF

SEQ ID NO: 20277 - protein, 20 aa, synthetic construct
  source 1..20: note = Seed: SATGFKQSSKALQRPVASDF
SATGYKQGSVALVRPVASDF

SEQ ID NO: 20278 - protein, 20 aa, synthetic construct
  source 1..20: note = Seed: SATGFKQSSKALQRPVASDF
SATGYKQHSAALARPVASDF

SEQ ID NO: 20279 - protein, 20 aa, synthetic construct
  source 1..20: note = Seed: SATGFKQSSKALQRPVASDF
SATGYKQHSAALGRPVASDF

SEQ ID NO: 20280 - protein, 20 aa, synthetic construct
  source 1..20: note = Seed: SATGFKQSSKALQRPVASDF
SATGYKQHSAALIRPVASDF

SEQ ID NO: 20281 - protein, 20 aa, synthetic construct
  source 1..20: note = Seed: SATGFKQSSKALQRPVASDF
SATGYKQHSAALLRPVASDF

SEQ ID NO: 20282 - protein, 20 aa, synthetic construct
  source 1..20: note = Seed: SATGFKQSSKALQRPVASDF
SATGYKQHSAALMRPVASDF

SEQ ID NO: 20283 - protein, 20 aa, synthetic construct
  source 1..20: note = Seed: SATGFKQSSKALQRPVASDF
SATGYKQHSAALNRPVASDF

SEQ ID NO: 20284 - protein, 20 aa, synthetic construct
  source 1..20: note = Seed: SATGFKQSSKALQRPVASDF
SATGYKQHSAALSRPVASDF

SEQ ID NO: 20285 - protein, 20 aa, synthetic construct
  source 1..20: note = Seed: SATGFKQSSKALQRPVASDF
SATGYKQHSAALTRPVASDF

SEQ ID NO: 20286 - protein, 20 aa, synthetic construct
  source 1..20: note = Seed: SATGFKQSSKALQRPVASDF
SATGYKQHSAALVRPVASDF

SEQ ID NO: 20287 - protein, 20 aa, synthetic construct
  source 1..20: note = Seed: SATGFKQSSKALQRPVASDF
SATGYKQHSFALFRPVASDF

SEQ ID NO: 20288 - protein, 20 aa, synthetic construct
  source 1..20: note = Seed: SATGFKQSSKALQRPVASDF
SATGYKQHSFALIRPVASDF

SEQ ID NO: 20289 - protein, 20 aa, synthetic construct
  source 1..20: note = Seed: SATGFKQSSKALQRPVASDF
SATGYKQHSFALLRPVASDF

SEQ ID NO: 20290 - protein, 20 aa, synthetic construct
  source 1..20: note = Seed: SATGFKQSSKALQRPVASDF
SATGYKQHSFALVRPVASDF

SEQ ID NO: 20291 - protein, 20 aa, synthetic construct
  source 1..20: note = Seed: SATGFKQSSKALQRPVASDF
SATGYKQHSGALARPVASDF

SEQ ID NO: 20292 - protein, 20 aa, synthetic construct
  source 1..20: note = Seed: SATGFKQSSKALQRPVASDF
SATGYKQHSGALIRPVASDF

SEQ ID NO: 20293 - protein, 20 aa, synthetic construct
  source 1..20: note = Seed: SATGFKQSSKALQRPVASDF
SATGYKQHSGALLRPVASDF

SEQ ID NO: 20294 - protein, 20 aa, synthetic construct
  source 1..20: note = Seed: SATGFKQSSKALQRPVASDF
SATGYKQHSGALMRPVASDF

SEQ ID NO: 20295 - protein, 20 aa, synthetic construct
  source 1..20: note = Seed: SATGFKQSSKALQRPVASDF
SATGYKQHSGALVRPVASDF

SEQ ID NO: 20296 - protein, 20 aa, synthetic construct
  source 1..20: note = Seed: SATGFKQSSKALQRPVASDF
SATGYKQHSIALHRPVASDF

SEQ ID NO: 20297 - protein, 20 aa, synthetic construct
  source 1..20: note = Seed: SATGFKQSSKALQRPVASDF
SATGYKQHSIALNRPVASDF

SEQ ID NO: 20298 - protein, 20 aa, synthetic construct
  source 1..20: note = Seed: SATGFKQSSKALQRPVASDF
SATGYKQHSIALSRPVASDF

SEQ ID NO: 20299 - protein, 20 aa, synthetic construct
  source 1..20: note = Seed: SATGFKQSSKALQRPVASDF
SATGYKQHSLALNRPVASDF

SEQ ID NO: 20300 - protein, 20 aa, synthetic construct
  source 1..20: note = Seed: SATGFKQSSKALQRPVASDF
SATGYKQHSMALNRPVASDF

SEQ ID NO: 20301 - protein, 20 aa, synthetic construct
  source 1..20: note = Seed: SATGFKQSSKALQRPVASDF
SATGYKQHSMALSRPVASDF

SEQ ID NO: 20302 - protein, 20 aa, synthetic construct
  source 1..20: note = Seed: SATGFKQSSKALQRPVASDF
SATGYKQHSMALVRPVASDF

SEQ ID NO: 20303 - protein, 20 aa, synthetic construct
  source 1..20: note = Seed: SATGFKQSSKALQRPVASDF
SATGYKQHSNALLRPVASDF

SEQ ID NO: 20304 - protein, 20 aa, synthetic construct
  source 1..20: note = Seed: SATGFKQSSKALQRPVASDF
SATGYKQHSPALARPVASDF

SEQ ID NO: 20305 - protein, 20 aa, synthetic construct
  source 1..20: note = Seed: SATGFKQSSKALQRPVASDF
SATGYKQHSPALIRPVASDF

SEQ ID NO: 20306 - protein, 20 aa, synthetic construct
  source 1..20: note = Seed: SATGFKQSSKALQRPVASDF
SATGYKQHSPALLRPVASDF

SEQ ID NO: 20307 - protein, 20 aa, synthetic construct
  source 1..20: note = Seed: SATGFKQSSKALQRPVASDF
SATGYKQHSPALVRPVASDF

SEQ ID NO: 20308 - protein, 20 aa, synthetic construct
  source 1..20: note = Seed: SATGFKQSSKALQRPVASDF
SATGYKQHSSALARPVASDF

SEQ ID NO: 20309 - protein, 20 aa, synthetic construct
  source 1..20: note = Seed: SATGFKQSSKALQRPVASDF
SATGYKQHSSALIRPVASDF

SEQ ID NO: 20310 - protein, 20 aa, synthetic construct
  source 1..20: note = Seed: SATGFKQSSKALQRPVASDF
SATGYKQHSSALLRPVASDF

SEQ ID NO: 20311 - protein, 20 aa, synthetic construct
  source 1..20: note = Seed: SATGFKQSSKALQRPVASDF
SATGYKQHSSALMRPVASDF

SEQ ID NO: 20312 - protein, 20 aa, synthetic construct
  source 1..20: note = Seed: SATGFKQSSKALQRPVASDF
SATGYKQHSSALSRPVASDF

SEQ ID NO: 20313 - protein, 20 aa, synthetic construct
  source 1..20: note = Seed: SATGFKQSSKALQRPVASDF
SATGYKQHSSALTRPVASDF

SEQ ID NO: 20314 - protein, 20 aa, synthetic construct
  source 1..20: note = Seed: SATGFKQSSKALQRPVASDF
SATGYKQHSSALVRPVASDF

SEQ ID NO: 20315 - protein, 20 aa, synthetic construct
  source 1..20: note = Seed: SATGFKQSSKALQRPVASDF
SATGYKQHSTALARPVASDF

SEQ ID NO: 20316 - protein, 20 aa, synthetic construct
  source 1..20: note = Seed: SATGFKQSSKALQRPVASDF
SATGYKQHSTALIRPVASDF

SEQ ID NO: 20317 - protein, 20 aa, synthetic construct
  source 1..20: note = Seed: SATGFKQSSKALQRPVASDF
SATGYKQHSTALLRPVASDF

SEQ ID NO: 20318 - protein, 20 aa, synthetic construct
  source 1..20: note = Seed: SATGFKQSSKALQRPVASDF
SATGYKQHSTALVRPVASDF

SEQ ID NO: 20319 - protein, 20 aa, synthetic construct
  source 1..20: note = Seed: SATGFKQSSKALQRPVASDF
SATGYKQHSVALARPVASDF

SEQ ID NO: 20320 - protein, 20 aa, synthetic construct
  source 1..20: note = Seed: SATGFKQSSKALQRPVASDF
SATGYKQHSVALIRPVASDF

SEQ ID NO: 20321 - protein, 20 aa, synthetic construct
  source 1..20: note = Seed: SATGFKQSSKALQRPVASDF
SATGYKQHSVALNRPVASDF

SEQ ID NO: 20322 - protein, 20 aa, synthetic construct
  source 1..20: note = Seed: SATGFKQSSKALQRPVASDF
SATGYKQHSVALQRPVASDF

SEQ ID NO: 20323 - protein, 20 aa, synthetic construct
  source 1..20: note = Seed: SATGFKQSSKALQRPVASDF
SATGYKQHSVALSRPVASDF

SEQ ID NO: 20324 - protein, 20 aa, synthetic construct
  source 1..20: note = Seed: SATGFKQSSKALQRPVASDF
SATGYKQHSVALTRPVASDF

SEQ ID NO: 20325 - protein, 20 aa, synthetic construct
  source 1..20: note = Seed: SATGFKQSSKALQRPVASDF
SATGYKQHSVALVRPVASDF

SEQ ID NO: 20326 - protein, 20 aa, synthetic construct
  source 1..20: note = Seed: SATGFKQSSKALQRPVASDF
SATGYKQISAALARPVASDF

SEQ ID NO: 20327 - protein, 20 aa, synthetic construct
  source 1..20: note = Seed: SATGFKQSSKALQRPVASDF
SATGYKQISAALCRPVASDF

SEQ ID NO: 20328 - protein, 20 aa, synthetic construct
  source 1..20: note = Seed: SATGFKQSSKALQRPVASDF
SATGYKQISAALDRPVASDF

SEQ ID NO: 20329 - protein, 20 aa, synthetic construct
  source 1..20: note = Seed: SATGFKQSSKALQRPVASDF
SATGYKQISAALERPVASDF

SEQ ID NO: 20330 - protein, 20 aa, synthetic construct
  source 1..20: note = Seed: SATGFKQSSKALQRPVASDF
SATGYKQISAALFRPVASDF

SEQ ID NO: 20331 - protein, 20 aa, synthetic construct
  source 1..20: note = Seed: SATGFKQSSKALQRPVASDF
SATGYKQISAALGRPVASDF

SEQ ID NO: 20332 - protein, 20 aa, synthetic construct
  source 1..20: note = Seed: SATGFKQSSKALQRPVASDF
SATGYKQISAALHRPVASDF

SEQ ID NO: 20333 - protein, 20 aa, synthetic construct
  source 1..20: note = Seed: SATGFKQSSKALQRPVASDF
SATGYKQISAALIRPVASDF

SEQ ID NO: 20334 - protein, 20 aa, synthetic construct
  source 1..20: note = Seed: SATGFKQSSKALQRPVASDF
SATGYKQISAALKRPVASDF

SEQ ID NO: 20335 - protein, 20 aa, synthetic construct
  source 1..20: note = Seed: SATGFKQSSKALQRPVASDF
SATGYKQISAALLRPVASDF

SEQ ID NO: 20336 - protein, 20 aa, synthetic construct
  source 1..20: note = Seed: SATGFKQSSKALQRPVASDF
SATGYKQISAALMRPVASDF

SEQ ID NO: 20337 - protein, 20 aa, synthetic construct
  source 1..20: note = Seed: SATGFKQSSKALQRPVASDF
SATGYKQISAALNRPVASDF

SEQ ID NO: 20338 - protein, 20 aa, synthetic construct
  source 1..20: note = Seed: SATGFKQSSKALQRPVASDF
SATGYKQISAALPRPVASDF

SEQ ID NO: 20339 - protein, 20 aa, synthetic construct
  source 1..20: note = Seed: SATGFKQSSKALQRPVASDF
SATGYKQISAALQRPVASDF

SEQ ID NO: 20340 - protein, 20 aa, synthetic construct
  source 1..20: note = Seed: SATGFKQSSKALQRPVASDF
SATGYKQISAALRRPVASDF

SEQ ID NO: 20341 - protein, 20 aa, synthetic construct
  source 1..20: note = Seed: SATGFKQSSKALQRPVASDF
SATGYKQISAALSRPVASDF

SEQ ID NO: 20342 - protein, 20 aa, synthetic construct
  source 1..20: note = Seed: SATGFKQSSKALQRPVASDF
SATGYKQISAALTRPVASDF

SEQ ID NO: 20343 - protein, 20 aa, synthetic construct
  source 1..20: note = Seed: SATGFKQSSKALQRPVASDF
SATGYKQISAALVRPVASDF

SEQ ID NO: 20344 - protein, 20 aa, synthetic construct
  source 1..20: note = Seed: SATGFKQSSKALQRPVASDF
SATGYKQISAALWRPVASDF

SEQ ID NO: 20345 - protein, 20 aa, synthetic construct
  source 1..20: note = Seed: SATGFKQSSKALQRPVASDF
SATGYKQISAALYRPVASDF

SEQ ID NO: 20346 - protein, 20 aa, synthetic construct
  source 1..20: note = Seed: SATGFKQSSKALQRPVASDF
SATGYKQISCALARPVASDF

SEQ ID NO: 20347 - protein, 20 aa, synthetic construct
  source 1..20: note = Seed: SATGFKQSSKALQRPVASDF
SATGYKQISCALIRPVASDF

SEQ ID NO: 20348 - protein, 20 aa, synthetic construct
  source 1..20: note = Seed: SATGFKQSSKALQRPVASDF
SATGYKQISCALLRPVASDF

SEQ ID NO: 20349 - protein, 20 aa, synthetic construct
  source 1..20: note = Seed: SATGFKQSSKALQRPVASDF
SATGYKQISCALMRPVASDF

SEQ ID NO: 20350 - protein, 20 aa, synthetic construct
  source 1..20: note = Seed: SATGFKQSSKALQRPVASDF
SATGYKQISCALNRPVASDF

SEQ ID NO: 20351 - protein, 20 aa, synthetic construct
  source 1..20: note = Seed: SATGFKQSSKALQRPVASDF
SATGYKQISCALSRPVASDF

SEQ ID NO: 20352 - protein, 20 aa, synthetic construct
  source 1..20: note = Seed: SATGFKQSSKALQRPVASDF
SATGYKQISCALTRPVASDF

SEQ ID NO: 20353 - protein, 20 aa, synthetic construct
  source 1..20: note = Seed: SATGFKQSSKALQRPVASDF
SATGYKQISCALVRPVASDF

SEQ ID NO: 20354 - protein, 20 aa, synthetic construct
  source 1..20: note = Seed: SATGFKQSSKALQRPVASDF
SATGYKQISDALARPVASDF

SEQ ID NO: 20355 - protein, 20 aa, synthetic construct
  source 1..20: note = Seed: SATGFKQSSKALQRPVASDF
SATGYKQISDALSRPVASDF

SEQ ID NO: 20356 - protein, 20 aa, synthetic construct
  source 1..20: note = Seed: SATGFKQSSKALQRPVASDF
SATGYKQISDALVRPVASDF

SEQ ID NO: 20357 - protein, 20 aa, synthetic construct
  source 1..20: note = Seed: SATGFKQSSKALQRPVASDF
SATGYKQISEALARPVASDF

SEQ ID NO: 20358 - protein, 20 aa, synthetic construct
  source 1..20: note = Seed: SATGFKQSSKALQRPVASDF
SATGYKQISEALGRPVASDF

SEQ ID NO: 20359 - protein, 20 aa, synthetic construct
  source 1..20: note = Seed: SATGFKQSSKALQRPVASDF
SATGYKQISEALIRPVASDF

SEQ ID NO: 20360 - protein, 20 aa, synthetic construct
  source 1..20: note = Seed: SATGFKQSSKALQRPVASDF
SATGYKQISEALLRPVASDF

SEQ ID NO: 20361 - protein, 20 aa, synthetic construct
  source 1..20: note = Seed: SATGFKQSSKALQRPVASDF
SATGYKQISEALNRPVASDF

SEQ ID NO: 20362 - protein, 20 aa, synthetic construct
  source 1..20: note = Seed: SATGFKQSSKALQRPVASDF
SATGYKQISEALSRPVASDF

SEQ ID NO: 20363 - protein, 20 aa, synthetic construct
  source 1..20: note = Seed: SATGFKQSSKALQRPVASDF
SATGYKQISEALTRPVASDF

SEQ ID NO: 20364 - protein, 20 aa, synthetic construct
  source 1..20: note = Seed: SATGFKQSSKALQRPVASDF
SATGYKQISEALVRPVASDF

SEQ ID NO: 20365 - protein, 20 aa, synthetic construct
  source 1..20: note = Seed: SATGFKQSSKALQRPVASDF
SATGYKQISFALARPVASDF

SEQ ID NO: 20366 - protein, 20 aa, synthetic construct
  source 1..20: note = Seed: SATGFKQSSKALQRPVASDF
SATGYKQISFALDRPVASDF

SEQ ID NO: 20367 - protein, 20 aa, synthetic construct
  source 1..20: note = Seed: SATGFKQSSKALQRPVASDF
SATGYKQISFALERPVASDF

SEQ ID NO: 20368 - protein, 20 aa, synthetic construct
  source 1..20: note = Seed: SATGFKQSSKALQRPVASDF
SATGYKQISFALIRPVASDF

SEQ ID NO: 20369 - protein, 20 aa, synthetic construct
  source 1..20: note = Seed: SATGFKQSSKALQRPVASDF
SATGYKQISFALLRPVASDF

SEQ ID NO: 20370 - protein, 20 aa, synthetic construct
  source 1..20: note = Seed: SATGFKQSSKALQRPVASDF
SATGYKQISFALMRPVASDF

SEQ ID NO: 20371 - protein, 20 aa, synthetic construct
  source 1..20: note = Seed: SATGFKQSSKALQRPVASDF
SATGYKQISFALNRPVASDF

SEQ ID NO: 20372 - protein, 20 aa, synthetic construct
  source 1..20: note = Seed: SATGFKQSSKALQRPVASDF
SATGYKQISFALSRPVASDF

SEQ ID NO: 20373 - protein, 20 aa, synthetic construct
  source 1..20: note = Seed: SATGFKQSSKALQRPVASDF
SATGYKQISFALTRPVASDF

SEQ ID NO: 20374 - protein, 20 aa, synthetic construct
  source 1..20: note = Seed: SATGFKQSSKALQRPVASDF
SATGYKQISFALVRPVASDF

SEQ ID NO: 20375 - protein, 20 aa, synthetic construct
  source 1..20: note = Seed: SATGFKQSSKALQRPVASDF
SATGYKQISGALARPVASDF

SEQ ID NO: 20376 - protein, 20 aa, synthetic construct
  source 1..20: note = Seed: SATGFKQSSKALQRPVASDF
SATGYKQISGALCRPVASDF

SEQ ID NO: 20377 - protein, 20 aa, synthetic construct
  source 1..20: note = Seed: SATGFKQSSKALQRPVASDF
SATGYKQISGALDRPVASDF

SEQ ID NO: 20378 - protein, 20 aa, synthetic construct
  source 1..20: note = Seed: SATGFKQSSKALQRPVASDF
SATGYKQISGALERPVASDF

SEQ ID NO: 20379 - protein, 20 aa, synthetic construct
  source 1..20: note = Seed: SATGFKQSSKALQRPVASDF
SATGYKQISGALFRPVASDF

SEQ ID NO: 20380 - protein, 20 aa, synthetic construct
  source 1..20: note = Seed: SATGFKQSSKALQRPVASDF
SATGYKQISGALGRPVASDF

SEQ ID NO: 20381 - protein, 20 aa, synthetic construct
  source 1..20: note = Seed: SATGFKQSSKALQRPVASDF
SATGYKQISGALHRPVASDF

SEQ ID NO: 20382 - protein, 20 aa, synthetic construct
  source 1..20: note = Seed: SATGFKQSSKALQRPVASDF
SATGYKQISGALIRPVASDF

SEQ ID NO: 20383 - protein, 20 aa, synthetic construct
  source 1..20: note = Seed: SATGFKQSSKALQRPVASDF
SATGYKQISGALLRPVASDF

SEQ ID NO: 20384 - protein, 20 aa, synthetic construct
  source 1..20: note = Seed: SATGFKQSSKALQRPVASDF
SATGYKQISGALMRPVASDF

SEQ ID NO: 20385 - protein, 20 aa, synthetic construct
  source 1..20: note = Seed: SATGFKQSSKALQRPVASDF
SATGYKQISGALNRPVASDF

SEQ ID NO: 20386 - protein, 20 aa, synthetic construct
  source 1..20: note = Seed: SATGFKQSSKALQRPVASDF
SATGYKQISGALPRPVASDF

SEQ ID NO: 20387 - protein, 20 aa, synthetic construct
  source 1..20: note = Seed: SATGFKQSSKALQRPVASDF
SATGYKQISGALQRPVASDF

SEQ ID NO: 20388 - protein, 20 aa, synthetic construct
  source 1..20: note = Seed: SATGFKQSSKALQRPVASDF
SATGYKQISGALRRPVASDF

SEQ ID NO: 20389 - protein, 20 aa, synthetic construct
  source 1..20: note = Seed: SATGFKQSSKALQRPVASDF
SATGYKQISGALSRPVASDF

SEQ ID NO: 20390 - protein, 20 aa, synthetic construct
  source 1..20: note = Seed: SATGFKQSSKALQRPVASDF
SATGYKQISGALTRPVASDF

SEQ ID NO: 20391 - protein, 20 aa, synthetic construct
  source 1..20: note = Seed: SATGFKQSSKALQRPVASDF
SATGYKQISGALVRPVASDF

SEQ ID NO: 20392 - protein, 20 aa, synthetic construct
  source 1..20: note = Seed: SATGFKQSSKALQRPVASDF
SATGYKQISGALYRPVASDF

SEQ ID NO: 20393 - protein, 20 aa, synthetic construct
  source 1..20: note = Seed: SATGFKQSSKALQRPVASDF
SATGYKQISHALARPVASDF

SEQ ID NO: 20394 - protein, 20 aa, synthetic construct
  source 1..20: note = Seed: SATGFKQSSKALQRPVASDF
SATGYKQISHALGRPVASDF

SEQ ID NO: 20395 - protein, 20 aa, synthetic construct
  source 1..20: note = Seed: SATGFKQSSKALQRPVASDF
SATGYKQISHALHRPVASDF

SEQ ID NO: 20396 - protein, 20 aa, synthetic construct
  source 1..20: note = Seed: SATGFKQSSKALQRPVASDF
SATGYKQISHALIRPVASDF

SEQ ID NO: 20397 - protein, 20 aa, synthetic construct
  source 1..20: note = Seed: SATGFKQSSKALQRPVASDF
SATGYKQISHALKRPVASDF

SEQ ID NO: 20398 - protein, 20 aa, synthetic construct
  source 1..20: note = Seed: SATGFKQSSKALQRPVASDF
SATGYKQISHALLRPVASDF

SEQ ID NO: 20399 - protein, 20 aa, synthetic construct
  source 1..20: note = Seed: SATGFKQSSKALQRPVASDF
SATGYKQISHALMRPVASDF

SEQ ID NO: 20400 - protein, 20 aa, synthetic construct
  source 1..20: note = Seed: SATGFKQSSKALQRPVASDF
SATGYKQISHALNRPVASDF

SEQ ID NO: 20401 - protein, 20 aa, synthetic construct
  source 1..20: note = Seed: SATGFKQSSKALQRPVASDF
SATGYKQISHALRRPVASDF

SEQ ID NO: 20402 - protein, 20 aa, synthetic construct
  source 1..20: note = Seed: SATGFKQSSKALQRPVASDF
SATGYKQISHALSRPVASDF

SEQ ID NO: 20403 - protein, 20 aa, synthetic construct
  source 1..20: note = Seed: SATGFKQSSKALQRPVASDF
SATGYKQISHALTRPVASDF

SEQ ID NO: 20404 - protein, 20 aa, synthetic construct
  source 1..20: note = Seed: SATGFKQSSKALQRPVASDF
SATGYKQISHALVRPVASDF

SEQ ID NO: 20405 - protein, 20 aa, synthetic construct
  source 1..20: note = Seed: SATGFKQSSKALQRPVASDF
SATGYKQISIALARPVASDF

SEQ ID NO: 20406 - protein, 20 aa, synthetic construct
  source 1..20: note = Seed: SATGFKQSSKALQRPVASDF
SATGYKQISIALCRPVASDF

SEQ ID NO: 20407 - protein, 20 aa, synthetic construct
  source 1..20: note = Seed: SATGFKQSSKALQRPVASDF
SATGYKQISIALDRPVASDF

SEQ ID NO: 20408 - protein, 20 aa, synthetic construct
  source 1..20: note = Seed: SATGFKQSSKALQRPVASDF
SATGYKQISIALERPVASDF

SEQ ID NO: 20409 - protein, 20 aa, synthetic construct
  source 1..20: note = Seed: SATGFKQSSKALQRPVASDF
SATGYKQISIALFRPVASDF

SEQ ID NO: 20410 - protein, 20 aa, synthetic construct
  source 1..20: note = Seed: SATGFKQSSKALQRPVASDF
SATGYKQISIALGRPVASDF

SEQ ID NO: 20411 - protein, 20 aa, synthetic construct
  source 1..20: note = Seed: SATGFKQSSKALQRPVASDF
SATGYKQISIALHRPVASDF

SEQ ID NO: 20412 - protein, 20 aa, synthetic construct
  source 1..20: note = Seed: SATGFKQSSKALQRPVASDF
SATGYKQISIALIRPVASDF

SEQ ID NO: 20413 - protein, 20 aa, synthetic construct
  source 1..20: note = Seed: SATGFKQSSKALQRPVASDF
SATGYKQISIALKRPVASDF

SEQ ID NO: 20414 - protein, 20 aa, synthetic construct
  source 1..20: note = Seed: SATGFKQSSKALQRPVASDF
SATGYKQISIALNRPVASDF

SEQ ID NO: 20415 - protein, 20 aa, synthetic construct
  source 1..20: note = Seed: SATGFKQSSKALQRPVASDF
SATGYKQISIALPRPVASDF

SEQ ID NO: 20416 - protein, 20 aa, synthetic construct
  source 1..20: note = Seed: SATGFKQSSKALQRPVASDF
SATGYKQISIALQRPVASDF

SEQ ID NO: 20417 - protein, 20 aa, synthetic construct
  source 1..20: note = Seed: SATGFKQSSKALQRPVASDF
SATGYKQISIALRRPVASDF

SEQ ID NO: 20418 - protein, 20 aa, synthetic construct
  source 1..20: note = Seed: SATGFKQSSKALQRPVASDF
SATGYKQISIALSRPVASDF

SEQ ID NO: 20419 - protein, 20 aa, synthetic construct
  source 1..20: note = Seed: SATGFKQSSKALQRPVASDF
SATGYKQISIALTRPVASDF

SEQ ID NO: 20420 - protein, 20 aa, synthetic construct
  source 1..20: note = Seed: SATGFKQSSKALQRPVASDF
SATGYKQISIALVRPVASDF

SEQ ID NO: 20421 - protein, 20 aa, synthetic construct
  source 1..20: note = Seed: SATGFKQSSKALQRPVASDF
SATGYKQISIALYRPVASDF

SEQ ID NO: 20422 - protein, 20 aa, synthetic construct
  source 1..20: note = Seed: SATGFKQSSKALQRPVASDF
SATGYKQISKALARPVASDF

SEQ ID NO: 20423 - protein, 20 aa, synthetic construct
  source 1..20: note = Seed: SATGFKQSSKALQRPVASDF
SATGYKQISKALCRPVASDF

SEQ ID NO: 20424 - protein, 20 aa, synthetic construct
  source 1..20: note = Seed: SATGFKQSSKALQRPVASDF
SATGYKQISKALDRPVASDF

SEQ ID NO: 20425 - protein, 20 aa, synthetic construct
  source 1..20: note = Seed: SATGFKQSSKALQRPVASDF
SATGYKQISKALFRPVASDF

SEQ ID NO: 20426 - protein, 20 aa, synthetic construct
  source 1..20: note = Seed: SATGFKQSSKALQRPVASDF
SATGYKQISKALGRPVASDF

SEQ ID NO: 20427 - protein, 20 aa, synthetic construct
  source 1..20: note = Seed: SATGFKQSSKALQRPVASDF
SATGYKQISKALHRPVASDF

SEQ ID NO: 20428 - protein, 20 aa, synthetic construct
  source 1..20: note = Seed: SATGFKQSSKALQRPVASDF
SATGYKQISKALIRPVASDF

SEQ ID NO: 20429 - protein, 20 aa, synthetic construct
  source 1..20: note = Seed: SATGFKQSSKALQRPVASDF
SATGYKQISKALKRPVASDF

SEQ ID NO: 20430 - protein, 20 aa, synthetic construct
  source 1..20: note = Seed: SATGFKQSSKALQRPVASDF
SATGYKQISKALLRPVASDF

SEQ ID NO: 20431 - protein, 20 aa, synthetic construct
  source 1..20: note = Seed: SATGFKQSSKALQRPVASDF
SATGYKQISKALMRPVASDF

SEQ ID NO: 20432 - protein, 20 aa, synthetic construct
  source 1..20: note = Seed: SATGFKQSSKALQRPVASDF
SATGYKQISKALNRPVASDF

SEQ ID NO: 20433 - protein, 20 aa, synthetic construct
  source 1..20: note = Seed: SATGFKQSSKALQRPVASDF
SATGYKQISKALPRPVASDF

SEQ ID NO: 20434 - protein, 20 aa, synthetic construct
  source 1..20: note = Seed: SATGFKQSSKALQRPVASDF
SATGYKQISKALQRPVASDF

SEQ ID NO: 20435 - protein, 20 aa, synthetic construct
  source 1..20: note = Seed: SATGFKQSSKALQRPVASDF
SATGYKQISKALRRPVASDF

SEQ ID NO: 20436 - protein, 20 aa, synthetic construct
  source 1..20: note = Seed: SATGFKQSSKALQRPVASDF
SATGYKQISKALSRPVASDF

SEQ ID NO: 20437 - protein, 20 aa, synthetic construct
  source 1..20: note = Seed: SATGFKQSSKALQRPVASDF
SATGYKQISKALTRPVASDF

SEQ ID NO: 20438 - protein, 20 aa, synthetic construct
  source 1..20: note = Seed: SATGFKQSSKALQRPVASDF
SATGYKQISKALVRPVASDF

SEQ ID NO: 20439 - protein, 20 aa, synthetic construct
  source 1..20: note = Seed: SATGFKQSSKALQRPVASDF
SATGYKQISKALWRPVASDF

SEQ ID NO: 20440 - protein, 20 aa, synthetic construct
  source 1..20: note = Seed: SATGFKQSSKALQRPVASDF
SATGYKQISKALYRPVASDF

SEQ ID NO: 20441 - protein, 20 aa, synthetic construct
  source 1..20: note = Seed: SATGFKQSSKALQRPVASDF
SATGYKQISLALARPVASDF

SEQ ID NO: 20442 - protein, 20 aa, synthetic construct
  source 1..20: note = Seed: SATGFKQSSKALQRPVASDF
SATGYKQISLALCRPVASDF

SEQ ID NO: 20443 - protein, 20 aa, synthetic construct
  source 1..20: note = Seed: SATGFKQSSKALQRPVASDF
SATGYKQISLALDRPVASDF

SEQ ID NO: 20444 - protein, 20 aa, synthetic construct
  source 1..20: note = Seed: SATGFKQSSKALQRPVASDF
SATGYKQISLALFRPVASDF

SEQ ID NO: 20445 - protein, 20 aa, synthetic construct
  source 1..20: note = Seed: SATGFKQSSKALQRPVASDF
SATGYKQISLALGRPVASDF

SEQ ID NO: 20446 - protein, 20 aa, synthetic construct
  source 1..20: note = Seed: SATGFKQSSKALQRPVASDF
SATGYKQISLALHRPVASDF

SEQ ID NO: 20447 - protein, 20 aa, synthetic construct
  source 1..20: note = Seed: SATGFKQSSKALQRPVASDF
SATGYKQISLALIRPVASDF

SEQ ID NO: 20448 - protein, 20 aa, synthetic construct
  source 1..20: note = Seed: SATGFKQSSKALQRPVASDF
SATGYKQISLALKRPVASDF

SEQ ID NO: 20449 - protein, 20 aa, synthetic construct
  source 1..20: note = Seed: SATGFKQSSKALQRPVASDF
SATGYKQISLALLRPVASDF

SEQ ID NO: 20450 - protein, 20 aa, synthetic construct
  source 1..20: note = Seed: SATGFKQSSKALQRPVASDF
SATGYKQISLALNRPVASDF

SEQ ID NO: 20451 - protein, 20 aa, synthetic construct
  source 1..20: note = Seed: SATGFKQSSKALQRPVASDF
SATGYKQISLALQRPVASDF

SEQ ID NO: 20452 - protein, 20 aa, synthetic construct
  source 1..20: note = Seed: SATGFKQSSKALQRPVASDF
SATGYKQISLALSRPVASDF

SEQ ID NO: 20453 - protein, 20 aa, synthetic construct
  source 1..20: note = Seed: SATGFKQSSKALQRPVASDF
SATGYKQISLALTRPVASDF

SEQ ID NO: 20454 - protein, 20 aa, synthetic construct
  source 1..20: note = Seed: SATGFKQSSKALQRPVASDF
SATGYKQISLALVRPVASDF

SEQ ID NO: 20455 - protein, 20 aa, synthetic construct
  source 1..20: note = Seed: SATGFKQSSKALQRPVASDF
SATGYKQISLALYRPVASDF

SEQ ID NO: 20456 - protein, 20 aa, synthetic construct
  source 1..20: note = Seed: SATGFKQSSKALQRPVASDF
SATGYKQISMALARPVASDF

SEQ ID NO: 20457 - protein, 20 aa, synthetic construct
  source 1..20: note = Seed: SATGFKQSSKALQRPVASDF
SATGYKQISMALCRPVASDF

SEQ ID NO: 20458 - protein, 20 aa, synthetic construct
  source 1..20: note = Seed: SATGFKQSSKALQRPVASDF
SATGYKQISMALDRPVASDF

SEQ ID NO: 20459 - protein, 20 aa, synthetic construct
  source 1..20: note = Seed: SATGFKQSSKALQRPVASDF
SATGYKQISMALFRPVASDF

SEQ ID NO: 20460 - protein, 20 aa, synthetic construct
  source 1..20: note = Seed: SATGFKQSSKALQRPVASDF
SATGYKQISMALGRPVASDF

SEQ ID NO: 20461 - protein, 20 aa, synthetic construct
  source 1..20: note = Seed: SATGFKQSSKALQRPVASDF
SATGYKQISMALHRPVASDF

SEQ ID NO: 20462 - protein, 20 aa, synthetic construct
  source 1..20: note = Seed: SATGFKQSSKALQRPVASDF
SATGYKQISMALIRPVASDF

SEQ ID NO: 20463 - protein, 20 aa, synthetic construct
  source 1..20: note = Seed: SATGFKQSSKALQRPVASDF
SATGYKQISMALKRPVASDF

SEQ ID NO: 20464 - protein, 20 aa, synthetic construct
  source 1..20: note = Seed: SATGFKQSSKALQRPVASDF
SATGYKQISMALNRPVASDF

SEQ ID NO: 20465 - protein, 20 aa, synthetic construct
  source 1..20: note = Seed: SATGFKQSSKALQRPVASDF
SATGYKQISMALQRPVASDF

SEQ ID NO: 20466 - protein, 20 aa, synthetic construct
  source 1..20: note = Seed: SATGFKQSSKALQRPVASDF
SATGYKQISMALRRPVASDF

SEQ ID NO: 20467 - protein, 20 aa, synthetic construct
  source 1..20: note = Seed: SATGFKQSSKALQRPVASDF
SATGYKQISMALSRPVASDF

SEQ ID NO: 20468 - protein, 20 aa, synthetic construct
  source 1..20: note = Seed: SATGFKQSSKALQRPVASDF
SATGYKQISMALVRPVASDF

SEQ ID NO: 20469 - protein, 20 aa, synthetic construct
  source 1..20: note = Seed: SATGFKQSSKALQRPVASDF
SATGYKQISMALYRPVASDF

SEQ ID NO: 20470 - protein, 20 aa, synthetic construct
  source 1..20: note = Seed: SATGFKQSSKALQRPVASDF
SATGYKQISNALARPVASDF

SEQ ID NO: 20471 - protein, 20 aa, synthetic construct
  source 1..20: note = Seed: SATGFKQSSKALQRPVASDF
SATGYKQISNALCRPVASDF

SEQ ID NO: 20472 - protein, 20 aa, synthetic construct
  source 1..20: note = Seed: SATGFKQSSKALQRPVASDF
SATGYKQISNALDRPVASDF

SEQ ID NO: 20473 - protein, 20 aa, synthetic construct
  source 1..20: note = Seed: SATGFKQSSKALQRPVASDF
SATGYKQISNALERPVASDF

SEQ ID NO: 20474 - protein, 20 aa, synthetic construct
  source 1..20: note = Seed: SATGFKQSSKALQRPVASDF
SATGYKQISNALFRPVASDF

SEQ ID NO: 20475 - protein, 20 aa, synthetic construct
  source 1..20: note = Seed: SATGFKQSSKALQRPVASDF
SATGYKQISNALGRPVASDF

SEQ ID NO: 20476 - protein, 20 aa, synthetic construct
  source 1..20: note = Seed: SATGFKQSSKALQRPVASDF
SATGYKQISNALHRPVASDF

SEQ ID NO: 20477 - protein, 20 aa, synthetic construct
  source 1..20: note = Seed: SATGFKQSSKALQRPVASDF
SATGYKQISNALIRPVASDF

SEQ ID NO: 20478 - protein, 20 aa, synthetic construct
  source 1..20: note = Seed: SATGFKQSSKALQRPVASDF
SATGYKQISNALLRPVASDF

SEQ ID NO: 20479 - protein, 20 aa, synthetic construct
  source 1..20: note = Seed: SATGFKQSSKALQRPVASDF
SATGYKQISNALMRPVASDF

SEQ ID NO: 20480 - protein, 20 aa, synthetic construct
  source 1..20: note = Seed: SATGFKQSSKALQRPVASDF
SATGYKQISNALNRPVASDF

SEQ ID NO: 20481 - protein, 20 aa, synthetic construct
  source 1..20: note = Seed: SATGFKQSSKALQRPVASDF
SATGYKQISNALPRPVASDF

SEQ ID NO: 20482 - protein, 20 aa, synthetic construct
  source 1..20: note = Seed: SATGFKQSSKALQRPVASDF
SATGYKQISNALQRPVASDF

SEQ ID NO: 20483 - protein, 20 aa, synthetic construct
  source 1..20: note = Seed: SATGFKQSSKALQRPVASDF
SATGYKQISNALSRPVASDF

SEQ ID NO: 20484 - protein, 20 aa, synthetic construct
  source 1..20: note = Seed: SATGFKQSSKALQRPVASDF
SATGYKQISNALTRPVASDF

SEQ ID NO: 20485 - protein, 20 aa, synthetic construct
  source 1..20: note = Seed: SATGFKQSSKALQRPVASDF
SATGYKQISNALVRPVASDF

SEQ ID NO: 20486 - protein, 20 aa, synthetic construct
  source 1..20: note = Seed: SATGFKQSSKALQRPVASDF
SATGYKQISPALARPVASDF

SEQ ID NO: 20487 - protein, 20 aa, synthetic construct
  source 1..20: note = Seed: SATGFKQSSKALQRPVASDF
SATGYKQISPALCRPVASDF

SEQ ID NO: 20488 - protein, 20 aa, synthetic construct
  source 1..20: note = Seed: SATGFKQSSKALQRPVASDF
SATGYKQISPALDRPVASDF

SEQ ID NO: 20489 - protein, 20 aa, synthetic construct
  source 1..20: note = Seed: SATGFKQSSKALQRPVASDF
SATGYKQISPALERPVASDF

SEQ ID NO: 20490 - protein, 20 aa, synthetic construct
  source 1..20: note = Seed: SATGFKQSSKALQRPVASDF
SATGYKQISPALFRPVASDF

SEQ ID NO: 20491 - protein, 20 aa, synthetic construct
  source 1..20: note = Seed: SATGFKQSSKALQRPVASDF
SATGYKQISPALGRPVASDF

SEQ ID NO: 20492 - protein, 20 aa, synthetic construct
  source 1..20: note = Seed: SATGFKQSSKALQRPVASDF
SATGYKQISPALHRPVASDF

SEQ ID NO: 20493 - protein, 20 aa, synthetic construct
  source 1..20: note = Seed: SATGFKQSSKALQRPVASDF
SATGYKQISPALIRPVASDF

SEQ ID NO: 20494 - protein, 20 aa, synthetic construct
  source 1..20: note = Seed: SATGFKQSSKALQRPVASDF
SATGYKQISPALKRPVASDF

SEQ ID NO: 20495 - protein, 20 aa, synthetic construct
  source 1..20: note = Seed: SATGFKQSSKALQRPVASDF
SATGYKQISPALLRPVASDF

SEQ ID NO: 20496 - protein, 20 aa, synthetic construct
  source 1..20: note = Seed: SATGFKQSSKALQRPVASDF
SATGYKQISPALMRPVASDF

SEQ ID NO: 20497 - protein, 20 aa, synthetic construct
  source 1..20: note = Seed: SATGFKQSSKALQRPVASDF
SATGYKQISPALNRPVASDF

SEQ ID NO: 20498 - protein, 20 aa, synthetic construct
  source 1..20: note = Seed: SATGFKQSSKALQRPVASDF
SATGYKQISPALPRPVASDF

SEQ ID NO: 20499 - protein, 20 aa, synthetic construct
  source 1..20: note = Seed: SATGFKQSSKALQRPVASDF
SATGYKQISPALQRPVASDF

SEQ ID NO: 20500 - protein, 20 aa, synthetic construct
  source 1..20: note = Seed: SATGFKQSSKALQRPVASDF
SATGYKQISPALRRPVASDF

SEQ ID NO: 20501 - protein, 20 aa, synthetic construct
  source 1..20: note = Seed: SATGFKQSSKALQRPVASDF
SATGYKQISPALSRPVASDF

SEQ ID NO: 20502 - protein, 20 aa, synthetic construct
  source 1..20: note = Seed: SATGFKQSSKALQRPVASDF
SATGYKQISPALTRPVASDF

SEQ ID NO: 20503 - protein, 20 aa, synthetic construct
  source 1..20: note = Seed: SATGFKQSSKALQRPVASDF
SATGYKQISPALVRPVASDF

SEQ ID NO: 20504 - protein, 20 aa, synthetic construct
  source 1..20: note = Seed: SATGFKQSSKALQRPVASDF
SATGYKQISPALWRPVASDF

SEQ ID NO: 20505 - protein, 20 aa, synthetic construct
  source 1..20: note = Seed: SATGFKQSSKALQRPVASDF
SATGYKQISPALYRPVASDF

SEQ ID NO: 20506 - protein, 20 aa, synthetic construct
  source 1..20: note = Seed: SATGFKQSSKALQRPVASDF
SATGYKQISQALARPVASDF

SEQ ID NO: 20507 - protein, 20 aa, synthetic construct
  source 1..20: note = Seed: SATGFKQSSKALQRPVASDF
SATGYKQISQALGRPVASDF

SEQ ID NO: 20508 - protein, 20 aa, synthetic construct
  source 1..20: note = Seed: SATGFKQSSKALQRPVASDF
SATGYKQISQALIRPVASDF

SEQ ID NO: 20509 - protein, 20 aa, synthetic construct
  source 1..20: note = Seed: SATGFKQSSKALQRPVASDF
SATGYKQISQALLRPVASDF

SEQ ID NO: 20510 - protein, 20 aa, synthetic construct
  source 1..20: note = Seed: SATGFKQSSKALQRPVASDF
SATGYKQISQALMRPVASDF

SEQ ID NO: 20511 - protein, 20 aa, synthetic construct
  source 1..20: note = Seed: SATGFKQSSKALQRPVASDF
SATGYKQISQALNRPVASDF

SEQ ID NO: 20512 - protein, 20 aa, synthetic construct
  source 1..20: note = Seed: SATGFKQSSKALQRPVASDF
SATGYKQISQALSRPVASDF

SEQ ID NO: 20513 - protein, 20 aa, synthetic construct
  source 1..20: note = Seed: SATGFKQSSKALQRPVASDF
SATGYKQISQALTRPVASDF

SEQ ID NO: 20514 - protein, 20 aa, synthetic construct
  source 1..20: note = Seed: SATGFKQSSKALQRPVASDF
SATGYKQISQALVRPVASDF

SEQ ID NO: 20515 - protein, 20 aa, synthetic construct
  source 1..20: note = Seed: SATGFKQSSKALQRPVASDF
SATGYKQISRALARPVASDF

SEQ ID NO: 20516 - protein, 20 aa, synthetic construct
  source 1..20: note = Seed: SATGFKQSSKALQRPVASDF
SATGYKQISRALCRPVASDF

SEQ ID NO: 20517 - protein, 20 aa, synthetic construct
  source 1..20: note = Seed: SATGFKQSSKALQRPVASDF
SATGYKQISRALDRPVASDF

SEQ ID NO: 20518 - protein, 20 aa, synthetic construct
  source 1..20: note = Seed: SATGFKQSSKALQRPVASDF
SATGYKQISRALERPVASDF

SEQ ID NO: 20519 - protein, 20 aa, synthetic construct
  source 1..20: note = Seed: SATGFKQSSKALQRPVASDF
SATGYKQISRALFRPVASDF

SEQ ID NO: 20520 - protein, 20 aa, synthetic construct
  source 1..20: note = Seed: SATGFKQSSKALQRPVASDF
SATGYKQISRALGRPVASDF

SEQ ID NO: 20521 - protein, 20 aa, synthetic construct
  source 1..20: note = Seed: SATGFKQSSKALQRPVASDF
SATGYKQISRALHRPVASDF

SEQ ID NO: 20522 - protein, 20 aa, synthetic construct
  source 1..20: note = Seed: SATGFKQSSKALQRPVASDF
SATGYKQISRALIRPVASDF

SEQ ID NO: 20523 - protein, 20 aa, synthetic construct
  source 1..20: note = Seed: SATGFKQSSKALQRPVASDF
SATGYKQISRALKRPVASDF

SEQ ID NO: 20524 - protein, 20 aa, synthetic construct
  source 1..20: note = Seed: SATGFKQSSKALQRPVASDF
SATGYKQISRALLRPVASDF

SEQ ID NO: 20525 - protein, 20 aa, synthetic construct
  source 1..20: note = Seed: SATGFKQSSKALQRPVASDF
SATGYKQISRALMRPVASDF

SEQ ID NO: 20526 - protein, 20 aa, synthetic construct
  source 1..20: note = Seed: SATGFKQSSKALQRPVASDF
SATGYKQISRALNRPVASDF

SEQ ID NO: 20527 - protein, 20 aa, synthetic construct
  source 1..20: note = Seed: SATGFKQSSKALQRPVASDF
SATGYKQISRALPRPVASDF

SEQ ID NO: 20528 - protein, 20 aa, synthetic construct
  source 1..20: note = Seed: SATGFKQSSKALQRPVASDF
SATGYKQISRALQRPVASDF

SEQ ID NO: 20529 - protein, 20 aa, synthetic construct
  source 1..20: note = Seed: SATGFKQSSKALQRPVASDF
SATGYKQISRALRRPVASDF

SEQ ID NO: 20530 - protein, 20 aa, synthetic construct
  source 1..20: note = Seed: SATGFKQSSKALQRPVASDF
SATGYKQISRALSRPVASDF

SEQ ID NO: 20531 - protein, 20 aa, synthetic construct
  source 1..20: note = Seed: SATGFKQSSKALQRPVASDF
SATGYKQISRALTRPVASDF

SEQ ID NO: 20532 - protein, 20 aa, synthetic construct
  source 1..20: note = Seed: SATGFKQSSKALQRPVASDF
SATGYKQISRALVRPVASDF

SEQ ID NO: 20533 - protein, 20 aa, synthetic construct
  source 1..20: note = Seed: SATGFKQSSKALQRPVASDF
SATGYKQISRALWRPVASDF

SEQ ID NO: 20534 - protein, 20 aa, synthetic construct
  source 1..20: note = Seed: SATGFKQSSKALQRPVASDF
SATGYKQISRALYRPVASDF

SEQ ID NO: 20535 - protein, 20 aa, synthetic construct
  source 1..20: note = Seed: SATGFKQSSKALQRPVASDF
SATGYKQISSALARPVASDF

SEQ ID NO: 20536 - protein, 20 aa, synthetic construct
  source 1..20: note = Seed: SATGFKQSSKALQRPVASDF
SATGYKQISSALCRPVASDF

SEQ ID NO: 20537 - protein, 20 aa, synthetic construct
  source 1..20: note = Seed: SATGFKQSSKALQRPVASDF
SATGYKQISSALDRPVASDF

SEQ ID NO: 20538 - protein, 20 aa, synthetic construct
  source 1..20: note = Seed: SATGFKQSSKALQRPVASDF
SATGYKQISSALERPVASDF

SEQ ID NO: 20539 - protein, 20 aa, synthetic construct
  source 1..20: note = Seed: SATGFKQSSKALQRPVASDF
SATGYKQISSALFRPVASDF

SEQ ID NO: 20540 - protein, 20 aa, synthetic construct
  source 1..20: note = Seed: SATGFKQSSKALQRPVASDF
SATGYKQISSALGRPVASDF

SEQ ID NO: 20541 - protein, 20 aa, synthetic construct
  source 1..20: note = Seed: SATGFKQSSKALQRPVASDF
SATGYKQISSALHRPVASDF

SEQ ID NO: 20542 - protein, 20 aa, synthetic construct
  source 1..20: note = Seed: SATGFKQSSKALQRPVASDF
SATGYKQISSALIRPVASDF

SEQ ID NO: 20543 - protein, 20 aa, synthetic construct
  source 1..20: note = Seed: SATGFKQSSKALQRPVASDF
SATGYKQISSALKRPVASDF

SEQ ID NO: 20544 - protein, 20 aa, synthetic construct
  source 1..20: note = Seed: SATGFKQSSKALQRPVASDF
SATGYKQISSALLRPVASDF

SEQ ID NO: 20545 - protein, 20 aa, synthetic construct
  source 1..20: note = Seed: SATGFKQSSKALQRPVASDF
SATGYKQISSALMRPVASDF

SEQ ID NO: 20546 - protein, 20 aa, synthetic construct
  source 1..20: note = Seed: SATGFKQSSKALQRPVASDF
SATGYKQISSALNRPVASDF

SEQ ID NO: 20547 - protein, 20 aa, synthetic construct
  source 1..20: note = Seed: SATGFKQSSKALQRPVASDF
SATGYKQISSALPRPVASDF

SEQ ID NO: 20548 - protein, 20 aa, synthetic construct
  source 1..20: note = Seed: SATGFKQSSKALQRPVASDF
SATGYKQISSALQRPVASDF

SEQ ID NO: 20549 - protein, 20 aa, synthetic construct
  source 1..20: note = Seed: SATGFKQSSKALQRPVASDF
SATGYKQISSALRRPVASDF

SEQ ID NO: 20550 - protein, 20 aa, synthetic construct
  source 1..20: note = Seed: SATGFKQSSKALQRPVASDF
SATGYKQISSALSRPVASDF

SEQ ID NO: 20551 - protein, 20 aa, synthetic construct
  source 1..20: note = Seed: SATGFKQSSKALQRPVASDF
SATGYKQISSALTRPVASDF

SEQ ID NO: 20552 - protein, 20 aa, synthetic construct
  source 1..20: note = Seed: SATGFKQSSKALQRPVASDF
SATGYKQISSALVRPVASDF

SEQ ID NO: 20553 - protein, 20 aa, synthetic construct
  source 1..20: note = Seed: SATGFKQSSKALQRPVASDF
SATGYKQISSALWRPVASDF

SEQ ID NO: 20554 - protein, 20 aa, synthetic construct
  source 1..20: note = Seed: SATGFKQSSKALQRPVASDF
SATGYKQISSALYRPVASDF

SEQ ID NO: 20555 - protein, 20 aa, synthetic construct
  source 1..20: note = Seed: SATGFKQSSKALQRPVASDF
SATGYKQISTALARPVASDF

SEQ ID NO: 20556 - protein, 20 aa, synthetic construct
  source 1..20: note = Seed: SATGFKQSSKALQRPVASDF
SATGYKQISTALCRPVASDF

SEQ ID NO: 20557 - protein, 20 aa, synthetic construct
  source 1..20: note = Seed: SATGFKQSSKALQRPVASDF
SATGYKQISTALDRPVASDF

SEQ ID NO: 20558 - protein, 20 aa, synthetic construct
  source 1..20: note = Seed: SATGFKQSSKALQRPVASDF
SATGYKQISTALERPVASDF

SEQ ID NO: 20559 - protein, 20 aa, synthetic construct
  source 1..20: note = Seed: SATGFKQSSKALQRPVASDF
SATGYKQISTALFRPVASDF

SEQ ID NO: 20560 - protein, 20 aa, synthetic construct
  source 1..20: note = Seed: SATGFKQSSKALQRPVASDF
SATGYKQISTALGRPVASDF

SEQ ID NO: 20561 - protein, 20 aa, synthetic construct
  source 1..20: note = Seed: SATGFKQSSKALQRPVASDF
SATGYKQISTALHRPVASDF

SEQ ID NO: 20562 - protein, 20 aa, synthetic construct
  source 1..20: note = Seed: SATGFKQSSKALQRPVASDF
SATGYKQISTALIRPVASDF

SEQ ID NO: 20563 - protein, 20 aa, synthetic construct
  source 1..20: note = Seed: SATGFKQSSKALQRPVASDF
SATGYKQISTALKRPVASDF

SEQ ID NO: 20564 - protein, 20 aa, synthetic construct
  source 1..20: note = Seed: SATGFKQSSKALQRPVASDF
SATGYKQISTALLRPVASDF

SEQ ID NO: 20565 - protein, 20 aa, synthetic construct
  source 1..20: note = Seed: SATGFKQSSKALQRPVASDF
SATGYKQISTALMRPVASDF

SEQ ID NO: 20566 - protein, 20 aa, synthetic construct
  source 1..20: note = Seed: SATGFKQSSKALQRPVASDF
SATGYKQISTALNRPVASDF

SEQ ID NO: 20567 - protein, 20 aa, synthetic construct
  source 1..20: note = Seed: SATGFKQSSKALQRPVASDF
SATGYKQISTALPRPVASDF

SEQ ID NO: 20568 - protein, 20 aa, synthetic construct
  source 1..20: note = Seed: SATGFKQSSKALQRPVASDF
SATGYKQISTALQRPVASDF

SEQ ID NO: 20569 - protein, 20 aa, synthetic construct
  source 1..20: note = Seed: SATGFKQSSKALQRPVASDF
SATGYKQISTALRRPVASDF

SEQ ID NO: 20570 - protein, 20 aa, synthetic construct
  source 1..20: note = Seed: SATGFKQSSKALQRPVASDF
SATGYKQISTALSRPVASDF

SEQ ID NO: 20571 - protein, 20 aa, synthetic construct
  source 1..20: note = Seed: SATGFKQSSKALQRPVASDF
SATGYKQISTALTRPVASDF

SEQ ID NO: 20572 - protein, 20 aa, synthetic construct
  source 1..20: note = Seed: SATGFKQSSKALQRPVASDF
SATGYKQISTALVRPVASDF

SEQ ID NO: 20573 - protein, 20 aa, synthetic construct
  source 1..20: note = Seed: SATGFKQSSKALQRPVASDF
SATGYKQISTALWRPVASDF

SEQ ID NO: 20574 - protein, 20 aa, synthetic construct
  source 1..20: note = Seed: SATGFKQSSKALQRPVASDF
SATGYKQISTALYRPVASDF

SEQ ID NO: 20575 - protein, 20 aa, synthetic construct
  source 1..20: note = Seed: SATGFKQSSKALQRPVASDF
SATGYKQISVALARPVASDF

SEQ ID NO: 20576 - protein, 20 aa, synthetic construct
  source 1..20: note = Seed: SATGFKQSSKALQRPVASDF
SATGYKQISVALCRPVASDF

SEQ ID NO: 20577 - protein, 20 aa, synthetic construct
  source 1..20: note = Seed: SATGFKQSSKALQRPVASDF
SATGYKQISVALDRPVASDF

SEQ ID NO: 20578 - protein, 20 aa, synthetic construct
  source 1..20: note = Seed: SATGFKQSSKALQRPVASDF
SATGYKQISVALERPVASDF

SEQ ID NO: 20579 - protein, 20 aa, synthetic construct
  source 1..20: note = Seed: SATGFKQSSKALQRPVASDF
SATGYKQISVALFRPVASDF

SEQ ID NO: 20580 - protein, 20 aa, synthetic construct
  source 1..20: note = Seed: SATGFKQSSKALQRPVASDF
SATGYKQISVALGRPVASDF

SEQ ID NO: 20581 - protein, 20 aa, synthetic construct
  source 1..20: note = Seed: SATGFKQSSKALQRPVASDF
SATGYKQISVALHRPVASDF

SEQ ID NO: 20582 - protein, 20 aa, synthetic construct
  source 1..20: note = Seed: SATGFKQSSKALQRPVASDF
SATGYKQISVALIRPVASDF

SEQ ID NO: 20583 - protein, 20 aa, synthetic construct
  source 1..20: note = Seed: SATGFKQSSKALQRPVASDF
SATGYKQISVALKRPVASDF

SEQ ID NO: 20584 - protein, 20 aa, synthetic construct
  source 1..20: note = Seed: SATGFKQSSKALQRPVASDF
SATGYKQISVALLRPVASDF

SEQ ID NO: 20585 - protein, 20 aa, synthetic construct
  source 1..20: note = Seed: SATGFKQSSKALQRPVASDF
SATGYKQISVALMRPVASDF

SEQ ID NO: 20586 - protein, 20 aa, synthetic construct
  source 1..20: note = Seed: SATGFKQSSKALQRPVASDF
SATGYKQISVALNRPVASDF

SEQ ID NO: 20587 - protein, 20 aa, synthetic construct
  source 1..20: note = Seed: SATGFKQSSKALQRPVASDF
SATGYKQISVALPRPVASDF

SEQ ID NO: 20588 - protein, 20 aa, synthetic construct
  source 1..20: note = Seed: SATGFKQSSKALQRPVASDF
SATGYKQISVALQRPVASDF

SEQ ID NO: 20589 - protein, 20 aa, synthetic construct
  source 1..20: note = Seed: SATGFKQSSKALQRPVASDF
SATGYKQISVALRRPVASDF

SEQ ID NO: 20590 - protein, 20 aa, synthetic construct
  source 1..20: note = Seed: SATGFKQSSKALQRPVASDF
SATGYKQISVALSRPVASDF

SEQ ID NO: 20591 - protein, 20 aa, synthetic construct
  source 1..20: note = Seed: SATGFKQSSKALQRPVASDF
SATGYKQISVALTRPVASDF

SEQ ID NO: 20592 - protein, 20 aa, synthetic construct
  source 1..20: note = Seed: SATGFKQSSKALQRPVASDF
SATGYKQISVALVRPVASDF

SEQ ID NO: 20593 - protein, 20 aa, synthetic construct
  source 1..20: note = Seed: SATGFKQSSKALQRPVASDF
SATGYKQISVALWRPVASDF

SEQ ID NO: 20594 - protein, 20 aa, synthetic construct
  source 1..20: note = Seed: SATGFKQSSKALQRPVASDF
SATGYKQISVALYRPVASDF

SEQ ID NO: 20595 - protein, 20 aa, synthetic construct
  source 1..20: note = Seed: SATGFKQSSKALQRPVASDF
SATGYKQISYALVRPVASDF

SEQ ID NO: 20596 - protein, 20 aa, synthetic construct
  source 1..20: note = Seed: SATGFKQSSKALQRPVASDF
SATGYKQKSAALARPVASDF

SEQ ID NO: 20597 - protein, 20 aa, synthetic construct
  source 1..20: note = Seed: SATGFKQSSKALQRPVASDF
SATGYKQKSAALIRPVASDF

SEQ ID NO: 20598 - protein, 20 aa, synthetic construct
  source 1..20: note = Seed: SATGFKQSSKALQRPVASDF
SATGYKQKSAALLRPVASDF

SEQ ID NO: 20599 - protein, 20 aa, synthetic construct
  source 1..20: note = Seed: SATGFKQSSKALQRPVASDF
SATGYKQKSAALMRPVASDF

SEQ ID NO: 20600 - protein, 20 aa, synthetic construct
  source 1..20: note = Seed: SATGFKQSSKALQRPVASDF
SATGYKQKSAALVRPVASDF

SEQ ID NO: 20601 - protein, 20 aa, synthetic construct
  source 1..20: note = Seed: SATGFKQSSKALQRPVASDF
SATGYKQKSFALFRPVASDF

SEQ ID NO: 20602 - protein, 20 aa, synthetic construct
  source 1..20: note = Seed: SATGFKQSSKALQRPVASDF
SATGYKQKSGALARPVASDF

SEQ ID NO: 20603 - protein, 20 aa, synthetic construct
  source 1..20: note = Seed: SATGFKQSSKALQRPVASDF
SATGYKQKSGALIRPVASDF

SEQ ID NO: 20604 - protein, 20 aa, synthetic construct
  source 1..20: note = Seed: SATGFKQSSKALQRPVASDF
SATGYKQKSGALLRPVASDF

SEQ ID NO: 20605 - protein, 20 aa, synthetic construct
  source 1..20: note = Seed: SATGFKQSSKALQRPVASDF
SATGYKQKSGALVRPVASDF

SEQ ID NO: 20606 - protein, 20 aa, synthetic construct
  source 1..20: note = Seed: SATGFKQSSKALQRPVASDF
SATGYKQKSIALARPVASDF

SEQ ID NO: 20607 - protein, 20 aa, synthetic construct
  source 1..20: note = Seed: SATGFKQSSKALQRPVASDF
SATGYKQKSIALHRPVASDF

SEQ ID NO: 20608 - protein, 20 aa, synthetic construct
  source 1..20: note = Seed: SATGFKQSSKALQRPVASDF
SATGYKQKSIALNRPVASDF

SEQ ID NO: 20609 - protein, 20 aa, synthetic construct
  source 1..20: note = Seed: SATGFKQSSKALQRPVASDF
SATGYKQKSIALSRPVASDF

SEQ ID NO: 20610 - protein, 20 aa, synthetic construct
  source 1..20: note = Seed: SATGFKQSSKALQRPVASDF
SATGYKQKSKALARPVASDF

SEQ ID NO: 20611 - protein, 20 aa, synthetic construct
  source 1..20: note = Seed: SATGFKQSSKALQRPVASDF
SATGYKQKSMALVRPVASDF

SEQ ID NO: 20612 - protein, 20 aa, synthetic construct
  source 1..20: note = Seed: SATGFKQSSKALQRPVASDF
SATGYKQKSPALLRPVASDF

SEQ ID NO: 20613 - protein, 20 aa, synthetic construct
  source 1..20: note = Seed: SATGFKQSSKALQRPVASDF
SATGYKQKSRALARPVASDF

SEQ ID NO: 20614 - protein, 20 aa, synthetic construct
  source 1..20: note = Seed: SATGFKQSSKALQRPVASDF
SATGYKQKSRALSRPVASDF

SEQ ID NO: 20615 - protein, 20 aa, synthetic construct
  source 1..20: note = Seed: SATGFKQSSKALQRPVASDF
SATGYKQKSSALARPVASDF

SEQ ID NO: 20616 - protein, 20 aa, synthetic construct
  source 1..20: note = Seed: SATGFKQSSKALQRPVASDF
SATGYKQKSSALIRPVASDF

SEQ ID NO: 20617 - protein, 20 aa, synthetic construct
  source 1..20: note = Seed: SATGFKQSSKALQRPVASDF
SATGYKQKSSALLRPVASDF

SEQ ID NO: 20618 - protein, 20 aa, synthetic construct
  source 1..20: note = Seed: SATGFKQSSKALQRPVASDF
SATGYKQKSSALVRPVASDF

SEQ ID NO: 20619 - protein, 20 aa, synthetic construct
  source 1..20: note = Seed: SATGFKQSSKALQRPVASDF
SATGYKQKSVALARPVASDF

SEQ ID NO: 20620 - protein, 20 aa, synthetic construct
  source 1..20: note = Seed: SATGFKQSSKALQRPVASDF
SATGYKQKSVALIRPVASDF

SEQ ID NO: 20621 - protein, 20 aa, synthetic construct
  source 1..20: note = Seed: SATGFKQSSKALQRPVASDF
SATGYKQKSVALNRPVASDF

SEQ ID NO: 20622 - protein, 20 aa, synthetic construct
  source 1..20: note = Seed: SATGFKQSSKALQRPVASDF
SATGYKQKSVALQRPVASDF

SEQ ID NO: 20623 - protein, 20 aa, synthetic construct
  source 1..20: note = Seed: SATGFKQSSKALQRPVASDF
SATGYKQKSVALSRPVASDF

SEQ ID NO: 20624 - protein, 20 aa, synthetic construct
  source 1..20: note = Seed: SATGFKQSSKALQRPVASDF
SATGYKQKSVALTRPVASDF

SEQ ID NO: 20625 - protein, 20 aa, synthetic construct
  source 1..20: note = Seed: SATGFKQSSKALQRPVASDF
SATGYKQKSVALVRPVASDF

SEQ ID NO: 20626 - protein, 20 aa, synthetic construct
  source 1..20: note = Seed: SATGFKQSSKALQRPVASDF
SATGYKQLSAALARPVASDF

SEQ ID NO: 20627 - protein, 20 aa, synthetic construct
  source 1..20: note = Seed: SATGFKQSSKALQRPVASDF
SATGYKQLSAALCRPVASDF

SEQ ID NO: 20628 - protein, 20 aa, synthetic construct
  source 1..20: note = Seed: SATGFKQSSKALQRPVASDF
SATGYKQLSAALDRPVASDF

SEQ ID NO: 20629 - protein, 20 aa, synthetic construct
  source 1..20: note = Seed: SATGFKQSSKALQRPVASDF
SATGYKQLSAALERPVASDF

SEQ ID NO: 20630 - protein, 20 aa, synthetic construct
  source 1..20: note = Seed: SATGFKQSSKALQRPVASDF
SATGYKQLSAALFRPVASDF

SEQ ID NO: 20631 - protein, 20 aa, synthetic construct
  source 1..20: note = Seed: SATGFKQSSKALQRPVASDF
SATGYKQLSAALGRPVASDF

SEQ ID NO: 20632 - protein, 20 aa, synthetic construct
  source 1..20: note = Seed: SATGFKQSSKALQRPVASDF
SATGYKQLSAALHRPVASDF

SEQ ID NO: 20633 - protein, 20 aa, synthetic construct
  source 1..20: note = Seed: SATGFKQSSKALQRPVASDF
SATGYKQLSAALIRPVASDF

SEQ ID NO: 20634 - protein, 20 aa, synthetic construct
  source 1..20: note = Seed: SATGFKQSSKALQRPVASDF
SATGYKQLSAALKRPVASDF

SEQ ID NO: 20635 - protein, 20 aa, synthetic construct
  source 1..20: note = Seed: SATGFKQSSKALQRPVASDF
SATGYKQLSAALLRPVASDF

SEQ ID NO: 20636 - protein, 20 aa, synthetic construct
  source 1..20: note = Seed: SATGFKQSSKALQRPVASDF
SATGYKQLSAALMRPVASDF

SEQ ID NO: 20637 - protein, 20 aa, synthetic construct
  source 1..20: note = Seed: SATGFKQSSKALQRPVASDF
SATGYKQLSAALNRPVASDF

SEQ ID NO: 20638 - protein, 20 aa, synthetic construct
  source 1..20: note = Seed: SATGFKQSSKALQRPVASDF
SATGYKQLSAALPRPVASDF

SEQ ID NO: 20639 - protein, 20 aa, synthetic construct
  source 1..20: note = Seed: SATGFKQSSKALQRPVASDF
SATGYKQLSAALQRPVASDF

SEQ ID NO: 20640 - protein, 20 aa, synthetic construct
  source 1..20: note = Seed: SATGFKQSSKALQRPVASDF
SATGYKQLSAALRRPVASDF

SEQ ID NO: 20641 - protein, 20 aa, synthetic construct
  source 1..20: note = Seed: SATGFKQSSKALQRPVASDF
SATGYKQLSAALSRPVASDF

SEQ ID NO: 20642 - protein, 20 aa, synthetic construct
  source 1..20: note = Seed: SATGFKQSSKALQRPVASDF
SATGYKQLSAALTRPVASDF

SEQ ID NO: 20643 - protein, 20 aa, synthetic construct
  source 1..20: note = Seed: SATGFKQSSKALQRPVASDF
SATGYKQLSAALVRPVASDF

SEQ ID NO: 20644 - protein, 20 aa, synthetic construct
  source 1..20: note = Seed: SATGFKQSSKALQRPVASDF
SATGYKQLSAALWRPVASDF

SEQ ID NO: 20645 - protein, 20 aa, synthetic construct
  source 1..20: note = Seed: SATGFKQSSKALQRPVASDF
SATGYKQLSAALYRPVASDF

SEQ ID NO: 20646 - protein, 20 aa, synthetic construct
  source 1..20: note = Seed: SATGFKQSSKALQRPVASDF
SATGYKQLSCALARPVASDF

SEQ ID NO: 20647 - protein, 20 aa, synthetic construct
  source 1..20: note = Seed: SATGFKQSSKALQRPVASDF
SATGYKQLSCALGRPVASDF

SEQ ID NO: 20648 - protein, 20 aa, synthetic construct
  source 1..20: note = Seed: SATGFKQSSKALQRPVASDF
SATGYKQLSCALIRPVASDF

SEQ ID NO: 20649 - protein, 20 aa, synthetic construct
  source 1..20: note = Seed: SATGFKQSSKALQRPVASDF
SATGYKQLSCALLRPVASDF

SEQ ID NO: 20650 - protein, 20 aa, synthetic construct
  source 1..20: note = Seed: SATGFKQSSKALQRPVASDF
SATGYKQLSCALMRPVASDF

SEQ ID NO: 20651 - protein, 20 aa, synthetic construct
  source 1..20: note = Seed: SATGFKQSSKALQRPVASDF
SATGYKQLSCALNRPVASDF

SEQ ID NO: 20652 - protein, 20 aa, synthetic construct
  source 1..20: note = Seed: SATGFKQSSKALQRPVASDF
SATGYKQLSCALPRPVASDF

SEQ ID NO: 20653 - protein, 20 aa, synthetic construct
  source 1..20: note = Seed: SATGFKQSSKALQRPVASDF
SATGYKQLSCALSRPVASDF

SEQ ID NO: 20654 - protein, 20 aa, synthetic construct
  source 1..20: note = Seed: SATGFKQSSKALQRPVASDF
SATGYKQLSCALTRPVASDF

SEQ ID NO: 20655 - protein, 20 aa, synthetic construct
  source 1..20: note = Seed: SATGFKQSSKALQRPVASDF
SATGYKQLSCALVRPVASDF

SEQ ID NO: 20656 - protein, 20 aa, synthetic construct
  source 1..20: note = Seed: SATGFKQSSKALQRPVASDF
SATGYKQLSDALARPVASDF

SEQ ID NO: 20657 - protein, 20 aa, synthetic construct
  source 1..20: note = Seed: SATGFKQSSKALQRPVASDF
SATGYKQLSDALIRPVASDF

SEQ ID NO: 20658 - protein, 20 aa, synthetic construct
  source 1..20: note = Seed: SATGFKQSSKALQRPVASDF
SATGYKQLSDALLRPVASDF

SEQ ID NO: 20659 - protein, 20 aa, synthetic construct
  source 1..20: note = Seed: SATGFKQSSKALQRPVASDF
SATGYKQLSDALNRPVASDF

SEQ ID NO: 20660 - protein, 20 aa, synthetic construct
  source 1..20: note = Seed: SATGFKQSSKALQRPVASDF
SATGYKQLSDALSRPVASDF

SEQ ID NO: 20661 - protein, 20 aa, synthetic construct
  source 1..20: note = Seed: SATGFKQSSKALQRPVASDF
SATGYKQLSDALVRPVASDF

SEQ ID NO: 20662 - protein, 20 aa, synthetic construct
  source 1..20: note = Seed: SATGFKQSSKALQRPVASDF
SATGYKQLSEALARPVASDF

SEQ ID NO: 20663 - protein, 20 aa, synthetic construct
  source 1..20: note = Seed: SATGFKQSSKALQRPVASDF
SATGYKQLSEALGRPVASDF

SEQ ID NO: 20664 - protein, 20 aa, synthetic construct
  source 1..20: note = Seed: SATGFKQSSKALQRPVASDF
SATGYKQLSEALIRPVASDF

SEQ ID NO: 20665 - protein, 20 aa, synthetic construct
  source 1..20: note = Seed: SATGFKQSSKALQRPVASDF
SATGYKQLSEALLRPVASDF

SEQ ID NO: 20666 - protein, 20 aa, synthetic construct
  source 1..20: note = Seed: SATGFKQSSKALQRPVASDF
SATGYKQLSEALMRPVASDF

SEQ ID NO: 20667 - protein, 20 aa, synthetic construct
  source 1..20: note = Seed: SATGFKQSSKALQRPVASDF
SATGYKQLSEALNRPVASDF

SEQ ID NO: 20668 - protein, 20 aa, synthetic construct
  source 1..20: note = Seed: SATGFKQSSKALQRPVASDF
SATGYKQLSEALSRPVASDF

SEQ ID NO: 20669 - protein, 20 aa, synthetic construct
  source 1..20: note = Seed: SATGFKQSSKALQRPVASDF
SATGYKQLSEALTRPVASDF

SEQ ID NO: 20670 - protein, 20 aa, synthetic construct
  source 1..20: note = Seed: SATGFKQSSKALQRPVASDF
SATGYKQLSEALVRPVASDF

SEQ ID NO: 20671 - protein, 20 aa, synthetic construct
  source 1..20: note = Seed: SATGFKQSSKALQRPVASDF
SATGYKQLSFALARPVASDF

SEQ ID NO: 20672 - protein, 20 aa, synthetic construct
  source 1..20: note = Seed: SATGFKQSSKALQRPVASDF
SATGYKQLSFALCRPVASDF

SEQ ID NO: 20673 - protein, 20 aa, synthetic construct
  source 1..20: note = Seed: SATGFKQSSKALQRPVASDF
SATGYKQLSFALERPVASDF

SEQ ID NO: 20674 - protein, 20 aa, synthetic construct
  source 1..20: note = Seed: SATGFKQSSKALQRPVASDF
SATGYKQLSFALIRPVASDF

SEQ ID NO: 20675 - protein, 20 aa, synthetic construct
  source 1..20: note = Seed: SATGFKQSSKALQRPVASDF
SATGYKQLSFALLRPVASDF

SEQ ID NO: 20676 - protein, 20 aa, synthetic construct
  source 1..20: note = Seed: SATGFKQSSKALQRPVASDF
SATGYKQLSFALMRPVASDF

SEQ ID NO: 20677 - protein, 20 aa, synthetic construct
  source 1..20: note = Seed: SATGFKQSSKALQRPVASDF
SATGYKQLSFALRRPVASDF

SEQ ID NO: 20678 - protein, 20 aa, synthetic construct
  source 1..20: note = Seed: SATGFKQSSKALQRPVASDF
SATGYKQLSFALSRPVASDF

SEQ ID NO: 20679 - protein, 20 aa, synthetic construct
  source 1..20: note = Seed: SATGFKQSSKALQRPVASDF
SATGYKQLSFALTRPVASDF

SEQ ID NO: 20680 - protein, 20 aa, synthetic construct
  source 1..20: note = Seed: SATGFKQSSKALQRPVASDF
SATGYKQLSFALVRPVASDF

SEQ ID NO: 20681 - protein, 20 aa, synthetic construct
  source 1..20: note = Seed: SATGFKQSSKALQRPVASDF
SATGYKQLSFALYRPVASDF

SEQ ID NO: 20682 - protein, 20 aa, synthetic construct
  source 1..20: note = Seed: SATGFKQSSKALQRPVASDF
SATGYKQLSGALARPVASDF

SEQ ID NO: 20683 - protein, 20 aa, synthetic construct
  source 1..20: note = Seed: SATGFKQSSKALQRPVASDF
SATGYKQLSGALCRPVASDF

SEQ ID NO: 20684 - protein, 20 aa, synthetic construct
  source 1..20: note = Seed: SATGFKQSSKALQRPVASDF
SATGYKQLSGALDRPVASDF

SEQ ID NO: 20685 - protein, 20 aa, synthetic construct
  source 1..20: note = Seed: SATGFKQSSKALQRPVASDF
SATGYKQLSGALERPVASDF

SEQ ID NO: 20686 - protein, 20 aa, synthetic construct
  source 1..20: note = Seed: SATGFKQSSKALQRPVASDF
SATGYKQLSGALFRPVASDF

SEQ ID NO: 20687 - protein, 20 aa, synthetic construct
  source 1..20: note = Seed: SATGFKQSSKALQRPVASDF
SATGYKQLSGALGRPVASDF

SEQ ID NO: 20688 - protein, 20 aa, synthetic construct
  source 1..20: note = Seed: SATGFKQSSKALQRPVASDF
SATGYKQLSGALHRPVASDF

SEQ ID NO: 20689 - protein, 20 aa, synthetic construct
  source 1..20: note = Seed: SATGFKQSSKALQRPVASDF
SATGYKQLSGALIRPVASDF

SEQ ID NO: 20690 - protein, 20 aa, synthetic construct
  source 1..20: note = Seed: SATGFKQSSKALQRPVASDF
SATGYKQLSGALKRPVASDF

SEQ ID NO: 20691 - protein, 20 aa, synthetic construct
  source 1..20: note = Seed: SATGFKQSSKALQRPVASDF
SATGYKQLSGALLRPVASDF

SEQ ID NO: 20692 - protein, 20 aa, synthetic construct
  source 1..20: note = Seed: SATGFKQSSKALQRPVASDF
SATGYKQLSGALMRPVASDF

SEQ ID NO: 20693 - protein, 20 aa, synthetic construct
  source 1..20: note = Seed: SATGFKQSSKALQRPVASDF
SATGYKQLSGALNRPVASDF

SEQ ID NO: 20694 - protein, 20 aa, synthetic construct
  source 1..20: note = Seed: SATGFKQSSKALQRPVASDF
SATGYKQLSGALPRPVASDF

SEQ ID NO: 20695 - protein, 20 aa, synthetic construct
  source 1..20: note = Seed: SATGFKQSSKALQRPVASDF
SATGYKQLSGALQRPVASDF

SEQ ID NO: 20696 - protein, 20 aa, synthetic construct
  source 1..20: note = Seed: SATGFKQSSKALQRPVASDF
SATGYKQLSGALRRPVASDF

SEQ ID NO: 20697 - protein, 20 aa, synthetic construct
  source 1..20: note = Seed: SATGFKQSSKALQRPVASDF
SATGYKQLSGALSRPVASDF

SEQ ID NO: 20698 - protein, 20 aa, synthetic construct
  source 1..20: note = Seed: SATGFKQSSKALQRPVASDF
SATGYKQLSGALTRPVASDF

SEQ ID NO: 20699 - protein, 20 aa, synthetic construct
  source 1..20: note = Seed: SATGFKQSSKALQRPVASDF
SATGYKQLSGALVRPVASDF

SEQ ID NO: 20700 - protein, 20 aa, synthetic construct
  source 1..20: note = Seed: SATGFKQSSKALQRPVASDF
SATGYKQLSGALWRPVASDF

SEQ ID NO: 20701 - protein, 20 aa, synthetic construct
  source 1..20: note = Seed: SATGFKQSSKALQRPVASDF
SATGYKQLSGALYRPVASDF

SEQ ID NO: 20702 - protein, 20 aa, synthetic construct
  source 1..20: note = Seed: SATGFKQSSKALQRPVASDF
SATGYKQLSHALARPVASDF

SEQ ID NO: 20703 - protein, 20 aa, synthetic construct
  source 1..20: note = Seed: SATGFKQSSKALQRPVASDF
SATGYKQLSHALFRPVASDF

SEQ ID NO: 20704 - protein, 20 aa, synthetic construct
  source 1..20: note = Seed: SATGFKQSSKALQRPVASDF
SATGYKQLSHALGRPVASDF

SEQ ID NO: 20705 - protein, 20 aa, synthetic construct
  source 1..20: note = Seed: SATGFKQSSKALQRPVASDF
SATGYKQLSHALIRPVASDF

SEQ ID NO: 20706 - protein, 20 aa, synthetic construct
  source 1..20: note = Seed: SATGFKQSSKALQRPVASDF
SATGYKQLSHALLRPVASDF

SEQ ID NO: 20707 - protein, 20 aa, synthetic construct
  source 1..20: note = Seed: SATGFKQSSKALQRPVASDF
SATGYKQLSHALMRPVASDF

SEQ ID NO: 20708 - protein, 20 aa, synthetic construct
  source 1..20: note = Seed: SATGFKQSSKALQRPVASDF
SATGYKQLSHALNRPVASDF

SEQ ID NO: 20709 - protein, 20 aa, synthetic construct
  source 1..20: note = Seed: SATGFKQSSKALQRPVASDF
SATGYKQLSHALPRPVASDF

SEQ ID NO: 20710 - protein, 20 aa, synthetic construct
  source 1..20: note = Seed: SATGFKQSSKALQRPVASDF
SATGYKQLSHALRRPVASDF

SEQ ID NO: 20711 - protein, 20 aa, synthetic construct
  source 1..20: note = Seed: SATGFKQSSKALQRPVASDF
SATGYKQLSHALSRPVASDF

SEQ ID NO: 20712 - protein, 20 aa, synthetic construct
  source 1..20: note = Seed: SATGFKQSSKALQRPVASDF
SATGYKQLSHALTRPVASDF

SEQ ID NO: 20713 - protein, 20 aa, synthetic construct
  source 1..20: note = Seed: SATGFKQSSKALQRPVASDF
SATGYKQLSHALVRPVASDF

SEQ ID NO: 20714 - protein, 20 aa, synthetic construct
  source 1..20: note = Seed: SATGFKQSSKALQRPVASDF
SATGYKQLSIALARPVASDF

SEQ ID NO: 20715 - protein, 20 aa, synthetic construct
  source 1..20: note = Seed: SATGFKQSSKALQRPVASDF
SATGYKQLSIALCRPVASDF

SEQ ID NO: 20716 - protein, 20 aa, synthetic construct
  source 1..20: note = Seed: SATGFKQSSKALQRPVASDF
SATGYKQLSIALDRPVASDF

SEQ ID NO: 20717 - protein, 20 aa, synthetic construct
  source 1..20: note = Seed: SATGFKQSSKALQRPVASDF
SATGYKQLSIALERPVASDF

SEQ ID NO: 20718 - protein, 20 aa, synthetic construct
  source 1..20: note = Seed: SATGFKQSSKALQRPVASDF
SATGYKQLSIALFRPVASDF

SEQ ID NO: 20719 - protein, 20 aa, synthetic construct
  source 1..20: note = Seed: SATGFKQSSKALQRPVASDF
SATGYKQLSIALGRPVASDF

SEQ ID NO: 20720 - protein, 20 aa, synthetic construct
  source 1..20: note = Seed: SATGFKQSSKALQRPVASDF
SATGYKQLSIALHRPVASDF

SEQ ID NO: 20721 - protein, 20 aa, synthetic construct
  source 1..20: note = Seed: SATGFKQSSKALQRPVASDF
SATGYKQLSIALIRPVASDF

SEQ ID NO: 20722 - protein, 20 aa, synthetic construct
  source 1..20: note = Seed: SATGFKQSSKALQRPVASDF
SATGYKQLSIALKRPVASDF

SEQ ID NO: 20723 - protein, 20 aa, synthetic construct
  source 1..20: note = Seed: SATGFKQSSKALQRPVASDF
SATGYKQLSIALLRPVASDF

SEQ ID NO: 20724 - protein, 20 aa, synthetic construct
  source 1..20: note = Seed: SATGFKQSSKALQRPVASDF
SATGYKQLSIALMRPVASDF

SEQ ID NO: 20725 - protein, 20 aa, synthetic construct
  source 1..20: note = Seed: SATGFKQSSKALQRPVASDF
SATGYKQLSIALNRPVASDF

SEQ ID NO: 20726 - protein, 20 aa, synthetic construct
  source 1..20: note = Seed: SATGFKQSSKALQRPVASDF
SATGYKQLSIALPRPVASDF

SEQ ID NO: 20727 - protein, 20 aa, synthetic construct
  source 1..20: note = Seed: SATGFKQSSKALQRPVASDF
SATGYKQLSIALQRPVASDF

SEQ ID NO: 20728 - protein, 20 aa, synthetic construct
  source 1..20: note = Seed: SATGFKQSSKALQRPVASDF
SATGYKQLSIALRRPVASDF

SEQ ID NO: 20729 - protein, 20 aa, synthetic construct
  source 1..20: note = Seed: SATGFKQSSKALQRPVASDF
SATGYKQLSIALSRPVASDF

SEQ ID NO: 20730 - protein, 20 aa, synthetic construct
  source 1..20: note = Seed: SATGFKQSSKALQRPVASDF
SATGYKQLSIALTRPVASDF

SEQ ID NO: 20731 - protein, 20 aa, synthetic construct
  source 1..20: note = Seed: SATGFKQSSKALQRPVASDF
SATGYKQLSIALVRPVASDF

SEQ ID NO: 20732 - protein, 20 aa, synthetic construct
  source 1..20: note = Seed: SATGFKQSSKALQRPVASDF
SATGYKQLSIALWRPVASDF

SEQ ID NO: 20733 - protein, 20 aa, synthetic construct
  source 1..20: note = Seed: SATGFKQSSKALQRPVASDF
SATGYKQLSIALYRPVASDF

SEQ ID NO: 20734 - protein, 20 aa, synthetic construct
  source 1..20: note = Seed: SATGFKQSSKALQRPVASDF
SATGYKQLSKALARPVASDF

SEQ ID NO: 20735 - protein, 20 aa, synthetic construct
  source 1..20: note = Seed: SATGFKQSSKALQRPVASDF
SATGYKQLSKALCRPVASDF

SEQ ID NO: 20736 - protein, 20 aa, synthetic construct
  source 1..20: note = Seed: SATGFKQSSKALQRPVASDF
SATGYKQLSKALFRPVASDF

SEQ ID NO: 20737 - protein, 20 aa, synthetic construct
  source 1..20: note = Seed: SATGFKQSSKALQRPVASDF
SATGYKQLSKALGRPVASDF

SEQ ID NO: 20738 - protein, 20 aa, synthetic construct
  source 1..20: note = Seed: SATGFKQSSKALQRPVASDF
SATGYKQLSKALHRPVASDF

SEQ ID NO: 20739 - protein, 20 aa, synthetic construct
  source 1..20: note = Seed: SATGFKQSSKALQRPVASDF
SATGYKQLSKALIRPVASDF

SEQ ID NO: 20740 - protein, 20 aa, synthetic construct
  source 1..20: note = Seed: SATGFKQSSKALQRPVASDF
SATGYKQLSKALKRPVASDF

SEQ ID NO: 20741 - protein, 20 aa, synthetic construct
  source 1..20: note = Seed: SATGFKQSSKALQRPVASDF
SATGYKQLSKALLRPVASDF

SEQ ID NO: 20742 - protein, 20 aa, synthetic construct
  source 1..20: note = Seed: SATGFKQSSKALQRPVASDF
SATGYKQLSKALMRPVASDF

SEQ ID NO: 20743 - protein, 20 aa, synthetic construct
  source 1..20: note = Seed: SATGFKQSSKALQRPVASDF
SATGYKQLSKALNRPVASDF

SEQ ID NO: 20744 - protein, 20 aa, synthetic construct
  source 1..20: note = Seed: SATGFKQSSKALQRPVASDF
SATGYKQLSKALPRPVASDF

SEQ ID NO: 20745 - protein, 20 aa, synthetic construct
  source 1..20: note = Seed: SATGFKQSSKALQRPVASDF
SATGYKQLSKALQRPVASDF

SEQ ID NO: 20746 - protein, 20 aa, synthetic construct
  source 1..20: note = Seed: SATGFKQSSKALQRPVASDF
SATGYKQLSKALRRPVASDF

SEQ ID NO: 20747 - protein, 20 aa, synthetic construct
  source 1..20: note = Seed: SATGFKQSSKALQRPVASDF
SATGYKQLSKALSRPVASDF

SEQ ID NO: 20748 - protein, 20 aa, synthetic construct
  source 1..20: note = Seed: SATGFKQSSKALQRPVASDF
SATGYKQLSKALTRPVASDF

SEQ ID NO: 20749 - protein, 20 aa, synthetic construct
  source 1..20: note = Seed: SATGFKQSSKALQRPVASDF
SATGYKQLSKALVRPVASDF

SEQ ID NO: 20750 - protein, 20 aa, synthetic construct
  source 1..20: note = Seed: SATGFKQSSKALQRPVASDF
SATGYKQLSKALWRPVASDF

SEQ ID NO: 20751 - protein, 20 aa, synthetic construct
  source 1..20: note = Seed: SATGFKQSSKALQRPVASDF
SATGYKQLSKALYRPVASDF

SEQ ID NO: 20752 - protein, 20 aa, synthetic construct
  source 1..20: note = Seed: SATGFKQSSKALQRPVASDF
SATGYKQLSLALARPVASDF

SEQ ID NO: 20753 - protein, 20 aa, synthetic construct
  source 1..20: note = Seed: SATGFKQSSKALQRPVASDF
SATGYKQLSLALCRPVASDF

SEQ ID NO: 20754 - protein, 20 aa, synthetic construct
  source 1..20: note = Seed: SATGFKQSSKALQRPVASDF
SATGYKQLSLALDRPVASDF

SEQ ID NO: 20755 - protein, 20 aa, synthetic construct
  source 1..20: note = Seed: SATGFKQSSKALQRPVASDF
SATGYKQLSLALERPVASDF

SEQ ID NO: 20756 - protein, 20 aa, synthetic construct
  source 1..20: note = Seed: SATGFKQSSKALQRPVASDF
SATGYKQLSLALFRPVASDF

SEQ ID NO: 20757 - protein, 20 aa, synthetic construct
  source 1..20: note = Seed: SATGFKQSSKALQRPVASDF
SATGYKQLSLALGRPVASDF

SEQ ID NO: 20758 - protein, 20 aa, synthetic construct
  source 1..20: note = Seed: SATGFKQSSKALQRPVASDF
SATGYKQLSLALHRPVASDF

SEQ ID NO: 20759 - protein, 20 aa, synthetic construct
  source 1..20: note = Seed: SATGFKQSSKALQRPVASDF
SATGYKQLSLALIRPVASDF

SEQ ID NO: 20760 - protein, 20 aa, synthetic construct
  source 1..20: note = Seed: SATGFKQSSKALQRPVASDF
SATGYKQLSLALKRPVASDF

SEQ ID NO: 20761 - protein, 20 aa, synthetic construct
  source 1..20: note = Seed: SATGFKQSSKALQRPVASDF
SATGYKQLSLALLRPVASDF

SEQ ID NO: 20762 - protein, 20 aa, synthetic construct
  source 1..20: note = Seed: SATGFKQSSKALQRPVASDF
SATGYKQLSLALMRPVASDF

SEQ ID NO: 20763 - protein, 20 aa, synthetic construct
  source 1..20: note = Seed: SATGFKQSSKALQRPVASDF
SATGYKQLSLALNRPVASDF

SEQ ID NO: 20764 - protein, 20 aa, synthetic construct
  source 1..20: note = Seed: SATGFKQSSKALQRPVASDF
SATGYKQLSLALPRPVASDF

SEQ ID NO: 20765 - protein, 20 aa, synthetic construct
  source 1..20: note = Seed: SATGFKQSSKALQRPVASDF
SATGYKQLSLALQRPVASDF

SEQ ID NO: 20766 - protein, 20 aa, synthetic construct
  source 1..20: note = Seed: SATGFKQSSKALQRPVASDF
SATGYKQLSLALRRPVASDF

SEQ ID NO: 20767 - protein, 20 aa, synthetic construct
  source 1..20: note = Seed: SATGFKQSSKALQRPVASDF
SATGYKQLSLALSRPVASDF

SEQ ID NO: 20768 - protein, 20 aa, synthetic construct
  source 1..20: note = Seed: SATGFKQSSKALQRPVASDF
SATGYKQLSLALTRPVASDF

SEQ ID NO: 20769 - protein, 20 aa, synthetic construct
  source 1..20: note = Seed: SATGFKQSSKALQRPVASDF
SATGYKQLSLALVRPVASDF

SEQ ID NO: 20770 - protein, 20 aa, synthetic construct
  source 1..20: note = Seed: SATGFKQSSKALQRPVASDF
SATGYKQLSLALYRPVASDF

SEQ ID NO: 20771 - protein, 20 aa, synthetic construct
  source 1..20: note = Seed: SATGFKQSSKALQRPVASDF
SATGYKQLSMALARPVASDF

SEQ ID NO: 20772 - protein, 20 aa, synthetic construct
  source 1..20: note = Seed: SATGFKQSSKALQRPVASDF
SATGYKQLSMALCRPVASDF

SEQ ID NO: 20773 - protein, 20 aa, synthetic construct
  source 1..20: note = Seed: SATGFKQSSKALQRPVASDF
SATGYKQLSMALDRPVASDF

SEQ ID NO: 20774 - protein, 20 aa, synthetic construct
  source 1..20: note = Seed: SATGFKQSSKALQRPVASDF
SATGYKQLSMALERPVASDF

SEQ ID NO: 20775 - protein, 20 aa, synthetic construct
  source 1..20: note = Seed: SATGFKQSSKALQRPVASDF
SATGYKQLSMALFRPVASDF

SEQ ID NO: 20776 - protein, 20 aa, synthetic construct
  source 1..20: note = Seed: SATGFKQSSKALQRPVASDF
SATGYKQLSMALGRPVASDF

SEQ ID NO: 20777 - protein, 20 aa, synthetic construct
  source 1..20: note = Seed: SATGFKQSSKALQRPVASDF
SATGYKQLSMALHRPVASDF

SEQ ID NO: 20778 - protein, 20 aa, synthetic construct
  source 1..20: note = Seed: SATGFKQSSKALQRPVASDF
SATGYKQLSMALIRPVASDF

SEQ ID NO: 20779 - protein, 20 aa, synthetic construct
  source 1..20: note = Seed: SATGFKQSSKALQRPVASDF
SATGYKQLSMALKRPVASDF

SEQ ID NO: 20780 - protein, 20 aa, synthetic construct
  source 1..20: note = Seed: SATGFKQSSKALQRPVASDF
SATGYKQLSMALLRPVASDF

SEQ ID NO: 20781 - protein, 20 aa, synthetic construct
  source 1..20: note = Seed: SATGFKQSSKALQRPVASDF
SATGYKQLSMALMRPVASDF

SEQ ID NO: 20782 - protein, 20 aa, synthetic construct
  source 1..20: note = Seed: SATGFKQSSKALQRPVASDF
SATGYKQLSMALNRPVASDF

SEQ ID NO: 20783 - protein, 20 aa, synthetic construct
  source 1..20: note = Seed: SATGFKQSSKALQRPVASDF
SATGYKQLSMALQRPVASDF

SEQ ID NO: 20784 - protein, 20 aa, synthetic construct
  source 1..20: note = Seed: SATGFKQSSKALQRPVASDF
SATGYKQLSMALRRPVASDF

SEQ ID NO: 20785 - protein, 20 aa, synthetic construct
  source 1..20: note = Seed: SATGFKQSSKALQRPVASDF
SATGYKQLSMALSRPVASDF

SEQ ID NO: 20786 - protein, 20 aa, synthetic construct
  source 1..20: note = Seed: SATGFKQSSKALQRPVASDF
SATGYKQLSMALTRPVASDF

SEQ ID NO: 20787 - protein, 20 aa, synthetic construct
  source 1..20: note = Seed: SATGFKQSSKALQRPVASDF
SATGYKQLSMALVRPVASDF

SEQ ID NO: 20788 - protein, 20 aa, synthetic construct
  source 1..20: note = Seed: SATGFKQSSKALQRPVASDF
SATGYKQLSMALWRPVASDF

SEQ ID NO: 20789 - protein, 20 aa, synthetic construct
  source 1..20: note = Seed: SATGFKQSSKALQRPVASDF
SATGYKQLSMALYRPVASDF

SEQ ID NO: 20790 - protein, 20 aa, synthetic construct
  source 1..20: note = Seed: SATGFKQSSKALQRPVASDF
SATGYKQLSNALARPVASDF

SEQ ID NO: 20791 - protein, 20 aa, synthetic construct
  source 1..20: note = Seed: SATGFKQSSKALQRPVASDF
SATGYKQLSNALCRPVASDF

SEQ ID NO: 20792 - protein, 20 aa, synthetic construct
  source 1..20: note = Seed: SATGFKQSSKALQRPVASDF
SATGYKQLSNALDRPVASDF

SEQ ID NO: 20793 - protein, 20 aa, synthetic construct
  source 1..20: note = Seed: SATGFKQSSKALQRPVASDF
SATGYKQLSNALERPVASDF

SEQ ID NO: 20794 - protein, 20 aa, synthetic construct
  source 1..20: note = Seed: SATGFKQSSKALQRPVASDF
SATGYKQLSNALFRPVASDF

SEQ ID NO: 20795 - protein, 20 aa, synthetic construct
  source 1..20: note = Seed: SATGFKQSSKALQRPVASDF
SATGYKQLSNALGRPVASDF

SEQ ID NO: 20796 - protein, 20 aa, synthetic construct
  source 1..20: note = Seed: SATGFKQSSKALQRPVASDF
SATGYKQLSNALHRPVASDF

SEQ ID NO: 20797 - protein, 20 aa, synthetic construct
  source 1..20: note = Seed: SATGFKQSSKALQRPVASDF
SATGYKQLSNALIRPVASDF

SEQ ID NO: 20798 - protein, 20 aa, synthetic construct
  source 1..20: note = Seed: SATGFKQSSKALQRPVASDF
SATGYKQLSNALLRPVASDF

SEQ ID NO: 20799 - protein, 20 aa, synthetic construct
  source 1..20: note = Seed: SATGFKQSSKALQRPVASDF
SATGYKQLSNALMRPVASDF

SEQ ID NO: 20800 - protein, 20 aa, synthetic construct
  source 1..20: note = Seed: SATGFKQSSKALQRPVASDF
SATGYKQLSNALNRPVASDF

SEQ ID NO: 20801 - protein, 20 aa, synthetic construct
  source 1..20: note = Seed: SATGFKQSSKALQRPVASDF
SATGYKQLSNALPRPVASDF

SEQ ID NO: 20802 - protein, 20 aa, synthetic construct
  source 1..20: note = Seed: SATGFKQSSKALQRPVASDF
SATGYKQLSNALQRPVASDF

SEQ ID NO: 20803 - protein, 20 aa, synthetic construct
  source 1..20: note = Seed: SATGFKQSSKALQRPVASDF
SATGYKQLSNALRRPVASDF

SEQ ID NO: 20804 - protein, 20 aa, synthetic construct
  source 1..20: note = Seed: SATGFKQSSKALQRPVASDF
SATGYKQLSNALSRPVASDF

SEQ ID NO: 20805 - protein, 20 aa, synthetic construct
  source 1..20: note = Seed: SATGFKQSSKALQRPVASDF
SATGYKQLSNALTRPVASDF

SEQ ID NO: 20806 - protein, 20 aa, synthetic construct
  source 1..20: note = Seed: SATGFKQSSKALQRPVASDF
SATGYKQLSNALVRPVASDF

SEQ ID NO: 20807 - protein, 20 aa, synthetic construct
  source 1..20: note = Seed: SATGFKQSSKALQRPVASDF
SATGYKQLSNALWRPVASDF

SEQ ID NO: 20808 - protein, 20 aa, synthetic construct
  source 1..20: note = Seed: SATGFKQSSKALQRPVASDF
SATGYKQLSNALYRPVASDF

SEQ ID NO: 20809 - protein, 20 aa, synthetic construct
  source 1..20: note = Seed: SATGFKQSSKALQRPVASDF
SATGYKQLSPALARPVASDF

SEQ ID NO: 20810 - protein, 20 aa, synthetic construct
  source 1..20: note = Seed: SATGFKQSSKALQRPVASDF
SATGYKQLSPALCRPVASDF

SEQ ID NO: 20811 - protein, 20 aa, synthetic construct
  source 1..20: note = Seed: SATGFKQSSKALQRPVASDF
SATGYKQLSPALDRPVASDF

SEQ ID NO: 20812 - protein, 20 aa, synthetic construct
  source 1..20: note = Seed: SATGFKQSSKALQRPVASDF
SATGYKQLSPALERPVASDF

SEQ ID NO: 20813 - protein, 20 aa, synthetic construct
  source 1..20: note = Seed: SATGFKQSSKALQRPVASDF
SATGYKQLSPALFRPVASDF

SEQ ID NO: 20814 - protein, 20 aa, synthetic construct
  source 1..20: note = Seed: SATGFKQSSKALQRPVASDF
SATGYKQLSPALGRPVASDF

SEQ ID NO: 20815 - protein, 20 aa, synthetic construct
  source 1..20: note = Seed: SATGFKQSSKALQRPVASDF
SATGYKQLSPALHRPVASDF

SEQ ID NO: 20816 - protein, 20 aa, synthetic construct
  source 1..20: note = Seed: SATGFKQSSKALQRPVASDF
SATGYKQLSPALIRPVASDF

SEQ ID NO: 20817 - protein, 20 aa, synthetic construct
  source 1..20: note = Seed: SATGFKQSSKALQRPVASDF
SATGYKQLSPALKRPVASDF

SEQ ID NO: 20818 - protein, 20 aa, synthetic construct
  source 1..20: note = Seed: SATGFKQSSKALQRPVASDF
SATGYKQLSPALLRPVASDF

SEQ ID NO: 20819 - protein, 20 aa, synthetic construct
  source 1..20: note = Seed: SATGFKQSSKALQRPVASDF
SATGYKQLSPALMRPVASDF

SEQ ID NO: 20820 - protein, 20 aa, synthetic construct
  source 1..20: note = Seed: SATGFKQSSKALQRPVASDF
SATGYKQLSPALNRPVASDF

SEQ ID NO: 20821 - protein, 20 aa, synthetic construct
  source 1..20: note = Seed: SATGFKQSSKALQRPVASDF
SATGYKQLSPALPRPVASDF

SEQ ID NO: 20822 - protein, 20 aa, synthetic construct
  source 1..20: note = Seed: SATGFKQSSKALQRPVASDF
SATGYKQLSPALQRPVASDF

SEQ ID NO: 20823 - protein, 20 aa, synthetic construct
  source 1..20: note = Seed: SATGFKQSSKALQRPVASDF
SATGYKQLSPALRRPVASDF

SEQ ID NO: 20824 - protein, 20 aa, synthetic construct
  source 1..20: note = Seed: SATGFKQSSKALQRPVASDF
SATGYKQLSPALSRPVASDF

SEQ ID NO: 20825 - protein, 20 aa, synthetic construct
  source 1..20: note = Seed: SATGFKQSSKALQRPVASDF
SATGYKQLSPALTRPVASDF

SEQ ID NO: 20826 - protein, 20 aa, synthetic construct
  source 1..20: note = Seed: SATGFKQSSKALQRPVASDF
SATGYKQLSPALVRPVASDF

SEQ ID NO: 20827 - protein, 20 aa, synthetic construct
  source 1..20: note = Seed: SATGFKQSSKALQRPVASDF
SATGYKQLSPALWRPVASDF

SEQ ID NO: 20828 - protein, 20 aa, synthetic construct
  source 1..20: note = Seed: SATGFKQSSKALQRPVASDF
SATGYKQLSPALYRPVASDF

SEQ ID NO: 20829 - protein, 20 aa, synthetic construct
  source 1..20: note = Seed: SATGFKQSSKALQRPVASDF
SATGYKQLSQALARPVASDF

SEQ ID NO: 20830 - protein, 20 aa, synthetic construct
  source 1..20: note = Seed: SATGFKQSSKALQRPVASDF
SATGYKQLSQALGRPVASDF

SEQ ID NO: 20831 - protein, 20 aa, synthetic construct
  source 1..20: note = Seed: SATGFKQSSKALQRPVASDF
SATGYKQLSQALIRPVASDF

SEQ ID NO: 20832 - protein, 20 aa, synthetic construct
  source 1..20: note = Seed: SATGFKQSSKALQRPVASDF
SATGYKQLSQALLRPVASDF

SEQ ID NO: 20833 - protein, 20 aa, synthetic construct
  source 1..20: note = Seed: SATGFKQSSKALQRPVASDF
SATGYKQLSQALMRPVASDF

SEQ ID NO: 20834 - protein, 20 aa, synthetic construct
  source 1..20: note = Seed: SATGFKQSSKALQRPVASDF
SATGYKQLSQALNRPVASDF

SEQ ID NO: 20835 - protein, 20 aa, synthetic construct
  source 1..20: note = Seed: SATGFKQSSKALQRPVASDF
SATGYKQLSQALPRPVASDF

SEQ ID NO: 20836 - protein, 20 aa, synthetic construct
  source 1..20: note = Seed: SATGFKQSSKALQRPVASDF
SATGYKQLSQALSRPVASDF

SEQ ID NO: 20837 - protein, 20 aa, synthetic construct
  source 1..20: note = Seed: SATGFKQSSKALQRPVASDF
SATGYKQLSQALTRPVASDF

SEQ ID NO: 20838 - protein, 20 aa, synthetic construct
  source 1..20: note = Seed: SATGFKQSSKALQRPVASDF
SATGYKQLSQALVRPVASDF

SEQ ID NO: 20839 - protein, 20 aa, synthetic construct
  source 1..20: note = Seed: SATGFKQSSKALQRPVASDF
SATGYKQLSRALARPVASDF

SEQ ID NO: 20840 - protein, 20 aa, synthetic construct
  source 1..20: note = Seed: SATGFKQSSKALQRPVASDF
SATGYKQLSRALCRPVASDF

SEQ ID NO: 20841 - protein, 20 aa, synthetic construct
  source 1..20: note = Seed: SATGFKQSSKALQRPVASDF
SATGYKQLSRALDRPVASDF

SEQ ID NO: 20842 - protein, 20 aa, synthetic construct
  source 1..20: note = Seed: SATGFKQSSKALQRPVASDF
SATGYKQLSRALERPVASDF

SEQ ID NO: 20843 - protein, 20 aa, synthetic construct
  source 1..20: note = Seed: SATGFKQSSKALQRPVASDF
SATGYKQLSRALFRPVASDF

SEQ ID NO: 20844 - protein, 20 aa, synthetic construct
  source 1..20: note = Seed: SATGFKQSSKALQRPVASDF
SATGYKQLSRALGRPVASDF

SEQ ID NO: 20845 - protein, 20 aa, synthetic construct
  source 1..20: note = Seed: SATGFKQSSKALQRPVASDF
SATGYKQLSRALHRPVASDF

SEQ ID NO: 20846 - protein, 20 aa, synthetic construct
  source 1..20: note = Seed: SATGFKQSSKALQRPVASDF
SATGYKQLSRALIRPVASDF

SEQ ID NO: 20847 - protein, 20 aa, synthetic construct
  source 1..20: note = Seed: SATGFKQSSKALQRPVASDF
SATGYKQLSRALKRPVASDF

SEQ ID NO: 20848 - protein, 20 aa, synthetic construct
  source 1..20: note = Seed: SATGFKQSSKALQRPVASDF
SATGYKQLSRALLRPVASDF

SEQ ID NO: 20849 - protein, 20 aa, synthetic construct
  source 1..20: note = Seed: SATGFKQSSKALQRPVASDF
SATGYKQLSRALMRPVASDF

SEQ ID NO: 20850 - protein, 20 aa, synthetic construct
  source 1..20: note = Seed: SATGFKQSSKALQRPVASDF
SATGYKQLSRALNRPVASDF

SEQ ID NO: 20851 - protein, 20 aa, synthetic construct
  source 1..20: note = Seed: SATGFKQSSKALQRPVASDF
SATGYKQLSRALPRPVASDF

SEQ ID NO: 20852 - protein, 20 aa, synthetic construct
  source 1..20: note = Seed: SATGFKQSSKALQRPVASDF
SATGYKQLSRALQRPVASDF

SEQ ID NO: 20853 - protein, 20 aa, synthetic construct
  source 1..20: note = Seed: SATGFKQSSKALQRPVASDF
SATGYKQLSRALRRPVASDF

SEQ ID NO: 20854 - protein, 20 aa, synthetic construct
  source 1..20: note = Seed: SATGFKQSSKALQRPVASDF
SATGYKQLSRALSRPVASDF

SEQ ID NO: 20855 - protein, 20 aa, synthetic construct
  source 1..20: note = Seed: SATGFKQSSKALQRPVASDF
SATGYKQLSRALTRPVASDF

SEQ ID NO: 20856 - protein, 20 aa, synthetic construct
  source 1..20: note = Seed: SATGFKQSSKALQRPVASDF
SATGYKQLSRALVRPVASDF

SEQ ID NO: 20857 - protein, 20 aa, synthetic construct
  source 1..20: note = Seed: SATGFKQSSKALQRPVASDF
SATGYKQLSRALWRPVASDF

SEQ ID NO: 20858 - protein, 20 aa, synthetic construct
  source 1..20: note = Seed: SATGFKQSSKALQRPVASDF
SATGYKQLSRALYRPVASDF

SEQ ID NO: 20859 - protein, 20 aa, synthetic construct
  source 1..20: note = Seed: SATGFKQSSKALQRPVASDF
SATGYKQLSSALARPVASDF

SEQ ID NO: 20860 - protein, 20 aa, synthetic construct
  source 1..20: note = Seed: SATGFKQSSKALQRPVASDF
SATGYKQLSSALCRPVASDF

SEQ ID NO: 20861 - protein, 20 aa, synthetic construct
  source 1..20: note = Seed: SATGFKQSSKALQRPVASDF
SATGYKQLSSALDRPVASDF

SEQ ID NO: 20862 - protein, 20 aa, synthetic construct
  source 1..20: note = Seed: SATGFKQSSKALQRPVASDF
SATGYKQLSSALERPVASDF

SEQ ID NO: 20863 - protein, 20 aa, synthetic construct
  source 1..20: note = Seed: SATGFKQSSKALQRPVASDF
SATGYKQLSSALFRPVASDF

SEQ ID NO: 20864 - protein, 20 aa, synthetic construct
  source 1..20: note = Seed: SATGFKQSSKALQRPVASDF
SATGYKQLSSALGRPVASDF

SEQ ID NO: 20865 - protein, 20 aa, synthetic construct
  source 1..20: note = Seed: SATGFKQSSKALQRPVASDF
SATGYKQLSSALHRPVASDF

SEQ ID NO: 20866 - protein, 20 aa, synthetic construct
  source 1..20: note = Seed: SATGFKQSSKALQRPVASDF
SATGYKQLSSALIRPVASDF

SEQ ID NO: 20867 - protein, 20 aa, synthetic construct
  source 1..20: note = Seed: SATGFKQSSKALQRPVASDF
SATGYKQLSSALKRPVASDF

SEQ ID NO: 20868 - protein, 20 aa, synthetic construct
  source 1..20: note = Seed: SATGFKQSSKALQRPVASDF
SATGYKQLSSALLRPVASDF

SEQ ID NO: 20869 - protein, 20 aa, synthetic construct
  source 1..20: note = Seed: SATGFKQSSKALQRPVASDF
SATGYKQLSSALMRPVASDF

SEQ ID NO: 20870 - protein, 20 aa, synthetic construct
  source 1..20: note = Seed: SATGFKQSSKALQRPVASDF
SATGYKQLSSALNRPVASDF

SEQ ID NO: 20871 - protein, 20 aa, synthetic construct
  source 1..20: note = Seed: SATGFKQSSKALQRPVASDF
SATGYKQLSSALPRPVASDF

SEQ ID NO: 20872 - protein, 20 aa, synthetic construct
  source 1..20: note = Seed: SATGFKQSSKALQRPVASDF
SATGYKQLSSALQRPVASDF

SEQ ID NO: 20873 - protein, 20 aa, synthetic construct
  source 1..20: note = Seed: SATGFKQSSKALQRPVASDF
SATGYKQLSSALRRPVASDF

SEQ ID NO: 20874 - protein, 20 aa, synthetic construct
  source 1..20: note = Seed: SATGFKQSSKALQRPVASDF
SATGYKQLSSALSRPVASDF

SEQ ID NO: 20875 - protein, 20 aa, synthetic construct
  source 1..20: note = Seed: SATGFKQSSKALQRPVASDF
SATGYKQLSSALTRPVASDF

SEQ ID NO: 20876 - protein, 20 aa, synthetic construct
  source 1..20: note = Seed: SATGFKQSSKALQRPVASDF
SATGYKQLSSALVRPVASDF

SEQ ID NO: 20877 - protein, 20 aa, synthetic construct
  source 1..20: note = Seed: SATGFKQSSKALQRPVASDF
SATGYKQLSSALWRPVASDF

SEQ ID NO: 20878 - protein, 20 aa, synthetic construct
  source 1..20: note = Seed: SATGFKQSSKALQRPVASDF
SATGYKQLSSALYRPVASDF

SEQ ID NO: 20879 - protein, 20 aa, synthetic construct
  source 1..20: note = Seed: SATGFKQSSKALQRPVASDF
SATGYKQLSTALARPVASDF

SEQ ID NO: 20880 - protein, 20 aa, synthetic construct
  source 1..20: note = Seed: SATGFKQSSKALQRPVASDF
SATGYKQLSTALCRPVASDF

SEQ ID NO: 20881 - protein, 20 aa, synthetic construct
  source 1..20: note = Seed: SATGFKQSSKALQRPVASDF
SATGYKQLSTALDRPVASDF

SEQ ID NO: 20882 - protein, 20 aa, synthetic construct
  source 1..20: note = Seed: SATGFKQSSKALQRPVASDF
SATGYKQLSTALERPVASDF

SEQ ID NO: 20883 - protein, 20 aa, synthetic construct
  source 1..20: note = Seed: SATGFKQSSKALQRPVASDF
SATGYKQLSTALFRPVASDF

SEQ ID NO: 20884 - protein, 20 aa, synthetic construct
  source 1..20: note = Seed: SATGFKQSSKALQRPVASDF
SATGYKQLSTALGRPVASDF

SEQ ID NO: 20885 - protein, 20 aa, synthetic construct
  source 1..20: note = Seed: SATGFKQSSKALQRPVASDF
SATGYKQLSTALHRPVASDF

SEQ ID NO: 20886 - protein, 20 aa, synthetic construct
  source 1..20: note = Seed: SATGFKQSSKALQRPVASDF
SATGYKQLSTALIRPVASDF

SEQ ID NO: 20887 - protein, 20 aa, synthetic construct
  source 1..20: note = Seed: SATGFKQSSKALQRPVASDF
SATGYKQLSTALKRPVASDF

SEQ ID NO: 20888 - protein, 20 aa, synthetic construct
  source 1..20: note = Seed: SATGFKQSSKALQRPVASDF
SATGYKQLSTALLRPVASDF

SEQ ID NO: 20889 - protein, 20 aa, synthetic construct
  source 1..20: note = Seed: SATGFKQSSKALQRPVASDF
SATGYKQLSTALMRPVASDF

SEQ ID NO: 20890 - protein, 20 aa, synthetic construct
  source 1..20: note = Seed: SATGFKQSSKALQRPVASDF
SATGYKQLSTALNRPVASDF

SEQ ID NO: 20891 - protein, 20 aa, synthetic construct
  source 1..20: note = Seed: SATGFKQSSKALQRPVASDF
SATGYKQLSTALPRPVASDF

SEQ ID NO: 20892 - protein, 20 aa, synthetic construct
  source 1..20: note = Seed: SATGFKQSSKALQRPVASDF
SATGYKQLSTALQRPVASDF

SEQ ID NO: 20893 - protein, 20 aa, synthetic construct
  source 1..20: note = Seed: SATGFKQSSKALQRPVASDF
SATGYKQLSTALRRPVASDF

SEQ ID NO: 20894 - protein, 20 aa, synthetic construct
  source 1..20: note = Seed: SATGFKQSSKALQRPVASDF
SATGYKQLSTALSRPVASDF

SEQ ID NO: 20895 - protein, 20 aa, synthetic construct
  source 1..20: note = Seed: SATGFKQSSKALQRPVASDF
SATGYKQLSTALTRPVASDF

SEQ ID NO: 20896 - protein, 20 aa, synthetic construct
  source 1..20: note = Seed: SATGFKQSSKALQRPVASDF
SATGYKQLSTALVRPVASDF

SEQ ID NO: 20897 - protein, 20 aa, synthetic construct
  source 1..20: note = Seed: SATGFKQSSKALQRPVASDF
SATGYKQLSTALWRPVASDF

SEQ ID NO: 20898 - protein, 20 aa, synthetic construct
  source 1..20: note = Seed: SATGFKQSSKALQRPVASDF
SATGYKQLSTALYRPVASDF

SEQ ID NO: 20899 - protein, 20 aa, synthetic construct
  source 1..20: note = Seed: SATGFKQSSKALQRPVASDF
SATGYKQLSVALARPVASDF

SEQ ID NO: 20900 - protein, 20 aa, synthetic construct
  source 1..20: note = Seed: SATGFKQSSKALQRPVASDF
SATGYKQLSVALCRPVASDF

SEQ ID NO: 20901 - protein, 20 aa, synthetic construct
  source 1..20: note = Seed: SATGFKQSSKALQRPVASDF
SATGYKQLSVALDRPVASDF

SEQ ID NO: 20902 - protein, 20 aa, synthetic construct
  source 1..20: note = Seed: SATGFKQSSKALQRPVASDF
SATGYKQLSVALERPVASDF

SEQ ID NO: 20903 - protein, 20 aa, synthetic construct
  source 1..20: note = Seed: SATGFKQSSKALQRPVASDF
SATGYKQLSVALFRPVASDF

SEQ ID NO: 20904 - protein, 20 aa, synthetic construct
  source 1..20: note = Seed: SATGFKQSSKALQRPVASDF
SATGYKQLSVALGRPVASDF

SEQ ID NO: 20905 - protein, 20 aa, synthetic construct
  source 1..20: note = Seed: SATGFKQSSKALQRPVASDF
SATGYKQLSVALHRPVASDF

SEQ ID NO: 20906 - protein, 20 aa, synthetic construct
  source 1..20: note = Seed: SATGFKQSSKALQRPVASDF
SATGYKQLSVALIRPVASDF

SEQ ID NO: 20907 - protein, 20 aa, synthetic construct
  source 1..20: note = Seed: SATGFKQSSKALQRPVASDF
SATGYKQLSVALKRPVASDF

SEQ ID NO: 20908 - protein, 20 aa, synthetic construct
  source 1..20: note = Seed: SATGFKQSSKALQRPVASDF
SATGYKQLSVALLRPVASDF

SEQ ID NO: 20909 - protein, 20 aa, synthetic construct
  source 1..20: note = Seed: SATGFKQSSKALQRPVASDF
SATGYKQLSVALMRPVASDF

SEQ ID NO: 20910 - protein, 20 aa, synthetic construct
  source 1..20: note = Seed: SATGFKQSSKALQRPVASDF
SATGYKQLSVALNRPVASDF

SEQ ID NO: 20911 - protein, 20 aa, synthetic construct
  source 1..20: note = Seed: SATGFKQSSKALQRPVASDF
SATGYKQLSVALPRPVASDF

SEQ ID NO: 20912 - protein, 20 aa, synthetic construct
  source 1..20: note = Seed: SATGFKQSSKALQRPVASDF
SATGYKQLSVALQRPVASDF

SEQ ID NO: 20913 - protein, 20 aa, synthetic construct
  source 1..20: note = Seed: SATGFKQSSKALQRPVASDF
SATGYKQLSVALRRPVASDF

SEQ ID NO: 20914 - protein, 20 aa, synthetic construct
  source 1..20: note = Seed: SATGFKQSSKALQRPVASDF
SATGYKQLSVALSRPVASDF

SEQ ID NO: 20915 - protein, 20 aa, synthetic construct
  source 1..20: note = Seed: SATGFKQSSKALQRPVASDF
SATGYKQLSVALTRPVASDF

SEQ ID NO: 20916 - protein, 20 aa, synthetic construct
  source 1..20: note = Seed: SATGFKQSSKALQRPVASDF
SATGYKQLSVALVRPVASDF

SEQ ID NO: 20917 - protein, 20 aa, synthetic construct
  source 1..20: note = Seed: SATGFKQSSKALQRPVASDF
SATGYKQLSVALWRPVASDF

SEQ ID NO: 20918 - protein, 20 aa, synthetic construct
  source 1..20: note = Seed: SATGFKQSSKALQRPVASDF
SATGYKQLSVALYRPVASDF

SEQ ID NO: 20919 - protein, 20 aa, synthetic construct
  source 1..20: note = Seed: SATGFKQSSKALQRPVASDF
SATGYKQLSWALCRPVASDF

SEQ ID NO: 20920 - protein, 20 aa, synthetic construct
  source 1..20: note = Seed: SATGFKQSSKALQRPVASDF
SATGYKQLSWALVRPVASDF

SEQ ID NO: 20921 - protein, 20 aa, synthetic construct
  source 1..20: note = Seed: SATGFKQSSKALQRPVASDF
SATGYKQMSAALARPVASDF

SEQ ID NO: 20922 - protein, 20 aa, synthetic construct
  source 1..20: note = Seed: SATGFKQSSKALQRPVASDF
SATGYKQMSAALCRPVASDF

SEQ ID NO: 20923 - protein, 20 aa, synthetic construct
  source 1..20: note = Seed: SATGFKQSSKALQRPVASDF
SATGYKQMSAALDRPVASDF

SEQ ID NO: 20924 - protein, 20 aa, synthetic construct
  source 1..20: note = Seed: SATGFKQSSKALQRPVASDF
SATGYKQMSAALERPVASDF

SEQ ID NO: 20925 - protein, 20 aa, synthetic construct
  source 1..20: note = Seed: SATGFKQSSKALQRPVASDF
SATGYKQMSAALFRPVASDF

SEQ ID NO: 20926 - protein, 20 aa, synthetic construct
  source 1..20: note = Seed: SATGFKQSSKALQRPVASDF
SATGYKQMSAALGRPVASDF

SEQ ID NO: 20927 - protein, 20 aa, synthetic construct
  source 1..20: note = Seed: SATGFKQSSKALQRPVASDF
SATGYKQMSAALHRPVASDF

SEQ ID NO: 20928 - protein, 20 aa, synthetic construct
  source 1..20: note = Seed: SATGFKQSSKALQRPVASDF
SATGYKQMSAALIRPVASDF

SEQ ID NO: 20929 - protein, 20 aa, synthetic construct
  source 1..20: note = Seed: SATGFKQSSKALQRPVASDF
SATGYKQMSAALKRPVASDF

SEQ ID NO: 20930 - protein, 20 aa, synthetic construct
  source 1..20: note = Seed: SATGFKQSSKALQRPVASDF
SATGYKQMSAALLRPVASDF

SEQ ID NO: 20931 - protein, 20 aa, synthetic construct
  source 1..20: note = Seed: SATGFKQSSKALQRPVASDF
SATGYKQMSAALMRPVASDF

SEQ ID NO: 20932 - protein, 20 aa, synthetic construct
  source 1..20: note = Seed: SATGFKQSSKALQRPVASDF
SATGYKQMSAALNRPVASDF

SEQ ID NO: 20933 - protein, 20 aa, synthetic construct
  source 1..20: note = Seed: SATGFKQSSKALQRPVASDF
SATGYKQMSAALPRPVASDF

SEQ ID NO: 20934 - protein, 20 aa, synthetic construct
  source 1..20: note = Seed: SATGFKQSSKALQRPVASDF
SATGYKQMSAALQRPVASDF

SEQ ID NO: 20935 - protein, 20 aa, synthetic construct
  source 1..20: note = Seed: SATGFKQSSKALQRPVASDF
SATGYKQMSAALRRPVASDF

SEQ ID NO: 20936 - protein, 20 aa, synthetic construct
  source 1..20: note = Seed: SATGFKQSSKALQRPVASDF
SATGYKQMSAALSRPVASDF

SEQ ID NO: 20937 - protein, 20 aa, synthetic construct
  source 1..20: note = Seed: SATGFKQSSKALQRPVASDF
SATGYKQMSAALTRPVASDF

SEQ ID NO: 20938 - protein, 20 aa, synthetic construct
  source 1..20: note = Seed: SATGFKQSSKALQRPVASDF
SATGYKQMSAALVRPVASDF

SEQ ID NO: 20939 - protein, 20 aa, synthetic construct
  source 1..20: note = Seed: SATGFKQSSKALQRPVASDF
SATGYKQMSAALWRPVASDF

SEQ ID NO: 20940 - protein, 20 aa, synthetic construct
  source 1..20: note = Seed: SATGFKQSSKALQRPVASDF
SATGYKQMSAALYRPVASDF

SEQ ID NO: 20941 - protein, 20 aa, synthetic construct
  source 1..20: note = Seed: SATGFKQSSKALQRPVASDF
SATGYKQMSCALARPVASDF

SEQ ID NO: 20942 - protein, 20 aa, synthetic construct
  source 1..20: note = Seed: SATGFKQSSKALQRPVASDF
SATGYKQMSCALGRPVASDF

SEQ ID NO: 20943 - protein, 20 aa, synthetic construct
  source 1..20: note = Seed: SATGFKQSSKALQRPVASDF
SATGYKQMSCALHRPVASDF

SEQ ID NO: 20944 - protein, 20 aa, synthetic construct
  source 1..20: note = Seed: SATGFKQSSKALQRPVASDF
SATGYKQMSCALIRPVASDF

SEQ ID NO: 20945 - protein, 20 aa, synthetic construct
  source 1..20: note = Seed: SATGFKQSSKALQRPVASDF
SATGYKQMSCALLRPVASDF

SEQ ID NO: 20946 - protein, 20 aa, synthetic construct
  source 1..20: note = Seed: SATGFKQSSKALQRPVASDF
SATGYKQMSCALMRPVASDF

SEQ ID NO: 20947 - protein, 20 aa, synthetic construct
  source 1..20: note = Seed: SATGFKQSSKALQRPVASDF
SATGYKQMSCALNRPVASDF

SEQ ID NO: 20948 - protein, 20 aa, synthetic construct
  source 1..20: note = Seed: SATGFKQSSKALQRPVASDF
SATGYKQMSCALSRPVASDF

SEQ ID NO: 20949 - protein, 20 aa, synthetic construct
  source 1..20: note = Seed: SATGFKQSSKALQRPVASDF
SATGYKQMSCALTRPVASDF

SEQ ID NO: 20950 - protein, 20 aa, synthetic construct
  source 1..20: note = Seed: SATGFKQSSKALQRPVASDF
SATGYKQMSCALVRPVASDF

SEQ ID NO: 20951 - protein, 20 aa, synthetic construct
  source 1..20: note = Seed: SATGFKQSSKALQRPVASDF
SATGYKQMSDALARPVASDF

SEQ ID NO: 20952 - protein, 20 aa, synthetic construct
  source 1..20: note = Seed: SATGFKQSSKALQRPVASDF
SATGYKQMSDALIRPVASDF

SEQ ID NO: 20953 - protein, 20 aa, synthetic construct
  source 1..20: note = Seed: SATGFKQSSKALQRPVASDF
SATGYKQMSDALLRPVASDF

SEQ ID NO: 20954 - protein, 20 aa, synthetic construct
  source 1..20: note = Seed: SATGFKQSSKALQRPVASDF
SATGYKQMSDALMRPVASDF

SEQ ID NO: 20955 - protein, 20 aa, synthetic construct
  source 1..20: note = Seed: SATGFKQSSKALQRPVASDF
SATGYKQMSDALNRPVASDF

SEQ ID NO: 20956 - protein, 20 aa, synthetic construct
  source 1..20: note = Seed: SATGFKQSSKALQRPVASDF
SATGYKQMSDALSRPVASDF

SEQ ID NO: 20957 - protein, 20 aa, synthetic construct
  source 1..20: note = Seed: SATGFKQSSKALQRPVASDF
SATGYKQMSDALTRPVASDF

SEQ ID NO: 20958 - protein, 20 aa, synthetic construct
  source 1..20: note = Seed: SATGFKQSSKALQRPVASDF
SATGYKQMSDALVRPVASDF

SEQ ID NO: 20959 - protein, 20 aa, synthetic construct
  source 1..20: note = Seed: SATGFKQSSKALQRPVASDF
SATGYKQMSEALARPVASDF

SEQ ID NO: 20960 - protein, 20 aa, synthetic construct
  source 1..20: note = Seed: SATGFKQSSKALQRPVASDF
SATGYKQMSEALIRPVASDF

SEQ ID NO: 20961 - protein, 20 aa, synthetic construct
  source 1..20: note = Seed: SATGFKQSSKALQRPVASDF
SATGYKQMSEALLRPVASDF

SEQ ID NO: 20962 - protein, 20 aa, synthetic construct
  source 1..20: note = Seed: SATGFKQSSKALQRPVASDF
SATGYKQMSEALMRPVASDF

SEQ ID NO: 20963 - protein, 20 aa, synthetic construct
  source 1..20: note = Seed: SATGFKQSSKALQRPVASDF
SATGYKQMSEALNRPVASDF

SEQ ID NO: 20964 - protein, 20 aa, synthetic construct
  source 1..20: note = Seed: SATGFKQSSKALQRPVASDF
SATGYKQMSEALSRPVASDF

SEQ ID NO: 20965 - protein, 20 aa, synthetic construct
  source 1..20: note = Seed: SATGFKQSSKALQRPVASDF
SATGYKQMSEALTRPVASDF

SEQ ID NO: 20966 - protein, 20 aa, synthetic construct
  source 1..20: note = Seed: SATGFKQSSKALQRPVASDF
SATGYKQMSEALVRPVASDF

SEQ ID NO: 20967 - protein, 20 aa, synthetic construct
  source 1..20: note = Seed: SATGFKQSSKALQRPVASDF
SATGYKQMSFALARPVASDF

SEQ ID NO: 20968 - protein, 20 aa, synthetic construct
  source 1..20: note = Seed: SATGFKQSSKALQRPVASDF
SATGYKQMSFALERPVASDF

SEQ ID NO: 20969 - protein, 20 aa, synthetic construct
  source 1..20: note = Seed: SATGFKQSSKALQRPVASDF
SATGYKQMSFALIRPVASDF

SEQ ID NO: 20970 - protein, 20 aa, synthetic construct
  source 1..20: note = Seed: SATGFKQSSKALQRPVASDF
SATGYKQMSFALMRPVASDF

SEQ ID NO: 20971 - protein, 20 aa, synthetic construct
  source 1..20: note = Seed: SATGFKQSSKALQRPVASDF
SATGYKQMSFALRRPVASDF

SEQ ID NO: 20972 - protein, 20 aa, synthetic construct
  source 1..20: note = Seed: SATGFKQSSKALQRPVASDF
SATGYKQMSFALSRPVASDF

SEQ ID NO: 20973 - protein, 20 aa, synthetic construct
  source 1..20: note = Seed: SATGFKQSSKALQRPVASDF
SATGYKQMSFALTRPVASDF

SEQ ID NO: 20974 - protein, 20 aa, synthetic construct
  source 1..20: note = Seed: SATGFKQSSKALQRPVASDF
SATGYKQMSFALVRPVASDF

SEQ ID NO: 20975 - protein, 20 aa, synthetic construct
  source 1..20: note = Seed: SATGFKQSSKALQRPVASDF
SATGYKQMSGALARPVASDF

SEQ ID NO: 20976 - protein, 20 aa, synthetic construct
  source 1..20: note = Seed: SATGFKQSSKALQRPVASDF
SATGYKQMSGALCRPVASDF

SEQ ID NO: 20977 - protein, 20 aa, synthetic construct
  source 1..20: note = Seed: SATGFKQSSKALQRPVASDF
SATGYKQMSGALDRPVASDF

SEQ ID NO: 20978 - protein, 20 aa, synthetic construct
  source 1..20: note = Seed: SATGFKQSSKALQRPVASDF
SATGYKQMSGALERPVASDF

SEQ ID NO: 20979 - protein, 20 aa, synthetic construct
  source 1..20: note = Seed: SATGFKQSSKALQRPVASDF
SATGYKQMSGALFRPVASDF

SEQ ID NO: 20980 - protein, 20 aa, synthetic construct
  source 1..20: note = Seed: SATGFKQSSKALQRPVASDF
SATGYKQMSGALGRPVASDF

SEQ ID NO: 20981 - protein, 20 aa, synthetic construct
  source 1..20: note = Seed: SATGFKQSSKALQRPVASDF
SATGYKQMSGALHRPVASDF

SEQ ID NO: 20982 - protein, 20 aa, synthetic construct
  source 1..20: note = Seed: SATGFKQSSKALQRPVASDF
SATGYKQMSGALIRPVASDF

SEQ ID NO: 20983 - protein, 20 aa, synthetic construct
  source 1..20: note = Seed: SATGFKQSSKALQRPVASDF
SATGYKQMSGALKRPVASDF

SEQ ID NO: 20984 - protein, 20 aa, synthetic construct
  source 1..20: note = Seed: SATGFKQSSKALQRPVASDF
SATGYKQMSGALLRPVASDF

SEQ ID NO: 20985 - protein, 20 aa, synthetic construct
  source 1..20: note = Seed: SATGFKQSSKALQRPVASDF
SATGYKQMSGALMRPVASDF

SEQ ID NO: 20986 - protein, 20 aa, synthetic construct
  source 1..20: note = Seed: SATGFKQSSKALQRPVASDF
SATGYKQMSGALNRPVASDF

SEQ ID NO: 20987 - protein, 20 aa, synthetic construct
  source 1..20: note = Seed: SATGFKQSSKALQRPVASDF
SATGYKQMSGALPRPVASDF

SEQ ID NO: 20988 - protein, 20 aa, synthetic construct
  source 1..20: note = Seed: SATGFKQSSKALQRPVASDF
SATGYKQMSGALQRPVASDF

SEQ ID NO: 20989 - protein, 20 aa, synthetic construct
  source 1..20: note = Seed: SATGFKQSSKALQRPVASDF
SATGYKQMSGALRRPVASDF

SEQ ID NO: 20990 - protein, 20 aa, synthetic construct
  source 1..20: note = Seed: SATGFKQSSKALQRPVASDF
SATGYKQMSGALSRPVASDF

SEQ ID NO: 20991 - protein, 20 aa, synthetic construct
  source 1..20: note = Seed: SATGFKQSSKALQRPVASDF
SATGYKQMSGALTRPVASDF

SEQ ID NO: 20992 - protein, 20 aa, synthetic construct
  source 1..20: note = Seed: SATGFKQSSKALQRPVASDF
SATGYKQMSGALVRPVASDF

SEQ ID NO: 20993 - protein, 20 aa, synthetic construct
  source 1..20: note = Seed: SATGFKQSSKALQRPVASDF
SATGYKQMSGALWRPVASDF

SEQ ID NO: 20994 - protein, 20 aa, synthetic construct
  source 1..20: note = Seed: SATGFKQSSKALQRPVASDF
SATGYKQMSGALYRPVASDF

SEQ ID NO: 20995 - protein, 20 aa, synthetic construct
  source 1..20: note = Seed: SATGFKQSSKALQRPVASDF
SATGYKQMSHALARPVASDF

SEQ ID NO: 20996 - protein, 20 aa, synthetic construct
  source 1..20: note = Seed: SATGFKQSSKALQRPVASDF
SATGYKQMSHALFRPVASDF

SEQ ID NO: 20997 - protein, 20 aa, synthetic construct
  source 1..20: note = Seed: SATGFKQSSKALQRPVASDF
SATGYKQMSHALGRPVASDF

SEQ ID NO: 20998 - protein, 20 aa, synthetic construct
  source 1..20: note = Seed: SATGFKQSSKALQRPVASDF
SATGYKQMSHALHRPVASDF

SEQ ID NO: 20999 - protein, 20 aa, synthetic construct
  source 1..20: note = Seed: SATGFKQSSKALQRPVASDF
SATGYKQMSHALIRPVASDF

SEQ ID NO: 21000 - protein, 20 aa, synthetic construct
  source 1..20: note = Seed: SATGFKQSSKALQRPVASDF
SATGYKQMSHALKRPVASDF

SEQ ID NO: 21001 - protein, 20 aa, synthetic construct
  source 1..20: note = Seed: SATGFKQSSKALQRPVASDF
SATGYKQMSHALLRPVASDF

SEQ ID NO: 21002 - protein, 20 aa, synthetic construct
  source 1..20: note = Seed: SATGFKQSSKALQRPVASDF
SATGYKQMSHALMRPVASDF

SEQ ID NO: 21003 - protein, 20 aa, synthetic construct
  source 1..20: note = Seed: SATGFKQSSKALQRPVASDF
SATGYKQMSHALNRPVASDF

SEQ ID NO: 21004 - protein, 20 aa, synthetic construct
  source 1..20: note = Seed: SATGFKQSSKALQRPVASDF
SATGYKQMSHALPRPVASDF

SEQ ID NO: 21005 - protein, 20 aa, synthetic construct
  source 1..20: note = Seed: SATGFKQSSKALQRPVASDF
SATGYKQMSHALRRPVASDF

SEQ ID NO: 21006 - protein, 20 aa, synthetic construct
  source 1..20: note = Seed: SATGFKQSSKALQRPVASDF
SATGYKQMSHALSRPVASDF

SEQ ID NO: 21007 - protein, 20 aa, synthetic construct
  source 1..20: note = Seed: SATGFKQSSKALQRPVASDF
SATGYKQMSHALTRPVASDF

SEQ ID NO: 21008 - protein, 20 aa, synthetic construct
  source 1..20: note = Seed: SATGFKQSSKALQRPVASDF
SATGYKQMSHALVRPVASDF

SEQ ID NO: 21009 - protein, 20 aa, synthetic construct
  source 1..20: note = Seed: SATGFKQSSKALQRPVASDF
SATGYKQMSIALARPVASDF

SEQ ID NO: 21010 - protein, 20 aa, synthetic construct
  source 1..20: note = Seed: SATGFKQSSKALQRPVASDF
SATGYKQMSIALCRPVASDF

SEQ ID NO: 21011 - protein, 20 aa, synthetic construct
  source 1..20: note = Seed: SATGFKQSSKALQRPVASDF
SATGYKQMSIALDRPVASDF

SEQ ID NO: 21012 - protein, 20 aa, synthetic construct
  source 1..20: note = Seed: SATGFKQSSKALQRPVASDF
SATGYKQMSIALERPVASDF

SEQ ID NO: 21013 - protein, 20 aa, synthetic construct
  source 1..20: note = Seed: SATGFKQSSKALQRPVASDF
SATGYKQMSIALFRPVASDF

SEQ ID NO: 21014 - protein, 20 aa, synthetic construct
  source 1..20: note = Seed: SATGFKQSSKALQRPVASDF
SATGYKQMSIALGRPVASDF

SEQ ID NO: 21015 - protein, 20 aa, synthetic construct
  source 1..20: note = Seed: SATGFKQSSKALQRPVASDF
SATGYKQMSIALHRPVASDF

SEQ ID NO: 21016 - protein, 20 aa, synthetic construct
  source 1..20: note = Seed: SATGFKQSSKALQRPVASDF
SATGYKQMSIALIRPVASDF

SEQ ID NO: 21017 - protein, 20 aa, synthetic construct
  source 1..20: note = Seed: SATGFKQSSKALQRPVASDF
SATGYKQMSIALKRPVASDF

SEQ ID NO: 21018 - protein, 20 aa, synthetic construct
  source 1..20: note = Seed: SATGFKQSSKALQRPVASDF
SATGYKQMSIALLRPVASDF

SEQ ID NO: 21019 - protein, 20 aa, synthetic construct
  source 1..20: note = Seed: SATGFKQSSKALQRPVASDF
SATGYKQMSIALMRPVASDF

SEQ ID NO: 21020 - protein, 20 aa, synthetic construct
  source 1..20: note = Seed: SATGFKQSSKALQRPVASDF
SATGYKQMSIALNRPVASDF

SEQ ID NO: 21021 - protein, 20 aa, synthetic construct
  source 1..20: note = Seed: SATGFKQSSKALQRPVASDF
SATGYKQMSIALPRPVASDF

SEQ ID NO: 21022 - protein, 20 aa, synthetic construct
  source 1..20: note = Seed: SATGFKQSSKALQRPVASDF
SATGYKQMSIALQRPVASDF

SEQ ID NO: 21023 - protein, 20 aa, synthetic construct
  source 1..20: note = Seed: SATGFKQSSKALQRPVASDF
SATGYKQMSIALRRPVASDF

SEQ ID NO: 21024 - protein, 20 aa, synthetic construct
  source 1..20: note = Seed: SATGFKQSSKALQRPVASDF
SATGYKQMSIALSRPVASDF

SEQ ID NO: 21025 - protein, 20 aa, synthetic construct
  source 1..20: note = Seed: SATGFKQSSKALQRPVASDF
SATGYKQMSIALTRPVASDF

SEQ ID NO: 21026 - protein, 20 aa, synthetic construct
  source 1..20: note = Seed: SATGFKQSSKALQRPVASDF
SATGYKQMSIALVRPVASDF

SEQ ID NO: 21027 - protein, 20 aa, synthetic construct
  source 1..20: note = Seed: SATGFKQSSKALQRPVASDF
SATGYKQMSIALWRPVASDF

SEQ ID NO: 21028 - protein, 20 aa, synthetic construct
  source 1..20: note = Seed: SATGFKQSSKALQRPVASDF
SATGYKQMSIALYRPVASDF

SEQ ID NO: 21029 - protein, 20 aa, synthetic construct
  source 1..20: note = Seed: SATGFKQSSKALQRPVASDF
SATGYKQMSKALARPVASDF

SEQ ID NO: 21030 - protein, 20 aa, synthetic construct
  source 1..20: note = Seed: SATGFKQSSKALQRPVASDF
SATGYKQMSKALCRPVASDF

SEQ ID NO: 21031 - protein, 20 aa, synthetic construct
  source 1..20: note = Seed: SATGFKQSSKALQRPVASDF
SATGYKQMSKALERPVASDF

SEQ ID NO: 21032 - protein, 20 aa, synthetic construct
  source 1..20: note = Seed: SATGFKQSSKALQRPVASDF
SATGYKQMSKALFRPVASDF

SEQ ID NO: 21033 - protein, 20 aa, synthetic construct
  source 1..20: note = Seed: SATGFKQSSKALQRPVASDF
SATGYKQMSKALGRPVASDF

SEQ ID NO: 21034 - protein, 20 aa, synthetic construct
  source 1..20: note = Seed: SATGFKQSSKALQRPVASDF
SATGYKQMSKALHRPVASDF

SEQ ID NO: 21035 - protein, 20 aa, synthetic construct
  source 1..20: note = Seed: SATGFKQSSKALQRPVASDF
SATGYKQMSKALIRPVASDF

SEQ ID NO: 21036 - protein, 20 aa, synthetic construct
  source 1..20: note = Seed: SATGFKQSSKALQRPVASDF
SATGYKQMSKALKRPVASDF

SEQ ID NO: 21037 - protein, 20 aa, synthetic construct
  source 1..20: note = Seed: SATGFKQSSKALQRPVASDF
SATGYKQMSKALLRPVASDF

SEQ ID NO: 21038 - protein, 20 aa, synthetic construct
  source 1..20: note = Seed: SATGFKQSSKALQRPVASDF
SATGYKQMSKALMRPVASDF

SEQ ID NO: 21039 - protein, 20 aa, synthetic construct
  source 1..20: note = Seed: SATGFKQSSKALQRPVASDF
SATGYKQMSKALNRPVASDF

SEQ ID NO: 21040 - protein, 20 aa, synthetic construct
  source 1..20: note = Seed: SATGFKQSSKALQRPVASDF
SATGYKQMSKALPRPVASDF

SEQ ID NO: 21041 - protein, 20 aa, synthetic construct
  source 1..20: note = Seed: SATGFKQSSKALQRPVASDF
SATGYKQMSKALQRPVASDF

SEQ ID NO: 21042 - protein, 20 aa, synthetic construct
  source 1..20: note = Seed: SATGFKQSSKALQRPVASDF
SATGYKQMSKALRRPVASDF

SEQ ID NO: 21043 - protein, 20 aa, synthetic construct
  source 1..20: note = Seed: SATGFKQSSKALQRPVASDF
SATGYKQMSKALSRPVASDF

SEQ ID NO: 21044 - protein, 20 aa, synthetic construct
  source 1..20: note = Seed: SATGFKQSSKALQRPVASDF
SATGYKQMSKALTRPVASDF

SEQ ID NO: 21045 - protein, 20 aa, synthetic construct
  source 1..20: note = Seed: SATGFKQSSKALQRPVASDF
SATGYKQMSKALVRPVASDF

SEQ ID NO: 21046 - protein, 20 aa, synthetic construct
  source 1..20: note = Seed: SATGFKQSSKALQRPVASDF
SATGYKQMSKALWRPVASDF

SEQ ID NO: 21047 - protein, 20 aa, synthetic construct
  source 1..20: note = Seed: SATGFKQSSKALQRPVASDF
SATGYKQMSKALYRPVASDF

SEQ ID NO: 21048 - protein, 20 aa, synthetic construct
  source 1..20: note = Seed: SATGFKQSSKALQRPVASDF
SATGYKQMSLALARPVASDF

SEQ ID NO: 21049 - protein, 20 aa, synthetic construct
  source 1..20: note = Seed: SATGFKQSSKALQRPVASDF
SATGYKQMSLALCRPVASDF

SEQ ID NO: 21050 - protein, 20 aa, synthetic construct
  source 1..20: note = Seed: SATGFKQSSKALQRPVASDF
SATGYKQMSLALDRPVASDF

SEQ ID NO: 21051 - protein, 20 aa, synthetic construct
  source 1..20: note = Seed: SATGFKQSSKALQRPVASDF
SATGYKQMSLALERPVASDF

SEQ ID NO: 21052 - protein, 20 aa, synthetic construct
  source 1..20: note = Seed: SATGFKQSSKALQRPVASDF
SATGYKQMSLALFRPVASDF

SEQ ID NO: 21053 - protein, 20 aa, synthetic construct
  source 1..20: note = Seed: SATGFKQSSKALQRPVASDF
SATGYKQMSLALGRPVASDF

SEQ ID NO: 21054 - protein, 20 aa, synthetic construct
  source 1..20: note = Seed: SATGFKQSSKALQRPVASDF
SATGYKQMSLALHRPVASDF

SEQ ID NO: 21055 - protein, 20 aa, synthetic construct
  source 1..20: note = Seed: SATGFKQSSKALQRPVASDF
SATGYKQMSLALIRPVASDF

SEQ ID NO: 21056 - protein, 20 aa, synthetic construct
  source 1..20: note = Seed: SATGFKQSSKALQRPVASDF
SATGYKQMSLALKRPVASDF

SEQ ID NO: 21057 - protein, 20 aa, synthetic construct
  source 1..20: note = Seed: SATGFKQSSKALQRPVASDF
SATGYKQMSLALLRPVASDF

SEQ ID NO: 21058 - protein, 20 aa, synthetic construct
  source 1..20: note = Seed: SATGFKQSSKALQRPVASDF
SATGYKQMSLALMRPVASDF

SEQ ID NO: 21059 - protein, 20 aa, synthetic construct
  source 1..20: note = Seed: SATGFKQSSKALQRPVASDF
SATGYKQMSLALNRPVASDF

SEQ ID NO: 21060 - protein, 20 aa, synthetic construct
  source 1..20: note = Seed: SATGFKQSSKALQRPVASDF
SATGYKQMSLALPRPVASDF

SEQ ID NO: 21061 - protein, 20 aa, synthetic construct
  source 1..20: note = Seed: SATGFKQSSKALQRPVASDF
SATGYKQMSLALQRPVASDF

SEQ ID NO: 21062 - protein, 20 aa, synthetic construct
  source 1..20: note = Seed: SATGFKQSSKALQRPVASDF
SATGYKQMSLALRRPVASDF

SEQ ID NO: 21063 - protein, 20 aa, synthetic construct
  source 1..20: note = Seed: SATGFKQSSKALQRPVASDF
SATGYKQMSLALSRPVASDF

SEQ ID NO: 21064 - protein, 20 aa, synthetic construct
  source 1..20: note = Seed: SATGFKQSSKALQRPVASDF
SATGYKQMSLALTRPVASDF

SEQ ID NO: 21065 - protein, 20 aa, synthetic construct
  source 1..20: note = Seed: SATGFKQSSKALQRPVASDF
SATGYKQMSLALVRPVASDF

SEQ ID NO: 21066 - protein, 20 aa, synthetic construct
  source 1..20: note = Seed: SATGFKQSSKALQRPVASDF
SATGYKQMSLALYRPVASDF

SEQ ID NO: 21067 - protein, 20 aa, synthetic construct
  source 1..20: note = Seed: SATGFKQSSKALQRPVASDF
SATGYKQMSMALARPVASDF

SEQ ID NO: 21068 - protein, 20 aa, synthetic construct
  source 1..20: note = Seed: SATGFKQSSKALQRPVASDF
SATGYKQMSMALCRPVASDF

SEQ ID NO: 21069 - protein, 20 aa, synthetic construct
  source 1..20: note = Seed: SATGFKQSSKALQRPVASDF
SATGYKQMSMALDRPVASDF

SEQ ID NO: 21070 - protein, 20 aa, synthetic construct
  source 1..20: note = Seed: SATGFKQSSKALQRPVASDF
SATGYKQMSMALERPVASDF

SEQ ID NO: 21071 - protein, 20 aa, synthetic construct
  source 1..20: note = Seed: SATGFKQSSKALQRPVASDF
SATGYKQMSMALFRPVASDF

SEQ ID NO: 21072 - protein, 20 aa, synthetic construct
  source 1..20: note = Seed: SATGFKQSSKALQRPVASDF
SATGYKQMSMALGRPVASDF

SEQ ID NO: 21073 - protein, 20 aa, synthetic construct
  source 1..20: note = Seed: SATGFKQSSKALQRPVASDF
SATGYKQMSMALHRPVASDF

SEQ ID NO: 21074 - protein, 20 aa, synthetic construct
  source 1..20: note = Seed: SATGFKQSSKALQRPVASDF
SATGYKQMSMALIRPVASDF

SEQ ID NO: 21075 - protein, 20 aa, synthetic construct
  source 1..20: note = Seed: SATGFKQSSKALQRPVASDF
SATGYKQMSMALKRPVASDF

SEQ ID NO: 21076 - protein, 20 aa, synthetic construct
  source 1..20: note = Seed: SATGFKQSSKALQRPVASDF
SATGYKQMSMALLRPVASDF

SEQ ID NO: 21077 - protein, 20 aa, synthetic construct
  source 1..20: note = Seed: SATGFKQSSKALQRPVASDF
SATGYKQMSMALMRPVASDF

SEQ ID NO: 21078 - protein, 20 aa, synthetic construct
  source 1..20: note = Seed: SATGFKQSSKALQRPVASDF
SATGYKQMSMALNRPVASDF

SEQ ID NO: 21079 - protein, 20 aa, synthetic construct
  source 1..20: note = Seed: SATGFKQSSKALQRPVASDF
SATGYKQMSMALQRPVASDF

SEQ ID NO: 21080 - protein, 20 aa, synthetic construct
  source 1..20: note = Seed: SATGFKQSSKALQRPVASDF
SATGYKQMSMALRRPVASDF

SEQ ID NO: 21081 - protein, 20 aa, synthetic construct
  source 1..20: note = Seed: SATGFKQSSKALQRPVASDF
SATGYKQMSMALSRPVASDF

SEQ ID NO: 21082 - protein, 20 aa, synthetic construct
  source 1..20: note = Seed: SATGFKQSSKALQRPVASDF
SATGYKQMSMALTRPVASDF

SEQ ID NO: 21083 - protein, 20 aa, synthetic construct
  source 1..20: note = Seed: SATGFKQSSKALQRPVASDF
SATGYKQMSMALVRPVASDF

SEQ ID NO: 21084 - protein, 20 aa, synthetic construct
  source 1..20: note = Seed: SATGFKQSSKALQRPVASDF
SATGYKQMSMALYRPVASDF

SEQ ID NO: 21085 - protein, 20 aa, synthetic construct
  source 1..20: note = Seed: SATGFKQSSKALQRPVASDF
SATGYKQMSNALARPVASDF

SEQ ID NO: 21086 - protein, 20 aa, synthetic construct
  source 1..20: note = Seed: SATGFKQSSKALQRPVASDF
SATGYKQMSNALCRPVASDF

SEQ ID NO: 21087 - protein, 20 aa, synthetic construct
  source 1..20: note = Seed: SATGFKQSSKALQRPVASDF
SATGYKQMSNALDRPVASDF

SEQ ID NO: 21088 - protein, 20 aa, synthetic construct
  source 1..20: note = Seed: SATGFKQSSKALQRPVASDF
SATGYKQMSNALERPVASDF

SEQ ID NO: 21089 - protein, 20 aa, synthetic construct
  source 1..20: note = Seed: SATGFKQSSKALQRPVASDF
SATGYKQMSNALFRPVASDF

SEQ ID NO: 21090 - protein, 20 aa, synthetic construct
  source 1..20: note = Seed: SATGFKQSSKALQRPVASDF
SATGYKQMSNALGRPVASDF

SEQ ID NO: 21091 - protein, 20 aa, synthetic construct
  source 1..20: note = Seed: SATGFKQSSKALQRPVASDF
SATGYKQMSNALHRPVASDF

SEQ ID NO: 21092 - protein, 20 aa, synthetic construct
  source 1..20: note = Seed: SATGFKQSSKALQRPVASDF
SATGYKQMSNALIRPVASDF

SEQ ID NO: 21093 - protein, 20 aa, synthetic construct
  source 1..20: note = Seed: SATGFKQSSKALQRPVASDF
SATGYKQMSNALLRPVASDF

SEQ ID NO: 21094 - protein, 20 aa, synthetic construct
  source 1..20: note = Seed: SATGFKQSSKALQRPVASDF
SATGYKQMSNALMRPVASDF

SEQ ID NO: 21095 - protein, 20 aa, synthetic construct
  source 1..20: note = Seed: SATGFKQSSKALQRPVASDF
SATGYKQMSNALNRPVASDF

SEQ ID NO: 21096 - protein, 20 aa, synthetic construct
  source 1..20: note = Seed: SATGFKQSSKALQRPVASDF
SATGYKQMSNALPRPVASDF

SEQ ID NO: 21097 - protein, 20 aa, synthetic construct
  source 1..20: note = Seed: SATGFKQSSKALQRPVASDF
SATGYKQMSNALQRPVASDF

SEQ ID NO: 21098 - protein, 20 aa, synthetic construct
  source 1..20: note = Seed: SATGFKQSSKALQRPVASDF
SATGYKQMSNALRRPVASDF

SEQ ID NO: 21099 - protein, 20 aa, synthetic construct
  source 1..20: note = Seed: SATGFKQSSKALQRPVASDF
SATGYKQMSNALSRPVASDF

SEQ ID NO: 21100 - protein, 20 aa, synthetic construct
  source 1..20: note = Seed: SATGFKQSSKALQRPVASDF
SATGYKQMSNALTRPVASDF

SEQ ID NO: 21101 - protein, 20 aa, synthetic construct
  source 1..20: note = Seed: SATGFKQSSKALQRPVASDF
SATGYKQMSNALVRPVASDF

SEQ ID NO: 21102 - protein, 20 aa, synthetic construct
  source 1..20: note = Seed: SATGFKQSSKALQRPVASDF
SATGYKQMSNALWRPVASDF

SEQ ID NO: 21103 - protein, 20 aa, synthetic construct
  source 1..20: note = Seed: SATGFKQSSKALQRPVASDF
SATGYKQMSNALYRPVASDF

SEQ ID NO: 21104 - protein, 20 aa, synthetic construct
  source 1..20: note = Seed: SATGFKQSSKALQRPVASDF
SATGYKQMSPALARPVASDF

SEQ ID NO: 21105 - protein, 20 aa, synthetic construct
  source 1..20: note = Seed: SATGFKQSSKALQRPVASDF
SATGYKQMSPALCRPVASDF

SEQ ID NO: 21106 - protein, 20 aa, synthetic construct
  source 1..20: note = Seed: SATGFKQSSKALQRPVASDF
SATGYKQMSPALDRPVASDF

SEQ ID NO: 21107 - protein, 20 aa, synthetic construct
  source 1..20: note = Seed: SATGFKQSSKALQRPVASDF
SATGYKQMSPALERPVASDF

SEQ ID NO: 21108 - protein, 20 aa, synthetic construct
  source 1..20: note = Seed: SATGFKQSSKALQRPVASDF
SATGYKQMSPALFRPVASDF

SEQ ID NO: 21109 - protein, 20 aa, synthetic construct
  source 1..20: note = Seed: SATGFKQSSKALQRPVASDF
SATGYKQMSPALGRPVASDF

SEQ ID NO: 21110 - protein, 20 aa, synthetic construct
  source 1..20: note = Seed: SATGFKQSSKALQRPVASDF
SATGYKQMSPALHRPVASDF

SEQ ID NO: 21111 - protein, 20 aa, synthetic construct
  source 1..20: note = Seed: SATGFKQSSKALQRPVASDF
SATGYKQMSPALIRPVASDF

SEQ ID NO: 21112 - protein, 20 aa, synthetic construct
  source 1..20: note = Seed: SATGFKQSSKALQRPVASDF
SATGYKQMSPALKRPVASDF

SEQ ID NO: 21113 - protein, 20 aa, synthetic construct
  source 1..20: note = Seed: SATGFKQSSKALQRPVASDF
SATGYKQMSPALLRPVASDF

SEQ ID NO: 21114 - protein, 20 aa, synthetic construct
  source 1..20: note = Seed: SATGFKQSSKALQRPVASDF
SATGYKQMSPALMRPVASDF

SEQ ID NO: 21115 - protein, 20 aa, synthetic construct
  source 1..20: note = Seed: SATGFKQSSKALQRPVASDF
SATGYKQMSPALNRPVASDF

SEQ ID NO: 21116 - protein, 20 aa, synthetic construct
  source 1..20: note = Seed: SATGFKQSSKALQRPVASDF
SATGYKQMSPALPRPVASDF

SEQ ID NO: 21117 - protein, 20 aa, synthetic construct
  source 1..20: note = Seed: SATGFKQSSKALQRPVASDF
SATGYKQMSPALQRPVASDF

SEQ ID NO: 21118 - protein, 20 aa, synthetic construct
  source 1..20: note = Seed: SATGFKQSSKALQRPVASDF
SATGYKQMSPALRRPVASDF

SEQ ID NO: 21119 - protein, 20 aa, synthetic construct
  source 1..20: note = Seed: SATGFKQSSKALQRPVASDF
SATGYKQMSPALSRPVASDF

SEQ ID NO: 21120 - protein, 20 aa, synthetic construct
  source 1..20: note = Seed: SATGFKQSSKALQRPVASDF
SATGYKQMSPALTRPVASDF

SEQ ID NO: 21121 - protein, 20 aa, synthetic construct
  source 1..20: note = Seed: SATGFKQSSKALQRPVASDF
SATGYKQMSPALVRPVASDF

SEQ ID NO: 21122 - protein, 20 aa, synthetic construct
  source 1..20: note = Seed: SATGFKQSSKALQRPVASDF
SATGYKQMSPALWRPVASDF

SEQ ID NO: 21123 - protein, 20 aa, synthetic construct
  source 1..20: note = Seed: SATGFKQSSKALQRPVASDF
SATGYKQMSPALYRPVASDF

SEQ ID NO: 21124 - protein, 20 aa, synthetic construct
  source 1..20: note = Seed: SATGFKQSSKALQRPVASDF
SATGYKQMSQALARPVASDF

SEQ ID NO: 21125 - protein, 20 aa, synthetic construct
  source 1..20: note = Seed: SATGFKQSSKALQRPVASDF
SATGYKQMSQALGRPVASDF

SEQ ID NO: 21126 - protein, 20 aa, synthetic construct
  source 1..20: note = Seed: SATGFKQSSKALQRPVASDF
SATGYKQMSQALIRPVASDF

SEQ ID NO: 21127 - protein, 20 aa, synthetic construct
  source 1..20: note = Seed: SATGFKQSSKALQRPVASDF
SATGYKQMSQALLRPVASDF

SEQ ID NO: 21128 - protein, 20 aa, synthetic construct
  source 1..20: note = Seed: SATGFKQSSKALQRPVASDF
SATGYKQMSQALMRPVASDF

SEQ ID NO: 21129 - protein, 20 aa, synthetic construct
  source 1..20: note = Seed: SATGFKQSSKALQRPVASDF
SATGYKQMSQALNRPVASDF

SEQ ID NO: 21130 - protein, 20 aa, synthetic construct
  source 1..20: note = Seed: SATGFKQSSKALQRPVASDF
SATGYKQMSQALPRPVASDF

SEQ ID NO: 21131 - protein, 20 aa, synthetic construct
  source 1..20: note = Seed: SATGFKQSSKALQRPVASDF
SATGYKQMSQALSRPVASDF

SEQ ID NO: 21132 - protein, 20 aa, synthetic construct
  source 1..20: note = Seed: SATGFKQSSKALQRPVASDF
SATGYKQMSQALTRPVASDF

SEQ ID NO: 21133 - protein, 20 aa, synthetic construct
  source 1..20: note = Seed: SATGFKQSSKALQRPVASDF
SATGYKQMSQALVRPVASDF

SEQ ID NO: 21134 - protein, 20 aa, synthetic construct
  source 1..20: note = Seed: SATGFKQSSKALQRPVASDF
SATGYKQMSRALARPVASDF

SEQ ID NO: 21135 - protein, 20 aa, synthetic construct
  source 1..20: note = Seed: SATGFKQSSKALQRPVASDF
SATGYKQMSRALCRPVASDF

SEQ ID NO: 21136 - protein, 20 aa, synthetic construct
  source 1..20: note = Seed: SATGFKQSSKALQRPVASDF
SATGYKQMSRALDRPVASDF

SEQ ID NO: 21137 - protein, 20 aa, synthetic construct
  source 1..20: note = Seed: SATGFKQSSKALQRPVASDF
SATGYKQMSRALERPVASDF

SEQ ID NO: 21138 - protein, 20 aa, synthetic construct
  source 1..20: note = Seed: SATGFKQSSKALQRPVASDF
SATGYKQMSRALFRPVASDF

SEQ ID NO: 21139 - protein, 20 aa, synthetic construct
  source 1..20: note = Seed: SATGFKQSSKALQRPVASDF
SATGYKQMSRALGRPVASDF

SEQ ID NO: 21140 - protein, 20 aa, synthetic construct
  source 1..20: note = Seed: SATGFKQSSKALQRPVASDF
SATGYKQMSRALHRPVASDF

SEQ ID NO: 21141 - protein, 20 aa, synthetic construct
  source 1..20: note = Seed: SATGFKQSSKALQRPVASDF
SATGYKQMSRALIRPVASDF

SEQ ID NO: 21142 - protein, 20 aa, synthetic construct
  source 1..20: note = Seed: SATGFKQSSKALQRPVASDF
SATGYKQMSRALKRPVASDF

SEQ ID NO: 21143 - protein, 20 aa, synthetic construct
  source 1..20: note = Seed: SATGFKQSSKALQRPVASDF
SATGYKQMSRALLRPVASDF

SEQ ID NO: 21144 - protein, 20 aa, synthetic construct
  source 1..20: note = Seed: SATGFKQSSKALQRPVASDF
SATGYKQMSRALMRPVASDF

SEQ ID NO: 21145 - protein, 20 aa, synthetic construct
  source 1..20: note = Seed: SATGFKQSSKALQRPVASDF
SATGYKQMSRALNRPVASDF

SEQ ID NO: 21146 - protein, 20 aa, synthetic construct
  source 1..20: note = Seed: SATGFKQSSKALQRPVASDF
SATGYKQMSRALPRPVASDF

SEQ ID NO: 21147 - protein, 20 aa, synthetic construct
  source 1..20: note = Seed: SATGFKQSSKALQRPVASDF
SATGYKQMSRALQRPVASDF

SEQ ID NO: 21148 - protein, 20 aa, synthetic construct
  source 1..20: note = Seed: SATGFKQSSKALQRPVASDF
SATGYKQMSRALRRPVASDF

SEQ ID NO: 21149 - protein, 20 aa, synthetic construct
  source 1..20: note = Seed: SATGFKQSSKALQRPVASDF
SATGYKQMSRALSRPVASDF

SEQ ID NO: 21150 - protein, 20 aa, synthetic construct
  source 1..20: note = Seed: SATGFKQSSKALQRPVASDF
SATGYKQMSRALTRPVASDF

SEQ ID NO: 21151 - protein, 20 aa, synthetic construct
  source 1..20: note = Seed: SATGFKQSSKALQRPVASDF
SATGYKQMSRALVRPVASDF

SEQ ID NO: 21152 - protein, 20 aa, synthetic construct
  source 1..20: note = Seed: SATGFKQSSKALQRPVASDF
SATGYKQMSRALWRPVASDF

SEQ ID NO: 21153 - protein, 20 aa, synthetic construct
  source 1..20: note = Seed: SATGFKQSSKALQRPVASDF
SATGYKQMSRALYRPVASDF

SEQ ID NO: 21154 - protein, 20 aa, synthetic construct
  source 1..20: note = Seed: SATGFKQSSKALQRPVASDF
SATGYKQMSSALARPVASDF

SEQ ID NO: 21155 - protein, 20 aa, synthetic construct
  source 1..20: note = Seed: SATGFKQSSKALQRPVASDF
SATGYKQMSSALCRPVASDF

SEQ ID NO: 21156 - protein, 20 aa, synthetic construct
  source 1..20: note = Seed: SATGFKQSSKALQRPVASDF
SATGYKQMSSALDRPVASDF

SEQ ID NO: 21157 - protein, 20 aa, synthetic construct
  source 1..20: note = Seed: SATGFKQSSKALQRPVASDF
SATGYKQMSSALERPVASDF

SEQ ID NO: 21158 - protein, 20 aa, synthetic construct
  source 1..20: note = Seed: SATGFKQSSKALQRPVASDF
SATGYKQMSSALFRPVASDF

SEQ ID NO: 21159 - protein, 20 aa, synthetic construct
  source 1..20: note = Seed: SATGFKQSSKALQRPVASDF
SATGYKQMSSALGRPVASDF

SEQ ID NO: 21160 - protein, 20 aa, synthetic construct
  source 1..20: note = Seed: SATGFKQSSKALQRPVASDF
SATGYKQMSSALHRPVASDF

SEQ ID NO: 21161 - protein, 20 aa, synthetic construct
  source 1..20: note = Seed: SATGFKQSSKALQRPVASDF
SATGYKQMSSALIRPVASDF

SEQ ID NO: 21162 - protein, 20 aa, synthetic construct
  source 1..20: note = Seed: SATGFKQSSKALQRPVASDF
SATGYKQMSSALKRPVASDF

SEQ ID NO: 21163 - protein, 20 aa, synthetic construct
  source 1..20: note = Seed: SATGFKQSSKALQRPVASDF
SATGYKQMSSALLRPVASDF

SEQ ID NO: 21164 - protein, 20 aa, synthetic construct
  source 1..20: note = Seed: SATGFKQSSKALQRPVASDF
SATGYKQMSSALMRPVASDF

SEQ ID NO: 21165 - protein, 20 aa, synthetic construct
  source 1..20: note = Seed: SATGFKQSSKALQRPVASDF
SATGYKQMSSALNRPVASDF

SEQ ID NO: 21166 - protein, 20 aa, synthetic construct
  source 1..20: note = Seed: SATGFKQSSKALQRPVASDF
SATGYKQMSSALPRPVASDF

SEQ ID NO: 21167 - protein, 20 aa, synthetic construct
  source 1..20: note = Seed: SATGFKQSSKALQRPVASDF
SATGYKQMSSALQRPVASDF

SEQ ID NO: 21168 - protein, 20 aa, synthetic construct
  source 1..20: note = Seed: SATGFKQSSKALQRPVASDF
SATGYKQMSSALRRPVASDF

SEQ ID NO: 21169 - protein, 20 aa, synthetic construct
  source 1..20: note = Seed: SATGFKQSSKALQRPVASDF
SATGYKQMSSALSRPVASDF

SEQ ID NO: 21170 - protein, 20 aa, synthetic construct
  source 1..20: note = Seed: SATGFKQSSKALQRPVASDF
SATGYKQMSSALTRPVASDF

SEQ ID NO: 21171 - protein, 20 aa, synthetic construct
  source 1..20: note = Seed: SATGFKQSSKALQRPVASDF
SATGYKQMSSALVRPVASDF

SEQ ID NO: 21172 - protein, 20 aa, synthetic construct
  source 1..20: note = Seed: SATGFKQSSKALQRPVASDF
SATGYKQMSSALWRPVASDF

SEQ ID NO: 21173 - protein, 20 aa, synthetic construct
  source 1..20: note = Seed: SATGFKQSSKALQRPVASDF
SATGYKQMSSALYRPVASDF

SEQ ID NO: 21174 - protein, 20 aa, synthetic construct
  source 1..20: note = Seed: SATGFKQSSKALQRPVASDF
SATGYKQMSTALARPVASDF

SEQ ID NO: 21175 - protein, 20 aa, synthetic construct
  source 1..20: note = Seed: SATGFKQSSKALQRPVASDF
SATGYKQMSTALCRPVASDF

SEQ ID NO: 21176 - protein, 20 aa, synthetic construct
  source 1..20: note = Seed: SATGFKQSSKALQRPVASDF
SATGYKQMSTALDRPVASDF

SEQ ID NO: 21177 - protein, 20 aa, synthetic construct
  source 1..20: note = Seed: SATGFKQSSKALQRPVASDF
SATGYKQMSTALERPVASDF

SEQ ID NO: 21178 - protein, 20 aa, synthetic construct
  source 1..20: note = Seed: SATGFKQSSKALQRPVASDF
SATGYKQMSTALFRPVASDF

SEQ ID NO: 21179 - protein, 20 aa, synthetic construct
  source 1..20: note = Seed: SATGFKQSSKALQRPVASDF
SATGYKQMSTALGRPVASDF

SEQ ID NO: 21180 - protein, 20 aa, synthetic construct
  source 1..20: note = Seed: SATGFKQSSKALQRPVASDF
SATGYKQMSTALHRPVASDF

SEQ ID NO: 21181 - protein, 20 aa, synthetic construct
  source 1..20: note = Seed: SATGFKQSSKALQRPVASDF
SATGYKQMSTALIRPVASDF

SEQ ID NO: 21182 - protein, 20 aa, synthetic construct
  source 1..20: note = Seed: SATGFKQSSKALQRPVASDF
SATGYKQMSTALKRPVASDF

SEQ ID NO: 21183 - protein, 20 aa, synthetic construct
  source 1..20: note = Seed: SATGFKQSSKALQRPVASDF
SATGYKQMSTALLRPVASDF

SEQ ID NO: 21184 - protein, 20 aa, synthetic construct
  source 1..20: note = Seed: SATGFKQSSKALQRPVASDF
SATGYKQMSTALMRPVASDF

SEQ ID NO: 21185 - protein, 20 aa, synthetic construct
  source 1..20: note = Seed: SATGFKQSSKALQRPVASDF
SATGYKQMSTALNRPVASDF

SEQ ID NO: 21186 - protein, 20 aa, synthetic construct
  source 1..20: note = Seed: SATGFKQSSKALQRPVASDF
SATGYKQMSTALPRPVASDF

SEQ ID NO: 21187 - protein, 20 aa, synthetic construct
  source 1..20: note = Seed: SATGFKQSSKALQRPVASDF
SATGYKQMSTALQRPVASDF

SEQ ID NO: 21188 - protein, 20 aa, synthetic construct
  source 1..20: note = Seed: SATGFKQSSKALQRPVASDF
SATGYKQMSTALRRPVASDF

SEQ ID NO: 21189 - protein, 20 aa, synthetic construct
  source 1..20: note = Seed: SATGFKQSSKALQRPVASDF
SATGYKQMSTALSRPVASDF

SEQ ID NO: 21190 - protein, 20 aa, synthetic construct
  source 1..20: note = Seed: SATGFKQSSKALQRPVASDF
SATGYKQMSTALTRPVASDF

SEQ ID NO: 21191 - protein, 20 aa, synthetic construct
  source 1..20: note = Seed: SATGFKQSSKALQRPVASDF
SATGYKQMSTALVRPVASDF

SEQ ID NO: 21192 - protein, 20 aa, synthetic construct
  source 1..20: note = Seed: SATGFKQSSKALQRPVASDF
SATGYKQMSTALWRPVASDF

SEQ ID NO: 21193 - protein, 20 aa, synthetic construct
  source 1..20: note = Seed: SATGFKQSSKALQRPVASDF
SATGYKQMSTALYRPVASDF

SEQ ID NO: 21194 - protein, 20 aa, synthetic construct
  source 1..20: note = Seed: SATGFKQSSKALQRPVASDF
SATGYKQMSVALARPVASDF

SEQ ID NO: 21195 - protein, 20 aa, synthetic construct
  source 1..20: note = Seed: SATGFKQSSKALQRPVASDF
SATGYKQMSVALCRPVASDF

SEQ ID NO: 21196 - protein, 20 aa, synthetic construct
  source 1..20: note = Seed: SATGFKQSSKALQRPVASDF
SATGYKQMSVALDRPVASDF

SEQ ID NO: 21197 - protein, 20 aa, synthetic construct
  source 1..20: note = Seed: SATGFKQSSKALQRPVASDF
SATGYKQMSVALERPVASDF

SEQ ID NO: 21198 - protein, 20 aa, synthetic construct
  source 1..20: note = Seed: SATGFKQSSKALQRPVASDF
SATGYKQMSVALFRPVASDF

SEQ ID NO: 21199 - protein, 20 aa, synthetic construct
  source 1..20: note = Seed: SATGFKQSSKALQRPVASDF
SATGYKQMSVALGRPVASDF

SEQ ID NO: 21200 - protein, 20 aa, synthetic construct
  source 1..20: note = Seed: SATGFKQSSKALQRPVASDF
SATGYKQMSVALHRPVASDF

SEQ ID NO: 21201 - protein, 20 aa, synthetic construct
  source 1..20: note = Seed: SATGFKQSSKALQRPVASDF
SATGYKQMSVALIRPVASDF

SEQ ID NO: 21202 - protein, 20 aa, synthetic construct
  source 1..20: note = Seed: SATGFKQSSKALQRPVASDF
SATGYKQMSVALKRPVASDF

SEQ ID NO: 21203 - protein, 20 aa, synthetic construct
  source 1..20: note = Seed: SATGFKQSSKALQRPVASDF
SATGYKQMSVALLRPVASDF

SEQ ID NO: 21204 - protein, 20 aa, synthetic construct
  source 1..20: note = Seed: SATGFKQSSKALQRPVASDF
SATGYKQMSVALMRPVASDF

SEQ ID NO: 21205 - protein, 20 aa, synthetic construct
  source 1..20: note = Seed: SATGFKQSSKALQRPVASDF
SATGYKQMSVALNRPVASDF

SEQ ID NO: 21206 - protein, 20 aa, synthetic construct
  source 1..20: note = Seed: SATGFKQSSKALQRPVASDF
SATGYKQMSVALPRPVASDF

SEQ ID NO: 21207 - protein, 20 aa, synthetic construct
  source 1..20: note = Seed: SATGFKQSSKALQRPVASDF
SATGYKQMSVALQRPVASDF

SEQ ID NO: 21208 - protein, 20 aa, synthetic construct
  source 1..20: note = Seed: SATGFKQSSKALQRPVASDF
SATGYKQMSVALRRPVASDF

SEQ ID NO: 21209 - protein, 20 aa, synthetic construct
  source 1..20: note = Seed: SATGFKQSSKALQRPVASDF
SATGYKQMSVALSRPVASDF

SEQ ID NO: 21210 - protein, 20 aa, synthetic construct
  source 1..20: note = Seed: SATGFKQSSKALQRPVASDF
SATGYKQMSVALTRPVASDF

SEQ ID NO: 21211 - protein, 20 aa, synthetic construct
  source 1..20: note = Seed: SATGFKQSSKALQRPVASDF
SATGYKQMSVALVRPVASDF

SEQ ID NO: 21212 - protein, 20 aa, synthetic construct
  source 1..20: note = Seed: SATGFKQSSKALQRPVASDF
SATGYKQMSVALWRPVASDF

SEQ ID NO: 21213 - protein, 20 aa, synthetic construct
  source 1..20: note = Seed: SATGFKQSSKALQRPVASDF
SATGYKQMSVALYRPVASDF

SEQ ID NO: 21214 - protein, 20 aa, synthetic construct
  source 1..20: note = Seed: SATGFKQSSKALQRPVASDF
SATGYKQMSWALVRPVASDF

SEQ ID NO: 21215 - protein, 20 aa, synthetic construct
  source 1..20: note = Seed: SATGFKQSSKALQRPVASDF
SATGYKQNSAALARPVASDF

SEQ ID NO: 21216 - protein, 20 aa, synthetic construct
  source 1..20: note = Seed: SATGFKQSSKALQRPVASDF
SATGYKQNSAALFRPVASDF

SEQ ID NO: 21217 - protein, 20 aa, synthetic construct
  source 1..20: note = Seed: SATGFKQSSKALQRPVASDF
SATGYKQNSAALGRPVASDF

SEQ ID NO: 21218 - protein, 20 aa, synthetic construct
  source 1..20: note = Seed: SATGFKQSSKALQRPVASDF
SATGYKQNSAALIRPVASDF

SEQ ID NO: 21219 - protein, 20 aa, synthetic construct
  source 1..20: note = Seed: SATGFKQSSKALQRPVASDF
SATGYKQNSAALLRPVASDF

SEQ ID NO: 21220 - protein, 20 aa, synthetic construct
  source 1..20: note = Seed: SATGFKQSSKALQRPVASDF
SATGYKQNSAALMRPVASDF

SEQ ID NO: 21221 - protein, 20 aa, synthetic construct
  source 1..20: note = Seed: SATGFKQSSKALQRPVASDF
SATGYKQNSAALNRPVASDF

SEQ ID NO: 21222 - protein, 20 aa, synthetic construct
  source 1..20: note = Seed: SATGFKQSSKALQRPVASDF
SATGYKQNSAALSRPVASDF

SEQ ID NO: 21223 - protein, 20 aa, synthetic construct
  source 1..20: note = Seed: SATGFKQSSKALQRPVASDF
SATGYKQNSAALTRPVASDF

SEQ ID NO: 21224 - protein, 20 aa, synthetic construct
  source 1..20: note = Seed: SATGFKQSSKALQRPVASDF
SATGYKQNSAALVRPVASDF

SEQ ID NO: 21225 - protein, 20 aa, synthetic construct
  source 1..20: note = Seed: SATGFKQSSKALQRPVASDF
SATGYKQNSFALIRPVASDF

SEQ ID NO: 21226 - protein, 20 aa, synthetic construct
  source 1..20: note = Seed: SATGFKQSSKALQRPVASDF
SATGYKQNSFALLRPVASDF

SEQ ID NO: 21227 - protein, 20 aa, synthetic construct
  source 1..20: note = Seed: SATGFKQSSKALQRPVASDF
SATGYKQNSFALVRPVASDF

SEQ ID NO: 21228 - protein, 20 aa, synthetic construct
  source 1..20: note = Seed: SATGFKQSSKALQRPVASDF
SATGYKQNSGALARPVASDF

SEQ ID NO: 21229 - protein, 20 aa, synthetic construct
  source 1..20: note = Seed: SATGFKQSSKALQRPVASDF
SATGYKQNSGALIRPVASDF

SEQ ID NO: 21230 - protein, 20 aa, synthetic construct
  source 1..20: note = Seed: SATGFKQSSKALQRPVASDF
SATGYKQNSGALLRPVASDF

SEQ ID NO: 21231 - protein, 20 aa, synthetic construct
  source 1..20: note = Seed: SATGFKQSSKALQRPVASDF
SATGYKQNSGALMRPVASDF

SEQ ID NO: 21232 - protein, 20 aa, synthetic construct
  source 1..20: note = Seed: SATGFKQSSKALQRPVASDF
SATGYKQNSGALSRPVASDF

SEQ ID NO: 21233 - protein, 20 aa, synthetic construct
  source 1..20: note = Seed: SATGFKQSSKALQRPVASDF
SATGYKQNSGALTRPVASDF

SEQ ID NO: 21234 - protein, 20 aa, synthetic construct
  source 1..20: note = Seed: SATGFKQSSKALQRPVASDF
SATGYKQNSGALVRPVASDF

SEQ ID NO: 21235 - protein, 20 aa, synthetic construct
  source 1..20: note = Seed: SATGFKQSSKALQRPVASDF
SATGYKQNSIALARPVASDF

SEQ ID NO: 21236 - protein, 20 aa, synthetic construct
  source 1..20: note = Seed: SATGFKQSSKALQRPVASDF
SATGYKQNSIALGRPVASDF

SEQ ID NO: 21237 - protein, 20 aa, synthetic construct
  source 1..20: note = Seed: SATGFKQSSKALQRPVASDF
SATGYKQNSIALHRPVASDF

SEQ ID NO: 21238 - protein, 20 aa, synthetic construct
  source 1..20: note = Seed: SATGFKQSSKALQRPVASDF
SATGYKQNSIALNRPVASDF

SEQ ID NO: 21239 - protein, 20 aa, synthetic construct
  source 1..20: note = Seed: SATGFKQSSKALQRPVASDF
SATGYKQNSIALSRPVASDF

SEQ ID NO: 21240 - protein, 20 aa, synthetic construct
  source 1..20: note = Seed: SATGFKQSSKALQRPVASDF
SATGYKQNSIALTRPVASDF

SEQ ID NO: 21241 - protein, 20 aa, synthetic construct
  source 1..20: note = Seed: SATGFKQSSKALQRPVASDF
SATGYKQNSIALVRPVASDF

SEQ ID NO: 21242 - protein, 20 aa, synthetic construct
  source 1..20: note = Seed: SATGFKQSSKALQRPVASDF
SATGYKQNSKALARPVASDF

SEQ ID NO: 21243 - protein, 20 aa, synthetic construct
  source 1..20: note = Seed: SATGFKQSSKALQRPVASDF
SATGYKQNSLALNRPVASDF

SEQ ID NO: 21244 - protein, 20 aa, synthetic construct
  source 1..20: note = Seed: SATGFKQSSKALQRPVASDF
SATGYKQNSLALSRPVASDF

SEQ ID NO: 21245 - protein, 20 aa, synthetic construct
  source 1..20: note = Seed: SATGFKQSSKALQRPVASDF
SATGYKQNSLALVRPVASDF

SEQ ID NO: 21246 - protein, 20 aa, synthetic construct
  source 1..20: note = Seed: SATGFKQSSKALQRPVASDF
SATGYKQNSMALIRPVASDF

SEQ ID NO: 21247 - protein, 20 aa, synthetic construct
  source 1..20: note = Seed: SATGFKQSSKALQRPVASDF
SATGYKQNSMALSRPVASDF

SEQ ID NO: 21248 - protein, 20 aa, synthetic construct
  source 1..20: note = Seed: SATGFKQSSKALQRPVASDF
SATGYKQNSMALVRPVASDF

SEQ ID NO: 21249 - protein, 20 aa, synthetic construct
  source 1..20: note = Seed: SATGFKQSSKALQRPVASDF
SATGYKQNSNALARPVASDF

SEQ ID NO: 21250 - protein, 20 aa, synthetic construct
  source 1..20: note = Seed: SATGFKQSSKALQRPVASDF
SATGYKQNSNALIRPVASDF

SEQ ID NO: 21251 - protein, 20 aa, synthetic construct
  source 1..20: note = Seed: SATGFKQSSKALQRPVASDF
SATGYKQNSNALLRPVASDF

SEQ ID NO: 21252 - protein, 20 aa, synthetic construct
  source 1..20: note = Seed: SATGFKQSSKALQRPVASDF
SATGYKQNSNALVRPVASDF

SEQ ID NO: 21253 - protein, 20 aa, synthetic construct
  source 1..20: note = Seed: SATGFKQSSKALQRPVASDF
SATGYKQNSPALARPVASDF

SEQ ID NO: 21254 - protein, 20 aa, synthetic construct
  source 1..20: note = Seed: SATGFKQSSKALQRPVASDF
SATGYKQNSPALIRPVASDF

SEQ ID NO: 21255 - protein, 20 aa, synthetic construct
  source 1..20: note = Seed: SATGFKQSSKALQRPVASDF
SATGYKQNSPALLRPVASDF

SEQ ID NO: 21256 - protein, 20 aa, synthetic construct
  source 1..20: note = Seed: SATGFKQSSKALQRPVASDF
SATGYKQNSPALMRPVASDF

SEQ ID NO: 21257 - protein, 20 aa, synthetic construct
  source 1..20: note = Seed: SATGFKQSSKALQRPVASDF
SATGYKQNSPALSRPVASDF

SEQ ID NO: 21258 - protein, 20 aa, synthetic construct
  source 1..20: note = Seed: SATGFKQSSKALQRPVASDF
SATGYKQNSPALTRPVASDF

SEQ ID NO: 21259 - protein, 20 aa, synthetic construct
  source 1..20: note = Seed: SATGFKQSSKALQRPVASDF
SATGYKQNSPALVRPVASDF

SEQ ID NO: 21260 - protein, 20 aa, synthetic construct
  source 1..20: note = Seed: SATGFKQSSKALQRPVASDF
SATGYKQNSRALARPVASDF

SEQ ID NO: 21261 - protein, 20 aa, synthetic construct
  source 1..20: note = Seed: SATGFKQSSKALQRPVASDF
SATGYKQNSSALARPVASDF

SEQ ID NO: 21262 - protein, 20 aa, synthetic construct
  source 1..20: note = Seed: SATGFKQSSKALQRPVASDF
SATGYKQNSSALIRPVASDF

SEQ ID NO: 21263 - protein, 20 aa, synthetic construct
  source 1..20: note = Seed: SATGFKQSSKALQRPVASDF
SATGYKQNSSALLRPVASDF

SEQ ID NO: 21264 - protein, 20 aa, synthetic construct
  source 1..20: note = Seed: SATGFKQSSKALQRPVASDF
SATGYKQNSSALMRPVASDF

SEQ ID NO: 21265 - protein, 20 aa, synthetic construct
  source 1..20: note = Seed: SATGFKQSSKALQRPVASDF
SATGYKQNSSALSRPVASDF

SEQ ID NO: 21266 - protein, 20 aa, synthetic construct
  source 1..20: note = Seed: SATGFKQSSKALQRPVASDF
SATGYKQNSSALTRPVASDF

SEQ ID NO: 21267 - protein, 20 aa, synthetic construct
  source 1..20: note = Seed: SATGFKQSSKALQRPVASDF
SATGYKQNSSALVRPVASDF

SEQ ID NO: 21268 - protein, 20 aa, synthetic construct
  source 1..20: note = Seed: SATGFKQSSKALQRPVASDF
SATGYKQNSTALARPVASDF

SEQ ID NO: 21269 - protein, 20 aa, synthetic construct
  source 1..20: note = Seed: SATGFKQSSKALQRPVASDF
SATGYKQNSTALIRPVASDF

SEQ ID NO: 21270 - protein, 20 aa, synthetic construct
  source 1..20: note = Seed: SATGFKQSSKALQRPVASDF
SATGYKQNSTALLRPVASDF

SEQ ID NO: 21271 - protein, 20 aa, synthetic construct
  source 1..20: note = Seed: SATGFKQSSKALQRPVASDF
SATGYKQNSTALVRPVASDF

SEQ ID NO: 21272 - protein, 20 aa, synthetic construct
  source 1..20: note = Seed: SATGFKQSSKALQRPVASDF
SATGYKQNSVALARPVASDF

SEQ ID NO: 21273 - protein, 20 aa, synthetic construct
  source 1..20: note = Seed: SATGFKQSSKALQRPVASDF
SATGYKQNSVALIRPVASDF

SEQ ID NO: 21274 - protein, 20 aa, synthetic construct
  source 1..20: note = Seed: SATGFKQSSKALQRPVASDF
SATGYKQNSVALLRPVASDF

SEQ ID NO: 21275 - protein, 20 aa, synthetic construct
  source 1..20: note = Seed: SATGFKQSSKALQRPVASDF
SATGYKQNSVALMRPVASDF

SEQ ID NO: 21276 - protein, 20 aa, synthetic construct
  source 1..20: note = Seed: SATGFKQSSKALQRPVASDF
SATGYKQNSVALNRPVASDF

SEQ ID NO: 21277 - protein, 20 aa, synthetic construct
  source 1..20: note = Seed: SATGFKQSSKALQRPVASDF
SATGYKQNSVALQRPVASDF

SEQ ID NO: 21278 - protein, 20 aa, synthetic construct
  source 1..20: note = Seed: SATGFKQSSKALQRPVASDF
SATGYKQNSVALSRPVASDF

SEQ ID NO: 21279 - protein, 20 aa, synthetic construct
  source 1..20: note = Seed: SATGFKQSSKALQRPVASDF
SATGYKQNSVALTRPVASDF

SEQ ID NO: 21280 - protein, 20 aa, synthetic construct
  source 1..20: note = Seed: SATGFKQSSKALQRPVASDF
SATGYKQNSVALVRPVASDF

SEQ ID NO: 21281 - protein, 20 aa, synthetic construct
  source 1..20: note = Seed: SATGFKQSSKALQRPVASDF
SATGYKQPSVALARPVASDF

SEQ ID NO: 21282 - protein, 20 aa, synthetic construct
  source 1..20: note = Seed: SATGFKQSSKALQRPVASDF
SATGYKQQSAALARPVASDF

SEQ ID NO: 21283 - protein, 20 aa, synthetic construct
  source 1..20: note = Seed: SATGFKQSSKALQRPVASDF
SATGYKQQSAALCRPVASDF

SEQ ID NO: 21284 - protein, 20 aa, synthetic construct
  source 1..20: note = Seed: SATGFKQSSKALQRPVASDF
SATGYKQQSAALDRPVASDF

SEQ ID NO: 21285 - protein, 20 aa, synthetic construct
  source 1..20: note = Seed: SATGFKQSSKALQRPVASDF
SATGYKQQSAALERPVASDF

SEQ ID NO: 21286 - protein, 20 aa, synthetic construct
  source 1..20: note = Seed: SATGFKQSSKALQRPVASDF
SATGYKQQSAALFRPVASDF

SEQ ID NO: 21287 - protein, 20 aa, synthetic construct
  source 1..20: note = Seed: SATGFKQSSKALQRPVASDF
SATGYKQQSAALGRPVASDF

SEQ ID NO: 21288 - protein, 20 aa, synthetic construct
  source 1..20: note = Seed: SATGFKQSSKALQRPVASDF
SATGYKQQSAALHRPVASDF

SEQ ID NO: 21289 - protein, 20 aa, synthetic construct
  source 1..20: note = Seed: SATGFKQSSKALQRPVASDF
SATGYKQQSAALIRPVASDF

SEQ ID NO: 21290 - protein, 20 aa, synthetic construct
  source 1..20: note = Seed: SATGFKQSSKALQRPVASDF
SATGYKQQSAALLRPVASDF

SEQ ID NO: 21291 - protein, 20 aa, synthetic construct
  source 1..20: note = Seed: SATGFKQSSKALQRPVASDF
SATGYKQQSAALMRPVASDF

SEQ ID NO: 21292 - protein, 20 aa, synthetic construct
  source 1..20: note = Seed: SATGFKQSSKALQRPVASDF
SATGYKQQSAALNRPVASDF

SEQ ID NO: 21293 - protein, 20 aa, synthetic construct
  source 1..20: note = Seed: SATGFKQSSKALQRPVASDF
SATGYKQQSAALPRPVASDF

SEQ ID NO: 21294 - protein, 20 aa, synthetic construct
  source 1..20: note = Seed: SATGFKQSSKALQRPVASDF
SATGYKQQSAALQRPVASDF

SEQ ID NO: 21295 - protein, 20 aa, synthetic construct
  source 1..20: note = Seed: SATGFKQSSKALQRPVASDF
SATGYKQQSAALSRPVASDF

SEQ ID NO: 21296 - protein, 20 aa, synthetic construct
  source 1..20: note = Seed: SATGFKQSSKALQRPVASDF
SATGYKQQSAALTRPVASDF

SEQ ID NO: 21297 - protein, 20 aa, synthetic construct
  source 1..20: note = Seed: SATGFKQSSKALQRPVASDF
SATGYKQQSAALVRPVASDF

SEQ ID NO: 21298 - protein, 20 aa, synthetic construct
  source 1..20: note = Seed: SATGFKQSSKALQRPVASDF
SATGYKQQSAALWRPVASDF

SEQ ID NO: 21299 - protein, 20 aa, synthetic construct
  source 1..20: note = Seed: SATGFKQSSKALQRPVASDF
SATGYKQQSAALYRPVASDF

SEQ ID NO: 21300 - protein, 20 aa, synthetic construct
  source 1..20: note = Seed: SATGFKQSSKALQRPVASDF
SATGYKQQSFALFRPVASDF

SEQ ID NO: 21301 - protein, 20 aa, synthetic construct
  source 1..20: note = Seed: SATGFKQSSKALQRPVASDF
SATGYKQQSFALIRPVASDF

SEQ ID NO: 21302 - protein, 20 aa, synthetic construct
  source 1..20: note = Seed: SATGFKQSSKALQRPVASDF
SATGYKQQSFALLRPVASDF

SEQ ID NO: 21303 - protein, 20 aa, synthetic construct
  source 1..20: note = Seed: SATGFKQSSKALQRPVASDF
SATGYKQQSFALVRPVASDF

SEQ ID NO: 21304 - protein, 20 aa, synthetic construct
  source 1..20: note = Seed: SATGFKQSSKALQRPVASDF
SATGYKQQSGALARPVASDF

SEQ ID NO: 21305 - protein, 20 aa, synthetic construct
  source 1..20: note = Seed: SATGFKQSSKALQRPVASDF
SATGYKQQSGALCRPVASDF

SEQ ID NO: 21306 - protein, 20 aa, synthetic construct
  source 1..20: note = Seed: SATGFKQSSKALQRPVASDF
SATGYKQQSGALFRPVASDF

SEQ ID NO: 21307 - protein, 20 aa, synthetic construct
  source 1..20: note = Seed: SATGFKQSSKALQRPVASDF
SATGYKQQSGALGRPVASDF

SEQ ID NO: 21308 - protein, 20 aa, synthetic construct
  source 1..20: note = Seed: SATGFKQSSKALQRPVASDF
SATGYKQQSGALIRPVASDF

SEQ ID NO: 21309 - protein, 20 aa, synthetic construct
  source 1..20: note = Seed: SATGFKQSSKALQRPVASDF
SATGYKQQSGALLRPVASDF

SEQ ID NO: 21310 - protein, 20 aa, synthetic construct
  source 1..20: note = Seed: SATGFKQSSKALQRPVASDF
SATGYKQQSGALMRPVASDF

SEQ ID NO: 21311 - protein, 20 aa, synthetic construct
  source 1..20: note = Seed: SATGFKQSSKALQRPVASDF
SATGYKQQSGALNRPVASDF

SEQ ID NO: 21312 - protein, 20 aa, synthetic construct
  source 1..20: note = Seed: SATGFKQSSKALQRPVASDF
SATGYKQQSGALSRPVASDF

SEQ ID NO: 21313 - protein, 20 aa, synthetic construct
  source 1..20: note = Seed: SATGFKQSSKALQRPVASDF
SATGYKQQSGALTRPVASDF

SEQ ID NO: 21314 - protein, 20 aa, synthetic construct
  source 1..20: note = Seed: SATGFKQSSKALQRPVASDF
SATGYKQQSGALVRPVASDF

SEQ ID NO: 21315 - protein, 20 aa, synthetic construct
  source 1..20: note = Seed: SATGFKQSSKALQRPVASDF
SATGYKQQSHALARPVASDF

SEQ ID NO: 21316 - protein, 20 aa, synthetic construct
  source 1..20: note = Seed: SATGFKQSSKALQRPVASDF
SATGYKQQSHALLRPVASDF

SEQ ID NO: 21317 - protein, 20 aa, synthetic construct
  source 1..20: note = Seed: SATGFKQSSKALQRPVASDF
SATGYKQQSIALARPVASDF

SEQ ID NO: 21318 - protein, 20 aa, synthetic construct
  source 1..20: note = Seed: SATGFKQSSKALQRPVASDF
SATGYKQQSIALCRPVASDF

SEQ ID NO: 21319 - protein, 20 aa, synthetic construct
  source 1..20: note = Seed: SATGFKQSSKALQRPVASDF
SATGYKQQSIALDRPVASDF

SEQ ID NO: 21320 - protein, 20 aa, synthetic construct
  source 1..20: note = Seed: SATGFKQSSKALQRPVASDF
SATGYKQQSIALERPVASDF

SEQ ID NO: 21321 - protein, 20 aa, synthetic construct
  source 1..20: note = Seed: SATGFKQSSKALQRPVASDF
SATGYKQQSIALFRPVASDF

SEQ ID NO: 21322 - protein, 20 aa, synthetic construct
  source 1..20: note = Seed: SATGFKQSSKALQRPVASDF
SATGYKQQSIALGRPVASDF

SEQ ID NO: 21323 - protein, 20 aa, synthetic construct
  source 1..20: note = Seed: SATGFKQSSKALQRPVASDF
SATGYKQQSIALHRPVASDF

SEQ ID NO: 21324 - protein, 20 aa, synthetic construct
  source 1..20: note = Seed: SATGFKQSSKALQRPVASDF
SATGYKQQSIALIRPVASDF

SEQ ID NO: 21325 - protein, 20 aa, synthetic construct
  source 1..20: note = Seed: SATGFKQSSKALQRPVASDF
SATGYKQQSIALNRPVASDF

SEQ ID NO: 21326 - protein, 20 aa, synthetic construct
  source 1..20: note = Seed: SATGFKQSSKALQRPVASDF
SATGYKQQSIALPRPVASDF

SEQ ID NO: 21327 - protein, 20 aa, synthetic construct
  source 1..20: note = Seed: SATGFKQSSKALQRPVASDF
SATGYKQQSIALQRPVASDF

SEQ ID NO: 21328 - protein, 20 aa, synthetic construct
  source 1..20: note = Seed: SATGFKQSSKALQRPVASDF
SATGYKQQSIALSRPVASDF

SEQ ID NO: 21329 - protein, 20 aa, synthetic construct
  source 1..20: note = Seed: SATGFKQSSKALQRPVASDF
SATGYKQQSIALTRPVASDF

SEQ ID NO: 21330 - protein, 20 aa, synthetic construct
  source 1..20: note = Seed: SATGFKQSSKALQRPVASDF
SATGYKQQSIALVRPVASDF

SEQ ID NO: 21331 - protein, 20 aa, synthetic construct
  source 1..20: note = Seed: SATGFKQSSKALQRPVASDF
SATGYKQQSIALYRPVASDF

SEQ ID NO: 21332 - protein, 20 aa, synthetic construct
  source 1..20: note = Seed: SATGFKQSSKALQRPVASDF
SATGYKQQSKALARPVASDF

SEQ ID NO: 21333 - protein, 20 aa, synthetic construct
  source 1..20: note = Seed: SATGFKQSSKALQRPVASDF
SATGYKQQSKALGRPVASDF

SEQ ID NO: 21334 - protein, 20 aa, synthetic construct
  source 1..20: note = Seed: SATGFKQSSKALQRPVASDF
SATGYKQQSKALSRPVASDF

SEQ ID NO: 21335 - protein, 20 aa, synthetic construct
  source 1..20: note = Seed: SATGFKQSSKALQRPVASDF
SATGYKQQSKALTRPVASDF

SEQ ID NO: 21336 - protein, 20 aa, synthetic construct
  source 1..20: note = Seed: SATGFKQSSKALQRPVASDF
SATGYKQQSLALARPVASDF

SEQ ID NO: 21337 - protein, 20 aa, synthetic construct
  source 1..20: note = Seed: SATGFKQSSKALQRPVASDF
SATGYKQQSLALGRPVASDF

SEQ ID NO: 21338 - protein, 20 aa, synthetic construct
  source 1..20: note = Seed: SATGFKQSSKALQRPVASDF
SATGYKQQSLALHRPVASDF

SEQ ID NO: 21339 - protein, 20 aa, synthetic construct
  source 1..20: note = Seed: SATGFKQSSKALQRPVASDF
SATGYKQQSLALIRPVASDF

SEQ ID NO: 21340 - protein, 20 aa, synthetic construct
  source 1..20: note = Seed: SATGFKQSSKALQRPVASDF
SATGYKQQSLALNRPVASDF

SEQ ID NO: 21341 - protein, 20 aa, synthetic construct
  source 1..20: note = Seed: SATGFKQSSKALQRPVASDF
SATGYKQQSLALQRPVASDF

SEQ ID NO: 21342 - protein, 20 aa, synthetic construct
  source 1..20: note = Seed: SATGFKQSSKALQRPVASDF
SATGYKQQSLALSRPVASDF

SEQ ID NO: 21343 - protein, 20 aa, synthetic construct
  source 1..20: note = Seed: SATGFKQSSKALQRPVASDF
SATGYKQQSLALTRPVASDF

SEQ ID NO: 21344 - protein, 20 aa, synthetic construct
  source 1..20: note = Seed: SATGFKQSSKALQRPVASDF
SATGYKQQSLALVRPVASDF

SEQ ID NO: 21345 - protein, 20 aa, synthetic construct
  source 1..20: note = Seed: SATGFKQSSKALQRPVASDF
SATGYKQQSMALARPVASDF

SEQ ID NO: 21346 - protein, 20 aa, synthetic construct
  source 1..20: note = Seed: SATGFKQSSKALQRPVASDF
SATGYKQQSMALGRPVASDF

SEQ ID NO: 21347 - protein, 20 aa, synthetic construct
  source 1..20: note = Seed: SATGFKQSSKALQRPVASDF
SATGYKQQSMALHRPVASDF

SEQ ID NO: 21348 - protein, 20 aa, synthetic construct
  source 1..20: note = Seed: SATGFKQSSKALQRPVASDF
SATGYKQQSMALIRPVASDF

SEQ ID NO: 21349 - protein, 20 aa, synthetic construct
  source 1..20: note = Seed: SATGFKQSSKALQRPVASDF
SATGYKQQSMALNRPVASDF

SEQ ID NO: 21350 - protein, 20 aa, synthetic construct
  source 1..20: note = Seed: SATGFKQSSKALQRPVASDF
SATGYKQQSMALQRPVASDF

SEQ ID NO: 21351 - protein, 20 aa, synthetic construct
  source 1..20: note = Seed: SATGFKQSSKALQRPVASDF
SATGYKQQSMALSRPVASDF

SEQ ID NO: 21352 - protein, 20 aa, synthetic construct
  source 1..20: note = Seed: SATGFKQSSKALQRPVASDF
SATGYKQQSMALTRPVASDF

SEQ ID NO: 21353 - protein, 20 aa, synthetic construct
  source 1..20: note = Seed: SATGFKQSSKALQRPVASDF
SATGYKQQSMALVRPVASDF

SEQ ID NO: 21354 - protein, 20 aa, synthetic construct
  source 1..20: note = Seed: SATGFKQSSKALQRPVASDF
SATGYKQQSNALARPVASDF

SEQ ID NO: 21355 - protein, 20 aa, synthetic construct
  source 1..20: note = Seed: SATGFKQSSKALQRPVASDF
SATGYKQQSNALGRPVASDF

SEQ ID NO: 21356 - protein, 20 aa, synthetic construct
  source 1..20: note = Seed: SATGFKQSSKALQRPVASDF
SATGYKQQSNALIRPVASDF

SEQ ID NO: 21357 - protein, 20 aa, synthetic construct
  source 1..20: note = Seed: SATGFKQSSKALQRPVASDF
SATGYKQQSNALLRPVASDF

SEQ ID NO: 21358 - protein, 20 aa, synthetic construct
  source 1..20: note = Seed: SATGFKQSSKALQRPVASDF
SATGYKQQSNALMRPVASDF

SEQ ID NO: 21359 - protein, 20 aa, synthetic construct
  source 1..20: note = Seed: SATGFKQSSKALQRPVASDF
SATGYKQQSNALNRPVASDF

SEQ ID NO: 21360 - protein, 20 aa, synthetic construct
  source 1..20: note = Seed: SATGFKQSSKALQRPVASDF
SATGYKQQSNALSRPVASDF

SEQ ID NO: 21361 - protein, 20 aa, synthetic construct
  source 1..20: note = Seed: SATGFKQSSKALQRPVASDF
SATGYKQQSNALTRPVASDF

SEQ ID NO: 21362 - protein, 20 aa, synthetic construct
  source 1..20: note = Seed: SATGFKQSSKALQRPVASDF
SATGYKQQSNALVRPVASDF

SEQ ID NO: 21363 - protein, 20 aa, synthetic construct
  source 1..20: note = Seed: SATGFKQSSKALQRPVASDF
SATGYKQQSPALARPVASDF

SEQ ID NO: 21364 - protein, 20 aa, synthetic construct
  source 1..20: note = Seed: SATGFKQSSKALQRPVASDF
SATGYKQQSPALCRPVASDF

SEQ ID NO: 21365 - protein, 20 aa, synthetic construct
  source 1..20: note = Seed: SATGFKQSSKALQRPVASDF
SATGYKQQSPALFRPVASDF

SEQ ID NO: 21366 - protein, 20 aa, synthetic construct
  source 1..20: note = Seed: SATGFKQSSKALQRPVASDF
SATGYKQQSPALGRPVASDF

SEQ ID NO: 21367 - protein, 20 aa, synthetic construct
  source 1..20: note = Seed: SATGFKQSSKALQRPVASDF
SATGYKQQSPALHRPVASDF

SEQ ID NO: 21368 - protein, 20 aa, synthetic construct
  source 1..20: note = Seed: SATGFKQSSKALQRPVASDF
SATGYKQQSPALIRPVASDF

SEQ ID NO: 21369 - protein, 20 aa, synthetic construct
  source 1..20: note = Seed: SATGFKQSSKALQRPVASDF
SATGYKQQSPALLRPVASDF

SEQ ID NO: 21370 - protein, 20 aa, synthetic construct
  source 1..20: note = Seed: SATGFKQSSKALQRPVASDF
SATGYKQQSPALMRPVASDF

SEQ ID NO: 21371 - protein, 20 aa, synthetic construct
  source 1..20: note = Seed: SATGFKQSSKALQRPVASDF
SATGYKQQSPALNRPVASDF

SEQ ID NO: 21372 - protein, 20 aa, synthetic construct
  source 1..20: note = Seed: SATGFKQSSKALQRPVASDF
SATGYKQQSPALPRPVASDF

SEQ ID NO: 21373 - protein, 20 aa, synthetic construct
  source 1..20: note = Seed: SATGFKQSSKALQRPVASDF
SATGYKQQSPALQRPVASDF

SEQ ID NO: 21374 - protein, 20 aa, synthetic construct
  source 1..20: note = Seed: SATGFKQSSKALQRPVASDF
SATGYKQQSPALSRPVASDF

SEQ ID NO: 21375 - protein, 20 aa, synthetic construct
  source 1..20: note = Seed: SATGFKQSSKALQRPVASDF
SATGYKQQSPALTRPVASDF

SEQ ID NO: 21376 - protein, 20 aa, synthetic construct
  source 1..20: note = Seed: SATGFKQSSKALQRPVASDF
SATGYKQQSPALVRPVASDF

SEQ ID NO: 21377 - protein, 20 aa, synthetic construct
  source 1..20: note = Seed: SATGFKQSSKALQRPVASDF
SATGYKQQSQALLRPVASDF

SEQ ID NO: 21378 - protein, 20 aa, synthetic construct
  source 1..20: note = Seed: SATGFKQSSKALQRPVASDF
SATGYKQQSRALARPVASDF

SEQ ID NO: 21379 - protein, 20 aa, synthetic construct
  source 1..20: note = Seed: SATGFKQSSKALQRPVASDF
SATGYKQQSRALGRPVASDF

SEQ ID NO: 21380 - protein, 20 aa, synthetic construct
  source 1..20: note = Seed: SATGFKQSSKALQRPVASDF
SATGYKQQSRALHRPVASDF

SEQ ID NO: 21381 - protein, 20 aa, synthetic construct
  source 1..20: note = Seed: SATGFKQSSKALQRPVASDF
SATGYKQQSRALQRPVASDF

SEQ ID NO: 21382 - protein, 20 aa, synthetic construct
  source 1..20: note = Seed: SATGFKQSSKALQRPVASDF
SATGYKQQSRALSRPVASDF

SEQ ID NO: 21383 - protein, 20 aa, synthetic construct
  source 1..20: note = Seed: SATGFKQSSKALQRPVASDF
SATGYKQQSRALTRPVASDF

SEQ ID NO: 21384 - protein, 20 aa, synthetic construct
  source 1..20: note = Seed: SATGFKQSSKALQRPVASDF
SATGYKQQSRALVRPVASDF

SEQ ID NO: 21385 - protein, 20 aa, synthetic construct
  source 1..20: note = Seed: SATGFKQSSKALQRPVASDF
SATGYKQQSSALARPVASDF

SEQ ID NO: 21386 - protein, 20 aa, synthetic construct
  source 1..20: note = Seed: SATGFKQSSKALQRPVASDF
SATGYKQQSSALCRPVASDF

SEQ ID NO: 21387 - protein, 20 aa, synthetic construct
  source 1..20: note = Seed: SATGFKQSSKALQRPVASDF
SATGYKQQSSALFRPVASDF

SEQ ID NO: 21388 - protein, 20 aa, synthetic construct
  source 1..20: note = Seed: SATGFKQSSKALQRPVASDF
SATGYKQQSSALGRPVASDF

SEQ ID NO: 21389 - protein, 20 aa, synthetic construct
  source 1..20: note = Seed: SATGFKQSSKALQRPVASDF
SATGYKQQSSALHRPVASDF

SEQ ID NO: 21390 - protein, 20 aa, synthetic construct
  source 1..20: note = Seed: SATGFKQSSKALQRPVASDF
SATGYKQQSSALIRPVASDF

SEQ ID NO: 21391 - protein, 20 aa, synthetic construct
  source 1..20: note = Seed: SATGFKQSSKALQRPVASDF
SATGYKQQSSALLRPVASDF

SEQ ID NO: 21392 - protein, 20 aa, synthetic construct
  source 1..20: note = Seed: SATGFKQSSKALQRPVASDF
SATGYKQQSSALMRPVASDF

SEQ ID NO: 21393 - protein, 20 aa, synthetic construct
  source 1..20: note = Seed: SATGFKQSSKALQRPVASDF
SATGYKQQSSALNRPVASDF

SEQ ID NO: 21394 - protein, 20 aa, synthetic construct
  source 1..20: note = Seed: SATGFKQSSKALQRPVASDF
SATGYKQQSSALPRPVASDF

SEQ ID NO: 21395 - protein, 20 aa, synthetic construct
  source 1..20: note = Seed: SATGFKQSSKALQRPVASDF
SATGYKQQSSALQRPVASDF

SEQ ID NO: 21396 - protein, 20 aa, synthetic construct
  source 1..20: note = Seed: SATGFKQSSKALQRPVASDF
SATGYKQQSSALSRPVASDF

SEQ ID NO: 21397 - protein, 20 aa, synthetic construct
  source 1..20: note = Seed: SATGFKQSSKALQRPVASDF
SATGYKQQSSALTRPVASDF

SEQ ID NO: 21398 - protein, 20 aa, synthetic construct
  source 1..20: note = Seed: SATGFKQSSKALQRPVASDF
SATGYKQQSSALVRPVASDF

SEQ ID NO: 21399 - protein, 20 aa, synthetic construct
  source 1..20: note = Seed: SATGFKQSSKALQRPVASDF
SATGYKQQSTALARPVASDF

SEQ ID NO: 21400 - protein, 20 aa, synthetic construct
  source 1..20: note = Seed: SATGFKQSSKALQRPVASDF
SATGYKQQSTALGRPVASDF

SEQ ID NO: 21401 - protein, 20 aa, synthetic construct
  source 1..20: note = Seed: SATGFKQSSKALQRPVASDF
SATGYKQQSTALHRPVASDF

SEQ ID NO: 21402 - protein, 20 aa, synthetic construct
  source 1..20: note = Seed: SATGFKQSSKALQRPVASDF
SATGYKQQSTALIRPVASDF

SEQ ID NO: 21403 - protein, 20 aa, synthetic construct
  source 1..20: note = Seed: SATGFKQSSKALQRPVASDF
SATGYKQQSTALLRPVASDF

SEQ ID NO: 21404 - protein, 20 aa, synthetic construct
  source 1..20: note = Seed: SATGFKQSSKALQRPVASDF
SATGYKQQSTALMRPVASDF

SEQ ID NO: 21405 - protein, 20 aa, synthetic construct
  source 1..20: note = Seed: SATGFKQSSKALQRPVASDF
SATGYKQQSTALNRPVASDF

SEQ ID NO: 21406 - protein, 20 aa, synthetic construct
  source 1..20: note = Seed: SATGFKQSSKALQRPVASDF
SATGYKQQSTALPRPVASDF

SEQ ID NO: 21407 - protein, 20 aa, synthetic construct
  source 1..20: note = Seed: SATGFKQSSKALQRPVASDF
SATGYKQQSTALQRPVASDF

SEQ ID NO: 21408 - protein, 20 aa, synthetic construct
  source 1..20: note = Seed: SATGFKQSSKALQRPVASDF
SATGYKQQSTALSRPVASDF

SEQ ID NO: 21409 - protein, 20 aa, synthetic construct
  source 1..20: note = Seed: SATGFKQSSKALQRPVASDF
SATGYKQQSTALTRPVASDF

SEQ ID NO: 21410 - protein, 20 aa, synthetic construct
  source 1..20: note = Seed: SATGFKQSSKALQRPVASDF
SATGYKQQSTALVRPVASDF

SEQ ID NO: 21411 - protein, 20 aa, synthetic construct
  source 1..20: note = Seed: SATGFKQSSKALQRPVASDF
SATGYKQQSVALARPVASDF

SEQ ID NO: 21412 - protein, 20 aa, synthetic construct
  source 1..20: note = Seed: SATGFKQSSKALQRPVASDF
SATGYKQQSVALCRPVASDF

SEQ ID NO: 21413 - protein, 20 aa, synthetic construct
  source 1..20: note = Seed: SATGFKQSSKALQRPVASDF
SATGYKQQSVALDRPVASDF

SEQ ID NO: 21414 - protein, 20 aa, synthetic construct
  source 1..20: note = Seed: SATGFKQSSKALQRPVASDF
SATGYKQQSVALERPVASDF

SEQ ID NO: 21415 - protein, 20 aa, synthetic construct
  source 1..20: note = Seed: SATGFKQSSKALQRPVASDF
SATGYKQQSVALFRPVASDF

SEQ ID NO: 21416 - protein, 20 aa, synthetic construct
  source 1..20: note = Seed: SATGFKQSSKALQRPVASDF
SATGYKQQSVALGRPVASDF

SEQ ID NO: 21417 - protein, 20 aa, synthetic construct
  source 1..20: note = Seed: SATGFKQSSKALQRPVASDF
SATGYKQQSVALHRPVASDF

SEQ ID NO: 21418 - protein, 20 aa, synthetic construct
  source 1..20: note = Seed: SATGFKQSSKALQRPVASDF
SATGYKQQSVALIRPVASDF

SEQ ID NO: 21419 - protein, 20 aa, synthetic construct
  source 1..20: note = Seed: SATGFKQSSKALQRPVASDF
SATGYKQQSVALLRPVASDF

SEQ ID NO: 21420 - protein, 20 aa, synthetic construct
  source 1..20: note = Seed: SATGFKQSSKALQRPVASDF
SATGYKQQSVALMRPVASDF

SEQ ID NO: 21421 - protein, 20 aa, synthetic construct
  source 1..20: note = Seed: SATGFKQSSKALQRPVASDF
SATGYKQQSVALNRPVASDF

SEQ ID NO: 21422 - protein, 20 aa, synthetic construct
  source 1..20: note = Seed: SATGFKQSSKALQRPVASDF
SATGYKQQSVALPRPVASDF

SEQ ID NO: 21423 - protein, 20 aa, synthetic construct
  source 1..20: note = Seed: SATGFKQSSKALQRPVASDF
SATGYKQQSVALQRPVASDF

SEQ ID NO: 21424 - protein, 20 aa, synthetic construct
  source 1..20: note = Seed: SATGFKQSSKALQRPVASDF
SATGYKQQSVALSRPVASDF

SEQ ID NO: 21425 - protein, 20 aa, synthetic construct
  source 1..20: note = Seed: SATGFKQSSKALQRPVASDF
SATGYKQQSVALTRPVASDF

SEQ ID NO: 21426 - protein, 20 aa, synthetic construct
  source 1..20: note = Seed: SATGFKQSSKALQRPVASDF
SATGYKQQSVALVRPVASDF

SEQ ID NO: 21427 - protein, 20 aa, synthetic construct
  source 1..20: note = Seed: SATGFKQSSKALQRPVASDF
SATGYKQRSAALARPVASDF

SEQ ID NO: 21428 - protein, 20 aa, synthetic construct
  source 1..20: note = Seed: SATGFKQSSKALQRPVASDF
SATGYKQRSAALIRPVASDF

SEQ ID NO: 21429 - protein, 20 aa, synthetic construct
  source 1..20: note = Seed: SATGFKQSSKALQRPVASDF
SATGYKQRSAALLRPVASDF

SEQ ID NO: 21430 - protein, 20 aa, synthetic construct
  source 1..20: note = Seed: SATGFKQSSKALQRPVASDF
SATGYKQRSAALVRPVASDF

SEQ ID NO: 21431 - protein, 20 aa, synthetic construct
  source 1..20: note = Seed: SATGFKQSSKALQRPVASDF
SATGYKQRSGALLRPVASDF

SEQ ID NO: 21432 - protein, 20 aa, synthetic construct
  source 1..20: note = Seed: SATGFKQSSKALQRPVASDF
SATGYKQRSIALARPVASDF

SEQ ID NO: 21433 - protein, 20 aa, synthetic construct
  source 1..20: note = Seed: SATGFKQSSKALQRPVASDF
SATGYKQRSSALIRPVASDF

SEQ ID NO: 21434 - protein, 20 aa, synthetic construct
  source 1..20: note = Seed: SATGFKQSSKALQRPVASDF
SATGYKQRSSALLRPVASDF

SEQ ID NO: 21435 - protein, 20 aa, synthetic construct
  source 1..20: note = Seed: SATGFKQSSKALQRPVASDF
SATGYKQRSSALVRPVASDF

SEQ ID NO: 21436 - protein, 20 aa, synthetic construct
  source 1..20: note = Seed: SATGFKQSSKALQRPVASDF
SATGYKQRSVALSRPVASDF

SEQ ID NO: 21437 - protein, 20 aa, synthetic construct
  source 1..20: note = Seed: SATGFKQSSKALQRPVASDF
SATGYKQRSVALVRPVASDF

SEQ ID NO: 21438 - protein, 20 aa, synthetic construct
  source 1..20: note = Seed: SATGFKQSSKALQRPVASDF
SATGYKQSSAALARPVASDF

SEQ ID NO: 21439 - protein, 20 aa, synthetic construct
  source 1..20: note = Seed: SATGFKQSSKALQRPVASDF
SATGYKQSSAALCRPVASDF

SEQ ID NO: 21440 - protein, 20 aa, synthetic construct
  source 1..20: note = Seed: SATGFKQSSKALQRPVASDF
SATGYKQSSAALDRPVASDF

SEQ ID NO: 21441 - protein, 20 aa, synthetic construct
  source 1..20: note = Seed: SATGFKQSSKALQRPVASDF
SATGYKQSSAALERPVASDF

SEQ ID NO: 21442 - protein, 20 aa, synthetic construct
  source 1..20: note = Seed: SATGFKQSSKALQRPVASDF
SATGYKQSSAALFRPVASDF

SEQ ID NO: 21443 - protein, 20 aa, synthetic construct
  source 1..20: note = Seed: SATGFKQSSKALQRPVASDF
SATGYKQSSAALGRPVASDF

SEQ ID NO: 21444 - protein, 20 aa, synthetic construct
  source 1..20: note = Seed: SATGFKQSSKALQRPVASDF
SATGYKQSSAALHRPVASDF

SEQ ID NO: 21445 - protein, 20 aa, synthetic construct
  source 1..20: note = Seed: SATGFKQSSKALQRPVASDF
SATGYKQSSAALIRPVASDF

SEQ ID NO: 21446 - protein, 20 aa, synthetic construct
  source 1..20: note = Seed: SATGFKQSSKALQRPVASDF
SATGYKQSSAALLRPVASDF

SEQ ID NO: 21447 - protein, 20 aa, synthetic construct
  source 1..20: note = Seed: SATGFKQSSKALQRPVASDF
SATGYKQSSAALMRPVASDF

SEQ ID NO: 21448 - protein, 20 aa, synthetic construct
  source 1..20: note = Seed: SATGFKQSSKALQRPVASDF
SATGYKQSSAALNRPVASDF

SEQ ID NO: 21449 - protein, 20 aa, synthetic construct
  source 1..20: note = Seed: SATGFKQSSKALQRPVASDF
SATGYKQSSAALPRPVASDF

SEQ ID NO: 21450 - protein, 20 aa, synthetic construct
  source 1..20: note = Seed: SATGFKQSSKALQRPVASDF
SATGYKQSSAALQRPVASDF

SEQ ID NO: 21451 - protein, 20 aa, synthetic construct
  source 1..20: note = Seed: SATGFKQSSKALQRPVASDF
SATGYKQSSAALRRPVASDF

SEQ ID NO: 21452 - protein, 20 aa, synthetic construct
  source 1..20: note = Seed: SATGFKQSSKALQRPVASDF
SATGYKQSSAALSRPVASDF

SEQ ID NO: 21453 - protein, 20 aa, synthetic construct
  source 1..20: note = Seed: SATGFKQSSKALQRPVASDF
SATGYKQSSAALTRPVASDF

SEQ ID NO: 21454 - protein, 20 aa, synthetic construct
  source 1..20: note = Seed: SATGFKQSSKALQRPVASDF
SATGYKQSSAALVRPVASDF

SEQ ID NO: 21455 - protein, 20 aa, synthetic construct
  source 1..20: note = Seed: SATGFKQSSKALQRPVASDF
SATGYKQSSAALYRPVASDF

SEQ ID NO: 21456 - protein, 20 aa, synthetic construct
  source 1..20: note = Seed: SATGFKQSSKALQRPVASDF
SATGYKQSSFALARPVASDF

SEQ ID NO: 21457 - protein, 20 aa, synthetic construct
  source 1..20: note = Seed: SATGFKQSSKALQRPVASDF
SATGYKQSSFALDRPVASDF

SEQ ID NO: 21458 - protein, 20 aa, synthetic construct
  source 1..20: note = Seed: SATGFKQSSKALQRPVASDF
SATGYKQSSFALERPVASDF

SEQ ID NO: 21459 - protein, 20 aa, synthetic construct
  source 1..20: note = Seed: SATGFKQSSKALQRPVASDF
SATGYKQSSFALFRPVASDF

SEQ ID NO: 21460 - protein, 20 aa, synthetic construct
  source 1..20: note = Seed: SATGFKQSSKALQRPVASDF
SATGYKQSSFALIRPVASDF

SEQ ID NO: 21461 - protein, 20 aa, synthetic construct
  source 1..20: note = Seed: SATGFKQSSKALQRPVASDF
SATGYKQSSFALLRPVASDF

SEQ ID NO: 21462 - protein, 20 aa, synthetic construct
  source 1..20: note = Seed: SATGFKQSSKALQRPVASDF
SATGYKQSSFALMRPVASDF

SEQ ID NO: 21463 - protein, 20 aa, synthetic construct
  source 1..20: note = Seed: SATGFKQSSKALQRPVASDF
SATGYKQSSFALNRPVASDF

SEQ ID NO: 21464 - protein, 20 aa, synthetic construct
  source 1..20: note = Seed: SATGFKQSSKALQRPVASDF
SATGYKQSSFALSRPVASDF

SEQ ID NO: 21465 - protein, 20 aa, synthetic construct
  source 1..20: note = Seed: SATGFKQSSKALQRPVASDF
SATGYKQSSFALTRPVASDF

SEQ ID NO: 21466 - protein, 20 aa, synthetic construct
  source 1..20: note = Seed: SATGFKQSSKALQRPVASDF
SATGYKQSSFALVRPVASDF

SEQ ID NO: 21467 - protein, 20 aa, synthetic construct
  source 1..20: note = Seed: SATGFKQSSKALQRPVASDF
SATGYKQSSGALARPVASDF

SEQ ID NO: 21468 - protein, 20 aa, synthetic construct
  source 1..20: note = Seed: SATGFKQSSKALQRPVASDF
SATGYKQSSGALFRPVASDF

SEQ ID NO: 21469 - protein, 20 aa, synthetic construct
  source 1..20: note = Seed: SATGFKQSSKALQRPVASDF
SATGYKQSSGALGRPVASDF

SEQ ID NO: 21470 - protein, 20 aa, synthetic construct
  source 1..20: note = Seed: SATGFKQSSKALQRPVASDF
SATGYKQSSGALIRPVASDF

SEQ ID NO: 21471 - protein, 20 aa, synthetic construct
  source 1..20: note = Seed: SATGFKQSSKALQRPVASDF
SATGYKQSSGALLRPVASDF

SEQ ID NO: 21472 - protein, 20 aa, synthetic construct
  source 1..20: note = Seed: SATGFKQSSKALQRPVASDF
SATGYKQSSGALMRPVASDF

SEQ ID NO: 21473 - protein, 20 aa, synthetic construct
  source 1..20: note = Seed: SATGFKQSSKALQRPVASDF
SATGYKQSSGALNRPVASDF

SEQ ID NO: 21474 - protein, 20 aa, synthetic construct
  source 1..20: note = Seed: SATGFKQSSKALQRPVASDF
SATGYKQSSGALSRPVASDF

SEQ ID NO: 21475 - protein, 20 aa, synthetic construct
  source 1..20: note = Seed: SATGFKQSSKALQRPVASDF
SATGYKQSSGALTRPVASDF

SEQ ID NO: 21476 - protein, 20 aa, synthetic construct
  source 1..20: note = Seed: SATGFKQSSKALQRPVASDF
SATGYKQSSGALVRPVASDF

SEQ ID NO: 21477 - protein, 20 aa, synthetic construct
  source 1..20: note = Seed: SATGFKQSSKALQRPVASDF
SATGYKQSSIALARPVASDF

SEQ ID NO: 21478 - protein, 20 aa, synthetic construct
  source 1..20: note = Seed: SATGFKQSSKALQRPVASDF
SATGYKQSSIALCRPVASDF

SEQ ID NO: 21479 - protein, 20 aa, synthetic construct
  source 1..20: note = Seed: SATGFKQSSKALQRPVASDF
SATGYKQSSIALGRPVASDF

SEQ ID NO: 21480 - protein, 20 aa, synthetic construct
  source 1..20: note = Seed: SATGFKQSSKALQRPVASDF
SATGYKQSSIALHRPVASDF

SEQ ID NO: 21481 - protein, 20 aa, synthetic construct
  source 1..20: note = Seed: SATGFKQSSKALQRPVASDF
SATGYKQSSIALIRPVASDF

SEQ ID NO: 21482 - protein, 20 aa, synthetic construct
  source 1..20: note = Seed: SATGFKQSSKALQRPVASDF
SATGYKQSSIALNRPVASDF

SEQ ID NO: 21483 - protein, 20 aa, synthetic construct
  source 1..20: note = Seed: SATGFKQSSKALQRPVASDF
SATGYKQSSIALSRPVASDF

SEQ ID NO: 21484 - protein, 20 aa, synthetic construct
  source 1..20: note = Seed: SATGFKQSSKALQRPVASDF
SATGYKQSSIALTRPVASDF

SEQ ID NO: 21485 - protein, 20 aa, synthetic construct
  source 1..20: note = Seed: SATGFKQSSKALQRPVASDF
SATGYKQSSIALVRPVASDF

SEQ ID NO: 21486 - protein, 20 aa, synthetic construct
  source 1..20: note = Seed: SATGFKQSSKALQRPVASDF
SATGYKQSSKALARPVASDF

SEQ ID NO: 21487 - protein, 20 aa, synthetic construct
  source 1..20: note = Seed: SATGFKQSSKALQRPVASDF
SATGYKQSSKALGRPVASDF

SEQ ID NO: 21488 - protein, 20 aa, synthetic construct
  source 1..20: note = Seed: SATGFKQSSKALQRPVASDF
SATGYKQSSKALHRPVASDF

SEQ ID NO: 21489 - protein, 20 aa, synthetic construct
  source 1..20: note = Seed: SATGFKQSSKALQRPVASDF
SATGYKQSSKALQRPVASDF

SEQ ID NO: 21490 - protein, 20 aa, synthetic construct
  source 1..20: note = Seed: SATGFKQSSKALQRPVASDF
SATGYKQSSKALSRPVASDF

SEQ ID NO: 21491 - protein, 20 aa, synthetic construct
  source 1..20: note = Seed: SATGFKQSSKALQRPVASDF
SATGYKQSSKALTRPVASDF

SEQ ID NO: 21492 - protein, 20 aa, synthetic construct
  source 1..20: note = Seed: SATGFKQSSKALQRPVASDF
SATGYKQSSLALGRPVASDF

SEQ ID NO: 21493 - protein, 20 aa, synthetic construct
  source 1..20: note = Seed: SATGFKQSSKALQRPVASDF
SATGYKQSSLALHRPVASDF

SEQ ID NO: 21494 - protein, 20 aa, synthetic construct
  source 1..20: note = Seed: SATGFKQSSKALQRPVASDF
SATGYKQSSLALNRPVASDF

SEQ ID NO: 21495 - protein, 20 aa, synthetic construct
  source 1..20: note = Seed: SATGFKQSSKALQRPVASDF
SATGYKQSSLALSRPVASDF

SEQ ID NO: 21496 - protein, 20 aa, synthetic construct
  source 1..20: note = Seed: SATGFKQSSKALQRPVASDF
SATGYKQSSLALVRPVASDF

SEQ ID NO: 21497 - protein, 20 aa, synthetic construct
  source 1..20: note = Seed: SATGFKQSSKALQRPVASDF
SATGYKQSSMALARPVASDF

SEQ ID NO: 21498 - protein, 20 aa, synthetic construct
  source 1..20: note = Seed: SATGFKQSSKALQRPVASDF
SATGYKQSSMALIRPVASDF

SEQ ID NO: 21499 - protein, 20 aa, synthetic construct
  source 1..20: note = Seed: SATGFKQSSKALQRPVASDF
SATGYKQSSMALNRPVASDF

SEQ ID NO: 21500 - protein, 20 aa, synthetic construct
  source 1..20: note = Seed: SATGFKQSSKALQRPVASDF
SATGYKQSSMALSRPVASDF

SEQ ID NO: 21501 - protein, 20 aa, synthetic construct
  source 1..20: note = Seed: SATGFKQSSKALQRPVASDF
SATGYKQSSMALTRPVASDF

SEQ ID NO: 21502 - protein, 20 aa, synthetic construct
  source 1..20: note = Seed: SATGFKQSSKALQRPVASDF
SATGYKQSSMALVRPVASDF

SEQ ID NO: 21503 - protein, 20 aa, synthetic construct
  source 1..20: note = Seed: SATGFKQSSKALQRPVASDF
SATGYKQSSNALARPVASDF

SEQ ID NO: 21504 - protein, 20 aa, synthetic construct
  source 1..20: note = Seed: SATGFKQSSKALQRPVASDF
SATGYKQSSNALIRPVASDF

SEQ ID NO: 21505 - protein, 20 aa, synthetic construct
  source 1..20: note = Seed: SATGFKQSSKALQRPVASDF
SATGYKQSSNALLRPVASDF

SEQ ID NO: 21506 - protein, 20 aa, synthetic construct
  source 1..20: note = Seed: SATGFKQSSKALQRPVASDF
SATGYKQSSNALMRPVASDF

SEQ ID NO: 21507 - protein, 20 aa, synthetic construct
  source 1..20: note = Seed: SATGFKQSSKALQRPVASDF
SATGYKQSSNALNRPVASDF

SEQ ID NO: 21508 - protein, 20 aa, synthetic construct
  source 1..20: note = Seed: SATGFKQSSKALQRPVASDF
SATGYKQSSNALSRPVASDF

SEQ ID NO: 21509 - protein, 20 aa, synthetic construct
  source 1..20: note = Seed: SATGFKQSSKALQRPVASDF
SATGYKQSSNALVRPVASDF

SEQ ID NO: 21510 - protein, 20 aa, synthetic construct
  source 1..20: note = Seed: SATGFKQSSKALQRPVASDF
SATGYKQSSPALARPVASDF

SEQ ID NO: 21511 - protein, 20 aa, synthetic construct
  source 1..20: note = Seed: SATGFKQSSKALQRPVASDF
SATGYKQSSPALFRPVASDF

SEQ ID NO: 21512 - protein, 20 aa, synthetic construct
  source 1..20: note = Seed: SATGFKQSSKALQRPVASDF
SATGYKQSSPALGRPVASDF

SEQ ID NO: 21513 - protein, 20 aa, synthetic construct
  source 1..20: note = Seed: SATGFKQSSKALQRPVASDF
SATGYKQSSPALHRPVASDF

SEQ ID NO: 21514 - protein, 20 aa, synthetic construct
  source 1..20: note = Seed: SATGFKQSSKALQRPVASDF
SATGYKQSSPALIRPVASDF

SEQ ID NO: 21515 - protein, 20 aa, synthetic construct
  source 1..20: note = Seed: SATGFKQSSKALQRPVASDF
SATGYKQSSPALLRPVASDF

SEQ ID NO: 21516 - protein, 20 aa, synthetic construct
  source 1..20: note = Seed: SATGFKQSSKALQRPVASDF
SATGYKQSSPALMRPVASDF

SEQ ID NO: 21517 - protein, 20 aa, synthetic construct
  source 1..20: note = Seed: SATGFKQSSKALQRPVASDF
SATGYKQSSPALNRPVASDF

SEQ ID NO: 21518 - protein, 20 aa, synthetic construct
  source 1..20: note = Seed: SATGFKQSSKALQRPVASDF
SATGYKQSSPALQRPVASDF

SEQ ID NO: 21519 - protein, 20 aa, synthetic construct
  source 1..20: note = Seed: SATGFKQSSKALQRPVASDF
SATGYKQSSPALSRPVASDF

SEQ ID NO: 21520 - protein, 20 aa, synthetic construct
  source 1..20: note = Seed: SATGFKQSSKALQRPVASDF
SATGYKQSSPALTRPVASDF

SEQ ID NO: 21521 - protein, 20 aa, synthetic construct
  source 1..20: note = Seed: SATGFKQSSKALQRPVASDF
SATGYKQSSPALVRPVASDF

SEQ ID NO: 21522 - protein, 20 aa, synthetic construct
  source 1..20: note = Seed: SATGFKQSSKALQRPVASDF
SATGYKQSSRALARPVASDF

SEQ ID NO: 21523 - protein, 20 aa, synthetic construct
  source 1..20: note = Seed: SATGFKQSSKALQRPVASDF
SATGYKQSSRALGRPVASDF

SEQ ID NO: 21524 - protein, 20 aa, synthetic construct
  source 1..20: note = Seed: SATGFKQSSKALQRPVASDF
SATGYKQSSRALHRPVASDF

SEQ ID NO: 21525 - protein, 20 aa, synthetic construct
  source 1..20: note = Seed: SATGFKQSSKALQRPVASDF
SATGYKQSSRALQRPVASDF

SEQ ID NO: 21526 - protein, 20 aa, synthetic construct
  source 1..20: note = Seed: SATGFKQSSKALQRPVASDF
SATGYKQSSRALRRPVASDF

SEQ ID NO: 21527 - protein, 20 aa, synthetic construct
  source 1..20: note = Seed: SATGFKQSSKALQRPVASDF
SATGYKQSSRALSRPVASDF

SEQ ID NO: 21528 - protein, 20 aa, synthetic construct
  source 1..20: note = Seed: SATGFKQSSKALQRPVASDF
SATGYKQSSRALTRPVASDF

SEQ ID NO: 21529 - protein, 20 aa, synthetic construct
  source 1..20: note = Seed: SATGFKQSSKALQRPVASDF
SATGYKQSSRALVRPVASDF

SEQ ID NO: 21530 - protein, 20 aa, synthetic construct
  source 1..20: note = Seed: SATGFKQSSKALQRPVASDF
SATGYKQSSSALARPVASDF

SEQ ID NO: 21531 - protein, 20 aa, synthetic construct
  source 1..20: note = Seed: SATGFKQSSKALQRPVASDF
SATGYKQSSSALFRPVASDF

SEQ ID NO: 21532 - protein, 20 aa, synthetic construct
  source 1..20: note = Seed: SATGFKQSSKALQRPVASDF
SATGYKQSSSALGRPVASDF

SEQ ID NO: 21533 - protein, 20 aa, synthetic construct
  source 1..20: note = Seed: SATGFKQSSKALQRPVASDF
SATGYKQSSSALHRPVASDF

SEQ ID NO: 21534 - protein, 20 aa, synthetic construct
  source 1..20: note = Seed: SATGFKQSSKALQRPVASDF
SATGYKQSSSALIRPVASDF

SEQ ID NO: 21535 - protein, 20 aa, synthetic construct
  source 1..20: note = Seed: SATGFKQSSKALQRPVASDF
SATGYKQSSSALLRPVASDF

SEQ ID NO: 21536 - protein, 20 aa, synthetic construct
  source 1..20: note = Seed: SATGFKQSSKALQRPVASDF
SATGYKQSSSALMRPVASDF

SEQ ID NO: 21537 - protein, 20 aa, synthetic construct
  source 1..20: note = Seed: SATGFKQSSKALQRPVASDF
SATGYKQSSSALNRPVASDF

SEQ ID NO: 21538 - protein, 20 aa, synthetic construct
  source 1..20: note = Seed: SATGFKQSSKALQRPVASDF
SATGYKQSSSALQRPVASDF

SEQ ID NO: 21539 - protein, 20 aa, synthetic construct
  source 1..20: note = Seed: SATGFKQSSKALQRPVASDF
SATGYKQSSSALSRPVASDF

SEQ ID NO: 21540 - protein, 20 aa, synthetic construct
  source 1..20: note = Seed: SATGFKQSSKALQRPVASDF
SATGYKQSSSALTRPVASDF

SEQ ID NO: 21541 - protein, 20 aa, synthetic construct
  source 1..20: note = Seed: SATGFKQSSKALQRPVASDF
SATGYKQSSSALVRPVASDF

SEQ ID NO: 21542 - protein, 20 aa, synthetic construct
  source 1..20: note = Seed: SATGFKQSSKALQRPVASDF
SATGYKQSSTALARPVASDF

SEQ ID NO: 21543 - protein, 20 aa, synthetic construct
  source 1..20: note = Seed: SATGFKQSSKALQRPVASDF
SATGYKQSSTALGRPVASDF

SEQ ID NO: 21544 - protein, 20 aa, synthetic construct
  source 1..20: note = Seed: SATGFKQSSKALQRPVASDF
SATGYKQSSTALHRPVASDF

SEQ ID NO: 21545 - protein, 20 aa, synthetic construct
  source 1..20: note = Seed: SATGFKQSSKALQRPVASDF
SATGYKQSSTALIRPVASDF

SEQ ID NO: 21546 - protein, 20 aa, synthetic construct
  source 1..20: note = Seed: SATGFKQSSKALQRPVASDF
SATGYKQSSTALLRPVASDF

SEQ ID NO: 21547 - protein, 20 aa, synthetic construct
  source 1..20: note = Seed: SATGFKQSSKALQRPVASDF
SATGYKQSSTALMRPVASDF

SEQ ID NO: 21548 - protein, 20 aa, synthetic construct
  source 1..20: note = Seed: SATGFKQSSKALQRPVASDF
SATGYKQSSTALNRPVASDF

SEQ ID NO: 21549 - protein, 20 aa, synthetic construct
  source 1..20: note = Seed: SATGFKQSSKALQRPVASDF
SATGYKQSSTALQRPVASDF

SEQ ID NO: 21550 - protein, 20 aa, synthetic construct
  source 1..20: note = Seed: SATGFKQSSKALQRPVASDF
SATGYKQSSTALSRPVASDF

SEQ ID NO: 21551 - protein, 20 aa, synthetic construct
  source 1..20: note = Seed: SATGFKQSSKALQRPVASDF
SATGYKQSSTALTRPVASDF

SEQ ID NO: 21552 - protein, 20 aa, synthetic construct
  source 1..20: note = Seed: SATGFKQSSKALQRPVASDF
SATGYKQSSTALVRPVASDF

SEQ ID NO: 21553 - protein, 20 aa, synthetic construct
  source 1..20: note = Seed: SATGFKQSSKALQRPVASDF
SATGYKQSSVALARPVASDF

SEQ ID NO: 21554 - protein, 20 aa, synthetic construct
  source 1..20: note = Seed: SATGFKQSSKALQRPVASDF
SATGYKQSSVALERPVASDF

SEQ ID NO: 21555 - protein, 20 aa, synthetic construct
  source 1..20: note = Seed: SATGFKQSSKALQRPVASDF
SATGYKQSSVALFRPVASDF

SEQ ID NO: 21556 - protein, 20 aa, synthetic construct
  source 1..20: note = Seed: SATGFKQSSKALQRPVASDF
SATGYKQSSVALGRPVASDF

SEQ ID NO: 21557 - protein, 20 aa, synthetic construct
  source 1..20: note = Seed: SATGFKQSSKALQRPVASDF
SATGYKQSSVALHRPVASDF

SEQ ID NO: 21558 - protein, 20 aa, synthetic construct
  source 1..20: note = Seed: SATGFKQSSKALQRPVASDF
SATGYKQSSVALIRPVASDF

SEQ ID NO: 21559 - protein, 20 aa, synthetic construct
  source 1..20: note = Seed: SATGFKQSSKALQRPVASDF
SATGYKQSSVALLRPVASDF

SEQ ID NO: 21560 - protein, 20 aa, synthetic construct
  source 1..20: note = Seed: SATGFKQSSKALQRPVASDF
SATGYKQSSVALMRPVASDF

SEQ ID NO: 21561 - protein, 20 aa, synthetic construct
  source 1..20: note = Seed: SATGFKQSSKALQRPVASDF
SATGYKQSSVALNRPVASDF

SEQ ID NO: 21562 - protein, 20 aa, synthetic construct
  source 1..20: note = Seed: SATGFKQSSKALQRPVASDF
SATGYKQSSVALQRPVASDF

SEQ ID NO: 21563 - protein, 20 aa, synthetic construct
  source 1..20: note = Seed: SATGFKQSSKALQRPVASDF
SATGYKQSSVALSRPVASDF

SEQ ID NO: 21564 - protein, 20 aa, synthetic construct
  source 1..20: note = Seed: SATGFKQSSKALQRPVASDF
SATGYKQSSVALTRPVASDF

SEQ ID NO: 21565 - protein, 20 aa, synthetic construct
  source 1..20: note = Seed: SATGFKQSSKALQRPVASDF
SATGYKQSSVALVRPVASDF

SEQ ID NO: 21566 - protein, 20 aa, synthetic construct
  source 1..20: note = Seed: SATGFKQSSKALQRPVASDF
SATGYKQTSAALARPVASDF

SEQ ID NO: 21567 - protein, 20 aa, synthetic construct
  source 1..20: note = Seed: SATGFKQSSKALQRPVASDF
SATGYKQTSAALFRPVASDF

SEQ ID NO: 21568 - protein, 20 aa, synthetic construct
  source 1..20: note = Seed: SATGFKQSSKALQRPVASDF
SATGYKQTSAALGRPVASDF

SEQ ID NO: 21569 - protein, 20 aa, synthetic construct
  source 1..20: note = Seed: SATGFKQSSKALQRPVASDF
SATGYKQTSAALHRPVASDF

SEQ ID NO: 21570 - protein, 20 aa, synthetic construct
  source 1..20: note = Seed: SATGFKQSSKALQRPVASDF
SATGYKQTSAALIRPVASDF

SEQ ID NO: 21571 - protein, 20 aa, synthetic construct
  source 1..20: note = Seed: SATGFKQSSKALQRPVASDF
SATGYKQTSAALLRPVASDF

SEQ ID NO: 21572 - protein, 20 aa, synthetic construct
  source 1..20: note = Seed: SATGFKQSSKALQRPVASDF
SATGYKQTSAALMRPVASDF

SEQ ID NO: 21573 - protein, 20 aa, synthetic construct
  source 1..20: note = Seed: SATGFKQSSKALQRPVASDF
SATGYKQTSAALNRPVASDF

SEQ ID NO: 21574 - protein, 20 aa, synthetic construct
  source 1..20: note = Seed: SATGFKQSSKALQRPVASDF
SATGYKQTSAALPRPVASDF

SEQ ID NO: 21575 - protein, 20 aa, synthetic construct
  source 1..20: note = Seed: SATGFKQSSKALQRPVASDF
SATGYKQTSAALQRPVASDF

SEQ ID NO: 21576 - protein, 20 aa, synthetic construct
  source 1..20: note = Seed: SATGFKQSSKALQRPVASDF
SATGYKQTSAALSRPVASDF

SEQ ID NO: 21577 - protein, 20 aa, synthetic construct
  source 1..20: note = Seed: SATGFKQSSKALQRPVASDF
SATGYKQTSAALTRPVASDF

SEQ ID NO: 21578 - protein, 20 aa, synthetic construct
  source 1..20: note = Seed: SATGFKQSSKALQRPVASDF
SATGYKQTSAALVRPVASDF

SEQ ID NO: 21579 - protein, 20 aa, synthetic construct
  source 1..20: note = Seed: SATGFKQSSKALQRPVASDF
SATGYKQTSFALARPVASDF

SEQ ID NO: 21580 - protein, 20 aa, synthetic construct
  source 1..20: note = Seed: SATGFKQSSKALQRPVASDF
SATGYKQTSFALDRPVASDF

SEQ ID NO: 21581 - protein, 20 aa, synthetic construct
  source 1..20: note = Seed: SATGFKQSSKALQRPVASDF
SATGYKQTSFALERPVASDF

SEQ ID NO: 21582 - protein, 20 aa, synthetic construct
  source 1..20: note = Seed: SATGFKQSSKALQRPVASDF
SATGYKQTSFALFRPVASDF

SEQ ID NO: 21583 - protein, 20 aa, synthetic construct
  source 1..20: note = Seed: SATGFKQSSKALQRPVASDF
SATGYKQTSFALIRPVASDF

SEQ ID NO: 21584 - protein, 20 aa, synthetic construct
  source 1..20: note = Seed: SATGFKQSSKALQRPVASDF
SATGYKQTSFALLRPVASDF

SEQ ID NO: 21585 - protein, 20 aa, synthetic construct
  source 1..20: note = Seed: SATGFKQSSKALQRPVASDF
SATGYKQTSFALMRPVASDF

SEQ ID NO: 21586 - protein, 20 aa, synthetic construct
  source 1..20: note = Seed: SATGFKQSSKALQRPVASDF
SATGYKQTSFALNRPVASDF

SEQ ID NO: 21587 - protein, 20 aa, synthetic construct
  source 1..20: note = Seed: SATGFKQSSKALQRPVASDF
SATGYKQTSFALSRPVASDF

SEQ ID NO: 21588 - protein, 20 aa, synthetic construct
  source 1..20: note = Seed: SATGFKQSSKALQRPVASDF
SATGYKQTSFALTRPVASDF

SEQ ID NO: 21589 - protein, 20 aa, synthetic construct
  source 1..20: note = Seed: SATGFKQSSKALQRPVASDF
SATGYKQTSFALVRPVASDF

SEQ ID NO: 21590 - protein, 20 aa, synthetic construct
  source 1..20: note = Seed: SATGFKQSSKALQRPVASDF
SATGYKQTSGALARPVASDF

SEQ ID NO: 21591 - protein, 20 aa, synthetic construct
  source 1..20: note = Seed: SATGFKQSSKALQRPVASDF
SATGYKQTSGALIRPVASDF

SEQ ID NO: 21592 - protein, 20 aa, synthetic construct
  source 1..20: note = Seed: SATGFKQSSKALQRPVASDF
SATGYKQTSGALLRPVASDF

SEQ ID NO: 21593 - protein, 20 aa, synthetic construct
  source 1..20: note = Seed: SATGFKQSSKALQRPVASDF
SATGYKQTSGALMRPVASDF

SEQ ID NO: 21594 - protein, 20 aa, synthetic construct
  source 1..20: note = Seed: SATGFKQSSKALQRPVASDF
SATGYKQTSGALNRPVASDF

SEQ ID NO: 21595 - protein, 20 aa, synthetic construct
  source 1..20: note = Seed: SATGFKQSSKALQRPVASDF
SATGYKQTSGALSRPVASDF

SEQ ID NO: 21596 - protein, 20 aa, synthetic construct
  source 1..20: note = Seed: SATGFKQSSKALQRPVASDF
SATGYKQTSGALTRPVASDF

SEQ ID NO: 21597 - protein, 20 aa, synthetic construct
  source 1..20: note = Seed: SATGFKQSSKALQRPVASDF
SATGYKQTSGALVRPVASDF

SEQ ID NO: 21598 - protein, 20 aa, synthetic construct
  source 1..20: note = Seed: SATGFKQSSKALQRPVASDF
SATGYKQTSIALARPVASDF

SEQ ID NO: 21599 - protein, 20 aa, synthetic construct
  source 1..20: note = Seed: SATGFKQSSKALQRPVASDF
SATGYKQTSIALGRPVASDF

SEQ ID NO: 21600 - protein, 20 aa, synthetic construct
  source 1..20: note = Seed: SATGFKQSSKALQRPVASDF
SATGYKQTSIALHRPVASDF

SEQ ID NO: 21601 - protein, 20 aa, synthetic construct
  source 1..20: note = Seed: SATGFKQSSKALQRPVASDF
SATGYKQTSIALIRPVASDF

SEQ ID NO: 21602 - protein, 20 aa, synthetic construct
  source 1..20: note = Seed: SATGFKQSSKALQRPVASDF
SATGYKQTSIALNRPVASDF

SEQ ID NO: 21603 - protein, 20 aa, synthetic construct
  source 1..20: note = Seed: SATGFKQSSKALQRPVASDF
SATGYKQTSIALSRPVASDF

SEQ ID NO: 21604 - protein, 20 aa, synthetic construct
  source 1..20: note = Seed: SATGFKQSSKALQRPVASDF
SATGYKQTSIALTRPVASDF

SEQ ID NO: 21605 - protein, 20 aa, synthetic construct
  source 1..20: note = Seed: SATGFKQSSKALQRPVASDF
SATGYKQTSIALVRPVASDF

SEQ ID NO: 21606 - protein, 20 aa, synthetic construct
  source 1..20: note = Seed: SATGFKQSSKALQRPVASDF
SATGYKQTSKALARPVASDF

SEQ ID NO: 21607 - protein, 20 aa, synthetic construct
  source 1..20: note = Seed: SATGFKQSSKALQRPVASDF
SATGYKQTSKALGRPVASDF

SEQ ID NO: 21608 - protein, 20 aa, synthetic construct
  source 1..20: note = Seed: SATGFKQSSKALQRPVASDF
SATGYKQTSKALSRPVASDF

SEQ ID NO: 21609 - protein, 20 aa, synthetic construct
  source 1..20: note = Seed: SATGFKQSSKALQRPVASDF
SATGYKQTSKALTRPVASDF

SEQ ID NO: 21610 - protein, 20 aa, synthetic construct
  source 1..20: note = Seed: SATGFKQSSKALQRPVASDF
SATGYKQTSLALGRPVASDF

SEQ ID NO: 21611 - protein, 20 aa, synthetic construct
  source 1..20: note = Seed: SATGFKQSSKALQRPVASDF
SATGYKQTSLALHRPVASDF

SEQ ID NO: 21612 - protein, 20 aa, synthetic construct
  source 1..20: note = Seed: SATGFKQSSKALQRPVASDF
SATGYKQTSLALIRPVASDF

SEQ ID NO: 21613 - protein, 20 aa, synthetic construct
  source 1..20: note = Seed: SATGFKQSSKALQRPVASDF
SATGYKQTSLALNRPVASDF

SEQ ID NO: 21614 - protein, 20 aa, synthetic construct
  source 1..20: note = Seed: SATGFKQSSKALQRPVASDF
SATGYKQTSLALSRPVASDF

SEQ ID NO: 21615 - protein, 20 aa, synthetic construct
  source 1..20: note = Seed: SATGFKQSSKALQRPVASDF
SATGYKQTSLALVRPVASDF

SEQ ID NO: 21616 - protein, 20 aa, synthetic construct
  source 1..20: note = Seed: SATGFKQSSKALQRPVASDF
SATGYKQTSMALARPVASDF

SEQ ID NO: 21617 - protein, 20 aa, synthetic construct
  source 1..20: note = Seed: SATGFKQSSKALQRPVASDF
SATGYKQTSMALIRPVASDF

SEQ ID NO: 21618 - protein, 20 aa, synthetic construct
  source 1..20: note = Seed: SATGFKQSSKALQRPVASDF
SATGYKQTSMALNRPVASDF

SEQ ID NO: 21619 - protein, 20 aa, synthetic construct
  source 1..20: note = Seed: SATGFKQSSKALQRPVASDF
SATGYKQTSMALSRPVASDF

SEQ ID NO: 21620 - protein, 20 aa, synthetic construct
  source 1..20: note = Seed: SATGFKQSSKALQRPVASDF
SATGYKQTSMALTRPVASDF

SEQ ID NO: 21621 - protein, 20 aa, synthetic construct
  source 1..20: note = Seed: SATGFKQSSKALQRPVASDF
SATGYKQTSMALVRPVASDF

SEQ ID NO: 21622 - protein, 20 aa, synthetic construct
  source 1..20: note = Seed: SATGFKQSSKALQRPVASDF
SATGYKQTSNALARPVASDF

SEQ ID NO: 21623 - protein, 20 aa, synthetic construct
  source 1..20: note = Seed: SATGFKQSSKALQRPVASDF
SATGYKQTSNALIRPVASDF

SEQ ID NO: 21624 - protein, 20 aa, synthetic construct
  source 1..20: note = Seed: SATGFKQSSKALQRPVASDF
SATGYKQTSNALLRPVASDF

SEQ ID NO: 21625 - protein, 20 aa, synthetic construct
  source 1..20: note = Seed: SATGFKQSSKALQRPVASDF
SATGYKQTSNALNRPVASDF

SEQ ID NO: 21626 - protein, 20 aa, synthetic construct
  source 1..20: note = Seed: SATGFKQSSKALQRPVASDF
SATGYKQTSNALSRPVASDF

SEQ ID NO: 21627 - protein, 20 aa, synthetic construct
  source 1..20: note = Seed: SATGFKQSSKALQRPVASDF
SATGYKQTSNALVRPVASDF

SEQ ID NO: 21628 - protein, 20 aa, synthetic construct
  source 1..20: note = Seed: SATGFKQSSKALQRPVASDF
SATGYKQTSPALARPVASDF

SEQ ID NO: 21629 - protein, 20 aa, synthetic construct
  source 1..20: note = Seed: SATGFKQSSKALQRPVASDF
SATGYKQTSPALGRPVASDF

SEQ ID NO: 21630 - protein, 20 aa, synthetic construct
  source 1..20: note = Seed: SATGFKQSSKALQRPVASDF
SATGYKQTSPALIRPVASDF

SEQ ID NO: 21631 - protein, 20 aa, synthetic construct
  source 1..20: note = Seed: SATGFKQSSKALQRPVASDF
SATGYKQTSPALLRPVASDF

SEQ ID NO: 21632 - protein, 20 aa, synthetic construct
  source 1..20: note = Seed: SATGFKQSSKALQRPVASDF
SATGYKQTSPALMRPVASDF

SEQ ID NO: 21633 - protein, 20 aa, synthetic construct
  source 1..20: note = Seed: SATGFKQSSKALQRPVASDF
SATGYKQTSPALNRPVASDF

SEQ ID NO: 21634 - protein, 20 aa, synthetic construct
  source 1..20: note = Seed: SATGFKQSSKALQRPVASDF
SATGYKQTSPALQRPVASDF

SEQ ID NO: 21635 - protein, 20 aa, synthetic construct
  source 1..20: note = Seed: SATGFKQSSKALQRPVASDF
SATGYKQTSPALSRPVASDF

SEQ ID NO: 21636 - protein, 20 aa, synthetic construct
  source 1..20: note = Seed: SATGFKQSSKALQRPVASDF
SATGYKQTSPALTRPVASDF

SEQ ID NO: 21637 - protein, 20 aa, synthetic construct
  source 1..20: note = Seed: SATGFKQSSKALQRPVASDF
SATGYKQTSPALVRPVASDF

SEQ ID NO: 21638 - protein, 20 aa, synthetic construct
  source 1..20: note = Seed: SATGFKQSSKALQRPVASDF
SATGYKQTSRALARPVASDF

SEQ ID NO: 21639 - protein, 20 aa, synthetic construct
  source 1..20: note = Seed: SATGFKQSSKALQRPVASDF
SATGYKQTSRALGRPVASDF

SEQ ID NO: 21640 - protein, 20 aa, synthetic construct
  source 1..20: note = Seed: SATGFKQSSKALQRPVASDF
SATGYKQTSRALHRPVASDF

SEQ ID NO: 21641 - protein, 20 aa, synthetic construct
  source 1..20: note = Seed: SATGFKQSSKALQRPVASDF
SATGYKQTSRALQRPVASDF

SEQ ID NO: 21642 - protein, 20 aa, synthetic construct
  source 1..20: note = Seed: SATGFKQSSKALQRPVASDF
SATGYKQTSRALRRPVASDF

SEQ ID NO: 21643 - protein, 20 aa, synthetic construct
  source 1..20: note = Seed: SATGFKQSSKALQRPVASDF
SATGYKQTSRALSRPVASDF

SEQ ID NO: 21644 - protein, 20 aa, synthetic construct
  source 1..20: note = Seed: SATGFKQSSKALQRPVASDF
SATGYKQTSRALTRPVASDF

SEQ ID NO: 21645 - protein, 20 aa, synthetic construct
  source 1..20: note = Seed: SATGFKQSSKALQRPVASDF
SATGYKQTSRALVRPVASDF

SEQ ID NO: 21646 - protein, 20 aa, synthetic construct
  source 1..20: note = Seed: SATGFKQSSKALQRPVASDF
SATGYKQTSSALARPVASDF

SEQ ID NO: 21647 - protein, 20 aa, synthetic construct
  source 1..20: note = Seed: SATGFKQSSKALQRPVASDF
SATGYKQTSSALGRPVASDF

SEQ ID NO: 21648 - protein, 20 aa, synthetic construct
  source 1..20: note = Seed: SATGFKQSSKALQRPVASDF
SATGYKQTSSALIRPVASDF

SEQ ID NO: 21649 - protein, 20 aa, synthetic construct
  source 1..20: note = Seed: SATGFKQSSKALQRPVASDF
SATGYKQTSSALLRPVASDF

SEQ ID NO: 21650 - protein, 20 aa, synthetic construct
  source 1..20: note = Seed: SATGFKQSSKALQRPVASDF
SATGYKQTSSALMRPVASDF

SEQ ID NO: 21651 - protein, 20 aa, synthetic construct
  source 1..20: note = Seed: SATGFKQSSKALQRPVASDF
SATGYKQTSSALNRPVASDF

SEQ ID NO: 21652 - protein, 20 aa, synthetic construct
  source 1..20: note = Seed: SATGFKQSSKALQRPVASDF
SATGYKQTSSALSRPVASDF

SEQ ID NO: 21653 - protein, 20 aa, synthetic construct
  source 1..20: note = Seed: SATGFKQSSKALQRPVASDF
SATGYKQTSSALTRPVASDF

SEQ ID NO: 21654 - protein, 20 aa, synthetic construct
  source 1..20: note = Seed: SATGFKQSSKALQRPVASDF
SATGYKQTSSALVRPVASDF

SEQ ID NO: 21655 - protein, 20 aa, synthetic construct
  source 1..20: note = Seed: SATGFKQSSKALQRPVASDF
SATGYKQTSTALARPVASDF

SEQ ID NO: 21656 - protein, 20 aa, synthetic construct
  source 1..20: note = Seed: SATGFKQSSKALQRPVASDF
SATGYKQTSTALIRPVASDF

SEQ ID NO: 21657 - protein, 20 aa, synthetic construct
  source 1..20: note = Seed: SATGFKQSSKALQRPVASDF
SATGYKQTSTALLRPVASDF

SEQ ID NO: 21658 - protein, 20 aa, synthetic construct
  source 1..20: note = Seed: SATGFKQSSKALQRPVASDF
SATGYKQTSTALMRPVASDF

SEQ ID NO: 21659 - protein, 20 aa, synthetic construct
  source 1..20: note = Seed: SATGFKQSSKALQRPVASDF
SATGYKQTSTALNRPVASDF

SEQ ID NO: 21660 - protein, 20 aa, synthetic construct
  source 1..20: note = Seed: SATGFKQSSKALQRPVASDF
SATGYKQTSTALSRPVASDF

SEQ ID NO: 21661 - protein, 20 aa, synthetic construct
  source 1..20: note = Seed: SATGFKQSSKALQRPVASDF
SATGYKQTSTALTRPVASDF

SEQ ID NO: 21662 - protein, 20 aa, synthetic construct
  source 1..20: note = Seed: SATGFKQSSKALQRPVASDF
SATGYKQTSTALVRPVASDF

SEQ ID NO: 21663 - protein, 20 aa, synthetic construct
  source 1..20: note = Seed: SATGFKQSSKALQRPVASDF
SATGYKQTSVALARPVASDF

SEQ ID NO: 21664 - protein, 20 aa, synthetic construct
  source 1..20: note = Seed: SATGFKQSSKALQRPVASDF
SATGYKQTSVALFRPVASDF

SEQ ID NO: 21665 - protein, 20 aa, synthetic construct
  source 1..20: note = Seed: SATGFKQSSKALQRPVASDF
SATGYKQTSVALGRPVASDF

SEQ ID NO: 21666 - protein, 20 aa, synthetic construct
  source 1..20: note = Seed: SATGFKQSSKALQRPVASDF
SATGYKQTSVALHRPVASDF

SEQ ID NO: 21667 - protein, 20 aa, synthetic construct
  source 1..20: note = Seed: SATGFKQSSKALQRPVASDF
SATGYKQTSVALIRPVASDF

SEQ ID NO: 21668 - protein, 20 aa, synthetic construct
  source 1..20: note = Seed: SATGFKQSSKALQRPVASDF
SATGYKQTSVALLRPVASDF

SEQ ID NO: 21669 - protein, 20 aa, synthetic construct
  source 1..20: note = Seed: SATGFKQSSKALQRPVASDF
SATGYKQTSVALMRPVASDF

SEQ ID NO: 21670 - protein, 20 aa, synthetic construct
  source 1..20: note = Seed: SATGFKQSSKALQRPVASDF
SATGYKQTSVALNRPVASDF

SEQ ID NO: 21671 - protein, 20 aa, synthetic construct
  source 1..20: note = Seed: SATGFKQSSKALQRPVASDF
SATGYKQTSVALQRPVASDF

SEQ ID NO: 21672 - protein, 20 aa, synthetic construct
  source 1..20: note = Seed: SATGFKQSSKALQRPVASDF
SATGYKQTSVALSRPVASDF

SEQ ID NO: 21673 - protein, 20 aa, synthetic construct
  source 1..20: note = Seed: SATGFKQSSKALQRPVASDF
SATGYKQTSVALTRPVASDF

SEQ ID NO: 21674 - protein, 20 aa, synthetic construct
  source 1..20: note = Seed: SATGFKQSSKALQRPVASDF
SATGYKQTSVALVRPVASDF

SEQ ID NO: 21675 - protein, 20 aa, synthetic construct
  source 1..20: note = Seed: SATGFKQSSKALQRPVASDF
SATGYKQTSYALIRPVASDF

SEQ ID NO: 21676 - protein, 20 aa, synthetic construct
  source 1..20: note = Seed: SATGFKQSSKALQRPVASDF
SATGYKQTSYALLRPVASDF

SEQ ID NO: 21677 - protein, 20 aa, synthetic construct
  source 1..20: note = Seed: SATGFKQSSKALQRPVASDF
SATGYKQTSYALVRPVASDF

SEQ ID NO: 21678 - protein, 20 aa, synthetic construct
  source 1..20: note = Seed: SATGFKQSSKALQRPVASDF
SATGYKQVSAALARPVASDF

SEQ ID NO: 21679 - protein, 20 aa, synthetic construct
  source 1..20: note = Seed: SATGFKQSSKALQRPVASDF
SATGYKQVSAALCRPVASDF

SEQ ID NO: 21680 - protein, 20 aa, synthetic construct
  source 1..20: note = Seed: SATGFKQSSKALQRPVASDF
SATGYKQVSAALDRPVASDF

SEQ ID NO: 21681 - protein, 20 aa, synthetic construct
  source 1..20: note = Seed: SATGFKQSSKALQRPVASDF
SATGYKQVSAALERPVASDF

SEQ ID NO: 21682 - protein, 20 aa, synthetic construct
  source 1..20: note = Seed: SATGFKQSSKALQRPVASDF
SATGYKQVSAALFRPVASDF

SEQ ID NO: 21683 - protein, 20 aa, synthetic construct
  source 1..20: note = Seed: SATGFKQSSKALQRPVASDF
SATGYKQVSAALGRPVASDF

SEQ ID NO: 21684 - protein, 20 aa, synthetic construct
  source 1..20: note = Seed: SATGFKQSSKALQRPVASDF
SATGYKQVSAALHRPVASDF

SEQ ID NO: 21685 - protein, 20 aa, synthetic construct
  source 1..20: note = Seed: SATGFKQSSKALQRPVASDF
SATGYKQVSAALIRPVASDF

SEQ ID NO: 21686 - protein, 20 aa, synthetic construct
  source 1..20: note = Seed: SATGFKQSSKALQRPVASDF
SATGYKQVSAALKRPVASDF

SEQ ID NO: 21687 - protein, 20 aa, synthetic construct
  source 1..20: note = Seed: SATGFKQSSKALQRPVASDF
SATGYKQVSAALLRPVASDF

SEQ ID NO: 21688 - protein, 20 aa, synthetic construct
  source 1..20: note = Seed: SATGFKQSSKALQRPVASDF
SATGYKQVSAALMRPVASDF

SEQ ID NO: 21689 - protein, 20 aa, synthetic construct
  source 1..20: note = Seed: SATGFKQSSKALQRPVASDF
SATGYKQVSAALNRPVASDF

SEQ ID NO: 21690 - protein, 20 aa, synthetic construct
  source 1..20: note = Seed: SATGFKQSSKALQRPVASDF
SATGYKQVSAALPRPVASDF

SEQ ID NO: 21691 - protein, 20 aa, synthetic construct
  source 1..20: note = Seed: SATGFKQSSKALQRPVASDF
SATGYKQVSAALQRPVASDF

SEQ ID NO: 21692 - protein, 20 aa, synthetic construct
  source 1..20: note = Seed: SATGFKQSSKALQRPVASDF
SATGYKQVSAALRRPVASDF

SEQ ID NO: 21693 - protein, 20 aa, synthetic construct
  source 1..20: note = Seed: SATGFKQSSKALQRPVASDF
SATGYKQVSAALSRPVASDF

SEQ ID NO: 21694 - protein, 20 aa, synthetic construct
  source 1..20: note = Seed: SATGFKQSSKALQRPVASDF
SATGYKQVSAALTRPVASDF

SEQ ID NO: 21695 - protein, 20 aa, synthetic construct
  source 1..20: note = Seed: SATGFKQSSKALQRPVASDF
SATGYKQVSAALVRPVASDF

SEQ ID NO: 21696 - protein, 20 aa, synthetic construct
  source 1..20: note = Seed: SATGFKQSSKALQRPVASDF
SATGYKQVSAALWRPVASDF

SEQ ID NO: 21697 - protein, 20 aa, synthetic construct
  source 1..20: note = Seed: SATGFKQSSKALQRPVASDF
SATGYKQVSAALYRPVASDF

SEQ ID NO: 21698 - protein, 20 aa, synthetic construct
  source 1..20: note = Seed: SATGFKQSSKALQRPVASDF
SATGYKQVSCALARPVASDF

SEQ ID NO: 21699 - protein, 20 aa, synthetic construct
  source 1..20: note = Seed: SATGFKQSSKALQRPVASDF
SATGYKQVSCALNRPVASDF

SEQ ID NO: 21700 - protein, 20 aa, synthetic construct
  source 1..20: note = Seed: SATGFKQSSKALQRPVASDF
SATGYKQVSCALSRPVASDF

SEQ ID NO: 21701 - protein, 20 aa, synthetic construct
  source 1..20: note = Seed: SATGFKQSSKALQRPVASDF
SATGYKQVSCALVRPVASDF

SEQ ID NO: 21702 - protein, 20 aa, synthetic construct
  source 1..20: note = Seed: SATGFKQSSKALQRPVASDF
SATGYKQVSEALARPVASDF

SEQ ID NO: 21703 - protein, 20 aa, synthetic construct
  source 1..20: note = Seed: SATGFKQSSKALQRPVASDF
SATGYKQVSEALSRPVASDF

SEQ ID NO: 21704 - protein, 20 aa, synthetic construct
  source 1..20: note = Seed: SATGFKQSSKALQRPVASDF
SATGYKQVSFALARPVASDF

SEQ ID NO: 21705 - protein, 20 aa, synthetic construct
  source 1..20: note = Seed: SATGFKQSSKALQRPVASDF
SATGYKQVSFALDRPVASDF

SEQ ID NO: 21706 - protein, 20 aa, synthetic construct
  source 1..20: note = Seed: SATGFKQSSKALQRPVASDF
SATGYKQVSFALERPVASDF

SEQ ID NO: 21707 - protein, 20 aa, synthetic construct
  source 1..20: note = Seed: SATGFKQSSKALQRPVASDF
SATGYKQVSFALIRPVASDF

SEQ ID NO: 21708 - protein, 20 aa, synthetic construct
  source 1..20: note = Seed: SATGFKQSSKALQRPVASDF
SATGYKQVSFALLRPVASDF

SEQ ID NO: 21709 - protein, 20 aa, synthetic construct
  source 1..20: note = Seed: SATGFKQSSKALQRPVASDF
SATGYKQVSFALMRPVASDF

SEQ ID NO: 21710 - protein, 20 aa, synthetic construct
  source 1..20: note = Seed: SATGFKQSSKALQRPVASDF
SATGYKQVSFALNRPVASDF

SEQ ID NO: 21711 - protein, 20 aa, synthetic construct
  source 1..20: note = Seed: SATGFKQSSKALQRPVASDF
SATGYKQVSFALSRPVASDF

SEQ ID NO: 21712 - protein, 20 aa, synthetic construct
  source 1..20: note = Seed: SATGFKQSSKALQRPVASDF
SATGYKQVSFALTRPVASDF

SEQ ID NO: 21713 - protein, 20 aa, synthetic construct
  source 1..20: note = Seed: SATGFKQSSKALQRPVASDF
SATGYKQVSFALVRPVASDF

SEQ ID NO: 21714 - protein, 20 aa, synthetic construct
  source 1..20: note = Seed: SATGFKQSSKALQRPVASDF
SATGYKQVSFALYRPVASDF

SEQ ID NO: 21715 - protein, 20 aa, synthetic construct
  source 1..20: note = Seed: SATGFKQSSKALQRPVASDF
SATGYKQVSGALARPVASDF

SEQ ID NO: 21716 - protein, 20 aa, synthetic construct
  source 1..20: note = Seed: SATGFKQSSKALQRPVASDF
SATGYKQVSGALCRPVASDF

SEQ ID NO: 21717 - protein, 20 aa, synthetic construct
  source 1..20: note = Seed: SATGFKQSSKALQRPVASDF
SATGYKQVSGALDRPVASDF

SEQ ID NO: 21718 - protein, 20 aa, synthetic construct
  source 1..20: note = Seed: SATGFKQSSKALQRPVASDF
SATGYKQVSGALFRPVASDF

SEQ ID NO: 21719 - protein, 20 aa, synthetic construct
  source 1..20: note = Seed: SATGFKQSSKALQRPVASDF
SATGYKQVSGALGRPVASDF

SEQ ID NO: 21720 - protein, 20 aa, synthetic construct
  source 1..20: note = Seed: SATGFKQSSKALQRPVASDF
SATGYKQVSGALHRPVASDF

SEQ ID NO: 21721 - protein, 20 aa, synthetic construct
  source 1..20: note = Seed: SATGFKQSSKALQRPVASDF
SATGYKQVSGALIRPVASDF

SEQ ID NO: 21722 - protein, 20 aa, synthetic construct
  source 1..20: note = Seed: SATGFKQSSKALQRPVASDF
SATGYKQVSGALLRPVASDF

SEQ ID NO: 21723 - protein, 20 aa, synthetic construct
  source 1..20: note = Seed: SATGFKQSSKALQRPVASDF
SATGYKQVSGALMRPVASDF

SEQ ID NO: 21724 - protein, 20 aa, synthetic construct
  source 1..20: note = Seed: SATGFKQSSKALQRPVASDF
SATGYKQVSGALNRPVASDF

SEQ ID NO: 21725 - protein, 20 aa, synthetic construct
  source 1..20: note = Seed: SATGFKQSSKALQRPVASDF
SATGYKQVSGALPRPVASDF

SEQ ID NO: 21726 - protein, 20 aa, synthetic construct
  source 1..20: note = Seed: SATGFKQSSKALQRPVASDF
SATGYKQVSGALQRPVASDF

SEQ ID NO: 21727 - protein, 20 aa, synthetic construct
  source 1..20: note = Seed: SATGFKQSSKALQRPVASDF
SATGYKQVSGALSRPVASDF

SEQ ID NO: 21728 - protein, 20 aa, synthetic construct
  source 1..20: note = Seed: SATGFKQSSKALQRPVASDF
SATGYKQVSGALTRPVASDF

SEQ ID NO: 21729 - protein, 20 aa, synthetic construct
  source 1..20: note = Seed: SATGFKQSSKALQRPVASDF
SATGYKQVSGALVRPVASDF

SEQ ID NO: 21730 - protein, 20 aa, synthetic construct
  source 1..20: note = Seed: SATGFKQSSKALQRPVASDF
SATGYKQVSHALARPVASDF

SEQ ID NO: 21731 - protein, 20 aa, synthetic construct
  source 1..20: note = Seed: SATGFKQSSKALQRPVASDF
SATGYKQVSHALGRPVASDF

SEQ ID NO: 21732 - protein, 20 aa, synthetic construct
  source 1..20: note = Seed: SATGFKQSSKALQRPVASDF
SATGYKQVSHALIRPVASDF

SEQ ID NO: 21733 - protein, 20 aa, synthetic construct
  source 1..20: note = Seed: SATGFKQSSKALQRPVASDF
SATGYKQVSHALLRPVASDF

SEQ ID NO: 21734 - protein, 20 aa, synthetic construct
  source 1..20: note = Seed: SATGFKQSSKALQRPVASDF
SATGYKQVSHALMRPVASDF

SEQ ID NO: 21735 - protein, 20 aa, synthetic construct
  source 1..20: note = Seed: SATGFKQSSKALQRPVASDF
SATGYKQVSHALNRPVASDF

SEQ ID NO: 21736 - protein, 20 aa, synthetic construct
  source 1..20: note = Seed: SATGFKQSSKALQRPVASDF
SATGYKQVSHALRRPVASDF

SEQ ID NO: 21737 - protein, 20 aa, synthetic construct
  source 1..20: note = Seed: SATGFKQSSKALQRPVASDF
SATGYKQVSHALSRPVASDF

SEQ ID NO: 21738 - protein, 20 aa, synthetic construct
  source 1..20: note = Seed: SATGFKQSSKALQRPVASDF
SATGYKQVSHALTRPVASDF

SEQ ID NO: 21739 - protein, 20 aa, synthetic construct
  source 1..20: note = Seed: SATGFKQSSKALQRPVASDF
SATGYKQVSHALVRPVASDF

SEQ ID NO: 21740 - protein, 20 aa, synthetic construct
  source 1..20: note = Seed: SATGFKQSSKALQRPVASDF
SATGYKQVSIALARPVASDF

SEQ ID NO: 21741 - protein, 20 aa, synthetic construct
  source 1..20: note = Seed: SATGFKQSSKALQRPVASDF
SATGYKQVSIALCRPVASDF

SEQ ID NO: 21742 - protein, 20 aa, synthetic construct
  source 1..20: note = Seed: SATGFKQSSKALQRPVASDF
SATGYKQVSIALDRPVASDF

SEQ ID NO: 21743 - protein, 20 aa, synthetic construct
  source 1..20: note = Seed: SATGFKQSSKALQRPVASDF
SATGYKQVSIALERPVASDF

SEQ ID NO: 21744 - protein, 20 aa, synthetic construct
  source 1..20: note = Seed: SATGFKQSSKALQRPVASDF
SATGYKQVSIALGRPVASDF

SEQ ID NO: 21745 - protein, 20 aa, synthetic construct
  source 1..20: note = Seed: SATGFKQSSKALQRPVASDF
SATGYKQVSIALHRPVASDF

SEQ ID NO: 21746 - protein, 20 aa, synthetic construct
  source 1..20: note = Seed: SATGFKQSSKALQRPVASDF
SATGYKQVSIALIRPVASDF

SEQ ID NO: 21747 - protein, 20 aa, synthetic construct
  source 1..20: note = Seed: SATGFKQSSKALQRPVASDF
SATGYKQVSIALKRPVASDF

SEQ ID NO: 21748 - protein, 20 aa, synthetic construct
  source 1..20: note = Seed: SATGFKQSSKALQRPVASDF
SATGYKQVSIALNRPVASDF

SEQ ID NO: 21749 - protein, 20 aa, synthetic construct
  source 1..20: note = Seed: SATGFKQSSKALQRPVASDF
SATGYKQVSIALPRPVASDF

SEQ ID NO: 21750 - protein, 20 aa, synthetic construct
  source 1..20: note = Seed: SATGFKQSSKALQRPVASDF
SATGYKQVSIALQRPVASDF

SEQ ID NO: 21751 - protein, 20 aa, synthetic construct
  source 1..20: note = Seed: SATGFKQSSKALQRPVASDF
SATGYKQVSIALSRPVASDF

SEQ ID NO: 21752 - protein, 20 aa, synthetic construct
  source 1..20: note = Seed: SATGFKQSSKALQRPVASDF
SATGYKQVSIALTRPVASDF

SEQ ID NO: 21753 - protein, 20 aa, synthetic construct
  source 1..20: note = Seed: SATGFKQSSKALQRPVASDF
SATGYKQVSIALVRPVASDF

SEQ ID NO: 21754 - protein, 20 aa, synthetic construct
  source 1..20: note = Seed: SATGFKQSSKALQRPVASDF
SATGYKQVSIALYRPVASDF

SEQ ID NO: 21755 - protein, 20 aa, synthetic construct
  source 1..20: note = Seed: SATGFKQSSKALQRPVASDF
SATGYKQVSKALARPVASDF

SEQ ID NO: 21756 - protein, 20 aa, synthetic construct
  source 1..20: note = Seed: SATGFKQSSKALQRPVASDF
SATGYKQVSKALGRPVASDF

SEQ ID NO: 21757 - protein, 20 aa, synthetic construct
  source 1..20: note = Seed: SATGFKQSSKALQRPVASDF
SATGYKQVSKALHRPVASDF

SEQ ID NO: 21758 - protein, 20 aa, synthetic construct
  source 1..20: note = Seed: SATGFKQSSKALQRPVASDF
SATGYKQVSKALIRPVASDF

SEQ ID NO: 21759 - protein, 20 aa, synthetic construct
  source 1..20: note = Seed: SATGFKQSSKALQRPVASDF
SATGYKQVSKALKRPVASDF

SEQ ID NO: 21760 - protein, 20 aa, synthetic construct
  source 1..20: note = Seed: SATGFKQSSKALQRPVASDF
SATGYKQVSKALLRPVASDF

SEQ ID NO: 21761 - protein, 20 aa, synthetic construct
  source 1..20: note = Seed: SATGFKQSSKALQRPVASDF
SATGYKQVSKALMRPVASDF

SEQ ID NO: 21762 - protein, 20 aa, synthetic construct
  source 1..20: note = Seed: SATGFKQSSKALQRPVASDF
SATGYKQVSKALNRPVASDF

SEQ ID NO: 21763 - protein, 20 aa, synthetic construct
  source 1..20: note = Seed: SATGFKQSSKALQRPVASDF
SATGYKQVSKALPRPVASDF

SEQ ID NO: 21764 - protein, 20 aa, synthetic construct
  source 1..20: note = Seed: SATGFKQSSKALQRPVASDF
SATGYKQVSKALQRPVASDF

SEQ ID NO: 21765 - protein, 20 aa, synthetic construct
  source 1..20: note = Seed: SATGFKQSSKALQRPVASDF
SATGYKQVSKALRRPVASDF

SEQ ID NO: 21766 - protein, 20 aa, synthetic construct
  source 1..20: note = Seed: SATGFKQSSKALQRPVASDF
SATGYKQVSKALSRPVASDF

SEQ ID NO: 21767 - protein, 20 aa, synthetic construct
  source 1..20: note = Seed: SATGFKQSSKALQRPVASDF
SATGYKQVSKALTRPVASDF

SEQ ID NO: 21768 - protein, 20 aa, synthetic construct
  source 1..20: note = Seed: SATGFKQSSKALQRPVASDF
SATGYKQVSKALVRPVASDF

SEQ ID NO: 21769 - protein, 20 aa, synthetic construct
  source 1..20: note = Seed: SATGFKQSSKALQRPVASDF
SATGYKQVSKALYRPVASDF

SEQ ID NO: 21770 - protein, 20 aa, synthetic construct
  source 1..20: note = Seed: SATGFKQSSKALQRPVASDF
SATGYKQVSLALARPVASDF

SEQ ID NO: 21771 - protein, 20 aa, synthetic construct
  source 1..20: note = Seed: SATGFKQSSKALQRPVASDF
SATGYKQVSLALCRPVASDF

SEQ ID NO: 21772 - protein, 20 aa, synthetic construct
  source 1..20: note = Seed: SATGFKQSSKALQRPVASDF
SATGYKQVSLALDRPVASDF

SEQ ID NO: 21773 - protein, 20 aa, synthetic construct
  source 1..20: note = Seed: SATGFKQSSKALQRPVASDF
SATGYKQVSLALGRPVASDF

SEQ ID NO: 21774 - protein, 20 aa, synthetic construct
  source 1..20: note = Seed: SATGFKQSSKALQRPVASDF
SATGYKQVSLALHRPVASDF

SEQ ID NO: 21775 - protein, 20 aa, synthetic construct
  source 1..20: note = Seed: SATGFKQSSKALQRPVASDF
SATGYKQVSLALIRPVASDF

SEQ ID NO: 21776 - protein, 20 aa, synthetic construct
  source 1..20: note = Seed: SATGFKQSSKALQRPVASDF
SATGYKQVSLALNRPVASDF

SEQ ID NO: 21777 - protein, 20 aa, synthetic construct
  source 1..20: note = Seed: SATGFKQSSKALQRPVASDF
SATGYKQVSLALSRPVASDF

SEQ ID NO: 21778 - protein, 20 aa, synthetic construct
  source 1..20: note = Seed: SATGFKQSSKALQRPVASDF
SATGYKQVSLALTRPVASDF

SEQ ID NO: 21779 - protein, 20 aa, synthetic construct
  source 1..20: note = Seed: SATGFKQSSKALQRPVASDF
SATGYKQVSLALVRPVASDF

SEQ ID NO: 21780 - protein, 20 aa, synthetic construct
  source 1..20: note = Seed: SATGFKQSSKALQRPVASDF
SATGYKQVSLALYRPVASDF

SEQ ID NO: 21781 - protein, 20 aa, synthetic construct
  source 1..20: note = Seed: SATGFKQSSKALQRPVASDF
SATGYKQVSMALARPVASDF

SEQ ID NO: 21782 - protein, 20 aa, synthetic construct
  source 1..20: note = Seed: SATGFKQSSKALQRPVASDF
SATGYKQVSMALCRPVASDF

SEQ ID NO: 21783 - protein, 20 aa, synthetic construct
  source 1..20: note = Seed: SATGFKQSSKALQRPVASDF
SATGYKQVSMALGRPVASDF

SEQ ID NO: 21784 - protein, 20 aa, synthetic construct
  source 1..20: note = Seed: SATGFKQSSKALQRPVASDF
SATGYKQVSMALHRPVASDF

SEQ ID NO: 21785 - protein, 20 aa, synthetic construct
  source 1..20: note = Seed: SATGFKQSSKALQRPVASDF
SATGYKQVSMALIRPVASDF

SEQ ID NO: 21786 - protein, 20 aa, synthetic construct
  source 1..20: note = Seed: SATGFKQSSKALQRPVASDF
SATGYKQVSMALNRPVASDF

SEQ ID NO: 21787 - protein, 20 aa, synthetic construct
  source 1..20: note = Seed: SATGFKQSSKALQRPVASDF
SATGYKQVSMALSRPVASDF

SEQ ID NO: 21788 - protein, 20 aa, synthetic construct
  source 1..20: note = Seed: SATGFKQSSKALQRPVASDF
SATGYKQVSMALTRPVASDF

SEQ ID NO: 21789 - protein, 20 aa, synthetic construct
  source 1..20: note = Seed: SATGFKQSSKALQRPVASDF
SATGYKQVSMALVRPVASDF

SEQ ID NO: 21790 - protein, 20 aa, synthetic construct
  source 1..20: note = Seed: SATGFKQSSKALQRPVASDF
SATGYKQVSMALYRPVASDF

SEQ ID NO: 21791 - protein, 20 aa, synthetic construct
  source 1..20: note = Seed: SATGFKQSSKALQRPVASDF
SATGYKQVSNALARPVASDF

SEQ ID NO: 21792 - protein, 20 aa, synthetic construct
  source 1..20: note = Seed: SATGFKQSSKALQRPVASDF
SATGYKQVSNALGRPVASDF

SEQ ID NO: 21793 - protein, 20 aa, synthetic construct
  source 1..20: note = Seed: SATGFKQSSKALQRPVASDF
SATGYKQVSNALIRPVASDF

SEQ ID NO: 21794 - protein, 20 aa, synthetic construct
  source 1..20: note = Seed: SATGFKQSSKALQRPVASDF
SATGYKQVSNALLRPVASDF

SEQ ID NO: 21795 - protein, 20 aa, synthetic construct
  source 1..20: note = Seed: SATGFKQSSKALQRPVASDF
SATGYKQVSNALMRPVASDF

SEQ ID NO: 21796 - protein, 20 aa, synthetic construct
  source 1..20: note = Seed: SATGFKQSSKALQRPVASDF
SATGYKQVSNALNRPVASDF

SEQ ID NO: 21797 - protein, 20 aa, synthetic construct
  source 1..20: note = Seed: SATGFKQSSKALQRPVASDF
SATGYKQVSNALPRPVASDF

SEQ ID NO: 21798 - protein, 20 aa, synthetic construct
  source 1..20: note = Seed: SATGFKQSSKALQRPVASDF
SATGYKQVSNALQRPVASDF

SEQ ID NO: 21799 - protein, 20 aa, synthetic construct
  source 1..20: note = Seed: SATGFKQSSKALQRPVASDF
SATGYKQVSNALSRPVASDF

SEQ ID NO: 21800 - protein, 20 aa, synthetic construct
  source 1..20: note = Seed: SATGFKQSSKALQRPVASDF
SATGYKQVSNALTRPVASDF

SEQ ID NO: 21801 - protein, 20 aa, synthetic construct
  source 1..20: note = Seed: SATGFKQSSKALQRPVASDF
SATGYKQVSNALVRPVASDF

SEQ ID NO: 21802 - protein, 20 aa, synthetic construct
  source 1..20: note = Seed: SATGFKQSSKALQRPVASDF
SATGYKQVSPALARPVASDF

SEQ ID NO: 21803 - protein, 20 aa, synthetic construct
  source 1..20: note = Seed: SATGFKQSSKALQRPVASDF
SATGYKQVSPALCRPVASDF

SEQ ID NO: 21804 - protein, 20 aa, synthetic construct
  source 1..20: note = Seed: SATGFKQSSKALQRPVASDF
SATGYKQVSPALDRPVASDF

SEQ ID NO: 21805 - protein, 20 aa, synthetic construct
  source 1..20: note = Seed: SATGFKQSSKALQRPVASDF
SATGYKQVSPALERPVASDF

SEQ ID NO: 21806 - protein, 20 aa, synthetic construct
  source 1..20: note = Seed: SATGFKQSSKALQRPVASDF
SATGYKQVSPALFRPVASDF

SEQ ID NO: 21807 - protein, 20 aa, synthetic construct
  source 1..20: note = Seed: SATGFKQSSKALQRPVASDF
SATGYKQVSPALGRPVASDF

SEQ ID NO: 21808 - protein, 20 aa, synthetic construct
  source 1..20: note = Seed: SATGFKQSSKALQRPVASDF
SATGYKQVSPALHRPVASDF

SEQ ID NO: 21809 - protein, 20 aa, synthetic construct
  source 1..20: note = Seed: SATGFKQSSKALQRPVASDF
SATGYKQVSPALIRPVASDF

SEQ ID NO: 21810 - protein, 20 aa, synthetic construct
  source 1..20: note = Seed: SATGFKQSSKALQRPVASDF
SATGYKQVSPALLRPVASDF

SEQ ID NO: 21811 - protein, 20 aa, synthetic construct
  source 1..20: note = Seed: SATGFKQSSKALQRPVASDF
SATGYKQVSPALMRPVASDF

SEQ ID NO: 21812 - protein, 20 aa, synthetic construct
  source 1..20: note = Seed: SATGFKQSSKALQRPVASDF
SATGYKQVSPALNRPVASDF

SEQ ID NO: 21813 - protein, 20 aa, synthetic construct
  source 1..20: note = Seed: SATGFKQSSKALQRPVASDF
SATGYKQVSPALPRPVASDF

SEQ ID NO: 21814 - protein, 20 aa, synthetic construct
  source 1..20: note = Seed: SATGFKQSSKALQRPVASDF
SATGYKQVSPALQRPVASDF

SEQ ID NO: 21815 - protein, 20 aa, synthetic construct
  source 1..20: note = Seed: SATGFKQSSKALQRPVASDF
SATGYKQVSPALSRPVASDF

SEQ ID NO: 21816 - protein, 20 aa, synthetic construct
  source 1..20: note = Seed: SATGFKQSSKALQRPVASDF
SATGYKQVSPALTRPVASDF

SEQ ID NO: 21817 - protein, 20 aa, synthetic construct
  source 1..20: note = Seed: SATGFKQSSKALQRPVASDF
SATGYKQVSPALVRPVASDF

SEQ ID NO: 21818 - protein, 20 aa, synthetic construct
  source 1..20: note = Seed: SATGFKQSSKALQRPVASDF
SATGYKQVSPALWRPVASDF

SEQ ID NO: 21819 - protein, 20 aa, synthetic construct
  source 1..20: note = Seed: SATGFKQSSKALQRPVASDF
SATGYKQVSPALYRPVASDF

SEQ ID NO: 21820 - protein, 20 aa, synthetic construct
  source 1..20: note = Seed: SATGFKQSSKALQRPVASDF
SATGYKQVSQALARPVASDF

SEQ ID NO: 21821 - protein, 20 aa, synthetic construct
  source 1..20: note = Seed: SATGFKQSSKALQRPVASDF
SATGYKQVSQALIRPVASDF

SEQ ID NO: 21822 - protein, 20 aa, synthetic construct
  source 1..20: note = Seed: SATGFKQSSKALQRPVASDF
SATGYKQVSQALLRPVASDF

SEQ ID NO: 21823 - protein, 20 aa, synthetic construct
  source 1..20: note = Seed: SATGFKQSSKALQRPVASDF
SATGYKQVSQALMRPVASDF

SEQ ID NO: 21824 - protein, 20 aa, synthetic construct
  source 1..20: note = Seed: SATGFKQSSKALQRPVASDF
SATGYKQVSQALNRPVASDF

SEQ ID NO: 21825 - protein, 20 aa, synthetic construct
  source 1..20: note = Seed: SATGFKQSSKALQRPVASDF
SATGYKQVSQALSRPVASDF

SEQ ID NO: 21826 - protein, 20 aa, synthetic construct
  source 1..20: note = Seed: SATGFKQSSKALQRPVASDF
SATGYKQVSQALTRPVASDF

SEQ ID NO: 21827 - protein, 20 aa, synthetic construct
  source 1..20: note = Seed: SATGFKQSSKALQRPVASDF
SATGYKQVSQALVRPVASDF

SEQ ID NO: 21828 - protein, 20 aa, synthetic construct
  source 1..20: note = Seed: SATGFKQSSKALQRPVASDF
SATGYKQVSRALARPVASDF

SEQ ID NO: 21829 - protein, 20 aa, synthetic construct
  source 1..20: note = Seed: SATGFKQSSKALQRPVASDF
SATGYKQVSRALCRPVASDF

SEQ ID NO: 21830 - protein, 20 aa, synthetic construct
  source 1..20: note = Seed: SATGFKQSSKALQRPVASDF
SATGYKQVSRALGRPVASDF

SEQ ID NO: 21831 - protein, 20 aa, synthetic construct
  source 1..20: note = Seed: SATGFKQSSKALQRPVASDF
SATGYKQVSRALHRPVASDF

SEQ ID NO: 21832 - protein, 20 aa, synthetic construct
  source 1..20: note = Seed: SATGFKQSSKALQRPVASDF
SATGYKQVSRALIRPVASDF

SEQ ID NO: 21833 - protein, 20 aa, synthetic construct
  source 1..20: note = Seed: SATGFKQSSKALQRPVASDF
SATGYKQVSRALKRPVASDF

SEQ ID NO: 21834 - protein, 20 aa, synthetic construct
  source 1..20: note = Seed: SATGFKQSSKALQRPVASDF
SATGYKQVSRALLRPVASDF

SEQ ID NO: 21835 - protein, 20 aa, synthetic construct
  source 1..20: note = Seed: SATGFKQSSKALQRPVASDF
SATGYKQVSRALMRPVASDF

SEQ ID NO: 21836 - protein, 20 aa, synthetic construct
  source 1..20: note = Seed: SATGFKQSSKALQRPVASDF
SATGYKQVSRALNRPVASDF

SEQ ID NO: 21837 - protein, 20 aa, synthetic construct
  source 1..20: note = Seed: SATGFKQSSKALQRPVASDF
SATGYKQVSRALPRPVASDF

SEQ ID NO: 21838 - protein, 20 aa, synthetic construct
  source 1..20: note = Seed: SATGFKQSSKALQRPVASDF
SATGYKQVSRALQRPVASDF

SEQ ID NO: 21839 - protein, 20 aa, synthetic construct
  source 1..20: note = Seed: SATGFKQSSKALQRPVASDF
SATGYKQVSRALRRPVASDF

SEQ ID NO: 21840 - protein, 20 aa, synthetic construct
  source 1..20: note = Seed: SATGFKQSSKALQRPVASDF
SATGYKQVSRALSRPVASDF

SEQ ID NO: 21841 - protein, 20 aa, synthetic construct
  source 1..20: note = Seed: SATGFKQSSKALQRPVASDF
SATGYKQVSRALTRPVASDF

SEQ ID NO: 21842 - protein, 20 aa, synthetic construct
  source 1..20: note = Seed: SATGFKQSSKALQRPVASDF
SATGYKQVSRALVRPVASDF

SEQ ID NO: 21843 - protein, 20 aa, synthetic construct
  source 1..20: note = Seed: SATGFKQSSKALQRPVASDF
SATGYKQVSRALYRPVASDF

SEQ ID NO: 21844 - protein, 20 aa, synthetic construct
  source 1..20: note = Seed: SATGFKQSSKALQRPVASDF
SATGYKQVSSALARPVASDF

SEQ ID NO: 21845 - protein, 20 aa, synthetic construct
  source 1..20: note = Seed: SATGFKQSSKALQRPVASDF
SATGYKQVSSALCRPVASDF

SEQ ID NO: 21846 - protein, 20 aa, synthetic construct
  source 1..20: note = Seed: SATGFKQSSKALQRPVASDF
SATGYKQVSSALDRPVASDF

SEQ ID NO: 21847 - protein, 20 aa, synthetic construct
  source 1..20: note = Seed: SATGFKQSSKALQRPVASDF
SATGYKQVSSALERPVASDF

SEQ ID NO: 21848 - protein, 20 aa, synthetic construct
  source 1..20: note = Seed: SATGFKQSSKALQRPVASDF
SATGYKQVSSALFRPVASDF

SEQ ID NO: 21849 - protein, 20 aa, synthetic construct
  source 1..20: note = Seed: SATGFKQSSKALQRPVASDF
SATGYKQVSSALGRPVASDF

SEQ ID NO: 21850 - protein, 20 aa, synthetic construct
  source 1..20: note = Seed: SATGFKQSSKALQRPVASDF
SATGYKQVSSALHRPVASDF

SEQ ID NO: 21851 - protein, 20 aa, synthetic construct
  source 1..20: note = Seed: SATGFKQSSKALQRPVASDF
SATGYKQVSSALIRPVASDF

SEQ ID NO: 21852 - protein, 20 aa, synthetic construct
  source 1..20: note = Seed: SATGFKQSSKALQRPVASDF
SATGYKQVSSALLRPVASDF

SEQ ID NO: 21853 - protein, 20 aa, synthetic construct
  source 1..20: note = Seed: SATGFKQSSKALQRPVASDF
SATGYKQVSSALMRPVASDF

SEQ ID NO: 21854 - protein, 20 aa, synthetic construct
  source 1..20: note = Seed: SATGFKQSSKALQRPVASDF
SATGYKQVSSALNRPVASDF

SEQ ID NO: 21855 - protein, 20 aa, synthetic construct
  source 1..20: note = Seed: SATGFKQSSKALQRPVASDF
SATGYKQVSSALPRPVASDF

SEQ ID NO: 21856 - protein, 20 aa, synthetic construct
  source 1..20: note = Seed: SATGFKQSSKALQRPVASDF
SATGYKQVSSALQRPVASDF

SEQ ID NO: 21857 - protein, 20 aa, synthetic construct
  source 1..20: note = Seed: SATGFKQSSKALQRPVASDF
SATGYKQVSSALSRPVASDF

SEQ ID NO: 21858 - protein, 20 aa, synthetic construct
  source 1..20: note = Seed: SATGFKQSSKALQRPVASDF
SATGYKQVSSALTRPVASDF

SEQ ID NO: 21859 - protein, 20 aa, synthetic construct
  source 1..20: note = Seed: SATGFKQSSKALQRPVASDF
SATGYKQVSSALVRPVASDF

SEQ ID NO: 21860 - protein, 20 aa, synthetic construct
  source 1..20: note = Seed: SATGFKQSSKALQRPVASDF
SATGYKQVSSALYRPVASDF

SEQ ID NO: 21861 - protein, 20 aa, synthetic construct
  source 1..20: note = Seed: SATGFKQSSKALQRPVASDF
SATGYKQVSTALARPVASDF

SEQ ID NO: 21862 - protein, 20 aa, synthetic construct
  source 1..20: note = Seed: SATGFKQSSKALQRPVASDF
SATGYKQVSTALCRPVASDF

SEQ ID NO: 21863 - protein, 20 aa, synthetic construct
  source 1..20: note = Seed: SATGFKQSSKALQRPVASDF
SATGYKQVSTALDRPVASDF

SEQ ID NO: 21864 - protein, 20 aa, synthetic construct
  source 1..20: note = Seed: SATGFKQSSKALQRPVASDF
SATGYKQVSTALERPVASDF

SEQ ID NO: 21865 - protein, 20 aa, synthetic construct
  source 1..20: note = Seed: SATGFKQSSKALQRPVASDF
SATGYKQVSTALFRPVASDF

SEQ ID NO: 21866 - protein, 20 aa, synthetic construct
  source 1..20: note = Seed: SATGFKQSSKALQRPVASDF
SATGYKQVSTALGRPVASDF

SEQ ID NO: 21867 - protein, 20 aa, synthetic construct
  source 1..20: note = Seed: SATGFKQSSKALQRPVASDF
SATGYKQVSTALHRPVASDF

SEQ ID NO: 21868 - protein, 20 aa, synthetic construct
  source 1..20: note = Seed: SATGFKQSSKALQRPVASDF
SATGYKQVSTALIRPVASDF

SEQ ID NO: 21869 - protein, 20 aa, synthetic construct
  source 1..20: note = Seed: SATGFKQSSKALQRPVASDF
SATGYKQVSTALLRPVASDF

SEQ ID NO: 21870 - protein, 20 aa, synthetic construct
  source 1..20: note = Seed: SATGFKQSSKALQRPVASDF
SATGYKQVSTALMRPVASDF

SEQ ID NO: 21871 - protein, 20 aa, synthetic construct
  source 1..20: note = Seed: SATGFKQSSKALQRPVASDF
SATGYKQVSTALNRPVASDF

SEQ ID NO: 21872 - protein, 20 aa, synthetic construct
  source 1..20: note = Seed: SATGFKQSSKALQRPVASDF
SATGYKQVSTALPRPVASDF

SEQ ID NO: 21873 - protein, 20 aa, synthetic construct
  source 1..20: note = Seed: SATGFKQSSKALQRPVASDF
SATGYKQVSTALQRPVASDF

SEQ ID NO: 21874 - protein, 20 aa, synthetic construct
  source 1..20: note = Seed: SATGFKQSSKALQRPVASDF
SATGYKQVSTALSRPVASDF

SEQ ID NO: 21875 - protein, 20 aa, synthetic construct
  source 1..20: note = Seed: SATGFKQSSKALQRPVASDF
SATGYKQVSTALTRPVASDF

SEQ ID NO: 21876 - protein, 20 aa, synthetic construct
  source 1..20: note = Seed: SATGFKQSSKALQRPVASDF
SATGYKQVSTALVRPVASDF

SEQ ID NO: 21877 - protein, 20 aa, synthetic construct
  source 1..20: note = Seed: SATGFKQSSKALQRPVASDF
SATGYKQVSTALYRPVASDF

SEQ ID NO: 21878 - protein, 20 aa, synthetic construct
  source 1..20: note = Seed: SATGFKQSSKALQRPVASDF
SATGYKQVSVALARPVASDF

SEQ ID NO: 21879 - protein, 20 aa, synthetic construct
  source 1..20: note = Seed: SATGFKQSSKALQRPVASDF
SATGYKQVSVALCRPVASDF

SEQ ID NO: 21880 - protein, 20 aa, synthetic construct
  source 1..20: note = Seed: SATGFKQSSKALQRPVASDF
SATGYKQVSVALDRPVASDF

SEQ ID NO: 21881 - protein, 20 aa, synthetic construct
  source 1..20: note = Seed: SATGFKQSSKALQRPVASDF
SATGYKQVSVALERPVASDF

SEQ ID NO: 21882 - protein, 20 aa, synthetic construct
  source 1..20: note = Seed: SATGFKQSSKALQRPVASDF
SATGYKQVSVALFRPVASDF

SEQ ID NO: 21883 - protein, 20 aa, synthetic construct
  source 1..20: note = Seed: SATGFKQSSKALQRPVASDF
SATGYKQVSVALGRPVASDF

SEQ ID NO: 21884 - protein, 20 aa, synthetic construct
  source 1..20: note = Seed: SATGFKQSSKALQRPVASDF
SATGYKQVSVALHRPVASDF

SEQ ID NO: 21885 - protein, 20 aa, synthetic construct
  source 1..20: note = Seed: SATGFKQSSKALQRPVASDF
SATGYKQVSVALIRPVASDF

SEQ ID NO: 21886 - protein, 20 aa, synthetic construct
  source 1..20: note = Seed: SATGFKQSSKALQRPVASDF
SATGYKQVSVALKRPVASDF

SEQ ID NO: 21887 - protein, 20 aa, synthetic construct
  source 1..20: note = Seed: SATGFKQSSKALQRPVASDF
SATGYKQVSVALLRPVASDF

SEQ ID NO: 21888 - protein, 20 aa, synthetic construct
  source 1..20: note = Seed: SATGFKQSSKALQRPVASDF
SATGYKQVSVALMRPVASDF

SEQ ID NO: 21889 - protein, 20 aa, synthetic construct
  source 1..20: note = Seed: SATGFKQSSKALQRPVASDF
SATGYKQVSVALNRPVASDF

SEQ ID NO: 21890 - protein, 20 aa, synthetic construct
  source 1..20: note = Seed: SATGFKQSSKALQRPVASDF
SATGYKQVSVALPRPVASDF

SEQ ID NO: 21891 - protein, 20 aa, synthetic construct
  source 1..20: note = Seed: SATGFKQSSKALQRPVASDF
SATGYKQVSVALQRPVASDF

SEQ ID NO: 21892 - protein, 20 aa, synthetic construct
  source 1..20: note = Seed: SATGFKQSSKALQRPVASDF
SATGYKQVSVALSRPVASDF

SEQ ID NO: 21893 - protein, 20 aa, synthetic construct
  source 1..20: note = Seed: SATGFKQSSKALQRPVASDF
SATGYKQVSVALTRPVASDF

SEQ ID NO: 21894 - protein, 20 aa, synthetic construct
  source 1..20: note = Seed: SATGFKQSSKALQRPVASDF
SATGYKQVSVALVRPVASDF

SEQ ID NO: 21895 - protein, 20 aa, synthetic construct
  source 1..20: note = Seed: SATGFKQSSKALQRPVASDF
SATGYKQVSVALYRPVASDF

SEQ ID NO: 21896 - protein, 20 aa, synthetic construct
  source 1..20: note = Seed: SATGFKQSSKALQRPVASDF
SATGYKQVSYALIRPVASDF

SEQ ID NO: 21897 - protein, 20 aa, synthetic construct
  source 1..20: note = Seed: SATGFKQSSKALQRPVASDF
SATGYKQVSYALLRPVASDF

SEQ ID NO: 21898 - protein, 20 aa, synthetic construct
  source 1..20: note = Seed: SATGFKQSSKALQRPVASDF
SATGYKQVSYALMRPVASDF

SEQ ID NO: 21899 - protein, 20 aa, synthetic construct
  source 1..20: note = Seed: SATGFKQSSKALQRPVASDF
SATGYKQVSYALVRPVASDF

SEQ ID NO: 21900 - protein, 20 aa, synthetic construct
  source 1..20: note = Seed: SATGFKQSSKALQRPVASDF
SATGYKQWSAALARPVASDF

SEQ ID NO: 21901 - protein, 20 aa, synthetic construct
  source 1..20: note = Seed: SATGFKQSSKALQRPVASDF
SATGYKQWSAALFRPVASDF

SEQ ID NO: 21902 - protein, 20 aa, synthetic construct
  source 1..20: note = Seed: SATGFKQSSKALQRPVASDF
SATGYKQWSAALGRPVASDF

SEQ ID NO: 21903 - protein, 20 aa, synthetic construct
  source 1..20: note = Seed: SATGFKQSSKALQRPVASDF
SATGYKQWSAALHRPVASDF

SEQ ID NO: 21904 - protein, 20 aa, synthetic construct
  source 1..20: note = Seed: SATGFKQSSKALQRPVASDF
SATGYKQWSAALIRPVASDF

SEQ ID NO: 21905 - protein, 20 aa, synthetic construct
  source 1..20: note = Seed: SATGFKQSSKALQRPVASDF
SATGYKQWSAALLRPVASDF

SEQ ID NO: 21906 - protein, 20 aa, synthetic construct
  source 1..20: note = Seed: SATGFKQSSKALQRPVASDF
SATGYKQWSAALMRPVASDF

SEQ ID NO: 21907 - protein, 20 aa, synthetic construct
  source 1..20: note = Seed: SATGFKQSSKALQRPVASDF
SATGYKQWSAALNRPVASDF

SEQ ID NO: 21908 - protein, 20 aa, synthetic construct
  source 1..20: note = Seed: SATGFKQSSKALQRPVASDF
SATGYKQWSAALQRPVASDF

SEQ ID NO: 21909 - protein, 20 aa, synthetic construct
  source 1..20: note = Seed: SATGFKQSSKALQRPVASDF
SATGYKQWSAALSRPVASDF

SEQ ID NO: 21910 - protein, 20 aa, synthetic construct
  source 1..20: note = Seed: SATGFKQSSKALQRPVASDF
SATGYKQWSAALVRPVASDF

SEQ ID NO: 21911 - protein, 20 aa, synthetic construct
  source 1..20: note = Seed: SATGFKQSSKALQRPVASDF
SATGYKQWSCALMRPVASDF

SEQ ID NO: 21912 - protein, 20 aa, synthetic construct
  source 1..20: note = Seed: SATGFKQSSKALQRPVASDF
SATGYKQWSFALSRPVASDF

SEQ ID NO: 21913 - protein, 20 aa, synthetic construct
  source 1..20: note = Seed: SATGFKQSSKALQRPVASDF
SATGYKQWSFALTRPVASDF

SEQ ID NO: 21914 - protein, 20 aa, synthetic construct
  source 1..20: note = Seed: SATGFKQSSKALQRPVASDF
SATGYKQWSFALVRPVASDF

SEQ ID NO: 21915 - protein, 20 aa, synthetic construct
  source 1..20: note = Seed: SATGFKQSSKALQRPVASDF
SATGYKQWSGALARPVASDF

SEQ ID NO: 21916 - protein, 20 aa, synthetic construct
  source 1..20: note = Seed: SATGFKQSSKALQRPVASDF
SATGYKQWSGALIRPVASDF

SEQ ID NO: 21917 - protein, 20 aa, synthetic construct
  source 1..20: note = Seed: SATGFKQSSKALQRPVASDF
SATGYKQWSGALLRPVASDF

SEQ ID NO: 21918 - protein, 20 aa, synthetic construct
  source 1..20: note = Seed: SATGFKQSSKALQRPVASDF
SATGYKQWSGALMRPVASDF

SEQ ID NO: 21919 - protein, 20 aa, synthetic construct
  source 1..20: note = Seed: SATGFKQSSKALQRPVASDF
SATGYKQWSGALNRPVASDF

SEQ ID NO: 21920 - protein, 20 aa, synthetic construct
  source 1..20: note = Seed: SATGFKQSSKALQRPVASDF
SATGYKQWSGALSRPVASDF

SEQ ID NO: 21921 - protein, 20 aa, synthetic construct
  source 1..20: note = Seed: SATGFKQSSKALQRPVASDF
SATGYKQWSGALTRPVASDF

SEQ ID NO: 21922 - protein, 20 aa, synthetic construct
  source 1..20: note = Seed: SATGFKQSSKALQRPVASDF
SATGYKQWSGALVRPVASDF

SEQ ID NO: 21923 - protein, 20 aa, synthetic construct
  source 1..20: note = Seed: SATGFKQSSKALQRPVASDF
SATGYKQWSHALLRPVASDF

SEQ ID NO: 21924 - protein, 20 aa, synthetic construct
  source 1..20: note = Seed: SATGFKQSSKALQRPVASDF
SATGYKQWSIALARPVASDF

SEQ ID NO: 21925 - protein, 20 aa, synthetic construct
  source 1..20: note = Seed: SATGFKQSSKALQRPVASDF
SATGYKQWSIALCRPVASDF

SEQ ID NO: 21926 - protein, 20 aa, synthetic construct
  source 1..20: note = Seed: SATGFKQSSKALQRPVASDF
SATGYKQWSIALDRPVASDF

SEQ ID NO: 21927 - protein, 20 aa, synthetic construct
  source 1..20: note = Seed: SATGFKQSSKALQRPVASDF
SATGYKQWSIALHRPVASDF

SEQ ID NO: 21928 - protein, 20 aa, synthetic construct
  source 1..20: note = Seed: SATGFKQSSKALQRPVASDF
SATGYKQWSIALNRPVASDF

SEQ ID NO: 21929 - protein, 20 aa, synthetic construct
  source 1..20: note = Seed: SATGFKQSSKALQRPVASDF
SATGYKQWSIALYRPVASDF

SEQ ID NO: 21930 - protein, 20 aa, synthetic construct
  source 1..20: note = Seed: SATGFKQSSKALQRPVASDF
SATGYKQWSKALARPVASDF

SEQ ID NO: 21931 - protein, 20 aa, synthetic construct
  source 1..20: note = Seed: SATGFKQSSKALQRPVASDF
SATGYKQWSKALKRPVASDF

SEQ ID NO: 21932 - protein, 20 aa, synthetic construct
  source 1..20: note = Seed: SATGFKQSSKALQRPVASDF
SATGYKQWSKALRRPVASDF

SEQ ID NO: 21933 - protein, 20 aa, synthetic construct
  source 1..20: note = Seed: SATGFKQSSKALQRPVASDF
SATGYKQWSLALARPVASDF

SEQ ID NO: 21934 - protein, 20 aa, synthetic construct
  source 1..20: note = Seed: SATGFKQSSKALQRPVASDF
SATGYKQWSLALIRPVASDF

SEQ ID NO: 21935 - protein, 20 aa, synthetic construct
  source 1..20: note = Seed: SATGFKQSSKALQRPVASDF
SATGYKQWSLALMRPVASDF

SEQ ID NO: 21936 - protein, 20 aa, synthetic construct
  source 1..20: note = Seed: SATGFKQSSKALQRPVASDF
SATGYKQWSLALVRPVASDF

SEQ ID NO: 21937 - protein, 20 aa, synthetic construct
  source 1..20: note = Seed: SATGFKQSSKALQRPVASDF
SATGYKQWSMALARPVASDF

SEQ ID NO: 21938 - protein, 20 aa, synthetic construct
  source 1..20: note = Seed: SATGFKQSSKALQRPVASDF
SATGYKQWSNALIRPVASDF

SEQ ID NO: 21939 - protein, 20 aa, synthetic construct
  source 1..20: note = Seed: SATGFKQSSKALQRPVASDF
SATGYKQWSNALMRPVASDF

SEQ ID NO: 21940 - protein, 20 aa, synthetic construct
  source 1..20: note = Seed: SATGFKQSSKALQRPVASDF
SATGYKQWSNALNRPVASDF

SEQ ID NO: 21941 - protein, 20 aa, synthetic construct
  source 1..20: note = Seed: SATGFKQSSKALQRPVASDF
SATGYKQWSNALSRPVASDF

SEQ ID NO: 21942 - protein, 20 aa, synthetic construct
  source 1..20: note = Seed: SATGFKQSSKALQRPVASDF
SATGYKQWSNALVRPVASDF

SEQ ID NO: 21943 - protein, 20 aa, synthetic construct
  source 1..20: note = Seed: SATGFKQSSKALQRPVASDF
SATGYKQWSPALARPVASDF

SEQ ID NO: 21944 - protein, 20 aa, synthetic construct
  source 1..20: note = Seed: SATGFKQSSKALQRPVASDF
SATGYKQWSPALGRPVASDF

SEQ ID NO: 21945 - protein, 20 aa, synthetic construct
  source 1..20: note = Seed: SATGFKQSSKALQRPVASDF
SATGYKQWSPALIRPVASDF

SEQ ID NO: 21946 - protein, 20 aa, synthetic construct
  source 1..20: note = Seed: SATGFKQSSKALQRPVASDF
SATGYKQWSPALLRPVASDF

SEQ ID NO: 21947 - protein, 20 aa, synthetic construct
  source 1..20: note = Seed: SATGFKQSSKALQRPVASDF
SATGYKQWSPALMRPVASDF

SEQ ID NO: 21948 - protein, 20 aa, synthetic construct
  source 1..20: note = Seed: SATGFKQSSKALQRPVASDF
SATGYKQWSPALNRPVASDF

SEQ ID NO: 21949 - protein, 20 aa, synthetic construct
  source 1..20: note = Seed: SATGFKQSSKALQRPVASDF
SATGYKQWSPALSRPVASDF

SEQ ID NO: 21950 - protein, 20 aa, synthetic construct
  source 1..20: note = Seed: SATGFKQSSKALQRPVASDF
SATGYKQWSPALTRPVASDF

SEQ ID NO: 21951 - protein, 20 aa, synthetic construct
  source 1..20: note = Seed: SATGFKQSSKALQRPVASDF
SATGYKQWSPALVRPVASDF

SEQ ID NO: 21952 - protein, 20 aa, synthetic construct
  source 1..20: note = Seed: SATGFKQSSKALQRPVASDF
SATGYKQWSRALARPVASDF

SEQ ID NO: 21953 - protein, 20 aa, synthetic construct
  source 1..20: note = Seed: SATGFKQSSKALQRPVASDF
SATGYKQWSRALKRPVASDF

SEQ ID NO: 21954 - protein, 20 aa, synthetic construct
  source 1..20: note = Seed: SATGFKQSSKALQRPVASDF
SATGYKQWSRALRRPVASDF

SEQ ID NO: 21955 - protein, 20 aa, synthetic construct
  source 1..20: note = Seed: SATGFKQSSKALQRPVASDF
SATGYKQWSRALSRPVASDF

SEQ ID NO: 21956 - protein, 20 aa, synthetic construct
  source 1..20: note = Seed: SATGFKQSSKALQRPVASDF
SATGYKQWSSALARPVASDF

SEQ ID NO: 21957 - protein, 20 aa, synthetic construct
  source 1..20: note = Seed: SATGFKQSSKALQRPVASDF
SATGYKQWSSALGRPVASDF

SEQ ID NO: 21958 - protein, 20 aa, synthetic construct
  source 1..20: note = Seed: SATGFKQSSKALQRPVASDF
SATGYKQWSSALIRPVASDF

SEQ ID NO: 21959 - protein, 20 aa, synthetic construct
  source 1..20: note = Seed: SATGFKQSSKALQRPVASDF
SATGYKQWSSALLRPVASDF

SEQ ID NO: 21960 - protein, 20 aa, synthetic construct
  source 1..20: note = Seed: SATGFKQSSKALQRPVASDF
SATGYKQWSSALMRPVASDF

SEQ ID NO: 21961 - protein, 20 aa, synthetic construct
  source 1..20: note = Seed: SATGFKQSSKALQRPVASDF
SATGYKQWSSALNRPVASDF

SEQ ID NO: 21962 - protein, 20 aa, synthetic construct
  source 1..20: note = Seed: SATGFKQSSKALQRPVASDF
SATGYKQWSSALSRPVASDF

SEQ ID NO: 21963 - protein, 20 aa, synthetic construct
  source 1..20: note = Seed: SATGFKQSSKALQRPVASDF
SATGYKQWSSALVRPVASDF

SEQ ID NO: 21964 - protein, 20 aa, synthetic construct
  source 1..20: note = Seed: SATGFKQSSKALQRPVASDF
SATGYKQWSTALARPVASDF

SEQ ID NO: 21965 - protein, 20 aa, synthetic construct
  source 1..20: note = Seed: SATGFKQSSKALQRPVASDF
SATGYKQWSTALGRPVASDF

SEQ ID NO: 21966 - protein, 20 aa, synthetic construct
  source 1..20: note = Seed: SATGFKQSSKALQRPVASDF
SATGYKQWSTALIRPVASDF

SEQ ID NO: 21967 - protein, 20 aa, synthetic construct
  source 1..20: note = Seed: SATGFKQSSKALQRPVASDF
SATGYKQWSTALLRPVASDF

SEQ ID NO: 21968 - protein, 20 aa, synthetic construct
  source 1..20: note = Seed: SATGFKQSSKALQRPVASDF
SATGYKQWSTALMRPVASDF

SEQ ID NO: 21969 - protein, 20 aa, synthetic construct
  source 1..20: note = Seed: SATGFKQSSKALQRPVASDF
SATGYKQWSTALNRPVASDF

SEQ ID NO: 21970 - protein, 20 aa, synthetic construct
  source 1..20: note = Seed: SATGFKQSSKALQRPVASDF
SATGYKQWSTALSRPVASDF

SEQ ID NO: 21971 - protein, 20 aa, synthetic construct
  source 1..20: note = Seed: SATGFKQSSKALQRPVASDF
SATGYKQWSTALVRPVASDF

SEQ ID NO: 21972 - protein, 20 aa, synthetic construct
  source 1..20: note = Seed: SATGFKQSSKALQRPVASDF
SATGYKQWSVALARPVASDF

SEQ ID NO: 21973 - protein, 20 aa, synthetic construct
  source 1..20: note = Seed: SATGFKQSSKALQRPVASDF
SATGYKQWSVALCRPVASDF

SEQ ID NO: 21974 - protein, 20 aa, synthetic construct
  source 1..20: note = Seed: SATGFKQSSKALQRPVASDF
SATGYKQWSVALERPVASDF

SEQ ID NO: 21975 - protein, 20 aa, synthetic construct
  source 1..20: note = Seed: SATGFKQSSKALQRPVASDF
SATGYKQWSVALFRPVASDF

SEQ ID NO: 21976 - protein, 20 aa, synthetic construct
  source 1..20: note = Seed: SATGFKQSSKALQRPVASDF
SATGYKQWSVALGRPVASDF

SEQ ID NO: 21977 - protein, 20 aa, synthetic construct
  source 1..20: note = Seed: SATGFKQSSKALQRPVASDF
SATGYKQWSVALHRPVASDF

SEQ ID NO: 21978 - protein, 20 aa, synthetic construct
  source 1..20: note = Seed: SATGFKQSSKALQRPVASDF
SATGYKQWSVALIRPVASDF

SEQ ID NO: 21979 - protein, 20 aa, synthetic construct
  source 1..20: note = Seed: SATGFKQSSKALQRPVASDF
SATGYKQWSVALLRPVASDF

SEQ ID NO: 21980 - protein, 20 aa, synthetic construct
  source 1..20: note = Seed: SATGFKQSSKALQRPVASDF
SATGYKQWSVALMRPVASDF

SEQ ID NO: 21981 - protein, 20 aa, synthetic construct
  source 1..20: note = Seed: SATGFKQSSKALQRPVASDF
SATGYKQWSVALNRPVASDF

SEQ ID NO: 21982 - protein, 20 aa, synthetic construct
  source 1..20: note = Seed: SATGFKQSSKALQRPVASDF
SATGYKQWSVALQRPVASDF

SEQ ID NO: 21983 - protein, 20 aa, synthetic construct
  source 1..20: note = Seed: SATGFKQSSKALQRPVASDF
SATGYKQWSVALSRPVASDF

SEQ ID NO: 21984 - protein, 20 aa, synthetic construct
  source 1..20: note = Seed: SATGFKQSSKALQRPVASDF
SATGYKQWSVALYRPVASDF

SEQ ID NO: 21985 - protein, 20 aa, synthetic construct
  source 1..20: note = Seed: SATGFKQSSKALQRPVASDF
SATGYKQYSAALARPVASDF

SEQ ID NO: 21986 - protein, 20 aa, synthetic construct
  source 1..20: note = Seed: SATGFKQSSKALQRPVASDF
SATGYKQYSAALGRPVASDF

SEQ ID NO: 21987 - protein, 20 aa, synthetic construct
  source 1..20: note = Seed: SATGFKQSSKALQRPVASDF
SATGYKQYSAALHRPVASDF

SEQ ID NO: 21988 - protein, 20 aa, synthetic construct
  source 1..20: note = Seed: SATGFKQSSKALQRPVASDF
SATGYKQYSAALIRPVASDF

SEQ ID NO: 21989 - protein, 20 aa, synthetic construct
  source 1..20: note = Seed: SATGFKQSSKALQRPVASDF
SATGYKQYSAALLRPVASDF

SEQ ID NO: 21990 - protein, 20 aa, synthetic construct
  source 1..20: note = Seed: SATGFKQSSKALQRPVASDF
SATGYKQYSAALMRPVASDF

SEQ ID NO: 21991 - protein, 20 aa, synthetic construct
  source 1..20: note = Seed: SATGFKQSSKALQRPVASDF
SATGYKQYSAALQRPVASDF

SEQ ID NO: 21992 - protein, 20 aa, synthetic construct
  source 1..20: note = Seed: SATGFKQSSKALQRPVASDF
SATGYKQYSAALRRPVASDF

SEQ ID NO: 21993 - protein, 20 aa, synthetic construct
  source 1..20: note = Seed: SATGFKQSSKALQRPVASDF
SATGYKQYSAALVRPVASDF

SEQ ID NO: 21994 - protein, 20 aa, synthetic construct
  source 1..20: note = Seed: SATGFKQSSKALQRPVASDF
SATGYKQYSFALERPVASDF

SEQ ID NO: 21995 - protein, 20 aa, synthetic construct
  source 1..20: note = Seed: SATGFKQSSKALQRPVASDF
SATGYKQYSGALARPVASDF

SEQ ID NO: 21996 - protein, 20 aa, synthetic construct
  source 1..20: note = Seed: SATGFKQSSKALQRPVASDF
SATGYKQYSGALIRPVASDF

SEQ ID NO: 21997 - protein, 20 aa, synthetic construct
  source 1..20: note = Seed: SATGFKQSSKALQRPVASDF
SATGYKQYSGALLRPVASDF

SEQ ID NO: 21998 - protein, 20 aa, synthetic construct
  source 1..20: note = Seed: SATGFKQSSKALQRPVASDF
SATGYKQYSGALMRPVASDF

SEQ ID NO: 21999 - protein, 20 aa, synthetic construct
  source 1..20: note = Seed: SATGFKQSSKALQRPVASDF
SATGYKQYSGALSRPVASDF

SEQ ID NO: 22000 - protein, 20 aa, synthetic construct
  source 1..20: note = Seed: SATGFKQSSKALQRPVASDF
SATGYKQYSGALVRPVASDF

SEQ ID NO: 22001 - protein, 20 aa, synthetic construct
  source 1..20: note = Seed: SATGFKQSSKALQRPVASDF
SATGYKQYSIALSRPVASDF

SEQ ID NO: 22002 - protein, 20 aa, synthetic construct
  source 1..20: note = Seed: SATGFKQSSKALQRPVASDF
SATGYKQYSKALARPVASDF

SEQ ID NO: 22003 - protein, 20 aa, synthetic construct
  source 1..20: note = Seed: SATGFKQSSKALQRPVASDF
SATGYKQYSKALHRPVASDF

SEQ ID NO: 22004 - protein, 20 aa, synthetic construct
  source 1..20: note = Seed: SATGFKQSSKALQRPVASDF
SATGYKQYSKALKRPVASDF

SEQ ID NO: 22005 - protein, 20 aa, synthetic construct
  source 1..20: note = Seed: SATGFKQSSKALQRPVASDF
SATGYKQYSKALRRPVASDF

SEQ ID NO: 22006 - protein, 20 aa, synthetic construct
  source 1..20: note = Seed: SATGFKQSSKALQRPVASDF
SATGYKQYSKALSRPVASDF

SEQ ID NO: 22007 - protein, 20 aa, synthetic construct
  source 1..20: note = Seed: SATGFKQSSKALQRPVASDF
SATGYKQYSKALTRPVASDF

SEQ ID NO: 22008 - protein, 20 aa, synthetic construct
  source 1..20: note = Seed: SATGFKQSSKALQRPVASDF
SATGYKQYSLALMRPVASDF

SEQ ID NO: 22009 - protein, 20 aa, synthetic construct
  source 1..20: note = Seed: SATGFKQSSKALQRPVASDF
SATGYKQYSNALARPVASDF

SEQ ID NO: 22010 - protein, 20 aa, synthetic construct
  source 1..20: note = Seed: SATGFKQSSKALQRPVASDF
SATGYKQYSNALIRPVASDF

SEQ ID NO: 22011 - protein, 20 aa, synthetic construct
  source 1..20: note = Seed: SATGFKQSSKALQRPVASDF
SATGYKQYSNALLRPVASDF

SEQ ID NO: 22012 - protein, 20 aa, synthetic construct
  source 1..20: note = Seed: SATGFKQSSKALQRPVASDF
SATGYKQYSNALMRPVASDF

SEQ ID NO: 22013 - protein, 20 aa, synthetic construct
  source 1..20: note = Seed: SATGFKQSSKALQRPVASDF
SATGYKQYSPALGRPVASDF

SEQ ID NO: 22014 - protein, 20 aa, synthetic construct
  source 1..20: note = Seed: SATGFKQSSKALQRPVASDF
SATGYKQYSPALIRPVASDF

SEQ ID NO: 22015 - protein, 20 aa, synthetic construct
  source 1..20: note = Seed: SATGFKQSSKALQRPVASDF
SATGYKQYSPALLRPVASDF

SEQ ID NO: 22016 - protein, 20 aa, synthetic construct
  source 1..20: note = Seed: SATGFKQSSKALQRPVASDF
SATGYKQYSPALMRPVASDF

SEQ ID NO: 22017 - protein, 20 aa, synthetic construct
  source 1..20: note = Seed: SATGFKQSSKALQRPVASDF
SATGYKQYSPALNRPVASDF

SEQ ID NO: 22018 - protein, 20 aa, synthetic construct
  source 1..20: note = Seed: SATGFKQSSKALQRPVASDF
SATGYKQYSRALARPVASDF

SEQ ID NO: 22019 - protein, 20 aa, synthetic construct
  source 1..20: note = Seed: SATGFKQSSKALQRPVASDF
SATGYKQYSRALHRPVASDF

SEQ ID NO: 22020 - protein, 20 aa, synthetic construct
  source 1..20: note = Seed: SATGFKQSSKALQRPVASDF
SATGYKQYSRALKRPVASDF

SEQ ID NO: 22021 - protein, 20 aa, synthetic construct
  source 1..20: note = Seed: SATGFKQSSKALQRPVASDF
SATGYKQYSRALRRPVASDF

SEQ ID NO: 22022 - protein, 20 aa, synthetic construct
  source 1..20: note = Seed: SATGFKQSSKALQRPVASDF
SATGYKQYSRALSRPVASDF

SEQ ID NO: 22023 - protein, 20 aa, synthetic construct
  source 1..20: note = Seed: SATGFKQSSKALQRPVASDF
SATGYKQYSRALTRPVASDF

SEQ ID NO: 22024 - protein, 20 aa, synthetic construct
  source 1..20: note = Seed: SATGFKQSSKALQRPVASDF
SATGYKQYSRALVRPVASDF

SEQ ID NO: 22025 - protein, 20 aa, synthetic construct
  source 1..20: note = Seed: SATGFKQSSKALQRPVASDF
SATGYKQYSSALARPVASDF

SEQ ID NO: 22026 - protein, 20 aa, synthetic construct
  source 1..20: note = Seed: SATGFKQSSKALQRPVASDF
SATGYKQYSSALGRPVASDF

SEQ ID NO: 22027 - protein, 20 aa, synthetic construct
  source 1..20: note = Seed: SATGFKQSSKALQRPVASDF
SATGYKQYSSALIRPVASDF

SEQ ID NO: 22028 - protein, 20 aa, synthetic construct
  source 1..20: note = Seed: SATGFKQSSKALQRPVASDF
SATGYKQYSSALLRPVASDF

SEQ ID NO: 22029 - protein, 20 aa, synthetic construct
  source 1..20: note = Seed: SATGFKQSSKALQRPVASDF
SATGYKQYSSALQRPVASDF

SEQ ID NO: 22030 - protein, 20 aa, synthetic construct
  source 1..20: note = Seed: SATGFKQSSKALQRPVASDF
SATGYKQYSSALTRPVASDF

SEQ ID NO: 22031 - protein, 20 aa, synthetic construct
  source 1..20: note = Seed: SATGFKQSSKALQRPVASDF
SATGYKQYSSALVRPVASDF

SEQ ID NO: 22032 - protein, 20 aa, synthetic construct
  source 1..20: note = Seed: SATGFKQSSKALQRPVASDF
SATGYKQYSTALARPVASDF

SEQ ID NO: 22033 - protein, 20 aa, synthetic construct
  source 1..20: note = Seed: SATGFKQSSKALQRPVASDF
SATGYKQYSTALGRPVASDF

SEQ ID NO: 22034 - protein, 20 aa, synthetic construct
  source 1..20: note = Seed: SATGFKQSSKALQRPVASDF
SATGYKQYSTALHRPVASDF

SEQ ID NO: 22035 - protein, 20 aa, synthetic construct
  source 1..20: note = Seed: SATGFKQSSKALQRPVASDF
SATGYKQYSTALLRPVASDF

SEQ ID NO: 22036 - protein, 20 aa, synthetic construct
  source 1..20: note = Seed: SATGFKQSSKALQRPVASDF
SATGYKQYSTALMRPVASDF

SEQ ID NO: 22037 - protein, 20 aa, synthetic construct
  source 1..20: note = Seed: SATGFKQSSKALQRPVASDF
SATGYKQYSTALQRPVASDF

SEQ ID NO: 22038 - protein, 20 aa, synthetic construct
  source 1..20: note = Seed: SATGFKQSSKALQRPVASDF
SATGYKQYSVALHRPVASDF

SEQ ID NO: 22039 - protein, 20 aa, synthetic construct
  source 1..20: note = Seed: SATGFKQSSKALQRPVASDF
SATGYKQYSVALQRPVASDF

SEQ ID NO: 22040 - protein, 20 aa, synthetic construct
  source 1..20: note = Seed: SATGFKQSSKALQRPVASDF
SATGYKQYSVALVRPVASDF

SEQ ID NO: 22041 - protein, 20 aa, synthetic construct
  source 1..20: note = Seed: SATGFKQSSKALQRPVASDF
SATGFKQSSFALARAVANDF

SEQ ID NO: 22042 - protein, 20 aa, synthetic construct
  source 1..20: note = Seed: SATGFKQSSKALQRPVASDF
SATGFKQSSFALARAVASDF

SEQ ID NO: 22043 - protein, 20 aa, synthetic construct
  source 1..20: note = Seed: SATGFKQSSKALQRPVASDF
SATGFKQSSFALARIVANDF

SEQ ID NO: 22044 - protein, 20 aa, synthetic construct
  source 1..20: note = Seed: SATGFKQSSKALQRPVASDF
SATGFKQSSFALARPVANDF

SEQ ID NO: 22045 - protein, 20 aa, synthetic construct
  source 1..20: note = Seed: SATGFKQSSKALQRPVASDF
SATGFKQSSFALARVVANDF

SEQ ID NO: 22046 - protein, 20 aa, synthetic construct
  source 1..20: note = Seed: SATGFKQSSKALQRPVASDF
SATGFKQSSFALIRAVANDF

SEQ ID NO: 22047 - protein, 20 aa, synthetic construct
  source 1..20: note = Seed: SATGFKQSSKALQRPVASDF
SATGFKQSSFALIRPVANDF

SEQ ID NO: 22048 - protein, 20 aa, synthetic construct
  source 1..20: note = Seed: SATGFKQSSKALQRPVASDF
SATGFKQSSFALSRAVANDF

SEQ ID NO: 22049 - protein, 20 aa, synthetic construct
  source 1..20: note = Seed: SATGFKQSSKALQRPVASDF
SATGFKQSSFALSRPVANDF

SEQ ID NO: 22050 - protein, 20 aa, synthetic construct
  source 1..20: note = Seed: SATGFKQSSKALQRPVASDF
SATGFKQSSFALTRAVANDF

SEQ ID NO: 22051 - protein, 20 aa, synthetic construct
  source 1..20: note = Seed: SATGFKQSSKALQRPVASDF
SATGFKQSSFALVRAVANDF

SEQ ID NO: 22052 - protein, 20 aa, synthetic construct
  source 1..20: note = Seed: SATGFKQSSKALQRPVASDF
SATGFKQSSFALVRPVANDF

SEQ ID NO: 22053 - protein, 20 aa, synthetic construct
  source 1..20: note = Seed: SATGFKQSSKALQRPVASDF
SATGFKQSSRALARAVADDF

SEQ ID NO: 22054 - protein, 20 aa, synthetic construct
  source 1..20: note = Seed: SATGFKQSSKALQRPVASDF
SATGFKQSSRALARAVAEDF

SEQ ID NO: 22055 - protein, 20 aa, synthetic construct
  source 1..20: note = Seed: SATGFKQSSKALQRPVASDF
SATGFKQSSRALARAVAGDF

SEQ ID NO: 22056 - protein, 20 aa, synthetic construct
  source 1..20: note = Seed: SATGFKQSSKALQRPVASDF
SATGFKQSSRALARAVAHDF

SEQ ID NO: 22057 - protein, 20 aa, synthetic construct
  source 1..20: note = Seed: SATGFKQSSKALQRPVASDF
SATGFKQSSRALARAVAIDF

SEQ ID NO: 22058 - protein, 20 aa, synthetic construct
  source 1..20: note = Seed: SATGFKQSSKALQRPVASDF
SATGFKQSSRALARAVALDF

SEQ ID NO: 22059 - protein, 20 aa, synthetic construct
  source 1..20: note = Seed: SATGFKQSSKALQRPVASDF
SATGFKQSSRALARAVAMDF

SEQ ID NO: 22060 - protein, 20 aa, synthetic construct
  source 1..20: note = Seed: SATGFKQSSKALQRPVASDF
SATGFKQSSRALARAVANDF

SEQ ID NO: 22061 - protein, 20 aa, synthetic construct
  source 1..20: note = Seed: SATGFKQSSKALQRPVASDF
SATGFKQSSRALARAVAQDF

SEQ ID NO: 22062 - protein, 20 aa, synthetic construct
  source 1..20: note = Seed: SATGFKQSSKALQRPVASDF
SATGFKQSSRALARAVASDF

SEQ ID NO: 22063 - protein, 20 aa, synthetic construct
  source 1..20: note = Seed: SATGFKQSSKALQRPVASDF
SATGFKQSSRALARAVATDF

SEQ ID NO: 22064 - protein, 20 aa, synthetic construct
  source 1..20: note = Seed: SATGFKQSSKALQRPVASDF
SATGFKQSSRALARAVAVDF

SEQ ID NO: 22065 - protein, 20 aa, synthetic construct
  source 1..20: note = Seed: SATGFKQSSKALQRPVASDF
SATGFKQSSRALARFVANDF

SEQ ID NO: 22066 - protein, 20 aa, synthetic construct
  source 1..20: note = Seed: SATGFKQSSKALQRPVASDF
SATGFKQSSRALARIVAADF

SEQ ID NO: 22067 - protein, 20 aa, synthetic construct
  source 1..20: note = Seed: SATGFKQSSKALQRPVASDF
SATGFKQSSRALARIVADDF

SEQ ID NO: 22068 - protein, 20 aa, synthetic construct
  source 1..20: note = Seed: SATGFKQSSKALQRPVASDF
SATGFKQSSRALARIVAEDF

SEQ ID NO: 22069 - protein, 20 aa, synthetic construct
  source 1..20: note = Seed: SATGFKQSSKALQRPVASDF
SATGFKQSSRALARIVAHDF

SEQ ID NO: 22070 - protein, 20 aa, synthetic construct
  source 1..20: note = Seed: SATGFKQSSKALQRPVASDF
SATGFKQSSRALARIVAIDF

SEQ ID NO: 22071 - protein, 20 aa, synthetic construct
  source 1..20: note = Seed: SATGFKQSSKALQRPVASDF
SATGFKQSSRALARIVALDF

SEQ ID NO: 22072 - protein, 20 aa, synthetic construct
  source 1..20: note = Seed: SATGFKQSSKALQRPVASDF
SATGFKQSSRALARIVAMDF

SEQ ID NO: 22073 - protein, 20 aa, synthetic construct
  source 1..20: note = Seed: SATGFKQSSKALQRPVASDF
SATGFKQSSRALARIVANDF

SEQ ID NO: 22074 - protein, 20 aa, synthetic construct
  source 1..20: note = Seed: SATGFKQSSKALQRPVASDF
SATGFKQSSRALARIVAQDF

SEQ ID NO: 22075 - protein, 20 aa, synthetic construct
  source 1..20: note = Seed: SATGFKQSSKALQRPVASDF
SATGFKQSSRALARIVASDF

SEQ ID NO: 22076 - protein, 20 aa, synthetic construct
  source 1..20: note = Seed: SATGFKQSSKALQRPVASDF
SATGFKQSSRALARIVATDF

SEQ ID NO: 22077 - protein, 20 aa, synthetic construct
  source 1..20: note = Seed: SATGFKQSSKALQRPVASDF
SATGFKQSSRALARIVAVDF

SEQ ID NO: 22078 - protein, 20 aa, synthetic construct
  source 1..20: note = Seed: SATGFKQSSKALQRPVASDF
SATGFKQSSRALARLVAADF

SEQ ID NO: 22079 - protein, 20 aa, synthetic construct
  source 1..20: note = Seed: SATGFKQSSKALQRPVASDF
SATGFKQSSRALARLVAHDF

SEQ ID NO: 22080 - protein, 20 aa, synthetic construct
  source 1..20: note = Seed: SATGFKQSSKALQRPVASDF
SATGFKQSSRALARLVAIDF

SEQ ID NO: 22081 - protein, 20 aa, synthetic construct
  source 1..20: note = Seed: SATGFKQSSKALQRPVASDF
SATGFKQSSRALARLVALDF

SEQ ID NO: 22082 - protein, 20 aa, synthetic construct
  source 1..20: note = Seed: SATGFKQSSKALQRPVASDF
SATGFKQSSRALARLVAMDF

SEQ ID NO: 22083 - protein, 20 aa, synthetic construct
  source 1..20: note = Seed: SATGFKQSSKALQRPVASDF
SATGFKQSSRALARLVANDF

SEQ ID NO: 22084 - protein, 20 aa, synthetic construct
  source 1..20: note = Seed: SATGFKQSSKALQRPVASDF
SATGFKQSSRALARLVASDF

SEQ ID NO: 22085 - protein, 20 aa, synthetic construct
  source 1..20: note = Seed: SATGFKQSSKALQRPVASDF
SATGFKQSSRALARLVAVDF

SEQ ID NO: 22086 - protein, 20 aa, synthetic construct
  source 1..20: note = Seed: SATGFKQSSKALQRPVASDF
SATGFKQSSRALARMVAADF

SEQ ID NO: 22087 - protein, 20 aa, synthetic construct
  source 1..20: note = Seed: SATGFKQSSKALQRPVASDF
SATGFKQSSRALARMVANDF

SEQ ID NO: 22088 - protein, 20 aa, synthetic construct
  source 1..20: note = Seed: SATGFKQSSKALQRPVASDF
SATGFKQSSRALARMVASDF

SEQ ID NO: 22089 - protein, 20 aa, synthetic construct
  source 1..20: note = Seed: SATGFKQSSKALQRPVASDF
SATGFKQSSRALARPVAADF

SEQ ID NO: 22090 - protein, 20 aa, synthetic construct
  source 1..20: note = Seed: SATGFKQSSKALQRPVASDF
SATGFKQSSRALARPVAHDF

SEQ ID NO: 22091 - protein, 20 aa, synthetic construct
  source 1..20: note = Seed: SATGFKQSSKALQRPVASDF
SATGFKQSSRALARPVAIDF

SEQ ID NO: 22092 - protein, 20 aa, synthetic construct
  source 1..20: note = Seed: SATGFKQSSKALQRPVASDF
SATGFKQSSRALARPVALDF

SEQ ID NO: 22093 - protein, 20 aa, synthetic construct
  source 1..20: note = Seed: SATGFKQSSKALQRPVASDF
SATGFKQSSRALARPVAMDF

SEQ ID NO: 22094 - protein, 20 aa, synthetic construct
  source 1..20: note = Seed: SATGFKQSSKALQRPVASDF
SATGFKQSSRALARPVANDF

SEQ ID NO: 22095 - protein, 20 aa, synthetic construct
  source 1..20: note = Seed: SATGFKQSSKALQRPVASDF
SATGFKQSSRALARPVATDF

SEQ ID NO: 22096 - protein, 20 aa, synthetic construct
  source 1..20: note = Seed: SATGFKQSSKALQRPVASDF
SATGFKQSSRALARPVAVDF

SEQ ID NO: 22097 - protein, 20 aa, synthetic construct
  source 1..20: note = Seed: SATGFKQSSKALQRPVASDF
SATGFKQSSRALARSVANDF

SEQ ID NO: 22098 - protein, 20 aa, synthetic construct
  source 1..20: note = Seed: SATGFKQSSKALQRPVASDF
SATGFKQSSRALARTVANDF

SEQ ID NO: 22099 - protein, 20 aa, synthetic construct
  source 1..20: note = Seed: SATGFKQSSKALQRPVASDF
SATGFKQSSRALARVVAADF

SEQ ID NO: 22100 - protein, 20 aa, synthetic construct
  source 1..20: note = Seed: SATGFKQSSKALQRPVASDF
SATGFKQSSRALARVVADDF

SEQ ID NO: 22101 - protein, 20 aa, synthetic construct
  source 1..20: note = Seed: SATGFKQSSKALQRPVASDF
SATGFKQSSRALARVVAEDF

SEQ ID NO: 22102 - protein, 20 aa, synthetic construct
  source 1..20: note = Seed: SATGFKQSSKALQRPVASDF
SATGFKQSSRALARVVAHDF

SEQ ID NO: 22103 - protein, 20 aa, synthetic construct
  source 1..20: note = Seed: SATGFKQSSKALQRPVASDF
SATGFKQSSRALARVVAIDF

SEQ ID NO: 22104 - protein, 20 aa, synthetic construct
  source 1..20: note = Seed: SATGFKQSSKALQRPVASDF
SATGFKQSSRALARVVALDF

SEQ ID NO: 22105 - protein, 20 aa, synthetic construct
  source 1..20: note = Seed: SATGFKQSSKALQRPVASDF
SATGFKQSSRALARVVAMDF

SEQ ID NO: 22106 - protein, 20 aa, synthetic construct
  source 1..20: note = Seed: SATGFKQSSKALQRPVASDF
SATGFKQSSRALARVVANDF

SEQ ID NO: 22107 - protein, 20 aa, synthetic construct
  source 1..20: note = Seed: SATGFKQSSKALQRPVASDF
SATGFKQSSRALARVVAQDF

SEQ ID NO: 22108 - protein, 20 aa, synthetic construct
  source 1..20: note = Seed: SATGFKQSSKALQRPVASDF
SATGFKQSSRALARVVASDF

SEQ ID NO: 22109 - protein, 20 aa, synthetic construct
  source 1..20: note = Seed: SATGFKQSSKALQRPVASDF
SATGFKQSSRALARVVATDF

SEQ ID NO: 22110 - protein, 20 aa, synthetic construct
  source 1..20: note = Seed: SATGFKQSSKALQRPVASDF
SATGFKQSSRALARVVAVDF

SEQ ID NO: 22111 - protein, 20 aa, synthetic construct
  source 1..20: note = Seed: SATGFKQSSKALQRPVASDF
SATGFKQSSRALERAVAADF

SEQ ID NO: 22112 - protein, 20 aa, synthetic construct
  source 1..20: note = Seed: SATGFKQSSKALQRPVASDF
SATGFKQSSRALERAVANDF

SEQ ID NO: 22113 - protein, 20 aa, synthetic construct
  source 1..20: note = Seed: SATGFKQSSKALQRPVASDF
SATGFKQSSRALERAVASDF

SEQ ID NO: 22114 - protein, 20 aa, synthetic construct
  source 1..20: note = Seed: SATGFKQSSKALQRPVASDF
SATGFKQSSRALERAVAVDF

SEQ ID NO: 22115 - protein, 20 aa, synthetic construct
  source 1..20: note = Seed: SATGFKQSSKALQRPVASDF
SATGFKQSSRALIRAVAADF

SEQ ID NO: 22116 - protein, 20 aa, synthetic construct
  source 1..20: note = Seed: SATGFKQSSKALQRPVASDF
SATGFKQSSRALIRAVADDF

SEQ ID NO: 22117 - protein, 20 aa, synthetic construct
  source 1..20: note = Seed: SATGFKQSSKALQRPVASDF
SATGFKQSSRALIRAVAEDF

SEQ ID NO: 22118 - protein, 20 aa, synthetic construct
  source 1..20: note = Seed: SATGFKQSSKALQRPVASDF
SATGFKQSSRALIRAVAHDF

SEQ ID NO: 22119 - protein, 20 aa, synthetic construct
  source 1..20: note = Seed: SATGFKQSSKALQRPVASDF
SATGFKQSSRALIRAVAIDF

SEQ ID NO: 22120 - protein, 20 aa, synthetic construct
  source 1..20: note = Seed: SATGFKQSSKALQRPVASDF
SATGFKQSSRALIRAVALDF

SEQ ID NO: 22121 - protein, 20 aa, synthetic construct
  source 1..20: note = Seed: SATGFKQSSKALQRPVASDF
SATGFKQSSRALIRAVAMDF

SEQ ID NO: 22122 - protein, 20 aa, synthetic construct
  source 1..20: note = Seed: SATGFKQSSKALQRPVASDF
SATGFKQSSRALIRAVANDF

SEQ ID NO: 22123 - protein, 20 aa, synthetic construct
  source 1..20: note = Seed: SATGFKQSSKALQRPVASDF
SATGFKQSSRALIRAVAQDF

SEQ ID NO: 22124 - protein, 20 aa, synthetic construct
  source 1..20: note = Seed: SATGFKQSSKALQRPVASDF
SATGFKQSSRALIRAVASDF

SEQ ID NO: 22125 - protein, 20 aa, synthetic construct
  source 1..20: note = Seed: SATGFKQSSKALQRPVASDF
SATGFKQSSRALIRAVATDF

SEQ ID NO: 22126 - protein, 20 aa, synthetic construct
  source 1..20: note = Seed: SATGFKQSSKALQRPVASDF
SATGFKQSSRALIRAVAVDF

SEQ ID NO: 22127 - protein, 20 aa, synthetic construct
  source 1..20: note = Seed: SATGFKQSSKALQRPVASDF
SATGFKQSSRALIRIVAADF

SEQ ID NO: 22128 - protein, 20 aa, synthetic construct
  source 1..20: note = Seed: SATGFKQSSKALQRPVASDF
SATGFKQSSRALIRIVANDF

SEQ ID NO: 22129 - protein, 20 aa, synthetic construct
  source 1..20: note = Seed: SATGFKQSSKALQRPVASDF
SATGFKQSSRALIRIVASDF

SEQ ID NO: 22130 - protein, 20 aa, synthetic construct
  source 1..20: note = Seed: SATGFKQSSKALQRPVASDF
SATGFKQSSRALIRPVAADF

SEQ ID NO: 22131 - protein, 20 aa, synthetic construct
  source 1..20: note = Seed: SATGFKQSSKALQRPVASDF
SATGFKQSSRALIRPVANDF

SEQ ID NO: 22132 - protein, 20 aa, synthetic construct
  source 1..20: note = Seed: SATGFKQSSKALQRPVASDF
SATGFKQSSRALIRPVAVDF

SEQ ID NO: 22133 - protein, 20 aa, synthetic construct
  source 1..20: note = Seed: SATGFKQSSKALQRPVASDF
SATGFKQSSRALIRVVAADF

SEQ ID NO: 22134 - protein, 20 aa, synthetic construct
  source 1..20: note = Seed: SATGFKQSSKALQRPVASDF
SATGFKQSSRALIRVVANDF

SEQ ID NO: 22135 - protein, 20 aa, synthetic construct
  source 1..20: note = Seed: SATGFKQSSKALQRPVASDF
SATGFKQSSRALIRVVASDF

SEQ ID NO: 22136 - protein, 20 aa, synthetic construct
  source 1..20: note = Seed: SATGFKQSSKALQRPVASDF
SATGFKQSSRALIRVVATDF

SEQ ID NO: 22137 - protein, 20 aa, synthetic construct
  source 1..20: note = Seed: SATGFKQSSKALQRPVASDF
SATGFKQSSRALLRAVAADF

SEQ ID NO: 22138 - protein, 20 aa, synthetic construct
  source 1..20: note = Seed: SATGFKQSSKALQRPVASDF
SATGFKQSSRALLRAVAHDF

SEQ ID NO: 22139 - protein, 20 aa, synthetic construct
  source 1..20: note = Seed: SATGFKQSSKALQRPVASDF
SATGFKQSSRALLRAVANDF

SEQ ID NO: 22140 - protein, 20 aa, synthetic construct
  source 1..20: note = Seed: SATGFKQSSKALQRPVASDF
SATGFKQSSRALLRAVASDF

SEQ ID NO: 22141 - protein, 20 aa, synthetic construct
  source 1..20: note = Seed: SATGFKQSSKALQRPVASDF
SATGFKQSSRALLRVVANDF

SEQ ID NO: 22142 - protein, 20 aa, synthetic construct
  source 1..20: note = Seed: SATGFKQSSKALQRPVASDF
SATGFKQSSRALMRAVAADF

SEQ ID NO: 22143 - protein, 20 aa, synthetic construct
  source 1..20: note = Seed: SATGFKQSSKALQRPVASDF
SATGFKQSSRALMRAVAEDF

SEQ ID NO: 22144 - protein, 20 aa, synthetic construct
  source 1..20: note = Seed: SATGFKQSSKALQRPVASDF
SATGFKQSSRALMRAVAHDF

SEQ ID NO: 22145 - protein, 20 aa, synthetic construct
  source 1..20: note = Seed: SATGFKQSSKALQRPVASDF
SATGFKQSSRALMRAVAIDF

SEQ ID NO: 22146 - protein, 20 aa, synthetic construct
  source 1..20: note = Seed: SATGFKQSSKALQRPVASDF
SATGFKQSSRALMRAVAMDF

SEQ ID NO: 22147 - protein, 20 aa, synthetic construct
  source 1..20: note = Seed: SATGFKQSSKALQRPVASDF
SATGFKQSSRALMRAVANDF

SEQ ID NO: 22148 - protein, 20 aa, synthetic construct
  source 1..20: note = Seed: SATGFKQSSKALQRPVASDF
SATGFKQSSRALMRAVASDF

SEQ ID NO: 22149 - protein, 20 aa, synthetic construct
  source 1..20: note = Seed: SATGFKQSSKALQRPVASDF
SATGFKQSSRALMRAVATDF

SEQ ID NO: 22150 - protein, 20 aa, synthetic construct
  source 1..20: note = Seed: SATGFKQSSKALQRPVASDF
SATGFKQSSRALMRAVAVDF

SEQ ID NO: 22151 - protein, 20 aa, synthetic construct
  source 1..20: note = Seed: SATGFKQSSKALQRPVASDF
SATGFKQSSRALMRIVANDF

SEQ ID NO: 22152 - protein, 20 aa, synthetic construct
  source 1..20: note = Seed: SATGFKQSSKALQRPVASDF
SATGFKQSSRALMRPVANDF

SEQ ID NO: 22153 - protein, 20 aa, synthetic construct
  source 1..20: note = Seed: SATGFKQSSKALQRPVASDF
SATGFKQSSRALMRVVANDF

SEQ ID NO: 22154 - protein, 20 aa, synthetic construct
  source 1..20: note = Seed: SATGFKQSSKALQRPVASDF
SATGFKQSSRALSRAVAADF

SEQ ID NO: 22155 - protein, 20 aa, synthetic construct
  source 1..20: note = Seed: SATGFKQSSKALQRPVASDF
SATGFKQSSRALSRAVADDF

SEQ ID NO: 22156 - protein, 20 aa, synthetic construct
  source 1..20: note = Seed: SATGFKQSSKALQRPVASDF
SATGFKQSSRALSRAVAEDF

SEQ ID NO: 22157 - protein, 20 aa, synthetic construct
  source 1..20: note = Seed: SATGFKQSSKALQRPVASDF
SATGFKQSSRALSRAVAGDF

SEQ ID NO: 22158 - protein, 20 aa, synthetic construct
  source 1..20: note = Seed: SATGFKQSSKALQRPVASDF
SATGFKQSSRALSRAVAHDF

SEQ ID NO: 22159 - protein, 20 aa, synthetic construct
  source 1..20: note = Seed: SATGFKQSSKALQRPVASDF
SATGFKQSSRALSRAVAIDF

SEQ ID NO: 22160 - protein, 20 aa, synthetic construct
  source 1..20: note = Seed: SATGFKQSSKALQRPVASDF
SATGFKQSSRALSRAVALDF

SEQ ID NO: 22161 - protein, 20 aa, synthetic construct
  source 1..20: note = Seed: SATGFKQSSKALQRPVASDF
SATGFKQSSRALSRAVAMDF

SEQ ID NO: 22162 - protein, 20 aa, synthetic construct
  source 1..20: note = Seed: SATGFKQSSKALQRPVASDF
SATGFKQSSRALSRAVAQDF

SEQ ID NO: 22163 - protein, 20 aa, synthetic construct
  source 1..20: note = Seed: SATGFKQSSKALQRPVASDF
SATGFKQSSRALSRAVASDF

SEQ ID NO: 22164 - protein, 20 aa, synthetic construct
  source 1..20: note = Seed: SATGFKQSSKALQRPVASDF
SATGFKQSSRALSRAVATDF

SEQ ID NO: 22165 - protein, 20 aa, synthetic construct
  source 1..20: note = Seed: SATGFKQSSKALQRPVASDF
SATGFKQSSRALSRAVAVDF

SEQ ID NO: 22166 - protein, 20 aa, synthetic construct
  source 1..20: note = Seed: SATGFKQSSKALQRPVASDF
SATGFKQSSRALSRIVAADF

SEQ ID NO: 22167 - protein, 20 aa, synthetic construct
  source 1..20: note = Seed: SATGFKQSSKALQRPVASDF
SATGFKQSSRALSRIVAHDF

SEQ ID NO: 22168 - protein, 20 aa, synthetic construct
  source 1..20: note = Seed: SATGFKQSSKALQRPVASDF
SATGFKQSSRALSRIVAIDF

SEQ ID NO: 22169 - protein, 20 aa, synthetic construct
  source 1..20: note = Seed: SATGFKQSSKALQRPVASDF
SATGFKQSSRALSRIVALDF

SEQ ID NO: 22170 - protein, 20 aa, synthetic construct
  source 1..20: note = Seed: SATGFKQSSKALQRPVASDF
SATGFKQSSRALSRIVAMDF

SEQ ID NO: 22171 - protein, 20 aa, synthetic construct
  source 1..20: note = Seed: SATGFKQSSKALQRPVASDF
SATGFKQSSRALSRIVANDF

SEQ ID NO: 22172 - protein, 20 aa, synthetic construct
  source 1..20: note = Seed: SATGFKQSSKALQRPVASDF
SATGFKQSSRALSRIVASDF

SEQ ID NO: 22173 - protein, 20 aa, synthetic construct
  source 1..20: note = Seed: SATGFKQSSKALQRPVASDF
SATGFKQSSRALSRIVATDF

SEQ ID NO: 22174 - protein, 20 aa, synthetic construct
  source 1..20: note = Seed: SATGFKQSSKALQRPVASDF
SATGFKQSSRALSRIVAVDF

SEQ ID NO: 22175 - protein, 20 aa, synthetic construct
  source 1..20: note = Seed: SATGFKQSSKALQRPVASDF
SATGFKQSSRALSRLVAADF

SEQ ID NO: 22176 - protein, 20 aa, synthetic construct
  source 1..20: note = Seed: SATGFKQSSKALQRPVASDF
SATGFKQSSRALSRLVANDF

SEQ ID NO: 22177 - protein, 20 aa, synthetic construct
  source 1..20: note = Seed: SATGFKQSSKALQRPVASDF
SATGFKQSSRALSRLVASDF

SEQ ID NO: 22178 - protein, 20 aa, synthetic construct
  source 1..20: note = Seed: SATGFKQSSKALQRPVASDF
SATGFKQSSRALSRLVAVDF

SEQ ID NO: 22179 - protein, 20 aa, synthetic construct
  source 1..20: note = Seed: SATGFKQSSKALQRPVASDF
SATGFKQSSRALSRMVAADF

SEQ ID NO: 22180 - protein, 20 aa, synthetic construct
  source 1..20: note = Seed: SATGFKQSSKALQRPVASDF
SATGFKQSSRALSRMVANDF

SEQ ID NO: 22181 - protein, 20 aa, synthetic construct
  source 1..20: note = Seed: SATGFKQSSKALQRPVASDF
SATGFKQSSRALSRPVAADF

SEQ ID NO: 22182 - protein, 20 aa, synthetic construct
  source 1..20: note = Seed: SATGFKQSSKALQRPVASDF
SATGFKQSSRALSRPVAIDF

SEQ ID NO: 22183 - protein, 20 aa, synthetic construct
  source 1..20: note = Seed: SATGFKQSSKALQRPVASDF
SATGFKQSSRALSRPVALDF

SEQ ID NO: 22184 - protein, 20 aa, synthetic construct
  source 1..20: note = Seed: SATGFKQSSKALQRPVASDF
SATGFKQSSRALSRPVAMDF

SEQ ID NO: 22185 - protein, 20 aa, synthetic construct
  source 1..20: note = Seed: SATGFKQSSKALQRPVASDF
SATGFKQSSRALSRPVANDF

(The sequence listing continues in the following parts.)

What is claimed is:

1. A composition comprising one or more polynucleotides encoding at least two amino acid sequences, wherein the at least two amino acid sequences are selected from the group consisting of SEQ ID NOs: 1 to 8, SEQ ID NOs: 10 to 17, and SEQ ID NOs: 19 to 44.

2. The composition of claim 1, wherein the one or more polynucleotides are contained in a construct for in vivo expression of the one or more polynucleotides.

3. The composition of claim 2, wherein an administration of the one or more polynucleotides causes one or more peptides encoded by the or more polynucleotides to be displayed by an HLA class I molecule present in a subject.

4. The composition of claim 3, wherein the one or more polynucleotides are contained in a construct for in vivo expression of at least two peptides encoded by the one or more polynucleotides, wherein an administration of the one or more polynucleotides to the subject causes:

a first peptide of the at least two peptides to be displayed by a first plurality of HLA class I alleles present in the subject; and a second peptide of the at least two peptides to be displayed by a second plurality of HLA class I alleles present in the subject, wherein the first plurality of HLA class I alleles and the second plurality of HLA class I alleles differ by at least one HLA class I allele.

5. The composition of claim 3, wherein the one or more peptides is a modified or an unmodified fragment of a BCL-ABL gene fusion.

6. The composition of claim 5, wherein the BCR-ABL gene fusion is b3a2 or b2a2.

7. The composition of claim 5, wherein the two or more amino acid sequences are selected based on a prevalence of the BCR-ABL gene fusion in a risk group that the subject belongs to, and wherein the composition is configured for administration in an effective amount to the subject to promote an immune response against cancer, and wherein the cancer is associated with the BCR-ABL gene fusion.

8. The composition of claim 3, wherein the one or more polynucleotides are configured for administration in an effective amount to the subject to treat cancer.

9. A composition comprising one or more polynucleotides encoding one or more amino acid sequences selected from the group consisting of SEQ ID NOs: 46 to 112.

10. The composition of claim 9, wherein the one or more polynucleotides are contained in a construct for in vivo expression of the one or more polynucleotides.

11. The composition of claim 10, wherein an administration of the one or more polynucleotides causes one or more peptides encoded by the one or more polynucleotides to be displayed by an HLA class II molecule present in a subject.

12. The composition of claim 11, wherein the one or more amino acid sequences are derived from a modified or an unmodified fragment of a BCL-ABL gene fusion.

13. The composition of claim 12, wherein the BCR-ABL gene fusion is b3a2 or b2a2.

14. The composition of claim 12, wherein the one or more amino acid sequences are selected based on a prevalence of the BCR-ABL gene fusion in a risk group that the subject belongs to, and wherein the composition is configured for administration in an effective amount to the subject to promote an immune response against cancer, and wherein the cancer is associated with the BCR-ABL gene fusion.

15. The composition of claim 11, wherein the composition is configured for administration in an effective amount to the subject to treat cancer, wherein the cancer is associated with the BCR-ABL gene fusion.

16. The composition of claim 9, wherein the one or more polynucleotides encode at least two amino acid sequences selected from the group consisting of SEQ ID NOs: 46 to 112.

* * * * *